United States Patent 9,328,346 (POLYCOMB-ASSOCIATED NON-CODING RNAS) - sequence listing, part 71

SEQ ID NO: 13293 - RNA, 15706 nt, Homo sapiens
acaguuaaucuucccuccccaaguuugcuauucaaaucaacugccugaaugacauuucuaguagucugauguauuuuucugaggaauaguuugugauuccaaugcaggugucuucauuaccauuaccucuacacugcagaagaagcaaaacuccuuuauuagaauuacugcacauguguauggggaaaauaguucugaaaggcuagaaugauacaagugagcaaaaguuggucagcuuggcuauggagugguggcaauaaucucuaaacauuccaaaagaccaugagcugaaccuaaacucccuuggaaucugaacaaaggaauauaaaauugccauuugaaaacugaccagcuaaucuggaccucagagauagaucagccaguggcccaaagccauuucaaguacagaaauuauagagacuacagcuaaauaaauuugaacauuaaauauaauuuuaccacuuuuugucuuuauaagcauauuuguaaacucagaacugagcagaagugacuuuacuuucucaaguuugauacugaguugacuguucccuuaucccucacccuuccccuucccuuuccuaaggcaauagugcacaacuuagguuauuuuugcuuccgaauuugaaugaaaaacuuaaugccauggauuuuuuucuuuugcaagacaccuguuuaucaucuuguuuaaauguaaauguccccuuaugcuuuugaaauaaauuuccuuuuguaauuuuguuuugugucuugauguguuauaauuaugguaacuucagauucuuggauaguuauuaacauuuauugauugcuucuacugugccaauaggcugaaaauauaaagauggacaagaacugcucucugccuucaaggaguucagucuuuuuuuuuuuuuuuuuuuuuuuugagacggagucucgcccugucucccaggcuggagugcagugguacaaucucggcucacugcaagcuccgccucccagguucaugccauucuccugccucagucuccugaguagcugggacuacaggcgcccgccaccacgcccagcuaauuuuuuguauuuuuaguagagacaggauuucaccguguuagccaggauggucucaaucuccugaccacgugauccacccgccuuggccucccaaagugcugggauuauaggcgugagccaccgcccccggcccaugaggaguucaguguugauauaauuuuguaaaucaucuuuaauuuugauccuugaaaguuuuuauuugaauuuauuuuuaggagcuaaucugaaaaaaaggauuugguuuuuuuuuauuaaagcaaaacaucagauaauugccaaaucaucauuaaguaaaucauuucuaucuucagauaaugugcaaagcaaguuggaacuuaguaauuuaacugccagccuuuaugaaaauauuccugaaguagcacuaagguugguugugaguguuugaaagcugggguuuaaguggaucaggauaagauaacuaaauucccuuggugaucacaucuaggccuauagcguuuuuuuuguuuguuuguuuuguuuuugagacagaguuucgcucuuguugcccaggcuggagugcaguggugugaucuuggcucaccgcaaccucugccucccagguucaagcgauucuccugccucaaccucccgaguagcugggauuauaaguguccgccaccacgcccagcuaauuuuuuguauuuuuaguagagacggggcuucaccauguuggcgaggcuggucucgaacuccagaccucaggugauccaccagccucggccucccgaagugcugggauuacaggcauaagccaccauucccggccuuccaggccuauggcuuuaaauacuaucuauaugcuaaggaaugccaaauuucuuuccccauuauuucuugccuagaguuucguaauaaccuccuaauugaucucccugccguuacaccuaacucuacaaucugcuugaaacccagcagcaaagagacaucuacuuuucugccagaaauuguucacuggcuccccguuucagaauaguaaccaaaaacauuaccauggcuuuuaauugugaccucagcugcuauucuuccccuccccuugaucacucugcugcagccaguuagccucaugcaggccaaagacauccuccugccuuacagcccuugcguuagcuagcuacccccucuugucaguauuccuuuauuuauuuauuuauuuauuuuauuuuuuuuuuuuuuauauuuaaagaggucuuuuauuuaaaucaucuuguaucaugucugacacauuauugguuuuuuuuuuguuuuuuuuuuauacuuuaaguuuuaggguacaugugcacauugugcagguuacauauguauacaugugccaugcuggugcgcugcacccacuaacucgucaucuagccuuagguauaucucccaaugcuauccuuccccccuccccccaccccaccacaguccccagagugugguauuccccuucauguguccaggugaucucauuguucaauucccaccuaugagugagaauauacgguguuuggugauaauuuuacugagaaugaugauuuccaauuucauccaugucccuacaaaggauaugaacucaucauuuuuuauggcugcauaguauuccaugguguauaugugccacauuuucuuaauccagucuaucauuguuggacauuuggguugguuccaagucuuugcuaucgugaauaaugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauagugguuuugauuugcauuucucugaugaccagugaugaugagcauuuuuucauguguuuuuuggcugcauaaaugucuucuuuugagaagugucuguucauguccuucgcccacuuuuugaugggguuguuuguuuuuuuccuguaaauuuguuugaguucauuguagauucuggauauuagcccuuugucagaugaguagguugugaaaauuuucucccauguuguagguugccuguucacucugaugguaguuucuuuugcugugcagaagcucuuuaguuuaauuagaucccauuugucaauuucggcuuuuguugccauugcuuuugguguuuuggacaugaaguccuugcccacgccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauaugccuagccaguuuucccagcaccauuuauuaaauagggaauccuuuccccauugcuuguuuuucucagguuugucaaagaucagauaguuguagguaugcggcguuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguauccucuuuuauuuccuugagcagugguuuguaguucuccuugaagagguccuucacaacccuuguaaguuggauuccuggguauuuuauucucuuugaagcaauugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagaugaugggguuuucuagauaaacaaucaugucaucugcaaauagggacaauuugacuuccucuuuuccuaauugaauacccuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuucucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugcuagaauucggcugugaauccaucugguccuggacucuuuuugguugguaagcuauugauuauugccacaauuucagcuccuguuauuggucuauucagagauucaacuucuuccugguuuagucuugggagaguguaugugucgaggaauguauccauuucuucuagauuuucuaguuuauuugcguagagguguuuguaguauucucugaugguaguuuguauuucugugggaucaguggugauauccccuuuaucauuuuuuauugugucuauuugauucuucucucuuuuuuucuuuauuagucuugcuagcggucuaucaauuuuguugauccuuucaaaaaaccagcuccuggauucauugauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugccuuuguucucguugguuucaaagaacaucuuuauuucugccuucauuucguuauguacccaguagucauucaggagcagguuguucaguuuccauguaguugagcggcuuugagugagauucuuaauccugaguucuaguuugauugcacuguggucugagagauaguuuguuauaauuucuguucuuuuacauuugcugaggagagcuuuacuucgaacuauguggucaauuuuggaauaggugugguguggugcugaaaaaaauguauauucuguugauuugggguggagaguucuguagaugucuauuagguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauauuuaggauaguuagcuccucuuguugaauugaucccuuuaccauuauguaauggccuucuuuuucucuuuugaucuuuguugguuuaaagucuguuuuaucagagacuaggauugcaaccccugccuuuuuuaguuuuccauuugcuugguagaucuuccuccauccuuuuauuuugagcccaugugugucucugcacgugagauggguuuccugaauacagcacacugaugggucuugacucuuuauccaacuugccagucugugucuuuuaauuggagaauuuaguccauuuacauuuaaaguuaauauuguuaugugugaauuugauccugucauuaugauguuagcuggugauuuugcucguuaguugaugcaguuucuuccuagucucgauggucuuuacauuuuggcaugauuuugcagcggcugguaccgguuguuccuuuccauguuuagcgcuuccuucaggagcucuuuuagggcaggcuugguggugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuucccuuugaggguaacccgaccuuucucucugacugcccuuaacauuuuuuccuucauuucaacuuuggugaaucugacaauuaugugucuuggaguugcucuucucgaggaguaucuuuauggcguucucuguauuuccggaaucugaaccuuggccugccuugcuagauuggggaaguucuccuggauaauauccugcagaguguuuuccaacuugguuccauucuccgcaucacuuucagguacaccaaucagacauagauuuggucuuuucacauagucccauauuucuuggaggguuugcucauuucuuuuuauucuuuuuucucuaaacuucccuucucgcuucauuucauucauuucaucuuccauugcugauacccuuucuuccaguugaucgcaucgucuccugaggcuucugcauucuucauguaguucucgagccuugguuuucagcuccaucagcuccuuuaagcacuucucuguauucguuauucuaguuauacauucuucuaaauuuuuuucaaaguuuucaacuucuuugccuuugguuugaauguccucccguagcucagaguaauuugaucgucugaagccuucuucucucagcucgucaaaaucauucuccauccagcuuuuuuccguugcuggugaggaacugccuuccuuuggaggaggagaggcgcucugcguuuuagaguuuccaguuuuucuguucuguuuuuuccccaucuuugugguuuuaucuacuuuuggucuuugaugauggugauguacagauggguuuucgguguggauguccuuucuguuuguuaguuuuccuucuaacagacaggacccucagcugcaggucuguuggaauacccugcagugugaggugucagugugccccugcuggggggugccuccgaguuaggcugcucgggggucaggggucagggacccacuugaggaggcagucugcccguucucagaucuccagcugcgugcugggagaaccacugcucucuucaaagcugucagacagggacauuuaagucugcagagguuacugcugucuuuuuguuugucugugcccugcccccagagguggagccuacagaggcaggcaggccuccuugagcuguggugggcuccacccaguucugagcuucccggcugcuucguuuaccuaagcaagccugggcaauggcgggcgccccucccccagccucgcugccgccuugcaguuugaucucagacugcugugcuagcaaucagcgagacuccgugggcguaggacccuccgagccaggugugggauauagucccguggugcgccguuuuuuaagccggucugaaaagcgcaauauucgggugggagugacccgauuuuccaggugcguccgucaccccuuucuuugacucggaaagggaacucccugaccccuugcgcuucccaggugaggcaaugccucgcccugcuucggcucgcgcacggugcgugcacccacuggccugcgcccacugucuggcacucccuagugagaugaacccgguaccucagauggaaaugcagaaaucacccgucuucugcgucgcucacgcugggagcuguagaccggagcuguuccuauucggccaucuuggcuccucccccaucaguauuccuuauauccacacaucuaacuccuuuuucaaauccucgaagcuaaccuacucaauccuaucuaauacugcaaugucccuuuccaccccaccaagacuccagacccacuuacccuacuauaugcucuccaguuuuaccaacuuguauguuguuuacucuguccccuacugcuagaauauguggcuaaagugccacaaaaguaaagauuuuugcauguuguucauucauaaucccaagcauccagaacaguguuuuguacauaguaagcuuucaacucauaauaaguugaaggcacuguuuuaagccuaggggauauaguggugaacaaaacaggcaaacucauggaguuuacauucucuuaugcagauccugacaaacuuaagccuguaccagaguaguaagugcuauaaggguacugaagcauucuaauaugcuucagcuaguauagauaaaauagucagaaaaaagccucugagugacuaauuggaggugagaccuggauaaugauaccaagccagccucgugaagaccucaaggaagagcacugagaucgaggcaacaaaauguguaggacacuuagcuuuuaagaaugugccaagcuguguuagagaaugggcuaucucggaggucuuagauuccuaaccuugaccucagaaguccuaaguucauccucuacuacaauagugaacugcuuucaguaaacugaaaguuaacaccauacucuuucugacauuaggaauuuuuccucuggaaaaucaugguuccuugauucugcccauuuaucuggcugcuucaggucugaguaaauuugacccuccuugggacaccuuuccucuccaguugguuacaggacuaccuauuaugugcuuccucaguagguggguaaaaaacagcaggagagagaucauuguaaucagugugauugaaacuaaagcuuaaacuaauaugaaauuaacauaccaauaaaaaccuaagaugacuaucuugcuauccucagagcagcccucugaguuugaauccuuggucucauccaugguagcccucauacuucacacugccugaucuauuugacaaaugauuucuaaaugaaauuacuauauuagguauccucugccucccuuuuaaaaauccucuucgcucaccgugcauauugauguugaagaguuacacauguaaaacccuucuugcuauaaccaggcuccuuuccaaccuguuccccuccacccugcuuccaaccaacucaaaauuacucuuaaagacuuaauuauggccaggcgcaguggcucacccccuguagucccagcacuuugggaggccgagguggguggaucacaaggucaagagaucgagaccauccugaccaacauggugaaaccccgucucuacuaaaaauacaaaauuuagccgggcgugguggcguacacuuguagucccagcuacuagggaggcugagguagaauugcuugaaucugggaggcggagguugcagugagccgagauugugccacugcacuccagccugccaauaaagcaagacuccagcucaaaaaaaaaaaaaaagaauuauauauaguaggaugccaauaauuccuuccauuccuacucaaacaugcuguuucuccuaucaagauaaaucuguguccauccacacuugaauuugggcuaagcuuguuacuuuccuuaaccaggagaaugcagaaugaugcuuuaccacuucuggggccugacccucugaaagccuggcagcuuccuuuuauucuuucagcacccugagccacccuguaagaagucuauguaacuccuugucuaagagaggcccagcuacccccagccauuucaaccacuccaaguaaagcaccagacaugguggagccaguuuggaacauuucagccucagcugagcuccuagcugaaugcagccuuaagagugaccccagccaacaccaggaguagcagaagaaccacccagcugaguccaacaaacugaaaaauaauaaaucauguuuuaaggcuuaaaauuuaaaccucuaagacuuacauugguuuuauuacaaagcaaaagauaacagaauguaagccagaguguuacccuccucccuagggguauuuauaucuuaaauauuuucucuaaggaauaggcaguauguaaauccuuugcaauuuucagguaagguggcccaagggaggacguuaauccagaaagaucauucauucuaucaacagaaugaauucuaauucauaacuucaagaauucuaugauuuauaguaauaguaaauaaaagaccuauuugcuaaaauauguugaaagacuaaauuacaugcaguuagggacuugccuaucauucguugaacuaacaauugaaucacaauuugagauaucagcaauuuugucaacugccauccuguauuucuauaaauuucaucgaagaggaaaaguauaaugaaaaaagaaacaucagaucuuagaacaacagaauaaaagaacggugacaagugaucuggauguagaaaauuaguaggaacaauuuuauuuaaguuuuuuguuuuauucacacaaaaugggaaugcuacauuugggggagcuaaaaaacugagucaacaaacuauuuugcacagaaguuccaaggaagauaaaaauguuaguauaggaaaugcuuccugcccucaguugcuaguguagguaauuauagaauugcaagaugacaggucccuggauggccuuggccaugccagcucuucccccucuugcuugcaauuuucaggcagaauguacugagaaugcaacauccugagauaaggaggaagcuuccagaacaaccugggcugcguccucauuuuuccuaaaacaggauguucugcaacacuuguacucagcaaucucaguuacacccaggguauaaaacccaaaguguuuuuggagucccucaucugugcugcaacaugggguaugugcagaugaggcuccaucugcccuaagcagcuuuccugagccaugggaucagcuaaccauggauccuccauuucuguguaucuuugcugccuauuuguaaaaaauuugcuuugccugacuuacuguuugaguguucugccucaccagauuagaacuaagaacuauugcaagaaccacucaagaguuuggcuguucaaaguuuauaaaauaauaucacaaagcagcauaguauugucauauuacugacagaauucagagguggcaaacaaguugacagacauuuuugcaggcuaggauuucaacuguaucuuaaauagauuugagaaagcagcaugaggaaaggauuuuaggcagggaacaggagcaaaaguaugucuaaauuagucugugauacuuaaaacaguucagugaaagacuagaagaaugguacuuggcagucaagaucugugguaggcaaaauucuaagaugauacccaaugguccuugcccgcauaaaaucuccccuacguauauuaaaacaucauguuguacacuaaauauauacaauuuuguccauuucaccuuaauagaguagaaaagggggaaauuuccuaacuugacuauguggguaaaacaugaauacgauaucacuccugugaucauagguuuggaugugguuagggccgccaaaacucauguugaaauuugguacccaauguggcaguguugggagauggggccuaguggaagguuucugggucauggggguggaucugucaugaacagauuaaugcccucacggugguggggggggaggugaguucuugcucucucaggaaugaauuaguucucgaguguggguuguuaaaagaguuuggcuuucuugauuugucucucuugcugcuucucucaacaugugaucucuaugcacacccacuccccuucugcuuuccucccuaaguggaagcagcgugaggcccuuaccagaugcggcugcccaaucuuggacuuuucagccaccagaaucauaagccaauuaaaccucuuuucuuuaugaauugcccagcuuuagguauucuguuauaacaacacaaaauggacuaagauaauguuauauggcaaacgaaauuuuugcagauggcauuaaaguuacuaaucaguugaauaaaaagggauauuauucagauagaccuuaucaacucacaugagcccuuuaagucuaggcuuagagauagaggaauucaagagauuucagcaguggaaauauucugcuugccuucaaggaauaacugccauugugagagccacauggcagaaaacuguggguagccucaauguuaauggccacaaucagcagccaguaagaaaauggagcccucaguccuacauuggcaauaaauugaauucugccaaggacuugaagaaugagcuugacugaggaaccccaagccucagaugagauugcagccuugauaugagccuugugacacugagcagagaacucagucacaccacagcagaagacuuuugccccaaggaaacugucagauaauguguuaagcuaaguuuguggcaauuguuacacagcauuagaaaacuaauacaggaucccaaaagauaagaguuaucaucuacagaaaauaggugguauaauaaagcuauagaagcuauaauuccaccccuuuagagguuaacuugugaaggucaaagaaauugcugauagcaaaauaugugaugcuggggccuuucucaaauuccucacuaacauucauucauucucaggcucucagaucuagagucagguggaucugaguccaaaccugagcucuaccacuuagcaauaugaucuuggccaacuuacuuaacuagccagagcuugguaaguugugacgauuaauaggaacuaugcauguacaggacccaguacguauuaaacacucaagaaauguuagaugaugaugaugucagcuuuauacacaagaaauaggguugaccucuaugccccaaaaauaagaugcugagacaaaagggauuccaucauuugccacuucucuauuuuaaaauucugaaacacucccuauugccuaugucuaaacuccaagaaacucuuaaaacaugccacugacuucaccuuuucguuucuugagacggauucucgcucugucacuuaggcuggagugcaguggugugaucucggcucacugcaauccccgccucccguguucaagcaauucucugccucagccucccaaguagcuggaauuacaggugcccgccaccaugcccggcugauuuuuguauuuuuaguagaggcgggguuucaccaucuuggccaggccagucuugaacuccugaccucagugauccauccaccucggccucccaaagugcugggauuacaggcgugagccaccgcgcccggccaacuucaccuuuucacuuauuauucugccugaaccagcaccugagcuccaaaccuuuuuuucaccugguugguugcucucuccuguacauaugcauucauacacccccauuauccuguauuuuaauuguuaaccugccaauaauaucucacuauauugcacacugcccaaugguuacauuuccauacccagagacuaucagaguaccaggcaaaaagcaaauaagccauauauuuuuaaugaaaugaauguucagucuucaggccuuuaagaaaagcuguuccuggaaugaagaaaaaaaaaacaccaaugcugugguuguuucuacauuucuauagcgugguguuuaaacacuuagcaacugcucuccugcauacacuuguguagagaagugguuaaacaauauucucauccuucuuuucccaaggagaaaaccaaaagcauaccaaccuuaaauaacacacacagagggcaaucuugaaagaccuaaaaugacauaucuagcaagaagcuggcagccaagcuugacgccugccugccugccuguugguucacuagaagaaagugguucucaaacuuuaauauguauaccagucaccugaggcuauuguuaaaauguagucugauucagcagguugcgggggagagggagaagagccgagaaugugcaggucuaaaaagcucccaggugaugccaauguuucuggucuccagaccuagaccucuagcuuagaccugugcugaccaguacguuagccacaugcggguauuaagccccugaaauaugacuagauaagcugucaguguaacaugccgauuuccaagacuuaguuaaaaaaaaaaaaacuaaacuaucucaaugauuuguacagaccacauugaauuaauauuuuguguacuuugaguuaaauaaaauguacuaguaggguuacuucccucuauauuuuacauuccacacguggcucgcauuauagugcuacuggacagcggugcccuaaacuaacaaccgucuccauucugaagcuuccacuauugugagacuuuaagaauaaaagcaacaccucucuucccauaggugguucgaaagcacaccuuuuguuccccaacuaucuaccagaaauaaaacgaaaaaacaaagauuuaaaaaacaauaaaauugaguccuuucacuucugcuuaagcgccaccuaagccacugcuuuugucucccuccgguucccacgcuccgagaucguaucacccacagaaaaacaauaacuaaaaagcggucuccaucccugaagccaagcugggagaguagccgaaggucgcgcuuccuggccgccaaaaccgagguggaggaaacuugguagucagcgagcuacgcccucucggcuccuccuccugcuccuccuccagggccgaccucuucaagauggcgggcgccggagacuagcuuccgcuuccggugugagcggcccggccgggggggcaagauggcggcggcaguagggguucguggccgguacgagcugccgccuugcuccggcccaggcuggcuccucagccuuuccgccuugcugaguguggcggcacgaggggccuucgccaccacgcacugggucgucacggaggacgggaaaauccagcagcagguagcggccggggcgucccucuucucccgugcccgcccucgccccggggggauuacccugcuuggccccuggcuguugggcuccgcgcggccccgcccccagccuacccucacagggagguggcaccgcgaccucggacucccugcauucggaccaggcaggcacuucccgcuccccacuugucuccugguccucguuuggcccccuagaaguucucacccuuccaccucgcgggccgcgcgccgcguggggaagagucgcccagcugcgggagacgggcccuacggaccuuuuuuuagcucgggguuuagaaaucacagauuucaggauuccugccuuuggugccucucggguucacgcgucaccggcccuccccgaggaaaua

SEQ ID NO: 13294 - RNA, 42671 nt, Homo sapiens
aaggccgcucccgacgugcgcgucuuuacguagacgucgggggcgcagccgcgcugugcgcggugacuggcggcugcacuggcggcagcuggagguguaauagugcggguaguggguuuggagaaguuccgaggcggcgguggcgccggucaggacaaggauagcggaaccgggcccugggcuugucgcucaccaugccgacaguagaggagcuuuaccgcaauuauggcauccuggccgaugccacggagcaagugggccaggugaguugaguccccgggcggccugcagggccuggcgcuccgcggccuuucgaaagcgcuucccgccgcacuccccgggccgagcgggggcugcggcuucauccucccggggccuccuagccuccucaggccgucucgucggggugggccucucugggaguguagacucugguuucaccagggagaccgcgguccccaggguuccaggcuuccuugccucccuugcccagccuuuucucaccguggcguaaccuaacucagcccguucaggcucacguuaauucuucucacggagcuuuucucuacaggauucucuuaagccuuucuccuuuucgguggagcucagugcuuccaagauuagaucgggaguuuucuucaugaggucaagauguguuuuuuuugggggggaggcaaaauucugcuacuaauugaagaagaguguuuaggagacagaaguuugugagaaacagaagagggacucuuugguccagacuuugaugagagcucacgguuucauuuauucagugcauuuuuuugagugccgagcgcuggagauacagauggaaagguccgcgcucucccagaauguacaguuaggagggaguguaguaagaaagauaggcauugugaggcccggcuugguggcucacgccuguaauccgagcacuuugggaggccgaggcgggcggaucacgaggucaggaguucgagaccagccugacccacauggugaaacccugucucuacuaaaaauacaaaaauuagccgggcguggugacacgcgcuuguaauccuagcuacucaggaggcugaggugggaggauugcuugaacccgggaggcagagguugcggugagccgagaucgcuucacugcacuccagccugggagacaaagcaagaccccgucucaaaaaaaaaaaaaaagguuuuuuuuaaaaauuuauucuuuuuaaugaaacauguuugaagaaaauaaaacagggcugggcgaaggagagugugagugcgcagcucugaauggaguugucuggaagagcucucuuaacgaugcuugcccccgauacacaguuucucagcaguguugaauuauccauacaagucauuuguucccuguaugaguuuucaaguacuggaguacauugaacuugauaagugguuggguauguguguucuugggaaaagaaccaggcucuccuggagguaaccuugaucauuguuuuagaaaucccacaccauagcuuuucagcgcuuagaacuuugugauuuuucugcuuacgcaucccuucuuggagaaaguggaagauucuagucuauuaacagucgugggaguaccuuucccguccccuuuucuuaacauaauucaaauaggacuuuucugagcugaacgaaaaaaaaaaaauuucauguuggagauuuauuguagcuuaaucuagaauuaagaauauaccaguuugaaauagcaaaugauuuuuuuuccuucauucccugucaguagggaauuucacuuuuaucaguaagaaauguauacggauguucugcuguacauguggauagaguguguaggucgguugugaaggaggaauauucuguucauuaagaagguaaaaacugccaggcacgguggcucacgccuguaaucccaauucuuuaaggggcguggaugggcagaucaguugagaucaggaguucgagaccagccuggccaacauggugaacccccaucucuacuaaaaauacaaaaauuagccaggcgugguggcaugcgccugaagucccagcuauuugggaggcugaggcaggacaauugcuugaacccggaggguggagguuccugugagcugauaucgggccacugcacuccagccugggcaacagagcaagacuccaucucaaacaaaaaauuaaaaaaaaaaaaagauacaaacuauguguggucaaucaguuugaauuuguuguuccuaaaaagaacuaguagugaagauauucucaaucguauaauuuaucugugacuuaguuggguaacuuuguagcaaauuguucuaccuacguuagacuuuguugcauaucaguagggggauagggugaaagcuacaacagugguugugucaggaauccuucuaagaaaccuuugaaaccguauacauaaugcuguccauccccuacucuaauuuugagaguugcuugcauuuccuucucaugucaucuuuauaaaaaccagauugaauugagaguucuccccaaggggucaaaaugucuuucacagcaaaaaucuacucuuuauuuaguaaggguacuuuagagacaaguuugugaaaaaugaaaaaggauaccuuugucuacacuuuaaugaggacuccaugcuuuauuccguacauuucaccuaccauguaccacacacccggcuggacacugaaauuuaacacaauucucuguagguuaugggugaucaaugcguucuguauugacaacugucaagcaacuauuuaaacaguaucucugcauaaugagauguagugguuagcucaggcagcucaaauauugugaauuguaggaaaaccgaagauaaugccuacuaauucugcucuguuggguuauacuucuccccuuuuagauaaaaugccuaaaaucacuuacuaaaaaagacaguagguuuuaggauauugcuuguaauuuuaacuaacaaaggcaaaagccaccuuaguagagaggacaccauuucacuuguuuuuaaggagagaaaaccguguucauguucuugauguagcaaagccugauuuucaugucaacuuaugagagauuuaugaucaguacuaaguuuccuggcaaauaccugucuggauacuucugagacugcauucaaguuugucagucuugacuuccuucuaacuuuuacuuugauuaucaaccuuuaccagagaggugagcacuacagguguucugauugcugccacuacagacuauucccuccccauuauugucaauacuccuuucagaguagugccuucuaaauauauaaggguaaacuuacaagccgucugagguuuuaucggcuaauuuccccaaagcagaucaaauccucuuuuugaaccccuugguacgauguacuuacuaauaaugcuucagacuuguauuuuauuuuauuuauuucuguacuuaaauuauaacgucucaaggguuaaauccuuuuauguauuuauuuauuuauuuauuuauugcuucucuucuugcacuguaccuugcccuucaguaagcauuucuuuuucauaguugaagaaauguauuggaagaaggaacagagaaaccauuuacaaaagaaaagaaaaaccauuuacacagauuaucucuaauggauaaagggaacuuuaucauacacacacacauacauacauauaugagcauguauauucuaauaagcaaacugcagaugacaaauucuaagugcagaauuauuuaauaccucaaaucuuccaguccuaucaucuucucauguaacugccauguucugccuaugcguucauccugccuuucccccacucugccucugcuacuccuucaggucucacucuucucuugugugcuccuuuaccuuucugaucuccuuuuccacuguacucugcccagggcuccugacuagccauaauagagcaagcuguggcccaccauuauuuaaaauucuguuucaaauuauuaugaauuuacuuacuuuaaauauagauacuuaauuuuauauuauguagucaaaaucuuaaaaguuaaaaaauguauccgacaccuguuaaaggaccauggcaguggggcugauuagaucuguauaaugcugaaacccugauuccuccuguucucucaaucauugaguauacuagcuuugcaggguuggcguguaggcuucuuggacuuuuauuucaugaaauaaccacucuuguaguaggguuuuuuguaugauuaagcuaaaaccacugaccaaccaaguucguaaucccucaaaaauauguggaaauauuuauuucacuucucugagcccuaguuuccucaucuaaaagauaagaauaguaguaacaccuauugugauauagacaaggaaucacucagucccugguagaccuucaauaaauauuguuaaugauuccuuuuuauuugauuccagauuuaauauuuuuuucuuggcaaaaggaaguuuuguuuuaagcaggguuuuuuuuuuuucauuuaauuuuggacaguguaaggaguuucuucaaauggcuuuaugaguaaguuugaguuaaagaaaauuagauuugugauacccugcaaaaaguaagggugucagaacaaacuuugauuuuaugaagccugccuagaagucugaggcaaaccacaggaauguaaagugguagagaagucagcaugauuucuuuuuuuaauguuugcggugaaaaguaugucauauaccuuucuuucuuugagacagggucuugcucugucaggcuggagugcaguggcgcgaccacagcuuaccacagccucuaacuccugggcgcgaccauggcuuaccacagccuuuaucgccugggcucaagugauucuccucccucagccucuccaguagcugggacugcaagcacacaccaccaugccugguuaauuuuauauuuuuuggagagacagggucuugauguguuuauaauacacuuuucagugaugacuccugaagacucauauaucugcauuucaugaagaaguuaaccuuauucacagaaauuucuguuauuugggaguuguucuguaacuuugcauccugcuuuauuuuuucacuuaacauagcauuaucaacaaaaaagaaucacuguaaaauaaauuugguaauucuguaguucauuggauauuuauuggucauuccccgcuugauggcaugaaguaagcucaugugucuaaagcacuuagaacacuccuuauacauaauaaauacuauacuguguauauguuuggucaagauuauaauuuuuaaguuguuuuuccaguuacuaaguuuuauucauauguccaaacaauauauauguguagucuuucuguauuuguuacuguuauuuaccaucuuuaucagugucauuucauaaaaggacugguuuggaggcaaguacuuaaggaggauugggaacuuauugauuccucccauuaugaguauuugagggagagcaccugugauuuuuuuuuuuaaggaaacaugagcuuugaguguauuguuccaauaaaagguuuaaacaugugacauuagaguccgucuuaauccaaaauugucuggcuauauggagugaauugucauggcuuucauauacugcuaugagguaaaauuaaacugcacuuccuaacauugcuggaauugcuaaauuucuggaauguauucccuucaccuucuucaaggugcuaauuagaaacagguaaauuuuuguuuaaguaaauacagugcaauucuuugugaauucuaugguauucaugaugauuuauuuauuuacuuguuuaagauagagucucauucugucacccaaucuggaaugcaguggugcgaucucagcucagugcaaccucugccuccuggguucaagcgauucuccugccucagccuccugaggagcugggauuacaaaugucugccaccacacccaguuaauuuuuguauuuuuagagagagggaguuucaccauguugggcaggcuggucuggaacuccugagcucaagugauugcccaccucggccucccaaaguguugagauuacaggcaugagccaccacaccuggccaucauuacaauuguuuuguuuguuuguuuguuuuguuuuguuuuguuuuuuggagacagagucucacucugucauccaggcuggagugcaguaguacgaucucagcucacugcaaccuccgcuucccggacucaagcaauucuccugccucagccucccgaguagccgggauuacaggcgcacaccaccacgccuggcuaauuuuuguguuuuaguagagacgggguuuaaccauguuggccaagcuagucuugaacuccugaccucaggugauccacccaccuuggccucccaaggugcugggauuacaggcgugagccaccacgccuggcccauuacaaauuuuuuaagcaugauacagucacauggccagaguuaauaaucacuagaaugaagaaguauuggcauauuaacaaacacauuugcuuuuuccacuuaaaauuagacucauccaucucccccaacucaaaaaugaaacaaagauggagggagaacggaauugggaagguaagugucaguuugagcaguaaaccucccaaaaucagcuuuauuucuuagccuguguaaaaauuuaaagcacacucuaacauguuuguuauggucuuuuacuuugcuucccauccuucaaaaucaugugucuuuccugcuuuauuuuuuauuucagcauaaagaugccuaucaagugauauuggauggugugaaaggugguacuaaggaaaagcgauuagcagcucaauuuauuccgaaauucuuuaagcauuuuccagaauuggcugauucugcuaucaaugcacaguuagaccucugugaggaugaagauguaucuguaaguuuaugaaugacacuucauagcaaucuuucagauguuucuguauguggcugauacaauuggaguagcaaucugauauaucagaguacacaauaaaauacuaugguauggucuggcauggcaucacacccaggcuuaaauuuacauaugauaaaguguauuagccuuuuucaacaccuuuaaauuaugaaaaaugcauagaaucucaaaauacuuaguuucgcuuaucauuuauccacuguuaaaaauggguuguggcucacaucuuguuucauagauuguuauucauugugcauaugaaauuagacuguuuuuaaucaauuugugcuuacuuggauauuuaaauuauuaaguguuauaucauaaaauguaguuucacuacccuuauauauuuugcauggcagaaaaaugguauguguaauaagugaauaggauuacuagauuaaaaagaaauaguuuuuguuuuuugguuuuugggggguuuuuuggaacagaauuaaccaguaauauuucuggcugcugacacagguuccuaagaauauucagccguuagcucuugucuuuucagaugaaacagcgaauugccaacauuucaugcagaauuugcuggauauaaacccuauacuuuuuuugcuuuuuuaauagaaacaggguuucacucuguugccuagaccagagugcaguugcacauccauagcucacugcagccuugaacuccuggguucaugcauuuuuuuccacuuuagccucccaagcagcacagaccaccguucccagcugauuuuuaauuuuuuuguagggucuugccauguuguccaggcuggucucaaacuccuggccucaagcuauccucccaccuuggccuucugaagcauugggauuacaggcgugagccaccucaucuggcccgcuguacauauuuuauguaaaaaucgaauaagccaagaucaguauuuggaauuaaacaugcagaauauagccacaaauguuguauuuaguagucaauacugaaaauucuaaaguaaacaguuacuagguauaacauugccacaguagccauuuuuuaggaauacuauauuauaagcccauagguaguaaaaaccuaacaguugcauauaauuagcauguaaauaguuguuuauaaucucaaaucugucuccuucagcgagacauuguuaacaucccuuuuuauauuuuauucuguguaacuugaagauuaaauuggagcaaauucucucuuuuuuuuuuuuuuuuuuuuugagaaggagccuuacucuauuggccaggcuggagugcgguggugcaaucuuggcucacugcaaccuccgccucccugguucaagcgauucuucugucuuagccucccaaguagcugggacuauaggcgugugccaccacgccuggcuaauuuuuguauuuuuaguacggacaggguuucaccauauuggcaaggcuggucucaaacuccugaccucgugauccaccugcuucagccucccaaagugcugggauuacaggugugagccaccacgcccggccaauuggagcaaauucuuuuuaaaacugcuagaaaucugcuguuucauauuuuugugacucguaugccccuaaugauggcuucucugugguuuuaguuuucuuaaaaaguugaguuugcagcugggcauggugacucaugccuguaaucccaacacuuugggaggcugaggugggaagaucacuugagcccaguaguucgagaacagccugggcaacauagggaaauccgccuuuaaaauuagccaggcguggaggcuugcgucuauaguccuagcuacuagggaggcuaaggcaagaggcucucuugagccuagaaggucaaggcuacauugagccaugguugcaccacugcacuccaaccugggcaacagagcaauaccuugucuuuaaaaaaaaaaaaaagaaagaaaagaaaaagcuguuuguuauuuuaaaggugauaguauuugguuaauuuuuguuugaaaucaugcccagauucgacgucaagcaauuaaagaacugccucaauuugccacuggagaaaaucuuccucgaguggcagauauacuaacgcaacuuuugcagacagguaagggauuuuauuauuaccuuuuucucuaaauauauaucuucuuucugaaauguugacucuguuuuuagguuuuaaauggggugcaggagagcuggagguccuaccucugauagagauuaaauuuccuacuuucauucaguaguuaaaguguaaugauuucugguuaucuaauuccugguguuguuuuguuuuuaauuccguuaugaagguguaaugacuagauucuuuugggcauuuugauauaucauaauuuuucccccaauuuccuguaguuucauaauuguagcaucuuaauaaaaguuuuucaggcaugccagaucggguucucaacuuacaaggaacacguaucuuuuugguacuugagggaauggcuuaaguuauaaguuuccugucaauguaaccuugagaaacuaaguugaaucaaguuugaaacugaagcagaugauauuuuaaauuuguuuuauauucauuaugccacuuuuucuuuauccagaugacucugcagaauuuaaccuagugaacaaugcccuauuaaguauauuuaaaauggaugcaaaagguaaggccaguucuuauucugaauuguguuugaugucuuacagaaucacaaaguuagguguuacucauuaagaauaaacucuaggguuuacccagaguucuauuucauaaaaauucuaaguauugugaaaaaagucuccuuaggucaagauguuuaugacuagaaaaacgagcagaaauaacugcaaaaacagaucacguuuuuccauuagaaaucuguuggaagaacuccuuuugacacuuucaagaaauucuuccaaaauaccuggguuuuauuauuaguaaugauaaaaaaggaaagucaugcuuaagcugacuaugucuucaugaagaaagcacucuuaugguucaggcuguagaaauuucagacuacuuuuaacuaguaaugaggaugauauuugggaaguucauuaacuuauuugagaagaaauacuauaaauugaguuaaaugggaaaacaccauuacacuauagaauugacuugcuacaggcaacuauuuuguuuugcagggacuuuagguggguuguucagccaaauacuucaaggagaggacauuguuagagaacgagcaauuaaauuccuuucuacaaaacuuaagacuuuaccagaugaagucuuaacaaaggaaguggaagagcuuauacuaacugaauccaaaaaggugagcuuuggucuucauuugguggaaauucucuaaagcaaaagagcauacuugacauuggcaguauucgucaauguuauguguggcuuguguauaaaaugauauaucauauaucccauuggaaccaccauagaacuucuaaguuuuucuuagauugaauuuagcacuuuugucggugguaaugaugaaucaauuugguaauuuaaaggaaucugauuacauuuaaacuuuucgugguaguguccuuaaaauuugugcaaccucugcaaaucaccuccuucaggaaacuuucccuaaguccuaccccucccuuccauuuuaggauacucucucauaguauucuaaauuauuucaaaaugaaacaucacaucaaaaugaccuguugucaccuuagcccuugacacuaucugcucuucaagggugagaccaugcuugucuuugcucccagcaucuagcauaguuguagacgcuaagauuggcaaggugcgucacaauuaacuuuucacucaucuuaaugugccaaaguuugggaauaguuuacuuuuuuaauauguuacagaagauucagcauuuuaucuaaagcaugugaucacuguuaugguucaggcuuuagaaauuucagacuacuacuacccacuuccuuauugauaagauuauuuuucagugagaaaaaaguagaucuuuagcugggaguaucagacuauuuuaccuaugccccagcuuguaaucugguagaguaugucgugauugugagcuuuuuugguccaugaauagaaagauuuagacccacugauauggaagauuuaacaugagacuugcaaggugaccuauuuuguauacaacaauuaccauauuaauaugaauuaggcugcuuuuaaauauaggauacaaucugauucaacaguuugcuacagaauuuuuccaaccauuuuuuaaagucacuccccuaaauagccaauuuuuuuaauuuuuuuuuuuucuuaacugcucucccaugaaauuuuaaugccacauauacacuguauaucuguuuaugguacuacauguauaucugugcuuuguacguaaaaaaguaacauuuucuaagaaccaauuuuugcccccuuggagaaugcgugguuuacacugaagcucaauugacugaagcuagaaguugccuuuucgucaguauuuuggaagcauuaauaacaaacugacuuuaguaacugaaauaaauuagcuauucucuuucaguguugaucugucccauucaaaugaugaacauacucuuauucugaauugucucuuuuccagguccuagaagaugugacuggugaagaauuuguucuauuuaugaagauacugucuggguuaaaaagcuuacagacagugaguggaagacagcaacuuguagaguugguggcugaacaggccgaccuagaacagaccuucaaucccucggauccugacuguguggacaggcucuuacagugcacucggcaggcaguaccccucuucucugugagcucuuuauuuuuacacacccgguauuagcuauauauauauuuccauaaauacucacuuuaacauuccccuuaaaccuuuccaguagugucccuuaucugaaaugcuugcuuggaaccagaaguguauucagauuuuugaauauuugcauugugccugguugagcaucccuaauucaaaaauccaaaaccugaaaugcuuuaaugagcauuuccuuugagcgugauguuugagcaucacauuggugcucaaaaaguuuuggauuuugaagcauuucagauuugggauuuucagaugagggaugcuuggucuguguuuaugaaggccacagugguguuggugagaacccaaagcagcaagaaacuuucuugaaagaaagaauuuuuuuuuuccuuugagacagagucuugcccugucacucaugcuggagugcaguggcacgaucuuggcuuacugcagcuucuaccucccaggcucaagccuuccuuccaucucagccucccaaguagcugcuacuacagucaugcacuaucacacucggcuaauuuuuguguuuuuuguagagacggggcuuccccauguugcccauacuagucuugaacuccugagcugaagcagucugcccaccuuggccucccaaagugcugggauuacaggugugagccaccaugaguggccaauaaauuuuuuuuaagucuuccuagagacuuuuuuugaaagucaugagaauuuugcauucugucucaggcuuuguguuuccugaggccaugcaucuucugggaugugcauacauucauuugaaaaacacaauuuaaaggaacuauccuagagcaggcgugguggcccgucccuguaaucccaaucccagcacuuugugagccaaggugggaguaucacuugaggcugaguucaagaccagccugggcaacagagcaagaccuugucucuacaaaaaaaauuaaguaauagaauuaucccuuuugagaaaugugcagucugaaaauccaacacuaaaagauguccacaauucauuuauuuauuuauuuauuuauuuaugagacagagucucgcuccaucccccaggcuggagugcaguggcaugaucuuggcugacugcaaccuccaccucccagauucaagcaauucucgugccucaacuucccgaguagcugggauuacaggcaagcaccaccacacccagcugauuuuuuguauuuuuaguagggaugggguuuugccauguugcccaggcugcucucgcacuccugaguucaggcaauccaccugccucagccucccaaagugcuaggauuacaggcaugagccaccaugccuggccaugccccaaauuugaccagagaaucaaggaagagaucaaaauguauagauguuccaaugcuccagaugacuuugcaguaaaguauauaaggggucuucaaaaaguuccuggaaaaugcauauuaugaaagaaaaaaaaaaaacuacgcauggauuacaaaacauuuuucaccaaaauaaacuuguacuuauaacaugucugaacaggauauaguuugaggaacuaagaagggucagacaucaguuugaaaagagcaccuaucagagcaacaugaauucugcuaaaguugaagcaagaacaaauaucgaauuuauggugaagcuugguggaagaauagugaaaucauugaugcuuuaugaaaaguuuauggagacaauguccccaaagaaaucaacaguuuacaaauggaucacucauuuuaagaagggacaagacaacgucaaagcccauugcagcagaucaauuugcgaggaaaaauuuaaucuuguuuaugcccuaaaugaagaagaccgaugauuaauagcagaaacaauagccaacaucaucgauaucucaguugguucagcuuauucaauuccgacugaaaaauugaaguuuaacaaacuuccuacugaugagugucaaaaccauugcacucagauuagcugcagacaagaacagagcuuucaguggaaauuguaaacaagugggaucaagauccugaagcaugucuuugaagaaugggaacaggaggugaaacauggcuuuagcagugcaauucugaagacaaaacacagucaaagcaauggcugccaggaagugaaaagggcccaguccaagcaaaaagagaccaguuaagaggaagggcuauggcaguuuuuugggaugcucaagacauuuugcugguugacauucuggagggcuaaagaauaaugucugcuuauuaugagcuuguuuugagaaaguuggccaaagauugagcaggaaaacgccuaggaaagcaucaccagaguucuccaccgccacagugcuccugcucauuccucucaucaaacagggacaauuuuuuaagaguuuugaugaggaaucauuaggcauccaccuuaaaguccuuauuugggcccuucugauuucuuuuuguugccuaaucuuaaaaaacaucuuuaaagggcacccacauuucuuugguuaauaguauaaaaaagacugcauugacaugguuaaguucccaggacccucaguuguucagagaugacugguaucauuaccugcaaaagugucuugaccuugauggagcuuauguugauaaauaaaguuuauauuuuuuauucuuuaucuuuuuauuccauuuuuccaugaacuuauugaagccccuucguagaucaccuauugagguuauaucuggggcaugcuggggugugcacuauaucguauuuguagucagaauacuugaugcuguagcgcucagcauuuauugaaugaaauucugcuauaauauuugagcgaauauuuguuuuucgacaaugcauuuucuuuggauuucuuacagaaaaauguccauuccacaagguuugugacauauuucugugagcagguucucccuaaccucgguaccuugacuaccccaguggaaggucuugauauacaguuggagguaagcaaaaauuucagcuuuagcacugauaaggcauucuuauauuuuaacaaaaauguaaaccacuaacuuagauccgauuucuaagggagcaguuuaaaugucugguaauggccagccaguaaucucccuagaccagaauuaauugcauuaggacugcuucauggauucaauuaaaguuugcugcaaugggaaagccuuaccuguaguuuuauuauagucagucucuacuuuuguagccuuaauauuuuuaaauaagguguuuaauucauucauuucuauccauaacugacagagccaauuuuaaacuggauuaacacaaaauauccuuuauuccuucuucaauagaauucacuaccccucccaacuuuguaucucaacuguaauguauguaaacauuuuuucacagcaucuguaauacuuuacauuuguuuauaaucucucccuacauuuaaucugauucaccucuguauccccagaaucuggcacaaaacuugauuuugaaucaagcacccaauagugauuauugaauuggacugaaauauggaaaugcgugugccauuucccucaugggucuuugggauagagaagaaucucacugugcacugacaagguaguuugcuucaaaugugcugggcuaggcccaucagacugggauugggaaaugcaggaaugaaccuugagaauaguggucauuaccaauauuuugaguaaguauccagagacuaaauuuaacaggaaaugaggcccaccuuaaccaugaguaauuaguucuuagcuguugagaguucuuacuaagugugucuuuauaguuaauauauuuaucauuuuugccuugcaauuagcacaaucauuaaccuguagcagaaagugucguauguauuauuuuccauacuucuucucacagauauauuggaaaucaugggaucuggguuuuagggucugcccugccacuuacacccugugacuuugucgagucacauaaucucugaccuuuacuuuccuucacaguaaaauguugggcugcaucuaucucuaagguuuucuuccauuucaaauguuaugauucugugaaaacauaauugaaaauaaagucuuaaaucguuaucuagaauuacucucauuucauaacccuugcuuauucaaaaaaacaguaauagugaauuguguguuuuagguauugaaauuguuggcggagaugaguucauuuuguggugacauggaaaaacuagaaacaaauuuaaggaaacuauuugauaaguuauugguaagaacuuuuuccuuuccuuaugggauagucaguauauagcucaaagucuaauuuauuauuaauuucuagauuacaagaaccaguuuuugaaauuucaauuaaacaauaauccuaauaaguauuguuagcuuccuaggccacauguuguugucuacuuuguuuuaaucuugguguuucuuauaauuagggagaaaauaggccaucugauaaaaucauuaucagcaucacugagugauuuucuuauuugauguauuuguauaacuaacacagugauaagcauuagguccuuagcaugaauugagucaucaacaucuggcacucguccagauguaacuuacuggguuguuauagcacugauacugaaugccauuggcaguacuucacuuguaaugagucaguacuuaaacaauauggacuuacguucagaaaauauuuuuguaguaagcauaguauaguuguuaagagcaucagcauuugaugucaaaucuagauugaauucugacucuuuaguuuauuaacuuuguuaccaugggaagguuacccuaacucucagagcaucagugccuuuaucuguaagugccuaauaaaugauagcuacauuaaucuucauuauuaauaauagcagcuguaacagcagcuguaacagguuaauauggagcguugacaggcuagagcauugauccaguaaguaaaaaagaaauccaaaugucugguuuugguaguuuuuaaugcuccaugccuuaaaaacaugcacuguaauucccugaauaucuguuuauaauuugaauauguagaacagauugcaaaaucuguauauuuuucucucuuaggaauacaugccccucccuccagaagaggcagaaaauggagagaaugcugguaaugaagaacccaagcuacaguucaguuauguggaauguuuguuguacaguuuucaccaguugggccgaaaacuuccagauuucuuaacagccaaacugaaugcagaaaagcucaaagauuucaaaaucaggugauauaugauugagguggcucaauccuuggcaaaggugguagcuauccugaaguuccuuggguuuugcuuuuguucuaugagagcuccccauccugccuuaccccagugauacagauuggaggguucagaaaaugggcauguuuguaaacauaugacagaaaugagccaggcaugguggcucacgucuguaaucccagcacuuugggaggccaaggcaggaggguugcuugacaccaggaguuugagaccagcugggcaacauaguaagauccugucucuauaaaaaauaacuuuaaaaaaauuagcggagugugguaacacaccaguagucccagcuacuugcaacacugagaugggaggcucacuugagcccaggagcucgagguuacggucagcugcagucaugccuccgcacuccugucugggcgaugagaucaugucucugaaaaaagaaacaguaaaaguaaaauuuaaaaaaaauuaaaagacagaaaugacuuaacaaauccaugggggguaaaggacucuagcucuuccuacuuguuuuaugaucuugggcagguacccuaaccucucuuggcucccccaaauuuuucucaguuguuaagugauaauaguaccuaccucauagaguuguaagaauuuaauaagacaaugaauguacagcuuuuagcauggugccuggcaaauaguagguauuaguaaacuguagcuguuguuauuaauaauaccuuaguguuacuggagaagcagcacuggagaagucaauguaaauaguuuucacaaagacacugcuuauugaauuguuccauuaacaaauucacauuuuaaauuuugaaaugcuugagccauguguuaccuguuacuguccuguacugugugguaaggcagaaguuugauacuugaugaagcucuuaaucagaaacaagcaacuuaaaauucucuucuuuaauuuacuggucauguaaccauuucugcacuuaggaucauuuugcuguaguauaagauugaguuuaaaaacaaaauugaagugaugaauugcuaauuaacaaauacauuuucauuuaggcugcaguacuuugcacggggccugcaaguuuauaucagacaacuucgcuuagcucuccaggguaaaacgggugaggccuuaaaaacagaagagguaagaauacuggcucacauuucauaaacugcuaguuccauaccaaacuauauagacuuguguugggaguuuuucauuuucccuuaucucaccuaauuuaacagucuucaucccaguccuaaugaaauauuuuagauuuuuauuauguuccuauaacuuaaacugauuuauuuuaaaacaacuucuaugugcaugugaccuuacucauuuuuuagcuacauucuaaccugucaagggaacacagauuauuugcuuucuuugcuacaucuagauuuguuuagagucaagcaauaggaauacgcauuaucuauagauuuaaaccaaggaauucuguaaagacuguagaggugauucugauagaaguguaauuacucuaguucuaugacagaauggauuaugccucauagaaguuauuggcaauuugucuuaauuuuccuuucccuuuguagaacaagauuaaagucguugcauugaaaauaacaaacaauaucaauguuuuaaucaagguaagucuguaauaccaagugacauuucugcaguuaccauaaaaucauacauuuauuuauuuaaaaguuuugcauaagauacuuccaacaaagggaggcaugcaaacuucuucuggcucaaagcauugaaacagauagauacagucucagaaauuucagcgacuuaaguucuaguggucuuaauuagcuguuggguucuuuugaauguccaguaaaucccuguucugcuuacucuuaagaauggacaugugguauguagcacaaugaaauguuuuucuguguuuguuuuuuauaaacuugacuauguaauaaauugagagcuuucuguacuguaggcuaggguauaccuuuccauuaagccauaauuacuuuucaauucuguuuacccuucccaaguaucugcuagccuaaacaaaaauaauaaccugagagaaccagaaaaaaaucacaaaguagccaucacuuguauuauauuauacaauacaguuacagcuuaauuguauugugccagaugggaaaaagaaacaguauuuguaacaccuagagcaguagccugccaguaacaaaaauugggacuaguaugccuuaaagcuaauguaaaaaugauacagaauaauuauaguugacccuugaacaaugaagggcuuagggauacggaccccauguauaccuuuugacucccccaaaacaaccacuggcugguacaaugguaguggguuaucagaacuuauuaacauuagcaucaccaaaauugguauacaaccccccugccaaugcuaaauuuggcuuuauaaaaaaucauuuuaaaaaacugcuaauagccugcuguggacaagaagccuuaccaauaacauaaacaguuaauuaacacauuuuuuauauguauuauguacuguauuacaauaaagcugcaggaaaaaaauguuuuauuauaaagaagagaaaauauuaaguggaaguggauuaucacaaaggucuucauccuuguugucuucacauuuaguagguggagaaagaggagggguuggucuugucucagggguagcaggcaaaagagguggaaggagaggcaggcacacuagguguaacuuuuauuggaaagaaucugcguauaagugagaccauguaguccaaauucaaguuguacaagggucagcugcaguuuguaucagaagagagagggaagcauuugagaaaaagcagcagugauuagauguugaggaaggaguaucauagugccaaguagaaaacugaaaaggcauuaaacacagaagagguaagaauauuauacuaaucuccuaaggaaauguuuccaauagcugccauuuauuacaaaucuuaaauacaaauaauuauuuugcauaguaaauucauauauaaaaaugugagauuugacuuuauuugaaccgcugauacaagucuauguugaauauacaauguguuaagaacauuuuaaacuuagcaaaugcuuauuaccugcaugcagaugagaaaauguucuuuucaagaaucuguaaguuaucuaaaggaagguauaggggaaagagagaugaauagggucagcaaccuguguguagagugcucugugaauauaggaauaaagucaguuucuccugcuauacucucacagugcacuucuaacaccagauggguggaaguuauuccccauacaucaaguaaguaaauaguucugcaguggauacuagcuggguguccuccaauucaguccugacgcuaucuaccuagagguagcaucagauuccacauguugagggcccagucccacaagaccacuucugaugacaguugcaagcuccaaguuguuuuacccaugcuucugauuggcuggcuauaaauggggauucccacaauuuaaccaaaccuuagguuugguuaaauugcuagagcagcuuauagaacucagggaaacacuuacuuauguuuacugguuuauuauaaaggauacauaugaacagccagaugaagagauacauagggaggggucuugaagaguccugagugcaggaguuuccaucccuauggaguugggguguacuacucucccagcacguggguguguucuuguucauauuccauccuggaacacccaaccccccucacucucauauacacacacacacagaguccuuuucaguuuuuauggaggcuccauuacauaggcaugauugauuaaaucauuggccaucagugauagauaaaccuuuauugguguuaaaucagccccuuucuccucccuggaggugggguuggacugaguuccgacccuguaaguaugugguugguuccccaggcagucagcucccccauccugugguuaucuagagacuuuccaaaaaucaccucauuaauauaaacucaggugugguugaaagaugcuucuuaaaaauaaaagauugucuuucaccuuuauugcucuggaacuuuucaggaaacaguaacaaagggccaaauguuuuagcaaaagauauucauauugcucuagucacuuaggaaauuucaagaauuauuggagcuaugagccaggaaucauggacaaaaaccaaaaugcagucaauacaggccuucuguauccaaaguggauugguugaaggacccccauggauaccaaaacccucagauuaacccucauuaaauggcauaguauuugcguauaaccuacacaaacccuccccuauacuuuaaagcaucucuagauuacuuaucauacuuaucaacuuaaaauaauuaaaagucucaggguccaauuaaaagaguuuauuuagguauaaagugugagauuggccaucuggggagcagaauuacaccaaagaaugcuggucagugcuccuaguauggggaaaaaugaggauuguuuauaugggcaaaaacugauacaggcauaaacugaggugcuaaaaagaaugacauuuucuauacaaaggcuaacauagauauaugacuggcuacuauugauuacauuaauacagauagauuacauuaauacagauagauauaugacuggcuacuauuaauacauuaauacagauagauauaugacuggcuacuauugauuaacagauagauacaugauuggcuacuauugauuacacucuaagaggauuaacauuuuauuguaaagagguaacagucacaguggucucuaucucccucauuuagucuagguuuaaguaaagaguagacucugguucaugcaaucucaacacaaaggucaggaaggcaacggucaugcaucagagaagaaaacagccaugagucgguuuccaggaguuaacuuuucccauugguguaauaaauuugggagaaccugaaauuuuauuuuuacauaccuaauacaguaccuacacaucacuucauucucgaggauucaacauaguaaauucaaguuuugcuuuuuuagaauuuuaugcaguuuuuuucugaauauuuuccauccacaguugcuuuaauccacagaugcaggaaccaugggcacagugggcaaacuguauauauuacauaguaucacaagugccuuaccugaaaaucuugaaauguuuuuaaguuggguagaaguaugugacaugauaaauuuuuuguuuuugggagaacauagguauguuuuaauccauccuugacauuucuugcaaucuuuaccuaccaggcagacucaucuaauuucacaacuucauuuuuauuuuaaugaauccccaaacuauacgccauuuuccuguugucuucugagauuuaacauguuuauaauugaagauuugccguuuccucuucauguggucccuuuuucaguuaacauuauaauaugcaaaaucacuccaguuagaaaccucaagcauuuuuuauucaaagcauguugcauuggccaauucccuacuuuauauaguacgcuggacuuaaguuuauauaccagggacgauuuuuuauuaguauacucauuuuaacugggagaaaaguuuacuuuuauugaauuuuaccuauauacaaaaaaucaagguaaagcugguaagaguauuacuaagaauaaauguguuuagcaauuuauucaguugugaggauauuaucagguuagauuauuugaauuccagguuauuuuaacacauucagcaaacauuugcauuccuaccacuuugaucacucgguauuuaaaucuuacacgguuuuuuuugccuuauuaauaauuuauagauauuucauagggcacggggaaacaugauuagccagaguuuuagugguuuuuuuuguuuguuuguuuuuacuuuuccuauggugcuggcaguaaagcuuuagauuuuuuucuaauuuugaaccacuuaaaaauuugcaaaagcacaugcagauugcaccauuguauuuuccuuaaagcaccauggugacugcaucugugcaaaaacaaaccgaaacaaaacuuauuugcugacuuuguuuauuaaaguggauaaauauugauauauuuuauccugaaauguauacugacauuuagaaaaaaauuagcuacacuacaguuuguuaugugcacaaaauuauguuaaugagguaauacaugugauuuguaaacaaaauuguuccuguuuaauuuucuguugcaguaagcucugucuccuaaauugaaucuuuaagaucugucuucguuuccuacccucaccaccacucccugccaccaacaaauacauuagaauucuugccugauuucugucucugcaggaucucuuccacauuccuccuucuuauaagagcacaguaacacuauccuggaaaccuguacaaaagguugagauuggguaagaaauauauuuaaaagagauuuaaguguuaucaaaacuuaauacgaguuacauuuacuguucaaaagggugcaauguuaaaugauucauaauagcauguuuaaauaugacuauuagaaauaugacuuaaaauguaaaaucuaauuucaauauuuguaaaaauaaacuggugggaggcaacgcuggaacuuucagccuuacuuguauuccuguagcaaaacuagauuuuuuucugacagguuuuguaaagugagucacuugcauguaagucugugaagcuacauauuucagauuauuuuaaaggcuuguaaaugccuucugacauugucugcauaaccaaacuauaauuaauuugaugacaucaaauguuaauuccuuuuuucugaugagauuauccucuuuaggaugucuuuccuaacugauaugcuaaauuauaaauguauugauagcuuuuggcuuaauagaauguuuuugaauugcucuucuuccuauuguuacaggcaaaagagagccagugaagauacaacuucagguucaccacccaagaaaucuucagcaggaccaaaaagagaugccaggcagauuuauaacccucccagugggaaauauagcagcaauuugggcaacuuuaauuauggugagcguuuccguuuggguacaaggaauaugagagauuaggcagaaauuguguuauacuuuauuuuaauuaguaauuauauacagugucaugguucuauccaaugacuuuucugaauuagcuuggagaacuagggcuguugaggaaaugauuuaucccauuccucucucauucacccuucugggcugacuguauugaacaugcaacauuaaacaguaagcacuuaaagaaaaauaugccucuuguauucagaggaaccaacagaaacaaaauaaguugacagaaccauucuuuccaugcuuucccaguugcagcuucaaggcaaggcauucugugcauucucccucagggauggguauagcuucugagagauaguauaaaugcucuuucuuggacauagucagccugcugccuauacucccaucuucuguagcuaguuaaaaagaaauaacagaaguggagucagauguucaggcaucaucuagcaaggaagauguguucuauugcagucucucccucugcccagaaugcaauccuccuaucagugcuuccuauuccccuuuagccauuagagccaggagagcuucauaccaguccauccucucccacggcugucgaaucaaaaguaaaguuuaucucucauuggcuuauuuccucauggaucuuuuuuuuuaaaagaauggagagaaauaucaggucaauuccuuaccuugcuuaagaagacaaaguuuaggccgggggcaguggcucaagccuguaaucccagcacuuugggaggccgaggcaggcggaucacgaggucaggaggucgagaccauccuggcuaacagggugaaaccccgucucuacuaaaaauaccaaaaauuugccaggugugguggcgggcgccuguagucccagcuacucuggaggcugaggcaggagaaugguuugaaccugggagguggagcuuucagugaguggagaucgcaccacuguacuccagccuaggcgacagagcaagacuccgucucaaaaaaaaaaaaaaaaaaaaaaaagacaaaguuuaggcaggcaugguagcucacacauguaaacccaacacuuucggaggccgaggugggaggaucacuugagcccaagaguucgaggccagccuggggaacaaagcgagaccccauuucuacaaagaaaauuuaaaaauuaguuggguaugguggcacgcacuuauagucccagcuacucaggaggcaagaggcaggaggauugcugaagcccaggaggccaaagcuacuguaagcuaugauggugcgacugcacuccagcugggugaccaagcaagacccugucucuuaaaauaaaaaaaaaguagauucugaaccauauaauaucuguaauuuuguuuccaaggugagagaauuguaacauuaaauuacuucuauaacaguugaauucuucuaaugucugaacaaacagauuauauagaaagccaauuuuagacugaaaugaacccuuccccuccagacucugagacaccuuuacuuuaaggaugaucacugaacucucuuauuuacauaacaguauguaaaugugcaucuccuugccucuuaucugaaaaaugagguaagagcucuuacagccuucuaauaacaauauuugugaaaguauuuuguaaggggaaaggauucuccguuacuugguugaaucacauguuguucucugucacuuguaugauuuaaugugucuaacaguaccauucuuaaaaucaaaaguuaucucagauacugggagaauggcuuuaaugaaaguaaucaauagcuauggcaauacaagaauuguacuccuuuuuauuggacaagucaauuugauuuuacaugaagauucuauuguguaaaacucauugccugcucaauagugagaaucaggugauauaaugcauguggaaaaagaaugugaaaaaucuaacacuuuagauuguauacaguguuuuuuaaaaagacacaaaaaaacugucaacaugagaaacauaagcaaaguuuuacucaagacaaacauccacgagucacaacuucaguuauucccagucuucaaaauaacagaagggcaaagcaaaguaaacaugcaaaagcaaacuaaaaucugauucuucuuauuagaaagaagagugaauuucugcaauuauuuuacauuugagaauuuaaugugaucaggucauagguauucucacaacaaaauuugaagcauuugcuugacuuuauuucaccuguugaaacaaaagcaguucucaguauccaaguuuauugcuuuacuaaccaaugucucuguuuuuugcuuuacaaacaugguauugguucucacaaauuaguucaacuucccggugcauucauaaacauauacccacguuuaguuuuccuuccagugcacaaaguuuccccaguaaccuaaaaguacuaaauguucuacauuuugugacuuguguucuuuacuuuuuggaauauaaaaauaauccuuaaaguuuaauuuaaacugggagcagugaauuaaaaaaaaaauguaagcuugaaacuauugaaaagaucaugaaaaugcagaguauuuuuuaggaugaagcucuucaaaaagaagaaaauuuggugaaucucuguacuauagaaauggcuguaucaauuggagguaaaaaaaaaaaaaaaaaaaaagcauuugccaauauagaaaagauaacuacgucaaauaguaccuucauacaguguauuuaauuuccucauuagguacagcugaauagaguguaaccugaauucauauuaaaauugaaagaguggauuguaauagucuuuuagcuuaaagcuaauaauaguaucuaugacaguguuaaguguguuggugugaauaaugaguaugauagggugaaaugugcaggcaucugcauagauggcucuaagucuaaacagucaaaaaugcagaagucauggcccacaaaaggcuacugcacuaccuuaaugcucccauaguuacugcaucugucucugggagcaucuugcccucagagaaaccaccucugauuuucugaauguguucacuaggauaauaaacacaaugauuucauuuucaaaugguuugcauacuaaucagcuuguaaaaaaaugugucauggcauaagaaggugacuuugaaucagacccauucuauuauacagauaaauauuagccaaacuggggaaagguccagugaguuuccugucucagaauugaauuacuuuucuuucugcagaaaggggggucaaaaaagacaucaagacaucacccuaguaagacauaauggcaaaaaaauugauugcaaaauugacugaaaagguauuuuucaagccuccaagauuguggaucaaaaacagcaaaaccaagcucucucuauuguugcuaacaagauugcuauaaugaggaaguuuagaaguuaaugaagagauuugaucucauuuacauaugauuaaaaguccagccuugugauaacuucgaucaguuuucuucaugggacgacaccuuugaggaccauuucucuguggcuauaaaagugacugaccaauggaugagagacucuuguucuguacaucacaagugacuugauuuuucagcaaaagauaugcuuaguuuauaucaguagcugaaacacacucagacgcacauacacacauagcaccuauuuggcaguauucugagaagcuuauguagcugauaaagcagugaaaaaaacucagccuuuagaucuacauuugugugaguccaguugcgugaaauacugugaucaaaacaaaaauugcauauuuauugcauucaaagggacauuuuguagucuaaccugauuuucgaaauugauuauugauaauuuaagauauuuuucauaguuauaugaguuaccuuuaguaaugauagacaauaaauaaagaacuaagaaguugucaugaaagucauagccagagcagguagauaagagaaagaaauaaagggcauccaaacuagaauggagaagucaaauuguucucuaugcagaugacaugauguuauauauauaaaaacaaaacuaaagacucuaccaaaaaacucauagaacugauaaauuuagaaaaguuagaagauacaaaauuaguauacaaaaaucaguagcauuucuaugcaugaacagugaacuagcugaaaaagaaaucaagguaaccccauuuauaauagcugugaaaaaaaucuaggaauaaauuaaccaagaagguaaaauauuucuauacaaggaaaacuacaaaacacugaugaaagaaauugaaggagauacaaacaaauugaaagacacuccguacucauggauuagaggaauuaauauauuuuaaaugaccaugcuacccaaagugaucuccagauucaauacaacuucuaucaaaauaacugacauucuucacagaaauugccaccaaaaaaaauucuuaaaauuuauauggaaccacaagaccccaaauagccaaagcaauacugagcaaaaagaacaaagcuggaguuaucacacuaccagaucucaaaauauaaaucaaaaauguaguaaccaaaacagccugauacuggcauaaaaauagauacagagcaauggaacagaacagagaaccagaaauuaauccacguaucuacagccaacugauuuuuuacaaagguggcaagaauacucauuggagggacaaaaaaaaaagggacagucucuucaauaaauggugcugagaaaacuggguauccauaugcagaagaaugaaacuagauccgcaccucccacccuguacaaaaaccaacucaaaauggaugaaagaccuaaauguaagaccuaaaacaauaaaacuaccauaagagaaaacaagaagcacuucaggacauuggucugggaaaagauuuuaugacugagaccuaaaagcacaggcaacaaaaacaugggaucauaucaaauuaaaaagcuucugugcagcagaggaaaccaucaacagugaaaagacagcuuacagaaugggagaaaauauuuguaaacuacucaugcaacagaggauuaauauucagaauauagaagauauucaaacaucuuaauagcaaaacaaaucuagauuaaaaaugggcaaaucaucugaacagacauuucucaaaagaagacguacaaauggccaauaaauguaugaaaaaauucuaaacacuaagcaucaggguaaugcacaucaaaaccacaaugaguaaguuggaaguucagggaagagauuuuaucucauuuacauaugauuaaaagucagacauuggcacccccauguuuauuguagcacuauucauuagccaagacauggaaucaacccagaaucaacaggugcaucaacaggugaauggcuaaacaagaugugguauuauacacaaugggauacuauucagccauaaaaaaagaauguccuuucauuugcagcaacauggaaggaacuggaggacuuuauaguaggugaaauaagccagcaauggaaaauuaaacaaugcauguucucacucauguggaaguuuuaaaaaguuaaucuuauagaaguaaaaauuaggacagcgcauacuagaggcugagaagauagggggaaggaagggauagggagagauuugugggaggaugcaaaauaacauaggaauaagcccuaguguuguguaccacuauagcaugacuauaguuaauauauacuuuaaaauagaagaauauugaauguucccaacacaaagaaauuauagguguuugagaugauggauaugcuuguuacccugagcugauaacuguacauucuuuguaucaaaguauucuaccccacgaauauguagaauuauuauucgugaauuugaagaauuaaguuuuuuaaaaaguguacgggcugggcacaguggcucacaccuguagucccagcacugaggcaggacgaucccuugaggccugcaguuugagaucagccuggcaacaaaaugaggaccugucucuacaaaaaaaaaaaauagccaaacaugguggugugcaucuguagcccuagcuacuggggagucugaggcagaaagaucacucuaguccagaaguucaauguuauggugaacugugaacgcaccacugcacuccagccugagcaacacagcaagacccuccaaaaaaaguguaguuaucguaacaucaccuugaaacaacuuuguuacugggauacauuuaauuaagcaacuaccaugaauguagucgguaccuugccuuacgugcuucaguauauauguuguucuuguuuuauguacaggcuaaauuuguagauugaauagcagaauauuaguucuguucuuauagggccuacugcuguauucagaguuaugagcuacguuucuucugcguuugcugcaccaugaaauccuaagcaagaccuaaacccuuguucgcuuuuucguagagcagagaggagccuucaggggaaguagagguggccgagguuggggcacacgaggaaaucguagucggggaagacucuacugaauaagacaucagcauucuucagcauugucaugagcuuaauauacuuaaauucuacuacucauuggauugccggggaugucccuuuaaacagacugcugccuucagcuaaaaacuuaauguucuuuauaccuuuguauguaugaccuacuuuuguaacagaccaugguuguguccaagguaaaaccacagugauauuuuuggaugcuuugucugcaaucuugacuuguuuuugcaguaucauuauucagacuucaaauugugaaucuuuuaaacaucuugauaauuuguuguugagagcuguucauucuaaaauguaaugaaauucagucuaguucugcugauaaagaucaucaguuuugaaagguuacugauuuuccucuucccucuuaguuuuuuacccaauauauggagaagaguaauggucaaucuuaacauuuuguuuuaauuguuuaauaaagcugcugggcaguggugcagcauuccuaccuagugucauaaaagcaaaauacuuacauagcuuucuuaaaauauaggaaugacauuacauuuuuaggagaaaguaaguugcuuugcaccgccuacuuaauucuuuuccauauauugugauacaaacuuuugaauauggaaucuuacuauuugaauagaaauguguauguauaauauacauacauacauaagcauauauguguguguguguguguauauauauauauaugcaugcugugaaacuugacuacacaacauaaaucacuuuuuaaauuccaggaacggguagucugacacggugauuauccuuuugaggcugaauccguuauuaacuuguuauuuagguuuuuacucccaguagcaagggauucuaaguuaguugcacuuacaugauuauuguuauuuaaaacuaagaauaaaggcugcauuuucaaagauaaauuggaauugcuguuggugaaauaacaaccaaaauacugaaucugauguacauacagguuucuacaggaagagaugguauaauuuacaauuuggagauuuaauaaccagggcuacccagaaaaagugacuugauaacaugguaccaauaaguaagggaugcucucucgguuugcuuuugccacuuucaagauuuuaacuucucagguuauuaaucaaaauuauuguauaaguuagccaauagaauuuuuagguuaaaacaacagaugggggguuuguggaguguuuaaugucaugggcauuuuuaguaggauagacccuuuguucugcauuugaauguuucguauauuuuuguuucacaguuaaucuucccuccccaaguuugcuauucaaaucaacugccugaaugacauuucuaguagucugauguauuuuucugaggaauaguuugugauuccaaugcaggugucuucauuaccauuaccucuacacugcagaagaagcaaaacuccuuuauuagaauuacugcacauguguauggggaaaauaguucugaaaggcuagaaugauacaagugagcaaaaguuggucagcuuggcuauggagugguggcaauaaucucuaaacauuccaaaagaccaugagcugaaccuaaacucccuuggaaucugaacaaaggaauauaaaauugccauuugaaaacugaccagcuaaucuggaccucagagauagaucagccaguggcccaaagccauuucaaguacagaaauuauagagacuacagcuaaauaaauuugaacauuaaauauaauuuuaccacuuuuugucuuuauaagcauauuuguaaacucagaacugagcagaagugacuuuacuuucucaaguuugauacugaguugacuguucccuuaucccucacccuuccccuucccuuuccuaaggcaauagugcacaacuuagguuauuuuugcuuccgaauuugaaugaaaaacuuaaugccauggauuuuuuucuuuugcaagacaccuguuuaucaucuuguuuaaauguaaauguccccuuaugcuuuugaaauaaauuuccuuuuguaauuuuguuuugugucuugauguguuauaauuaugguaacuucagauucuuggauaguuauuaacauuuauugauugcuucuacugugccaauaggcugaaaauauaaagauggacaagaacugcucucugccuucaaggaguucagucuuuuuuuuuuuuuuuuuuuuuuuugagacggagucucgcccugucucccaggcuggagugcagugguacaaucucggcucacugcaagcuccgccucccagguucaugccauucuccugccucagucuccugaguagcugggacuacaggcgcccgccaccacgcccagcuaauuuuuuguauuuuuaguagagacaggauuucaccguguuagccaggauggucucaaucuccugaccacgugauccacccgccuuggccucccaaagugcugggauuauaggcgugagccaccgcccccggcccaugaggaguucaguguugauauaauuuuguaaaucaucuuuaauuuugauccuugaaaguuuuuauuugaauuuauuuuuaggagcuaaucugaaaaaaaggauuugguuuuuuuuuauuaaagcaaaacaucagauaauugccaaaucaucauuaaguaaaucauuucuaucuucagauaaugugcaaagcaaguuggaacuuaguaauuuaacugccagccuuuaugaaaauauuccugaaguagcacuaagguugguugugaguguuugaaagcugggguuuaaguggaucaggauaagauaacuaaauucccuuggugaucacaucuaggccuauagcguuuuuuuuguuuguuuguuuuguuuuugagacagaguuucgcucuuguugcccaggcuggagugcaguggugugaucuuggcucaccgcaaccucugccucccagguucaagcgauucuccugccucaaccucccgaguagcugggauuauaaguguccgccaccacgcccagcuaauuuuuuguauuuuuaguagagacggggcuucaccauguuggcgaggcuggucucgaacuccagaccucaggugauccaccagccucggccucccgaagugcugggauuacaggcauaagccaccauucccggccuuccaggccuauggcuuuaaauacuaucuauaugcuaaggaaugccaaauuucuuuccccauuauuucuugccuagaguuucguaauaaccuccuaauugaucucccugccguuacaccuaacucuacaaucugcuugaaacccagcagcaaagagacaucuacuuuucugccagaaauuguucacuggcuccccguuucagaauaguaaccaaaaacauuaccauggcuuuuaauugugaccucagcugcuauucuuccccuccccuugaucacucugcugcagccaguuagccucaugcaggccaaagacauccuccugccuuacagcccuugcguuagcuagcuacccccucuugucaguauuccuuuauuuauuuauuuauuuauuuuauuuuuuuuuuuuuuauauuuaaagaggucuuuuauuuaaaucaucuuguaucaugucugacacauuauugguuuuuuuuuuguuuuuuuuuuauacuuuaaguuuuaggguacaugugcacauugugcagguuacauauguauacaugugccaugcuggugcgcugcacccacuaacucgucaucuagccuuagguauaucucccaaugcuauccuuccccccuccccccaccccaccacaguccccagagugugguauuccccuucauguguccaggugaucucauuguucaauucccaccuaugagugagaauauacgguguuuggugauaauuuuacugagaaugaugauuuccaauuucauccaugucccuacaaaggauaugaacucaucauuuuuuauggcugcauaguauuccaugguguauaugugccacauuuucuuaauccagucuaucauuguuggacauuuggguugguuccaagucuuugcuaucgugaauaaugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauagugguuuugauuugcauuucucugaugaccagugaugaugagcauuuuuucauguguuuuuuggcugcauaaaugucuucuuuugagaagugucuguucauguccuucgcccacuuuuugaugggguuguuuguuuuuuuccuguaaauuuguuugaguucauuguagauucuggauauuagcccuuugucagaugaguagguugugaaaauuuucucccauguuguagguugccuguucacucugaugguaguuucuuuugcugugcagaagcucuuuaguuuaauuagaucccauuugucaauuucggcuuuuguugccauugcuuuugguguuuuggacaugaaguccuugcccacgccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauaugccuagccaguuuucccagcaccauuuauuaaauagggaauccuuuccccauugcuuguuuuucucagguuugucaaagaucagauaguuguagguaugcggcguuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguauccucuuuuauuuccuugagcagugguuuguaguucuccuugaagagguccuucacaacccuuguaaguuggauuccuggguauuuuauucucuuugaagcaauugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagaugaugggguuuucuagauaaacaaucaugucaucugcaaauagggacaauuugacuuccucuuuuccuaauugaauacccuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuucucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugcuagaauucggcugugaauccaucugguccuggacucuuuuugguugguaagcuauugauuauugccacaauuucagcuccuguuauuggucuauucagagauucaacuucuuccugguuuagucuugggagaguguaugugucgaggaauguauccauuucuucuagauuuucuaguuuauuugcguagagguguuuguaguauucucugaugguaguuuguauuucugugggaucaguggugauauccccuuuaucauuuuuuauugugucuauuugauucuucucucuuuuuuucuuuauuagucuugcuagcggucuaucaauuuuguugauccuuucaaaaaaccagcuccuggauucauugauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugccuuuguucucguugguuucaaagaacaucuuuauuucugccuucauuucguuauguacccaguagucauucaggagcagguuguucaguuuccauguaguugagcggcuuugagugagauucuuaauccugaguucuaguuugauugcacuguggucugagagauaguuuguuauaauuucuguucuuuuacauuugcugaggagagcuuuacuucgaacuauguggucaauuuuggaauaggugugguguggugcugaaaaaaauguauauucuguugauuugggguggagaguucuguagaugucuauuagguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauauuuaggauaguuagcuccucuuguugaauugaucccuuuaccauuauguaauggccuucuuuuucucuuuugaucuuuguugguuuaaagucuguuuuaucagagacuaggauugcaaccccugccuuuuuuaguuuuccauuugcuugguagaucuuccuccauccuuuuauuuugagcccaugugugucucugcacgugagauggguuuccugaauacagcacacugaugggucuugacucuuuauccaacuugccagucugugucuuuuaauuggagaauuuaguccauuuacauuuaaaguuaauauuguuaugugugaauuugauccugucauuaugauguuagcuggugauuuugcucguuaguugaugcaguuucuuccuagucucgauggucuuuacauuuuggcaugauuuugcagcggcugguaccgguuguuccuuuccauguuuagcgcuuccuucaggagcucuuuuagggcaggcuugguggugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuucccuuugaggguaacccgaccuuucucucugacugcccuuaacauuuuuuccuucauuucaacuuuggugaaucugacaauuaugugucuuggaguugcucuucucgaggaguaucuuuauggcguucucuguauuuccggaaucugaaccuuggccugccuugcuagauuggggaaguucuccuggauaauauccugcagaguguuuuccaacuugguuccauucuccgcaucacuuucagguacaccaaucagacauagauuuggucuuuucacauagucccauauuucuuggaggguuugcucauuucuuuuuauucuuuuuucucuaaacuucccuucucgcuucauuucauucauuucaucuuccauugcugauacccuuucuuccaguugaucgcaucgucuccugaggcuucugcauucuucauguaguucucgagccuugguuuucagcuccaucagcuccuuuaagcacuucucuguauucguuauucuaguuauacauucuucuaaauuuuuuucaaaguuuucaacuucuuugccuuugguuugaauguccucccguagcucagaguaauuugaucgucugaagccuucuucucucagcucgucaaaaucauucuccauccagcuuuuuuccguugcuggugaggaacugccuuccuuuggaggaggagaggcgcucugcguuuuagaguuuccaguuuuucuguucuguuuuuuccccaucuuugugguuuuaucuacuuuuggucuuugaugauggugauguacagauggguuuucgguguggauguccuuucuguuuguuaguuuuccuucuaacagacaggacccucagcugcaggucuguuggaauacccugcagugugaggugucagugugccccugcuggggggugccuccgaguuaggcugcucgggggucaggggucagggacccacuugaggaggcagucugcccguucucagaucuccagcugcgugcugggagaaccacugcucucuucaaagcugucagacagggacauuuaagucugcagagguuacugcugucuuuuuguuugucugugcccugcccccagagguggagccuacagaggcaggcaggccuccuugagcuguggugggcuccacccaguucugagcuucccggcugcuucguuuaccuaagcaagccugggcaauggcgggcgccccucccccagccucgcugccgccuugcaguuugaucucagacugcugugcuagcaaucagcgagacuccgugggcguaggacccuccgagccaggugugggauauagucccguggugcgccguuuuuuaagccggucugaaaagcgcaauauucgggugggagugacccgauuuuccaggugcguccgucaccccuuucuuugacucggaaagggaacucccugaccccuugcgcuucccaggugaggcaaugccucgcccugcuucggcucgcgcacggugcgugcacccacuggccugcgcccacugucuggcacucccuagugagaugaacccgguaccucagauggaaaugcagaaaucacccgucuucugcgucgcucacgcugggagcuguagaccggagcuguuccuauucggccaucuuggcuccucccccaucaguauuccuuauauccacacaucuaacuccuuuuucaaauccucgaagcuaaccuacucaauccuaucuaauacugcaaugucccuuuccaccccaccaagacuccagacccacuuacccuacuauaugcucuccaguuuuaccaacuuguauguuguuuacucuguccccuacugcuagaauauguggcuaaagugccacaaaaguaaagauuuuugcauguuguucauucauaaucccaagcauccagaacaguguuuuguacauaguaagcuuucaacucauaauaaguugaaggcacuguuuuaagccuaggggauauaguggugaacaaaacaggcaaacucauggaguuuacauucucuuaugcagauccugacaaacuuaagccuguaccagaguaguaagugcuauaaggguacugaagcauucuaauaugcuucagcuaguauagauaaaauagucagaaaaaagccucugagugacuaauuggaggugagaccuggauaaugauaccaagccagccucgugaagaccucaaggaagagcacugagaucgaggcaacaaaauguguaggacacuuagcuuuuaagaaugugccaagcuguguuagagaaugggcuaucucggaggucuuagauuccuaaccuugaccucagaaguccuaaguucauccucuacuacaauagugaacugcuuucaguaaacugaaaguuaacaccauacucuuucugacauuaggaauuuuuccucuggaaaaucaugguuccuugauucugcccauuuaucuggcugcuucaggucugaguaaauuugacccuccuugggacaccuuuccucuccaguugguuacaggacuaccuauuaugugcuuccucaguagguggguaaaaaacagcaggagagagaucauuguaaucagugugauugaaacuaaagcuuaaacuaauaugaaauuaacauaccaauaaaaaccuaagaugacuaucuugcuauccucagagcagcccucugaguuugaauccuuggucucauccaugguagcccucauacuucacacugccugaucuauuugacaaaugauuucuaaaugaaauuacuauauuagguauccucugccucccuuuuaaaaauccucuucgcucaccgugcauauugauguugaagaguuacacauguaaaacccuucuugcuauaaccaggcuccuuuccaaccuguuccccuccacccugcuuccaaccaacucaaaauuacucuuaaagacuuaauuauggccaggcgcaguggcucacccccuguagucccagcacuuugggaggccgagguggguggaucacaaggucaagagaucgagaccauccugaccaacauggugaaaccccgucucuacuaaaaauacaaaauuuagccgggcgugguggcguacacuuguagucccagcuacuagggaggcugagguagaauugcuugaaucugggaggcggagguugcagugagccgagauugugccacugcacuccagccugccaauaaagcaagacuccagcucaaaaaaaaaaaaaaagaauuauauauaguaggaugccaauaauuccuuccauuccuacucaaacaugcuguuucuccuaucaagauaaaucuguguccauccacacuugaauuugggcuaagcuuguuacuuuccuuaaccaggagaaugcagaaugaugcuuuaccacuucuggggccugacccucugaaagccuggcagcuuccuuuuauucuuucagcacccugagccacccuguaagaagucuauguaacuccuugucuaagagaggcccagcuacccccagccauuucaaccacuccaaguaaagcaccagacaugguggagccaguuuggaacauuucagccucagcugagcuccuagcugaaugcagccuuaagagugaccccagccaacaccaggaguagcagaagaaccacccagcugaguccaacaaacugaaaaauaauaaaucauguuuuaaggcuuaaaauuuaaaccucuaagacuuacauugguuuuauuacaaagcaaaagauaacagaauguaagccagaguguuacccuccucccuagggguauuuauaucuuaaauauuuucucuaaggaauaggcaguauguaaauccuuugcaauuuucagguaagguggcccaagggaggacguuaauccagaaagaucauucauucuaucaacagaaugaauucuaauucauaacuucaagaauucuaugauuuauaguaauaguaaauaaaagaccuauuugcuaaaauauguugaaagacuaaauuacaugcaguuagggacuugccuaucauucguugaacuaacaauugaaucacaauuugagauaucagcaauuuugucaacugccauccuguauuucuauaaauuucaucgaagaggaaaaguauaaugaaaaaagaaacaucagaucuuagaacaacagaau

SEQ ID NO: 13295 - RNA, 1589 nt, Homo sapiens
auugggggaagggggugggacaggggcuggaggaagagcucuggaguccaucacagcacaggaauaacacacagggugguggagaagccagggccagggugucaccaggucagcacaaugaccacaucauccuucuugaagaagccucaggccuuaccaacauucauggccaaguucacucggagguccacauccucagccuagggcuccuggaugggguccuuacacagcacagggaagauaccacgguacaggugggccuggcgagcugccuggggaugccaugucacaacaaucaugggggcacgugggcaguaucuggccaccuggugggcacaccugcagacuuggugaggacgauuauggccccacugcagcacuugaaggaggccuccacagugcccauggcaguagcuucugcggggucacugguaaugggugccagguggcagaacuccucaaauaauugcaagugguagaugguggccucugccucacaggcaaucaggugcugcaugugcacagccuccagaggauaguucccuuuggcuguuucuccagacagcaugaugcagucagcuuccaccagaacugcauuggccacaccacugcccucagcccaagugggguggagcuucuugaucacauccucuagcaucugaguggcaagaugacaggcuucccagcuugguugcaccacccaaucaucauccucugagcaaggcagaccuucccugcaggaaucucaucucgacggcuugugguggaucaccacgagcuaccauaaucccaucgcuggccuccaggauuucaucaaaccuccaacccccaucaugauucucaauuuugcugguuaucuugcuguucuuuccuuucucucccaagaccuuccuaacuucauggacaucagaugucuugcagaugaaugaugaaaacaucauaucgacaucuugcucgcccccaaacuucagguccuggauguccuucuccaacauggcagacagguccacggcagccccaggaagguucacacucuucuugcugcccaaggagccaccauuuuccaccucugucaccagaaagugagcauccuucugcuucacuuggagagaaauuagcccaucauccacguagaucuugcagcccacuuccaccaccuugcagauguucuuguagucccgccacaggauguucucuuacccuuuuccauguagguauuauccagcgugaacuugagaguggcucccuucuucagcuccaccucugcagugccgcugcccuugacgggcccaguugggaucucagguccuuuagugucuggagccacagcaaugggcugguagaggauggagucagaagcaaagcuuuccguggcugugcgcacguucuugauggucucuguaugguacucaugggcuccaugagaguucagaugagccacauuaauuccagacuuaaucguuuucuucagcaucucuagcaauggagaagcugggcccauaguacagaugaugccagugcuccaggcugugauggguggcgagucaguguccaggcagcacaugugcuccaagaaugugucagccaug

SEQ ID NO: 13296 - RNA, 28401 nt, Homo sapiens
ugggcagcuccuccucuuccccauuucccuguuuuccacccucucacccuugcccuuacuuugaauucugcugggaagaggauggccuuuuaccccagacccacaaucuuuccaguucaggcugguucauuugccaucauuugcuuucucauugauuaggaauuaaucaauggcugacagucuccccagaguggaucacagcugucuaggaaaucugcugaccuagaaagauuuucagaugcuguuaacaacccacagaucacgcugucaaguauuuucuuucuucagcagcucuuggcauggcgagcaugugauucugccccucugcucuguggccuuucagugacauucauuauuuauccggguccuuugaagcucugccucaaaauguugccagaaauuccaaauuauuuucuuccuucuuguuuaaagaauuucaucuaaaacuuuguuuggagagagcccgcugaagucauaguuauauugacuuccgcgucuguuccccagcucaucuuugcucccuguuuucuccccacgcuggccuccgugccuggaacaagucagacuuguguuauuucccagcugugugaccuugagcaaguggcuuaauguuucugagccuuaguuucuuccucuguaaaauaaggauaauaauacguacuucacagacuagugguaaggauuaaaugagacaaugagagaaugcaaagcacuuagccuaguucaagaacauaguuauccaucacuuuaggauacagcaggggccucuuguucaccccuguuauucccagggguacccgccuggcucauaguaggugcguagcaagauuuuuuucaauggaaacuagagugggaugcgccuaucuagaaaauccucuguuggagccuagucuugguccuuaaaaguccugggccugccuucccccugccuuuaagaagcugagccagcaauaguagcauguggccaccugcagggcucuguggaggaaagagcuuugagcugggaaauuauguucuuagaugagucauguucugccucaccauuucuuuagugguucucaauccuaguugcacauuagaaucacccagggagcaguuuuuagagacuccauacaagagauugacucugcugauucgagguagagccuugcgaugugucagaaguccuuugcuuucguugagaagaacguacugaguggaaauuguauaaccucaucaacagcuaagcaccugaagggauaaaaaagaccgccaguaguuggcagucuugguugaggcuucaagauugaauccaaagcagcuugugauuccuuuggaguggcacgauccccaacugaagagcuguuugcacauacacauugucacugcaaacucaaagcccaaguuuguucguauagccagcucugcccagcaggacccuggguagggccaggugccuuggcagaacauggauggggcaguacagggccacuuggaucagguccacccauuugccauuguuagcaugagcugaaagaaguugggucucccaaggcagugcugucucacugcaguaaacagcaguuuucagaagaucuacguccuugaaauauacacagauuggguuuuguuuguuuacccacacacagccuucucuuagaggggaguuaagguaaggaaaugacugucucaacacucacacccugauguggcauuauuuggcaacaauaacuucuucaucauccccuccccuccucauggcacccacccagcuggcagaaaaugacaaagaaggaagaucagcauucaucaucuucagcaugauaugguuucagagauuuuuagcauuugauuuguaacauuucagaaggcaacauaaaucaagcugguaauuuguuuugucaugccaaaaaaaaaggaaaaucugaauucauuugggagaacguguguaugucagucacugccuuuucggaucugguugaaaagcugcaaauauuuuucuccacacaaaguacauucagguuuuguugaugauguuguuaguacagaucuccucuggggcacugaguaacccuggggagaggaugggaaacagcguaagggcuguaauuuucagccuggaauagaagcagcaauuuuaggcaauuuaaacaauucuauuaagggcaaucuuuuggucuccugcuggaaagagaggaccccauucagaaugcucccaguaaugcuguaaggggcugauggggucuccagauuguauacaguuuccugcacccccgaaaccaucauagaggaucucugcccccucaugccuuuaaacgggaacauuaauaauuuccugcuuagugcaggauguaguccaaaaacucaaaaugaguuguccagauaaagggagaccucugggggaugccagacaaacuuggucuugucagaagagaaaaacuugagagggaguuaauugaagaguuucccacauugcagcuugugagugguucuguugcacuuuuguugauuuuuaaaauuucuuuuuauuuagucaguuuuuaaagucccaaaugaaccaugggguucuuggcccagagaacagaugaacauugguuaggccagggaguuauuuuccagcaaacugcccaugaguuaaacuccacucuguggauugggggucaugauaagggaagggagccccuacuauuuugcgggucucuguuuugagugucuuaaaauucuaguggaguaggagccauugggaccaucacaggaagauauagccccugggugggaagcagggugucugucuuuuggagggagcggagugucuccauuucaguuguugcugagacaggcaaggucuggugguugaggaaacaucuuuuucucucugagccucuuuuugagcuuagauuauaaggaaucuagaucugucacggguagaugcuuccagguucugggagcagaaggcacugcuacaaggaggcaaguuggggacucaguagaagguaaccuguugguuaguagcuguuaagcaauuuggaccccaaccuacaauaagaacuacuuuuauaucacaaauauacagauaggaagucauucuacauucagcacacugacgcagguauuuuuuaauacauucuauucccuucuuuucguuuuaugcuggcccugacccacuauguuaguuucuguacuuauuauacuauuugguugagaccugauguugaaaaaacauuccagugggauagucuaugaagauagccucagcacaugaguuaugagagcugccucagcugugagaguuccaggcacgucacuguccggggguaauucccuuugaguuucauugaauuuuaaggaaaaagcccccuugcucuuccucaaaugcaccaaagacucucucaccccaggaucuuugcacuugcuguucuguucacuuagaacaccugucuuccauauacccaaggguccaccuucagcucuuuaucaggugccacccucucaaggagaaccccauccccauccccacccccuguuuaaaauugcaacccaucaccaaccccgcucccucuucguuccacuuaccauguucugggcuuuuuuuuuuuuuuuuuugccacagcauuuauuaucuucucccaaacaauauacccuauaacuuuuuauuauaucuacucucugucucugcccacuaccauguaaauucugugagggcaggaauuucuguucuguauaucaucauaucccaucagcuggagcagugccuguggugugacagaugcucacugaagacuuuguggaaugaauaaaugaaugaauuaaugcuguuaaaaugauagccucuucuuacuacaacugucuuuuauuuuuuuuaauugauacguaauaauuguacauauuuacaggguacaauguguuguaauccauguauacguuguguaaugaucaaaucaggguaauuggcacauccaucaccuuauaugugugucauuucuuuuggugacuacauucagaaaggucuagcuauuuugaaauauacaauacauuauuauuaacuauagcugcccuacugugcaagagaacaccaguuuuucuaauuguaauuuuguacguguuggcugcuuucuuaaauuguggaaauuaaaggaagggcugaacuguuacucagauuugaauagaaaugaggaagaagaagaacagugagauaaggagauagugacagugauacauguugacaauuccauugaaaaagaacuuggccggguguggucguucauggcuguaaucccagcacuuaggacacgaaggccgaagcaucgcuugagcccaggaauuugagaccagccugggcaacauagugagacccccaucuauauaaaaauuuuaaaaaacuugcuggguauggugguguuugccuguagucccagcuacuggagaagccgaggugggaggaucaccugagcucgggagguugauucugcggugagccgugagcacgccacuggacuccagccugagcaacagagucagacccugucucuaaaaagaaaaaggagccagaugcgguggcucacugcuguaaucccaggggaagccaaggcagaaggaucacuugaggccaggaguucaagaccagccuggucaacauaguaaaacaccgucuuuacagaaacuaaaaaaaaaaaaaaaaaaaaaaaagccagauguggugacaugcuccuguagucccagcuacaugggaagcugaggugggaggauugcuugagcuugggagguugaggcugcaguaagcccagaucaugccacugcacuccagccuggcaacagagcgaggcccucaaaaaaaaaggagaacucaggggacaagaaucaagguggcaaaggccuaugaccuuugcccacagaauaaccaccccuacccuggagggccaggacgguuccuuccucuccuuccaucccaagccugagucuuauguucccugcccaguagugaguccuccggcaacucaucagcaacacagagccgcagggcuuuuguugggacccccuugaaaacacucagucccacguugcugcacauugcuagugguugauaagaccguugcaggaaaauuuauaaauccguggccuuacuggcugugagcgaggcagauaagccacagucugacagaaagaaaagcaucucccuucccuguucuugccugagaugcaaagaauaaaccugaaucuguguggugaaugaacguccuggugaagugaacgugauaaaauuccagcuugcuguuuugugggacguauugcaggcaccgcaucuuuguucucaguccccucugcccuuugugugggccagccucgagggacguggcccagugaauccugggggaaaaucacgcucacagaaagccagcgugauuucccagccagaggagauaaggcccgugggagugaauggcagcuuagcgaccccuguugcaccaaauccuccuugaaauauuuaauuauaagauacaugaaugcuuaucccagcaguuauuuuuuccucuuaacccauauuuagccuugcagcaaaaaauaaaauaugguuccugggaguuuaucuuucuuuuaaugaggcucucaggggucaguuuuuucccuuaaaaaauuuuuggcccaucguucaacccaggaacucugcuugucagagaggaucuuugaauaaaauaaugcugucugguucuuuucauagguaucguuuacccuuucauauugguuuucaguuuuaaaaaguauuuucacauagaagaaaucgggacugaaaaugcguuagugaccagcucaaagucacacaaugacuuagugagaacucgaaauggaaacaggaucuuuuuuuuggcguggggagggacagaguuucgcucuuguugcccaggcuggagugcaauggcgcaaucugggcucacugcaaccuccgccucccagguucaagugauucuccugccucacccucccgaguaguugggauuacaggcaccugcaaccacacccagcuaauuucuguauuuucaguagaaauaggguuucaccauguuggccaggcuggucuugaacgccugaccucaggugaucugcccaccucagccucccaaagugcugggauuacaggcgugagccaccgcgccuggccagaagcaggaucuugaagcucucagaaugcccgucucuccuucugugcacagugagggcuucccauucuuucugauuucccuuuccuguagcagagaggggaagauacuccacauuagucaagagcuuuaggguaccaggcacuguguguaaaguacauuucuuauauuaccccuuugauuccucccaggaauccuauggcaucuauaauacuauccccauuuucuaaaugaggaaauggaacuucagagugauuuuguuccaaguagaaaucaggcucuggcaacugcuuccugcuagcagggugagauacaaacuuuuacaaauagcagacaggccaucauauaaauauaugauguauuuauaaauacauaccuguagauauauuucuaaauacauaucuguagauguguuuauaaaugugggggaaacagauaaaaaucccuacccuuguggagucuacauucuguugauucauuuugggauggauggauggauggauggauggauggaguacaacaaucuucagaggccaacuccacuucagucccggcaaauuccucuuacagaagagcgguaagauacauugguagacauauacaaccugggcuucagaccagggaaguuuuauuuugccacuaaauuuagccacuguaucaacacaucucccagcuuacaagaugacugagaacaaguguaaguucuugaggacacaagcccuugccuuagucagcuuugugugcccugcuguacuuaaugcuucauggguguucauuaaauguuuaaaugaaugagaugcauaauucaguuacgaugaggcucucugagaaugaguuaacaucuaucgagaguugugcaguccgcagacuuagaaauauccaaaaauaaucaccccuagagagaucucugcaaaucaguaaugaaagaacugaaguaaaacuauaaaucauuccguuaacgguuuuauacauuuacaaguaaguaauuuuggaagcaaaauugguguauaagcuguauuuagccucgaugugcuaagcaacuuugaaccaaauauaaauuccuggcgugguauuuuuaagccacggugggggcagggugcuggggaaaaaguugaguuggaggagcaucaaagcuauuuuuguaaguuucaucuacauuuuuagaaagaugcauuuuugaagaauugggauaucagucacuucucccuggcaggauuccucaucaagggagaaaugacagcauguccgaucuuccuugagucucuaaagaucgcauuauuaagaugguuucugucacugugcaccaugucugagaacaugucuuggcacaccacccuguccuucgucuccugauuuauagcuugcaauagacuuguugagugugaagcuagaacccagacagaauguuaaugcagggaaaugacaugugaaucaguggugcccugggcuuugagugcacaugacugaggggaggcccagucagcuguggcugugcuccucacauuagcuuugauuugcuagacauugcaugaagaaugaagcagagccuuagccgugagcuucucagacuggagcuaagccguggucccuaagucuauagcuucccacuggagacugacuuaauuagccaggauccugagcuuggcuaauggugggcccagugaaugcuugauuugcaauggaaaugcccaauuugguauggagucuccauuuuuaaaaugcauuggcuaacuuugcagcuucccccauccccuucucaugacagucucccuuucuggaauauuucaaaugcaaagggggaaacaggguugucguuauaucuggauccuauccacaagggcucagcagcugugauguucagcaggccaaauacagacccaagagaccaaacagcuucuuccuuccccaagcaguuaaaacaaagaucugcucacugccuugccugugugucuucauggguguuugauaucaggguaaacucuaggggcuaaaagugggagcagaaaaagcaaugcaaacgcauuaggcgagaagccagggcggaucagcaaaaggucuggaauuauggaaggcugaagauaagcaguuuugguugauuuccaacacaggcaguugccugcuuuaaugucuggauaagaacuugccuguaauugguagauggauugcuuggcuauaaauggagccugaaaagagucuauucccuuccagcaauuaaacaucccccugacugcugccacuuucuccacucugauuauucagcagacccauucuucuuaauacacagcaccgagguguggcuuagcccagccugguuugaauuagcuuaugggauccacauuaaugaagccuagccuuacuucccugcauaugaugugugacuggguauagucaagugcccaguguagguaaauagauuucggagaauggugauguaagauaccuaccaaccauauguggaaauccuuuucaggaugguuucccucugcaagacuguaaagguaggaaaugcacugccuuucccaccccuucacuccugcacccauuugauaacccacuugaguguuuagaacagucuuccaaagagggaugugugcaaggugauuguuuagggaaggaagggagggagggagggagggaaaagggagagagaaagggaaaaggggaggggaagaagggcaggaagaaagaaaagcuuuagauuugauauauagauugacgggaucauguauauaauggaaauauacauauauugggggaauagugucucaaaugguggaaguucacugguuuagagcacugaaugagccaccucaauuuugcucccguuuucaucuuugucccuagugcugaguggcuucaguuuucacugcuuugaucuauguccugccugacuggauuaagaaaauagagaccuagagcuuccagugggaagagaggaaaucggugacagaacugaauuaagacaucuuucuagaaggagccauuuuccagccucuuaccacugcccugggugauccucuaggucacacaggagcugauaucaugguugagcccugggaaucucagccacgcucugucccugugcaucucauacaagcuuccauggugaugaaaauuguuaagaugucuuaugugaagcacaugggcguuggguuugcucaucacaagcugccugcugcugaugcuguuucaccuauuuaaaauacccaaguguugcuuuauuuaaaauugaacaagagucagccacuuagaacauuuaucaauaaacucaucacucaaauggaauugugccccugccccugcacuugcauauggucuuagauugcugcucauuuccaggcacagauggcuugcuucaaaauuuuuugcuugaacaggguaaaaaagcgagaguugguagcuuuuaaguguacaaacuugccaagaaaggaaaaugcugugaguggggaugauugcuggcaagcagcaggguccgauauaauccaugucuguccauccgugugucuguucuucagcccuguguggcagauccccuuccagugagugagcuuuagcaaauggagugucuaugacagcuauuugaaucauccuagaaucuacuggcuuaaagcugacagcucugacucuuccuuuaacuucuuaagugcaguguuuuggacagagauagaagcuuugcgagcaggcagcccgccagauucuucuaugucccagaucuggauguuagauuagaaaauuugauauuuacaaaugugcuucaccuugaauuagccaugacccaguugcuauuguuuguugaaagagauaucuuuuagaauuuuacuuauacaacugacuugcuuuucaaaagcacaauaaaaucuuauguucccauuauaaaaguacauauacucauuacaggauguuuggaaaauauagaacagggaaaauuuuacccacauuuccugcuuccauaaauaaucacuauuagcaguuggcguauuuccucccauauccuuuuccaugccuaggcaauggaggcuuuuuguucuugcaaccgugauacuuuuuauucaguuuuacauccuacuuuuuuucccacuuauauuaauaaauauuuucccauguuguuauaaacucuuaguaagcauucuuaaugguuguaugauauucuauuaaaugggugcaucuuauuuuacuuagccacacaucuauugaugaacauuuagauuuugucaauacauuguuguagacgaaguugugauggcuuuaaaccuuuuuuuuuuugcuuucgucuuuugaauuacuuccuuaggauagauuaccguaagauuuauaugagguaugaacaccuuuagggcccauuacacuuauauuacuaacuuguuauccaaauggauaucuguuuacacccccacaagcaauuugauagaaccuuuuuuucaucacguaauugccaacauaggauauuaucauuuuaaaaaaucauucuugcacugcuaggcaagaaaugguaucuaauugcagcucccuucuaaguguugauugagccuuuauuuaggaagguccugcuguguuuugcauaguucauuggaaauucuaggaaagugcucuugaaaaaggaaauuauuuauuuucauucuacuuuuucaaacuucucaccucccccucccaccccccaguuuuaagucaucuuacaugaagaaauauaagaccaaauuacagaagcagggaauuaaugauccaaagauucuaguuaacaagaugaucacccagguuucaaaaaauaagugaucucauuuuuauggcuuaaauauuuuaguaaccguugagugccuacuguuuauauuucuuuucuaggcugacuggcuugcuuccucccucccucccucccucccucccucccucccuuccuuccuuccuuccuuccuuccucuauuccauccucuccucuccucccuccucucccauccuagacagcuuaggugaagggcugacagagggaaauugacuggcuaaucuaugugcaguagccccugguuccugcucuuuccgcugaacaugauuuauaguuguuuggcagaaggucaaaaucugauuccauagagugggaaugcagggggaaauauuugauuucuuugacacaguucauuaaaaauucauacauauggaucuggaaaugaaacauugcuccaugucaacaugaguuacagugggagccuagagcaagacaugaguauucaagugagacacugucaccagguaaucacaucggcauggcagugccucucagugagacauggaagggggaaaggugaccuggacucuggaggguggaaaugaaauuuuucucuuuugccuaaaggcuuuccuuguaaauagaagccaguuuguuagaaaaccucuguuacaaagagcccauuucauucauguauucuuuuguccauuuguuugacaaauauuuauuuauuuuccacuauugguaagguguauauugauuaauaagagagaugacuuauuucaaauuucccuguuauuucuacuuuguuucuuaauucuuccucuuugacccuuuacuuuagagcuaucugacuuuuacaaugucuagacuucaagccuuuuauuauaaauacuguaaaugguuggaaacaugaucuucuagcccaguacuucucaaauuguaauguacacacaaaucaucuggggaucuguuaaaaugaagauucugauucaguagguccaggauggggccagagagaaugcaugucugucaaauucccaggagaugccgcugcugcugauccaagcaccauuugaauagcgaggcucuagucuaccauaucuguacuggguugaauaauguucuccauaaauucauaaccacccagcaccuguguaugugaccuuauuuggauauaguuuuugcagauguaaucaaguuaagaugguuuuauggucaacauucuucaggaaaauggaauuaauagaauaggauguagauagaaugauauuaauuuauuuuaaggaauugguucaugcaguuguucggggcuagcuaguccaaaaucugcagggcaggucagcaagcuggagaccaagagaagaguagauguugcagucuugagucagaagggagucuggaagcagaauuccuucuuuucccgggaaccucagucuuuucucugaaagccuucaacugauuggaugaggcccgcccacacuauuugcuugaacucagagauguuaaucucaucugaagaaauaucuucacagcugcaucuggacuggugguggacuaaaagcugauuaccauagccuagcuaaguugacacauaaaauuaaccaucacgaugaggucauacuggauuagggugggcccuaaauccaauaugucucaugucccuguaagaagaaggaauuuuggacacagagacacagacucacaggaccacgugaagacagaaacagagauugagagcuaaacacaauugauccaauggagguaaagaguagaaucauuaccagaugcaucuacaagccaaggagcacccaagauagccagaaaccaccagcagcgaggaagagacaaggaaggacucuuuccuagggccuucagagggagcacgcccugcugacagcuugauugcagacuuugggccuccagaauacauuucuauuguuuucaugccacgcaguucauggcacuuuguuacagcagcccugggaagcuagcacgguaucuaagacauaggccuacaacagaccuaagaacaucaucacaaagccagaaugcuugacuuuucugguaauuugccaccuugacacauggaugcagugucuggaaggugcaccaacuaaaaugcuuugucauucucauagaagagaaguucagagucacugugggugggaaugaauuggucaggaauccccuccucuuucuuagacucccgaguuggucugaaaacgcucaucgauauucuccucuacuuucucuucuggcccugccuucagguugcagggcagcccggugacaaaugaggaggagcugaauuugcuuuuuauuugaacaaacuauacuaauugaaauggaccccacugggauugcugucugccauaaguaauguauauuucauuaacauuuucuuuaaaaaccaacaagaucauaaagcuaagauugcuuuagccuaaaugcuguccagauuuaauaugcaugauauaaccuccuggcauagcacuaagcuugagcaugcaauuuuuggugccucccugaugcuuguuuuuaacaggaggagaaucaauacggggugaggguuagaccaacaacgugaacugucaagaaccagagaaauaauuaaaguuauaauauuaacaaaacaacaugguuguagaggggauggauaaaugauuuuauuccguuuuuuucuuucuucuuuuuuuuuuuuuuuuuuuuuacugccucaggcauauuuguuggcauuuucagaaggagauagaaucaggaguuauuuuucugcuaggaaauguuuaaguaaaucccaguugugaucaauaggguagccuccacaaagcaagcaaagcaguaaaugucacucauuucacuuuuuagcaacaguuguguguguguuagagccgaagucugaaaccagugacuucaacauuagccagggaguaucgaccaaaaucgguggugaggagauaaaauugcccuggaaaaguuggguuccccuuaacaaugguagcauggagaaaucagacuuccagauguugugauuucucagcucucuaauucaucaaauuaagaugacuuucaggacugccuggagauggacuucagacagaacacagcccacaucaugcuuugagcugaacacguuuaaaagaguuucacauugagguugaagcauggcugugcagaaugacauaugaggaaugacuguauucccauuauaggagucacccugcuuuuuuacucucccagaagaguugucuuauuucugauuugggugagugcagacuacaguuguggagcauuagcuggaccccugcuccuccuggggcaaaacaaauccuucuuauugaucugugagcuuuuuuauugauacauaaugauuguaguguuuaugggguacaugugauauuuugacaaaugcauacaaugcauaaugaucaaaccaggguaauugggauauccaccaccucaaacauuuaucauuuauuucugcugggaacaugccaaaucaucucuucuagcuguuuugaaauauauaauuauuguuaacuguagucacccuacugcgcuguugaauacuaggacuuauuccuucuguuuaacuuuacguuuguaccuauuaaccaaacugucuuuaucccagccucaccccugccacccuucccagcuucugguaaccaucauucuacucuuucccucugugagaucaauuuuguuuagcucccacauguaagugagaacauguaauauuuguguuucugugccuggcuuauuucacuuaaccuaaugucuuccaguucuaguuccugucauuuguuacugcaaaugacagaauuucauucuuucuguggcuaaauaguauuccauuauguauacauaccacauuuucuuuaucuauucauccauugaugggcacuuauguugauuucguaucuuggcuaauagagcugcauaagcaugggagugcaggcaucuuuucgguauccugauuuccuuuccuuugaauauauccucagcagugagauuguuggaucauggggguaaaucuauuuuuagguuuuuguauuuuuuaaguuuuuuaauucaauagguuuuuggggaacaggugcuguuugguuccauggauaaguucuuuagcgguaauuucugaaauucugguacaccuaucacccgagcaauguacacuguacccaaugugcagucuuuuaucccucacccuccucccacccuucccucucuggauccccagagugcauuauaucauucucacgccuuugccuccucauagcuuagcucccacuuguaagugagaacauaugauguuugguuuuccaucccugaguuacuucacuuaaaauaaugguauugaacuccauccagguuguugcauaugccauuauuuuguuccuuuuuauggcugaacaauauuccaugguguguauguguguguauauauauauacacauauauauacacauauauguacauauauacacacauauauauacauauauacguauauauguauauauguacguauauacguauauauacauauauauacacacacacauauauaucugacauuuucuuuauccacuuguugauuuaugggcauuugggcugguuccauauuuuuucaauugcaaauugugcugcuauaaacauguaugugcaaguguauuuuuuauauaaugacuucuuuuccucuggguagauacccaguaaugaaauugcuggaucaaaugauagaucuacuuuuaguucuuuaaggaaucuccauauuguuuuccauagugguuguacuaguuuacauuccuaccagcgauauaaaaguguucccuguucaccacauucaugccaacauuuauuaucuuuugauguuuuaaugauggccauucuugcaagaguaagguggaaucacauugugguuuugaucugcagcucccugaucauuagugauguugagcaauuugucauacguuuguuggccauuuguauaucuucuuuuuuuuuuuuuuuugagacggagucucccucuguugccagguuggagugcaggggcgcgaucuuggcucacugaaaccuccgccuccugaguugaagcgauucuccugcgucagccucccgaguaggugggacaacaggcacaugccaccaugcccagcuaauuuuuguauuuuuaguagagacaggguuucaccauguuggccaggaugguaucgaucucuugacuucgugauccaccugucuuggccucccaaagugcugggauuauaggcgugacguuuaucuucuuuugggaauugucuauuuguguccuuagcccacuauuugaugagauuauuuguuuuuuucuugcugaauuguuugagucccuuguagauucucgauauuaguccuuuguugaaugcauaguuugcaaagauuuucucccauucuguuggguuguguguuuacucugcugauuguuucuuuugcuaugcagaagcuuuuucauuuaauuaagucccacuguuuaucuguuuuuguugcauuugcuuuuggguucuuggucaugaagucuuugccuaagcccaugucuggaaggguuuuucugauguuaucuucuagacuuuuuaugguuucaggucuuagauuuaagucuuugauccaucuugaguuuauuuuuguauaaggugagagaugaggauccaguuucauucuuuuacaugaggcuuguccauuuaucccaacaccauuuguugaauagaaugugcuuuccccacuuuauguuguuguuugcuuuccccacuuuauguuguuguuugcuuugucaaaggucaguugacugcaaguauuuggcuucauuucuggguucccuauucuguuccauuggucuaugugccuguuuuucuaccaguaccaugcuguuuuggugacuauagccuuauaguauaauuugaaguuggauaaugugaugccuccagguuuguucuuuuugcuuggucuuucuuuggcuaugagagcucuuuuuugguuccucaugaaauuuaggauuguuuuuucuaguucuuugaagaauuaugauaauauauugaugggaauuagauugaauuuggagauugcuuuugcaauauagucauuuucacaauauucuacccauccacaagcauaggguguguuuccauuuguuuguguaaucugugauuucuuucagcaguguuuuguaguuuuccuuguagaggucuuucauguucuugguuagguauauuccuaagguguuuuuuuguuuguuuguuuugcagcuauugcaaaaggaguugaguucuuuauuugauucucagcuuggucgcuguugguguauagcaguacuucugauuugugcacauugauuuuguauccugaaacuuuacugaauuuauuugucagaucuaggagacucuagaagauccagagucuuuaggguuuuuuagguauaugaucauaucauaagugaagagcaacaguuugaccuccucuuugacaauuuggaugcccuuuauuucguucucuuguuugauugcucuggcuaggacuuccagaacuauguugaauagaaguggcgggcauccuugucuuguuccaguucucggggggacugcuuucaacuauuccccauuuaguauaauguuggcuguggguuugucauaaauggcuuuuauuacauuaagguaugucccuucuaugccgauuuugcugaggguuuuaauaaaaaagggauacuggauuuuugucaaaugcuuuuucugcaucuauugagaugaucauaugauuuuuguuuuugauuuuguuuaugugauguaucacauuucuugacuugcguauauuaaaccagcccugcaucccugguaugaaacucacuugaucaugguuggauuaucuuuuugauaugcuguuggauucaguuagcuaucauuuuguugaggauuuuugcaucuauguucaucagggauauuggucuguaauuuuauuuuuugguuauguccuuuccugguuuugguguuagggugauacuggcuucauagaaagauuuagggagaauucucuauuucucuaucauuuguaauaguuucagugggauugguacuaauucuuccuugaaugucugauagaauucaacugugaaucuguccgugccuggacuuuuuugguuggcaauuuuuuaauuaucauuucaauugggcugcuuguuauuagucuguuuagaguuccuuuuucuuccugguuuaaucuaggaggguuguauauuuccaaaaauuuauccaucuccucuagcuuuucuacuuuguguguguaaggguauucauaguagccuugaauggucuuuuguauuucugugguaucaccuauaauaucucccauuucauucuuuuuuauuauuauuaugcuuuaaguucuaggguacaugugcacaaugugcagguuuguuacauauguauacaugugccauguuggugugcugcacccauuaacucgucauuuacauuagguauaucuccuaaugcuaucccuccccccuccccccaccccacaacaggcccaggugugugauauuccccuuccuguguccaaguauuaucauuguucaauucccaccuaugagugagaacaugcaguauuugguuuuuugucccugcgauaguuugcugagaaugaugguuuccagcuucauccaugucccuacaaaggacaugaacucauccuuuuuuauggcugcauaguauuccaugguguauauaugccacauuuucuuaauccagucuaucauugauggacauuuggguugguuccaagucuuugcuauugugaauaaugccacaauaaacauacauuugcaugugucuuuauagcagcaugauuuauaauccuuuggguauauacccaguaaugggauggcugggucaaaugguauuucugguucuagaucuagaucuuugagaaucaauaucgugaaaauggccauacugcccaagguaauuuauagauuuaaugccauccccaucaagcuaccaaugacuuucuucacagaauuggaaaaaaacuacuuuaaaguucauauggaacuaaaaaagaaccugcauugccaagacaauccuaagccaaaagagcaaagcuggaggcaucaugcugccugacuucaaacuacacuacaaggcuacaguaaccaaaacagcaugauacugguaccaaaacagagauacagaccaauggaacagaacagagcccucagaaauaauacuacacaucugcaaccaucugaucuuugacaaaccugacaaaaacaagcaauggggaaaggauucccuauuuaauaaauggugcugggaaaacuggguagccauauggagaaagcugaaacuggaucccuuccuuacaccuuacacaaaaauuaauucaagauggauuaaagacuuaaauguuagaccuaaaaccauaaaaaccccagaagaaaaccuagacaaugccauucaggccauaggcaugggcaaggacuuuaugucuaaaacaccaaaagcaauggcaacaaaagccaaaauugacaagugggaucuaauuaaacuaaagagcuucugcacagcaaaagaaacuaccaucagagugaacaagcaaccuacagaaugggagaaaauuuuugcaaucuacucaucugucaaagggcuaauauccagaagcuacaaagaacucagacaaauuuacaagaaaaaaacaaacaaccccaucaaaaagugggcaaaguauauaaacagacacuucucaaaagaagacauucaugcagccaacagacacaugaaaaaaugcuugucaucacuggccaucagagaaaugcaaaucaaaaccacaaugagauaccaucucacaccaguuagaauggcgaucauuaggccaggcgcaguggcucacgccugaaaucccaguacuuugggaggcugaggcaggcggaucacgaggucaggagaucgagaccauccuggcuaacaugaugaaacccugucucuacuaaaaauacaaaaaaauuagcugggcgugguggcaggugccuguagucccagcuacucaggaggcugagacaggagaauggcaugaacccaggaggcagagcuugcagugagcugagaucgugcuacuccacuccagccuggggacagagcgagacuccgucucaaaaaaaaagaaaagaaaagaaaaaaagaauggcgaucauuaaaaagucaggaaacaacaggugcuggagaggauguggagaaauacgaacauuuuuacgcuguugaugggacuguaaacugguucaaccauuguggaagacaguguggcaauuccucaaggaucuagaacuagaaauaucucccauuucauucuuaauugaaccuauuuggagcucucuucuuuuuuuugguuaaccucacuaauggucuauugauuuuguuuaucuuuucaaagaaccaccuuuugucucauuuaucuucuguaauuuuuuuuguuucaauuucauuuaguucugcucugaucuuuguucuuucauuucuucugcugggcuuggguuugcuuuguuuuuguuucucuaguuccuuuaggugugaccuuagauugucuauuugugcucuuucagacuuuucaauguagguauuuaaugcuaugaacuuuccucuuagcacugcuuucguuguaucccagaguuuuugguagguuguaucacuauuauuguucaguucaaggaauuuuaauuuccaucuugauuucauuguugacccagagaucauucaggagcagauuauuuaauuucuauguauuugcaugguuuuaaggguuccuuuuggagucaauuuccaauuuuauucugcuuuggucugagagaauccuugauauaauuucaguuuucagaaauuuguugagacuuguuuuguggccuauuauauggucugucuuagagaauguuccaugcacugaugaauagaauguauaucugcaguuguuggguagaauguucuguacauaucuguuaaguuuaguugcucuaggguauaguuuaaguccauuguuacuuugcugacuuucugucuugacuugucuagugcuaucaguggaguauugaagucccccacuauuauuguguugcugucuaucucauuucuuaggucuagagguaauuguuuuacaaaccuaggagcuccauuguuaguacauauauauuuagaauugugauauuuuccuguuggacuaauccuuuuaccauuauauaaugucccucuuugucuuuuuuaacuauuguugcuuuaaagucuguuuugucuauagcuacuccugcucgcuuuuguuguccauuugcauagacugucuuuuuccaccccuuuaccuuaaguuuaugugaguccuuauguguuaggugagucucuugaagacagcagauacuugucugcuguuggugaauucuuauccauucugauauucuuucucuuuuaaguggaguacuuaggccauuuacuuucaauguuaguauugagaugugagguccuauucuguuccucgugcuaguuguugccugaauaccuugugggguucuuuuuuucauuguguuacuguuuuauaggcccugugggauuuaugcuuuuuggaaguucuauuuugguguauuucaagguuuuuuuuuuucaaaauuuagaacuccuuuuagcaguuguuguaagugcuggcuugguaguggugaauugucucagcauuucuuugucuaaaaaagacuaucuuuccuucauuuauggagcuuaguuucacuggguacaggauucuuggcugauaauuguuuuguuuaaucaggcuaaagcuaggaccacucccuucuagccugcaggguuucugcugagaaauccgccguuaaucugauagguuuuccuuuauagguuaccugaugcuuuugccucacagcuguuaagauuauuuccuucaucuugacuucagauaaccuguugacuaugugucuaggugauuaucuuuuugugaugaauuucccagguguucuuugagcuucuucucuuucaaugucuaggucucuagcaaggccagggaaguuuuccucaguuauucccucaaauacguuuuccaaaauucuggauuucucuucuuacucaggaauaccaauuacucuuagguuuggugguuuaacauaaucccaaacuucuugggggcuuuguucaauuuuuuuuuucuuuuuucuuugucuuugucagauuggguuaauuugaaagccuugucuucgagcucugaaguucuuuccucuacuuguuugauucuauuguugaaaauuuccaguuuauuuugcauuucucugagugugucuuuuauuuccagaaguuguaauuguuuuucauugaugauauuuacuucuaaggagacuuuuuucauucauauccuauauuacuuuuuaaauuucuuuaaauugguuuucaccuuucucuggugccuccaugaguagcuaaacaauugagcuucuuagaucuuuuucuggcaguuuagugauuucuucuugauuuggauccauugcuggugagcuagugugaucuuuuguggaugauaaagaaccuugcuuugucauauuaccagaauuguuuuucugguuccuucucauuuggguagacucugucagaggaaggauuggggguucaagggcugcuguucagauucuuuugucccacaggguggucccuugauguggugcucucccucuuccccuagggauggggcuuccugagagccagacugcaugauuguuauugcucuucugggucuagccacccaguggagcuacuggacuccaggcuggugcuagggagugccugcagagagucaaagaguccuguaaugugauccaucuucacgucucucagccguggauaccagcaccugcucagguggagguagcaggggagugaaguggacucuguccuugguuguaauuuuguauaguccgcugguuuucacaaaugcugcuugugcucccgauugguuggacuccagcaaggaggugaugcuuucaagagagcaucagcugauacaaccuaaggucgccuggauaaguauuuggguuucucaggccauaggcagugccauagagcuccuaagagauuaugucuuuugucugaauucagaguuuuuguuuuuuggcugucucauggaguuugcaguggcaagccacuuccuucaaagauucugugaaaucuuguggcuuuccugcuguguuccuguggugguuuuuggagcuaaaguucacgaugugaguuucuacaugcuguucuguccuucugagugggagcugcaaguuaguccugccuccucaccaccauuuuucccuauuuucaguuuuuugaugcuaccacaguuuuauaccacuuuguucucaaucccucagucucauccugcagaagcccuugccuccaacucuauggagaagaauuaaggccucccagugagaguuucuucaaccuccucuccagcccaggauuucaguuucccacuguuccccuccccgccgccagcccaacugcugaggguucucuccuggaaccugccacacuucuuugaccuccaugguucaucugcccaguggucuucccaccuccucauuccgucguacgccaaauccauccuacacucagugucauauuuguuuuucucaguuguuaccucucccacucaaaccccuuccaaaugccccuuuugaguaagcuccucaccauggcauucagagccgugcauuugaguccaguggacauauaccccaccucuaugccccaucaaaacuggauuguugaucauuacccaaaaagaucuugcaguuucucuccuuccacugaccagcgcuaauucccuucacaugaaauauucugucuccaucuccacuugcuaaaguuguuuccauccuucaagacucaaauaccaccuaccugaugaaucaugagcugauuuucacuucugugccagagacccucccaucccuccugccuuugaacauccauagcauguaauuuauacugcuuuuccaucacuuaugguggagaacuuguauuccugacacuugccuaccuugauuuguccaccaauuugauuguaagugucuugaggucauagaaguaaaagcaugccuuguuacccagaguaugggcugucugccuuugcuaucagaagccguccuuaauugugaacugcauugaauucucaacagagcaggaccugucucuguaauuuaaucuuuucccugacuugaacaacaaugaagcagggagacagaaugcucuggcugacaugggaaucccaggguguucacuaaguacacauucuuguucugcaucccuggagauuccgaaugaaaagguagagcccagauaggccagguaugguggcucaugccuguaaucccagcacuuugagaggcugaggcggauggaucacuugaggucaggaguuagagaccagccuggcuaacauggugaaaccccaucucuacuaaaaauacaaaaauuagcugggagugguagcaggugccuguaauuccagcuacuugagaggcugagguaggagaaucacuugaacccaggagguggugguugcagugagccaagauugugccacugcacuccagccuggguaacagagugagacucugucucagaaaaaaaagguuagagcccagaaaccuguauuuuuuacaagcgucucagcucagaaguucauugcuacuaaaacaccuugugagaaccacuggggcaguggaccaaauaaaguugaguuugaauccaguucuucaguucccuaguugugcagaccuaagcagccuccucaucuguaaaaugggauaauacuugccuuuuuaggccacugcagggagugaauaaaacaacggauguagcugagcucgguggcucaugccuauaauuccagcacuuugggaggcugaggcaggaggauggcuugaacccaggaguuugaugccagccugggcaacacagggagacccccaucuguacaaaaaaauaaaaaauuagccggacaugguagccugugcuugccugugguccuagcuacuugggaggcugaggucggaggcuugcuugaacccagaucgaggccauaguaagccgugaucacaccaccgcacucuagccuagacaacagagcaaaacccugucucaaaaaaauaaauaaucaaaacaaacaaaaaacaacauauguaaaauggccagcccaacgcacagaucaggguagaugcugugucaguuuucuucccaaagugccacauucaguucugcauccugguuccaggggguuccuaccugccucgguacacuaucauuuuuccucauccucagcauuaguugaaggucucuuccauccuaagucagcagcucuucuucagcugggauuugucugccucuucacucucuucugcuuguggcccagaggaccugaguugcagaggucacaacugcugugcuggcuuucuuagaacaccuuucuguugggccauuuacucaacauacacuuguugagugucugcccuguggcagauucugucuuagagacugguuguacagcagugaauacaaugagcccaaaucccugucuucauggacguauagucuagaggcacuguacauguagaaguaaguaggaaggugcucaaggaggccugcgaggagaguggcgggagcuggggacagcugaagacaggaggcgugugccagacagugaagccuuaugaggcauugaagggacuuuugccucuacucugggugacacggagcgcauggacaguuuugaguggaggaguacccucauguggcucauauuuugacaggaucaucuggcugcuguguugagaauagacugcagaggguagugguggacaugaggaagcagaugggagacucuggcuguaauaagggguagguggggguuggggguggggugcggaugguggccaaggccagcgugugccaauuggugugguaagaacggucagugcgggccaugcuuggaaaguagagaccauuggaauugcuuguggauuugauguagagugugagagaaucgcuaaggauggcaccaagguuuuuggccuaaagaaauggaaggacggagcuaccaguaacagagauggggcaggggcacacauugcagaaagaacacaucaggaacucagcuagggauauauuaccuccugaaauucaguguggccuuggguagcugaucucgggcagagauuggugacucuuguccccguguguggcucaauguuaacuuuuuaacgaucagaugcugaccucucccaauaaaauguauuaacugcuggcaccacuucaaaacucuggcuagucuuuaaaauaacuaguuagcuuucauuacaaaaguaauaccuacacaugguaaaaaaaaaaaaaaaaaucuaagaauuacaggacuaaggugaaaaaauaagccuuccucacuaccccugcuuauuguucucugucuuuuugcagcuauuuuuccacaaauuacuguguccugagcccugagcuaauuaagugcuggauaagcaucaccucccaguaauccuguuaucagccuuugaaauguagguagcuuuauuauccacauuuugcagaugaggaaacagagucaggugaagugucuuuuccaaggccaagcuccugagggcaggggcucaagcuuaggccuucagacuccaaaguccagaccgucccugggaacaagcacccuagguuuucacauggagccuccgaaacgccucuggcaucuccugcugugggguuggauaugagcugucuuauauagacccuaccuaaauuaaauuaaaaucgacuaauuaaauguggccucuuugaauacacugccguauuucuaauuacagcuuuccuucucuccugagaaggcagcccaacauuguuucugaaaagguccucaauuacuaaugguuggauaacauuuugaaaauguaagugucauuaaauuguuaguuagaaggcccugaguggggaugagaggauggaagucaguugucaaccgucuccucucucucucuguuucugucucugucucucacacuuucucucucucacuguuucucucucuguaauacacauaugcacauccuuaucucacaauugacccaaagcaucagaaauaaaaagucagacugagugaccuuagcugcuaggaagcaucuuauugugccuucccucccucucugacuuuggccuugacacugaucugagccugcagauaacagaaaggaggagcuuaucuagacaggagugguggaaguagccaguaacaaaucauugaagugaggagaaugaagguaaagaaauugaucagcuuuaaauaggaggugacuccgcauuccucuugcuuggaaaugauccccaggauggaauuguguccagggugugagguuguuugugaaucaguccuuuccagauagaauauaugaggcuugaaacuacauagugcuuaucaccaagagguauauagguuugucagagcaagaagaccacucuccccuccaccugcccccgcaaaaaaaaagaaagguaguauagagacuuagaaaguagagaaauauagguagaaguacaguaccuuugagugaccuucagaauucgguccucuuggcucaaaauuuuggcaucauuucaacaaacuauuuuuuuucucuccucauuugauuuccccuucaagaagacagggagugagugggcuccaaucuuggcaacguuggcugcuuauuagagcauuugcaggccuaggagauuugcuccuccucuugguaucugaaguuccacaagccccuuguucacuuccccuggaguagggauuguggaauguugccacucaccuucaguucccuguugaagcucuugcagaccccuaauagugcaugcuaccguucugcagagaagaccaugaugacaaaccacagacaucccccuucaucuauugucuucugugucuuugggaaggcauuccuggaaugacugggggcugugugucucaguuuaauaaugcaagcuuuugguuuuuguuaaacacaugcagagccugauauuaagcauuaaaccaaggagcuaggcuaagacaguugugucaagaaguuguugucuuugaagaagcacaaggaauuuaaagggaugaggaaacaagaagggggccuauccaguugggaccacaauacaaaauugaauuuaucauuuaugaauaauggcuucuaguuuuugaguacuuacagggucccaggcacuguagauggugggacguagacggugggauggugggaaggugggagacccagagagcuuaagugauccagcccuagacacacgguguuaguuaacuuuugggagacacuucacaagcuggugugaaugaaagaaaagcagcauguacuuuuacaaaccuuaauuuaagcaaagguaauaaauuucaaccuacucaaagcagaacuagggugugauuacuugcuuuguaaaagauuuuuugcuuuggaaaguuagaaau

SEQ ID NO: 13297 - RNA, 2441 nt, Homo sapiens
agcagcugggaagcggcggggacucgaguucccagcgccgggcggagcgccggacagagccccgcagcgccccgcggccgcgauggggccgaagcgcccgaagccccggagcccacaaacugccgggcccgccucgccgccgggacccgggugccugggcucggcuugaagcggcggcggcgcaccggcacagccgcgggagcaugggcaggaggaugcggggcgccgccgccaccgcggggcucuggcugcuggcgcugggcucgcugcuggcgcuguggggagggcuccugccgccgcggaccgagcugcccgccucccggccgcccgaagaccgacucccacggcgcccggcccggagcggcggccccgcgcccgcgccucgcuucccucugcccccgccccuggcgugggacgcccgcggcggcucccugaaaacuuuccgggcgcugcucacccuggcggccggcgcggacggcccgccccggcagucccggagcgagcccagguggcacgugucagccaggcagccccggccggaggagagcgccgcggugcacgggggcgucuucuggagccgcggccuggaggagcaggugcccccgggcuuuucggaggcccaggcggcggcguggcuggaggcggcucgcggcgcccggaugguggcccuggagcgcggggguugcgggcgcagcuccaaccgacuggcccguuuugccgacggcacccgcgccugcgugcgcuacggcaucaacccggagcagauucagggcgaggcccugucuuacuaucuggcgcgccugcugggccuccagcgccacgugccgccgcuggcacuggcucggguggaggcucggggcgcgcagugggcgcaggugcaggaggagcugcgcgcugcgcacuggaccgagggcagcguggugagccugacacgcuggcugcccaaccucacggacgugguggugcccgcgcccuggcgcucggaggacggccgucugcgcccccuccgggaugccgggggugagcuggccaaccucagccaggcggagcugguggaccuaguacaauggaccgacuuaauccuuuucgacuaccugacggccaacuucgaccggcucguaagcaaccucuucagccugcagugggacccgcgcgucaugcagcgugccaccagcaaccugcaccgcgguccgggcggggcgcuggucuuucuggacaaugaggcgggcuuggugcacggcuaccggguagcaggcaugugggacaaguauaacgagccgcuguugcagucagugugcguguuccgcgagcggaccgcgcggcgcguccuggagcugcaccgcggacaggacgccgcggcccggcugcugcgccucuaccggcgccacgagccucgcuuccccgagcuggccgcccuugcagacccccacgcucagcugcuacagcgccgccucgacuuccucgccaagcacauuuugcacuguaaggccaaguacggccgccggucugggacuuagugucaccgggaggaaaagagagagaucuggggcugggguauggaugauggggggaagggcggucgccucugccacugucagggaccagccggccaacgcccacccgcaaaggugucuaaaaacuucagcuuuucacccaccugccccuuucuuucaaucccacgcuguuuccuuucaaaguucugggaggacgaacucaccgaggcgagaaguguaacauucucuccacccagcuuauaaaaggauucuuuacugugccagcacggggauuggauccgaagaaacuggcuacugggguuuggcccccgaguggccgucccugugggagaugcaccccauucuugggcccccccucauucccuuuccgaaaaaggaaaacuugcguuugagccguugagcuaauucugcaauuuucuaccaaacagagcgcugguggccccggagcagggcugugacauuggcugguggagcccccuuccuguguucucccuuuguuccagcgccgcgauggugagaucacuguuccaagcagggggacggcucgcgauaggacaaagagagcaggaccuccagacucuggggagcccugcagaccuugacaauuugccugacucauuccugaccucuugucauuuuggccugaaggcuacaaauucagggucagcuguaugcacuaagucaaauaaugaauuucuuccucccucucgcaaccgaccaaaauuuugacaacgaugauguucaccagaaggaaaaaaaaaaaucaguuuuaugcacuuuauuuuguuuugauuuucauuuuuuauuaagaaaaaauuuuauuuuacagaauuuaccuucucuguauauaugugcauaaagugugguguaaauauacuaaacaaacuuauauuucaauaaaagggaguuuaaaauuuauaauuuaau

SEQ ID NO: 13298 - RNA, 3116 nt, Homo sapiens
gggagauggccuagguguucaaggggcacgugcacagcgaggcuucauucccugggaguccguugggaaaggcagagcggccaauacugauuggugcugaugugcgagcucggaaaagggagugucgguucaaaguuguuggcuacagcggguuccucuuuccgcuggaaucacauccucuguggcucggagacauucccagagauuuacauaaagcagcgugaaucacccagacagaaacugagaaagcaaagggacccugccugauccuagccuggcggagcucggaaagagguggaaaucugucugaaguuugcaggagacccgcgcugccuaggcaaagggacccggcgaccaagacacccccgcgagggcccagggcgcgucccucccgccaggccccagacuccggcucugcgccacccccuccuacgccccggcgcgggcgcagccaguccggcuuccuccaggcccccaagucccggaccgaguguggggccgccucucccucucggaaggagccaucgccgcuuuaaguggaagaggagaggaagggggcgggggagcggggggcggggagcggaggcggaggagggggagggggaucccccuggcucccacgugguccgggcgccugugaaucgcgcccaccggagggucucacagcgaaauacaaaagcagcugggaagcggcggggacucgaguucccagcgccgggcggagcgccggacagagccccgcagcgccccgcggccgcgauggggccgaagcgcccgaagccccggagcccacaaacugccgggcccgccucgccgccgggacccgggugccugggcucggcuugaagcggcggcggcgcaccggcacagccgcgggagcaugggcaggaggaugcggggcgccgccgccaccgcggggcucuggcugcuggcgcugggcucgcugcuggcgcuguggggagggcuccugccgccgcggaccgagcugcccgccucccggccgcccgaagaccgacucccacggcgcccggcccggagcggcggccccgcgcccgcgccucgcuucccucugcccccgccccuggcgugggacgcccgcggcggcucccugaaaacuuuccgggcgcugcucacccuggcggccggcgcggacggcccgccccggcagucccggagcgagcccagguggcacgugucagccaggcagccccggccggaggagagcgccgcggugcacgggggcgucuucuggagccgcggccuggaggagcaggugcccccgggcuuuucggaggcccaggcggcggcguggcuggaggcggcucgcggcgcccggaugguggcccuggagcgcggggguugcgggcgcagcuccaaccgacuggcccguuuugccgacggcacccgcgccugcgugcgcuacggcaucaacccggagcagauucagggcgaggcccugucuuacuaucuggcgcgccugcugggccuccagcgccacgugccgccgcuggcacuggcucggguggaggcucggggcgcgcagugggcgcaggugcaggaggagcugcgcgcugcgcacuggaccgagggcagcguggugagccugacacgcuggcugcccaaccucacggacgugguggugcccgcgcccuggcgcucggaggacggccgucugcgcccccuccgggaugccgggggugagcuggccaaccucagccaggcggagcugguggaccuaguacaauggaccgacuuaauccuuuucgacuaccugacggccaacuucgaccggcucguaagcaaccucuucagccugcagugggacccgcgcgucaugcagcgugccaccagcaaccugcaccgcgguccgggcggggcgcuggucuuucuggacaaugaggcgggcuuggugcacggcuaccggguagcaggcaugugggacaaguauaacgagccgcuguugcagucagugugcguguuccgcgagcggaccgcgcggcgcguccuggagcugcaccgcggacaggacgccgcggcccggcugcugcgccucuaccggcgccacgagccucgcuuccccgagcuggccgcccuugcagacccccacgcucagcugcuacagcgccgccucgacuuccucgccaagcacauuuugcacuguaaggccaaguacggccgccggucugggacuuagugucaccgggaggaaaagagagagaucuggggcugggguauggaugauggggggaagggcggucgccucugccacugucagggaccagccggccaacgcccacccgcaaaggugucuaaaaacuucagcuuuucacccaccugccccuuucuuucaaucccacgcuguuuccuuucaaaguucugggaggacgaacucaccgaggcgagaaguguaacauucucuccacccagcuuauaaaaggauucuuuacugugccagcacggggauuggauccgaagaaacuggcuacugggguuuggcccccgaguggccgucccugugggagaugcaccccauucuugggcccccccucauucccuuuccgaaaaaggaaaacuugcguuugagccguugagcuaauucugcaauuuucuaccaaacagagcgcugguggccccggagcagggcugugacauuggcugguggagcccccuuccuguguucucccuuuguuccagcgccgcgauggugagaucacuguuccaagcagggggacggcucgcgauaggacaaagagagcaggaccuccagacucuggggagcccugcagaccuugacaauuugccugacucauuccugaccucuugucauuuuggccugaaggcuacaaauucagggucagcuguaugcacuaagucaaauaaugaauuucuuccucccucucgcaaccgaccaaaauuuugacaacgaugauguucaccagaaggaaaaaaaaaaaucaguuuuaugcacuuuauuuuguuuugauuuucauuuuuuauuaagaaaaaauuuuauuuuacagaauuuaccuucucuguauauaugugcauaaagugugguguaaauauacuaaacaaacuuauauuucaauaaaagggaguuuaaaauuuauaauuua

SEQ ID NO: 13299 - RNA, 93591 nt, Homo sapiens
cggaggcacaggcaccccgcgacacuccagguuccccgacccacgucccuggcagccccgauuauuuacagccucagcagagcacggggcgggggcagaggggcccgcccgggagggcugcuacuucuuaaaaccucugcgggcugcuuagucacagccccccuugcuuggguguguccuucgcucgcucccucccuccgucuuaggucacuguuuucaaccucgaauaaaaacugcagccaacuuccgaggcagccucauugcccagcggaccccagccucugccagguucgguccgccauccucgucccguccuccgccggccccugccccgcgcccagggauccuccagcuccuuucgcccgcgcccuccguucgcuccggacaccauggacaaguuuugguggcacgcagccuggggacucugccucgugccgcugagccuggcgcagaucggugagugcccgccgcagccugggcagcaagaugggugcggggugcucagcgcggacccggcggcagccccuccggcugagucggcccugggggacuggagucaagugagcugucugcgaagugcauugggcuccggaaagcagggcugggauuugcgcuaaaccguuggagaaugugucuguggaagcaccauuugguugaaagaaaaagagaaagagaagaaaguuuguugggcaggcugccggcgcgcaguuuugggcgaggucgcuagagcugcagcacauggcagaaaguaaccguucucccggaugcgcacagucguugucuggacuaacaggcuccugugcccaagggcucgccaagccccaccgggcugugucuaggcagggcagagcugggcggggcagagacuggggcuggaacagggcgaguggcuguuaucaagguggucacagaagggaucacaauuccaagugugagacuagcuggcaauggguuuuccagaaagggguccuggguucucccagcuccccacugagccuuguuccaaagcuuacaguccgcagugucacugccaccuuagcgcuguggaagcuugaaccagcucugcggugaggucuugggucuccaugagauuccagccugggauagggagcaugaauaugagaggcaaccacuggaccagcugcuugguccucaccaccuccugcuucugccaaucaguguggggaaaucucaacaguaagguggcuuauauucccugccuggcagccucagagcagagagaagagccuugauaccagggcaacaucagggacccuggagcuagggcuccaauaucucauccaaacagggucagugcuuugugguggcuauggaggggaggggcugcguguaagguauauucuagcacggcucaacuccaagcauucucuuucuuugucuauguauguacagauaauuacauggccgauuugcuuaucgcuggccaaaauuaaucuuucuuuuaagaagugccagcugggucauuaagacagcucagccugcaugcaguaaauucuacucagcaaauauuuauuaacccaguuccacgggaguacugagaaauugaaacacacagucucacccagguaguuuagauugaguacccaguauaaaguaucuugaauuacuuucugcuuucucuaucuuccuacuuucugcaguaggaagaaagugacccuagguggaggcuaggcaggaugaguucucugugcauaugcaucucccuuucugugugagugagaggucuuugcuagguggggauuuggggaucuaggauuuauacuacugaagcugaaauaauaauaauaaugauagcaacaacacagccugucaugguggcccaugccuguaauccuaggacuuugggaggcugaggcagcaaauuacccaaggucaggaguuugagaccagccuuggccaacauggugaaaccccaucuuuacaaaaaauacaaaaauuagcagggugugguggugcacaccuguagucccagcugcuugggacgcugaggcaggagaauugcuugaaccuaggaggugaagguugcagugaaccaagauuaugccauugcacuccagccugggugacaaagcgugacucuguuaaaaaaaaaaaaaugaauacagugcuagcuaccauuuacuguauauuuucacugugccaggcauuauguuaaauauuuuccauguguuaucucauucuacccucacaauggccuaguaagaagcuuccuguuaucaggccuguuugacaggaggaaaacugaugcuuagagacguuaagugacuugcuggcauucacauagccaggagcagugcuggauggaaacccagcuccacugagcuccaaagccuaggcuuagaauauguuagacuguauaagauggacgaacuuggaaggauuucagggagggaaggauuuugguggacucuaggccuuagggaaaguuccaaaagggacuggagcucaaauaagcccuugaaaaguggaaacauucaggaugggagagaagagucaagcuggagaucagggagagcccugggccuggccugaaagaagagggcccuggugguuucccuauagucucuagggaaguuuauuuguauguuaccuaccagugccaucuucugcuuugucuuugggcauucugacuccugacuccuuccaaccugucuccccguuccuucuaaaaggccccacuuccaaauauuuggcacuguccuaacccuugagguucucccagagacccgcagucucccuccugccccguguuuccacggccccuuugcgcagcaucauuuagaggaaguacaaugaagugccaguagcaauaacugccccggcccucgcuuucaugugcuuguaaaguuguuuggcaggaacugggacuuggaaaggagacaugacuuugucagagggcuuggggcugggcaugguguggguggcgaaggggagaaggaggaaaggggaaggaaaggagcucuuguugccccauucuggggagugguggacucuggacaaccacgaggaaacuuuggaaaggagcaaggcuuugaggaggaguccagucuuuguaugggaaagcaaaaaguggagaaauggccaaauguaguuaagugacauuggacccagaaacucugaguuggggaacagauaucuugaauucggggucuugugcaggaggaagaaaguggcccuugguggaggccaggggggaugaguccuucaugcacaugcaucuccuugucucugugggugaggggaucuuuuuuuuuaauuauuauuauacuuuaaguuuuaggguucaaccauuguggaagucaguguggcgauuccucagggaucuagaacuagaaauaccauuugacccagccaucccauuacuggguauauacccaaaggacuacaaaucaugcugcuauaaagacacaugcacauguauguuuauuguggcauuauucacaauagcaaagacuuggaaccaacccaaauguccaacaaugauagacugggugaggggaucuuugcuugggaauugcaugccugguguugagaaagaggagagcgucugagagcccugggucuuagggcuggcacacaccuuucugcucccuucucucuaauugagcauuagagacuccgcccccugcugggaguuagaacuuuagcuguguuuucccaugugaaggagcaaagaggcaaagcuucaucucuguuggggcuagcaucaacuaauucagguauuccccauuuacacauuggacaucuacuugcugcaaaggcauggugacaaguccuugugugggaggcuggcagccaguaggaaaauguuccauuuguuuuuucccaaauuuccccacaaaggaggggaugcuggacagcaugaaauucuuaguucaugacagauucccuuccauucauucaggaacuauuuccugacucauugucauagacucagagaugggaacucuaaggaucauuuagaaaaucugaaagagagggacuagugacuuccccucucugcgacuuguuaagauauuagggcagggcauuucucucauguaucucuaucaugaggacugugggagccucaaccccacccccugcaguggguggggaggguguggucuacugggguaacaacauuuguuucacaccuuaaauacuaccuuacagacucauuacaguuuuauauauuacucuacaauauacccaauuugaguuuaauacaauaauaaugauauauauuuuugaccauauagcaauguugguguucgacaaugauucucuguauuguccuggggcuucuagcaccuccuggaacaucgcuagauggucaggagcaccaaaguuuuaaaaaccugaugcucugcugugguaccauaugguccuguguaaagcaggguccuaaguccugagucucuaggaaauacugcucagugagcacugacucuauacuagaugugaagccggggguagcacaggauaucuuaucuaagccucccaacagcccaauacaccuagcacucucuuuaacuccauuuucuagauaaagagaucgagacuuguggagauggcaugacuugccccaggauccagugguggaguugggauuuccgcauuaucuaacauccucccauguuagacuccaaugcuuaugcuccuucaauucauuacgugucuggaggacuuuggaagcuauacguggcucucccacacuaccuguccccuguggccagcauaagugaacucuugcauggguggcuucucucuccauccccggcaggcuguggacucuuggcugcccugcccuggccugucucuccccagguuuggccacagauaucagagaugccaaccaaguuauuuguaacuaaaauaaaucacaucccuuaucagaguccagcugcccucccagauaugcucugauuuacaggcuuggaauaaagagagaggugguugcuugucuacaggacaaguuagggcaaugcccucugccugaauauuaggaaagcagcauuacaggagcucucacucugaccaggcaagcauuucacaugcacagacccagagacccacuccucacaugcucauuaguagguugugcgacccuggguaggaggcugacaugggucuugaacugaaacccaguguguggcucuaggugacauguggccacccaagugagguuucggauccaccugcagugucagaugcuucaaggcugggguccccugauggagaggaggugguuggagaucaccugggccuccucagcacugccuccuggcuggggcuggggcuggggauaagagaguaacugcaauugugcuuccccggcaccuucgcuuuaggucacuccaccgaagagccugaaagggaagugguucuugcgaaagaaugagcugaagcagguggcagaugcuaccaggcaccguguaguuuucaaaggggaucuuuuucugccucagagagaaauucugggguuugcacagcaagaaaccgaugacucaauuuccuuugugucccugcuuuaaugggaagguuguaggcguucuuuagaauggcaggguagguugauaccuucuaccuuaaauuugaaucccacuuuucacucacuuagcagguugaauuuuuuuuaaguguaccccccacagcugcccaacuggguuugcgaggcaagcccaacuugccagaguaaaccggaaggggugcuuucuaaaguuugugguucuggagucuggccaggcauggauacagucauugugcguuccagauuuucugggagagucaggaucucaaauaugcaaacacucuaccaauugaugucuagugcauauuuugacuaaauguuuauauauuuuuccacaaauaaauacaugacuuaauguaauugaaagucaaacacuuuuuaaaaaugcuuuuugcauaaagaaauucacaucuuuacaacuccuuaacuaggauggugucaauuaaauuaauguuugauucaggacauguguacuuuggagguaaguauuucauauuccuccccucuccauugcucaauugccccacugggugacguaccaagauaagccacauguuugauucuuguuugcuggauguggacauaugcacauugcagguaugccuauaaguacaugccugaaggaucuauguguguggugggaauuggugaugccaaagaaugcuaaagacuuucaugccccuuaaaggggaaaauaaccacaacaaaacaaauuccaauguaucuucuccugucuucugcagcacugggggaguccccugauaacagggaucaugucacauucauuuuugugggcccagaucccaguaauauugacccauaacuguugaacugcaaugaaugucuagaauauaaaagucaugauaucuauauauauggaagcaugcugucaguaugggcuaaggugcaaauacauuuauguguaagugagaaccauggugauggcuguguugcucaggacagggcugacuuggcuggcugacugcccaccacaggccucauguuuggucuaccccaaacagugagcucacccaucuguuuguuugcggcuuugguggcugccugcugugaccgcuggggacaucuggcuaaagacaggguuacuagauaguugggcugagaagggagugggagccagugagaugaggacaccaaccccaaauuuaagccucaaaacaaaaacacuccccagcagcagccaccuugggguucuaguuauuuuggagauacugauacgagguugagauccuugggugagaggcccacacuccuccaacccccaugucugcuucuggaaggugguggcagaggagagaaguagaaguacuauaugggagaugcgggagauucuugccuucucugucggucucuuugggcaauuaucaagcugucaucugaccagauacuaccauagcuucuucgggggcaaauccguagggaauccugacauccgacggggagccacuuuggcaauggcaaacggugucuccucuccacagagcuugugaugucagaaauuacccauaacuggggcagguuuugucuucccaaagauugucugcccagcuagaccugagagacagggagacaaacacagaaugagggggugggucuuguggggguggggaacgauggaaacucacagagccagaucuccccgaguuugaguugcacuggcugccuggguguguccuccugagguaagugucccugcgaagugcaagugugggcagacagaucucagguggguggggagggacugagucaccaaggaggugauuugcaaaacucaggucccagaaacuuucaggucuucagcuuuuaaaaguaaagguuaauugcaaaacuccgggguugagggaagagauuauucacauagaccagucauuuugagcaucugcuguuguggcauugcaagucuccuucgcagugccugaaaguucauuuguuuuugagagcucuuacgcuuuuucuguuugcaucuuugcacaaguucuauguuucugagaacccucaccacuauuaguaauaauagcaaacacuuacagaguguugaccauguaccagcgccauucuaauuguuuccuauauacugccuuguuuaauccaaacacugacuucaugaagguggugcuguuauuaucugucuuuuacauaugaggaaacugaggcacagagaauuuaaguagcuugcccaaggccaugcagcugauaagugauggcgcugggauucaaacucacaucuggcuacagaguucaugcucuuugucacuauguuagagugcuucucuugguauauuaagauaucgaggcacccuagaaauccagacgauuguaccuggaaguacuguaguuguuuucaaaaacuucauuugggaaucuaguugugggugaggucauaacauccacugagcuuuuaaacaugaugucagaggaagggguuagaauugcaaaaaugaaggaggaggaaguuguaauggaaacuucugccaaugcauauucugaguugacucauucauucugaucucugaauagaagcucuacucucuuccaugugauggaaaguugaggauaggguagggcugagagggaugugaauugaguuguuuguucauuaggauaggauagggcugaaagggaugugaauugaguuguuuguucauuaucacuucauuauuugucaccuggaugaaagguaaagguggcugauuaguguuucuccaucagcuagaacuuugacugggaaaugagccaaucaaauagcagcaaaauauuugcccucaccuuacaggcccuugguuccagggucuucucuccaccggcuagaauggaugagggagggagagaaacucugagaaaagaggcugucaggaguagggcuguacauauccagggcacaaggaauuuggcaaaagcuggaaguauacuauagcccuucucuccagcccuagccuaaaccagaugaccaggcuucuauuuggcccagcaugugaccaucccaucagggagcaagagaguuuccucuggguaccccucacugagaaaaaagccacccaggaagggaggaggcaaggcccccugggaacaucuggcucaguccacaggaagggaugcaggccuuuuccugggaaugaggacucaucccauauuccagcccccuucccccaacuuuuuuuuuuuucaauuuuagugcaucucuuuacacuuaacaggucugcagugacuucuaggaggauccacacaccaaucguggaacuaggcagcaucuuuuuccacuuccuuuccaagauaguagcacgauaacaguaaagccccuuugcaaguguucacuauuaugcacauuaagaugccagggagagggcugggaaagguggcucacaccuguaaucccagcacuuugggaggccgaggcaggcggaugaccugaggucgggaguucgagaccagccugaccaacauggagaaaccccgucucuacuaaaaauacaaaaaaauuagccgggcaugguggugcaugccuguaaucucagcuacuugggaggcugaggcaggagaaucacuugaacccgggaggcagagguugcagugagccaagaucacgccauugcacuccagccugggcaacaagagcgaaacucggucucaaaaaaaaaaaaggugccagggagaaaugaacaauuccaugcagccaacaccuggucuccugcguuuggcuuagaagggcauuucugcccaagcccccagcucuagucuuugcacacuuuaaaugaguagcuacuacaugccaaucacagauguugccucugcugaguauccagucaaaaaaccagaaucuaacagagcuaacuaagcaccaucuugcaggaaaccagcugacgucagcuccgcagccaccagugaguuacugggcccacaucugccugcaagagggggaggggaauucagguaacccacaagaggggauaaaaguucggggaagaaaucuccugucaaggaguuuguuuuugcaguggauccucugcagugagacuaguugucuuuacaauaucauuagaggucagguacauuccuguagacucccuuaagugacuugcuuucuccuauuguucccccugaaaauucauaaaaaccucacaaacacaucuccauuuaaaaagagaaaguuuaaaggaugccauguaaugguuaucucuuuucuuuugccagugagcauaaaagcuccuuagggaaaagcccaaacccucuauacauuuucauauucaugauagcccugagcggucagcacaguuccccaauuauagugggugcucaauaaacacuuggauggcuuacugaauuaauaauguuucuagacuuggcuagcaaagccaucuccguuacuuaucuuuugugauuuuuauagguucugucuaauucuuuuucuucauuuuuuuucuuucuggucuauacaaaucuucuuucauuuuucucuauugcuacuuguagcgauccucaacccgccuccucccuugaaauuucuguucucugcacucucuucagucuaaagagaucuuucuugagguuugaaauguuacacaaggcaggggaaguuuagagcuaauuguauuuuguccaguagaacggggaucuggauuuccuauaggucuggcugccucuuugucuacaccuuuacuuccaaaucuggccucauguauaaaaagaccccaaaccuuaaaaucauguucucaacaauacucagagaaaaauuguuggcuuuuuggucaccaugcuagaggaauaaaagggcaguuguuucuuucggucaaugguuugaaaaccucccagacuaaaaaucaccuccauauaaucagaugcuuggugugguguaaugaagaugaggaggucuggcuuugauaagagucauuuagaagguauaaaggcaguggaacaagacgggaggacccauacaccaguugauuccccucuugccacuuaacagcagcgugagcuugggcaguugcacuuguuaaaugucuggaacaauacuuagcacguaauuucuaaagcuuaauguuuaguucacagaagguaucccaagaauagaaaugauuauuauauuuuagcuucucucuauuacugauucacuaugugcugcuaggcaaaguauuucacccccauuuacuucuauuuuuccauguguaaaaugcgaggguuggauucuaguugaucugucaaguccuuuccaggccucauguucuauaaauucaccacucugugggcuuacuaacaccugagccucauaaaaccuaauggaaagaauaacacaaaaccaccauaaggcagugucaaaaaaaauugaugccugauuuguauuaaaugucaaaagugaauuauuaauccaugccagaaauaaacauauggacccaauuacacucuaacuccaaugggcaagaguguuguagggacaaagugcuuugcccguaguacuucauagaauccucuagaccauguggaaggugagcagaugaagcagcucuggccagagaaguuaggaacaugucccagucacacaacugaaacugcaggaagucaguccugggauuaacugcaggaucugaacacuguacucuuuauauuguacuuuaaaaacauugcuucacauggccagaaaagccaaccucugaagaagagaaaaauuguucccuucacucucagagcuucaugagcaccuuggacuugccagcuuuccucaagcaaccccuguaacuuguuggcacaaaauuaaccacaauauucagacaaagcaguacuuacagggugagugcuaguauccuaugcaacuaggguagccugagaaucuaggggaaaaaaagcuagaccaaacaaaagauuauauauaaucuuuccccaaaucaaggcacugagcaaggcaggccugagagauggugaauuucugcuucuacugagaguccuccagacccccaguaaaaauuucuuuucaucauaaaaccagagaaacucuugcucaggaaaaagaaagaaaaauggaaaucauaaagauugcacgacuuaggauuuugucaaaaugugucagaggcuauaauauaaggcuaguuuuuggcauucugucagucacugaauguccuucgucagaucacagcuccuuuugguugugcugacuuuauacccaucuggaauccacugaccauuagcugaaauaaaaucccagaugugcucagaucucacauccugugcaaugcccucaguuauugcugauacgguucagucaucugucucuccagcuaaucauacagacacaguauucuaggagaagugagaacccacucauagccaggagagcuucucccucucagucacagggugacugugggcaagguccuuccccuguugguugccucugucuccccaguuauaagauggugacaaacugaccaacuuaaaauuuccuuaaaauguauuggcacuguggacagaaaugaggaaaguggaagaccuaguuucuguccucagggagcuuaccauuugguggaaauaaaguuaaacaggugaaagaauuaugcaagagagcauaaccaagugucagaagacaggaaaaacagacaucucgauugcaugugaaggcuucaaggaauuugaggaugaguugaauguggaaaagaagauagacagagagaggggagaggagagaaacccagggaaaggcaaaacaugagccagguguuuaaagugggggaauaagaauggcuugauuggggccaggggaggggucugucugcuuggauaagagaauucaugaaaagaacagugagagaugaggucggacagauuccaggcaaucaaguaacaguggcacuguccacuggcagaagauccaauuuuucugccccagaaacucagaaguucucaugaaucacccucucagacagugcuagacagaguucagaagcaggccagcuccaacagugagaaagaacuuuggcaacuuugccuggguuagagaguggcaauuuaagugaaucccaaacaagaccuacuguggcaauagcaaauagauuuuagcucaaggaacauuucccauugacuccuagaggcuucccaaaaugcuguacuaagaagucaaaccuuggcucagguauggagagugcugugauccauuagugaugucugcuaugggcacaauaugaaggauuugacccccaugcaucacauggacaucaccguaguggagcagcaggcuuucuuuguuaauguuucugagaguuguguguauaguccucugggaguuuagccauucuagaaucuguccagcuagccauacuauagacucuaucuccuucuagaacaguaaaaaagcagucucuugcccagagggcagagguuagucacuugagccuuuuguuaggauucacucccauucugucuucccauuuacccacaugaaguuagaugcugggagccagauauuuccuguguuugaacaagggccagacuuccuggcaaagggucccuucuucccaucaguuucuucaacugcaaacugagaagacaaaagugaugccucacccgugguggcgacaggaggaauaacuagcuaaugcgaggaaagcuuuugaagaugaaagggugguaugugcauguuaauuacaacuuuuaucagcccuggagccucugcauucucagcugccacuggaagcucuucugugccucccaaaugcaaacagcagccacauuccaugagcuggccucacuaaguccugcuuagagcauccaagucaagaagguuggauuuugagcucaggcuggccagcuggcucacucugggccacucaaguuucccacuacucauccccaagggaaaaaguaggcuagcuaccugggcagguaagauaagauagaaccaagguauaaacaaaaggcuccaucaaaagucuaccagaaauagccccuggguaagauuaggacacucugcucuaauucccacccugugaaagccuaauuguuugaccuugggcuauuggcuuuaucugucuaaugguucaauauacugugugaaccauuuggggauaauaaucccucugccuccccuagaccucuccaccuuugccugcuggugugaaaguguuuugugcuaguaggcagaaacacgugauauaaaacuacaagguccuauuauuaccuaggauaacuuucgccucuaucuaugucuccuguugcugguugaccccaaucauugaaacuguauucuuuggaaugcucagcagucuccuccaagcugccauucccuccuuaucuaggugggcccaguauuggcucaggcuucuugguugugccacuuccuaaggcuugcaaaugcauucagccugcccuugcucucagugccagcucucagugcccuugcugggauaacucaauaaagggcuagaggugggaaugggauaaucaucagaugcuuugcuagugcugacgggacagcuuagaagguauaaacugagcugggcccaugcagcaacaccaaaauauguguucaaagagggagaagaggagaaaaagagaaaggaaguuaucguggucugauaacagggcaugucagaaugggaaaggguguuaggaauuauguagccaacuuguuugauuggaaagauaaggaagccucaagggcugcaagugacuuucccaaggucacaaaacuaauugguggcaaaaccguggucuucugacuuguccgguuuccuuucauuuuauccuuugagacgauaaaggagaggacacuaacuaaacaagaagacaaugaucugaucaggacaagaagacuuggaguacaaaaugagaagaagauaauaggguaauggauuuuuuaguggcacagugggaaauggcguagguguuuacacugcacuggagcccucacugugcuuggaacugguucccugugcacagucuugcacacccauauuugguauuuuuuuauccuuuuugacuuaaugagcauuuggaaaccauaaggcccacagcaaccugaccuuugacuugcccagacucucugagcaauuuugugaguugagucaacaaucaaugguuuucaaauuauucaauuguucacucaacgcauacuaguugaacaccaauaucugugcucugcuaggcacuggggauaccacuguagacaagagaggcauagucuccucucuccuggaacuuacagucuaucuggaagacagacaguaaacaacuaaugaugccuuuguuuaauuacacuugugguaagugcuaugaaggagaagcacuggaucuugugagagcauaauagggagaucucaucugauuuaaagcaccagggaaagccucccaggaccuguuggaugaauagcaguaaccaugucuccaggauccccacaauuccuugaggacccuuguugucagacuucucagagcuguaccagcccucucacugucucaccauugggucuucugaguaagaaagcaagaaaaaaaauuuuacuccucaaaauucugaaagcaagugguuuaucaugucugcccuguaauaguggugggaagaaaaucaugagaaccucuaagcugacucaggauuuuagaagcacacauuuggggagaagggaaacaaaaauucuggagaagcaaaaagugucauaugguauagaaguuauuuuaagcuacuggggaaaauucauaauuuacuuagggaucuugagugucaagcauugguuuagagacaaaucuuauccauuucguugaaaguuccuugaucuuguggcugaagcuugggccuaggguuuuauuaguguacauuuaggggaugguuuacagggugucuuucaaggucauacaggugccucuuuuggggucaggcaggaggaauaggacaaacucugggauacgaauguacaaccauuuggcuccuagggccucaguccuuuagcuccuugcuucuggugacuucuuggagacaagaguagacuuuuucagaacagcgagauaguugugcugacaaaacaaaaacaaaaacaucauuuaagaugccuucagaugcaaguacaugucauaauagaaauauuuaaaaauuaguagaguauaggcacuagcuaauucaaaugcuugguuguaaacaacuaugucuuguaaaugagaauaaaguuuauucucucaaugacgaugauaacaucuuucucacucacuuuuacucaaauuggcuuuauugggcaggagagacagagauggaguuauagguaucaugauugaacuuaagcuacaacccaucuaugcaucaaaccaucaugugucucgugugauuguuaucuguuguguauauuuugguauaucccuaucuguacauaccagcugaauauuucuguaaguaacagaacaaucagcucucauaaaauauuaccucccagggcaagaagucugggaugauuccaggaagucaaugauauuaucaagacucagguuuauuuuuccaacuuucaauucugccacucccagugucuuccugcaauuuagcaccccucauguuccuaaacuaaaucccacaguuccaggcauccuaggaaaaaaaaaaucaauauuuagcagcagaagaaagaguguauauucacaaacaucucuucuaaaauuggaggagcggcuuuuugggaaguccuuaauugaccucuccuuauuucucauuggaugaauggggucacaugcccacaccuaaccaaucacuggcaagaagagcuuggaccacagugcuugacuuagaccaaucaugauccacccacuggagcugggauuugaggucucaccuguccugaagcacaaauucaggguuucugaauaaaauugcacuucagguagaauagaauaacuuuuuuugcauugguaacaaugugggcuacaaugaguaagggaguccauuuaccugcuagaguugugguuugagacuauuugggcuaaggaaagaaggcaaagcuaaguuuuugugccucugugccacacccucaaccuuuuucugaaaagacaugccucauggguagagcucacaugggggacacacugcaguuugagguuuagauggucuguggcuuauacucaaugauaauaccuaaaacuuuauccuuuccugucuucuacaaaagagaauuauaucagggaauaaucuuaaaucuguuauaauuuacaagaaauagccagucuucugcacacuugaguacuuuauuauuagaaacucauuacuugcaacccaucucagcacuguuggagcuacaccaugcaugaggaccgcugcucuagagucauccauuaaaaaagaauuccuacgaaccugaaugagcauuucuuucucuaaauuaugagaugaugacccucaagggaaauggccgucuucccuuuucuacugcacucuuagagugcauuaaugugugugaaguguuuucgguuccauuaucuaaagcagcccucauauuaacaucgugguuggcauuacuggccuccuguaugggaugaaaguuuaaugacuucugcaagguuaugaaaggucaagaucacagcuaauuagugcaaauucaggauuugaauucuaguuucuaccccagagcugauguccaugucaccauggacaucauuugcucccaauauaccugauuuacuuucaaggggucuggaauugacuauuggauuuuauauuaaaaauugcucuuucauaggcaggaaaaaguccuuccuaauaguuugaguccaaagcuuaagggucuagcaucucaacuuuuuaaugaacccaaaaaugaacaggaggguuuucugagccaguccccugccuccacacaguuagcucaugaauccaacaucaugggaggaagucuucaggauuuuguuucccauuccuuuuuuaucaccuaaauauaguuaaaggauuugugaugacugcauccagagauguuuaaaaauggaccugaaggaugugauugugucuuaggcaggaagggugccgguucuuuucaguaucuaaugaugaacgaucuaaaggaaauggauucuaaaccauuugauucuaaaccaaaaugguguauguuucuuuugagggugaauuuccugaucaugagccuuguugagcauuagacuggccggcugguuccuaauccauccuucaguucucagcugcagugacauuuccuuagagagacagaucuccuuuggggacagcacaggacuugagaaaaaaggcuucccuuuccacugagcuuggcuccaacuacaccucaugugucuguuacauuuaucaugcuguguugucaacuuguuuaaugucugucaguggcucaugccuguaauucagcacuuugggagccugaggcaaaagacuuacuuugacagcagagguuugcagagguugcugggcaacauagugagacccugucucuacaaaaauauauuuuuaauuggcugugcaugguggcaugcaccuguagucccagcugcucaggaggcugaggugggaggagugcuugggcccaggaguuugagguuacacugagcuaagauugugcuacugcacuccagccugggugauggagccagacccugucucuauuaaaaauuaggaaaagaaauagccugucuacucuauugguccauaaccucuaucgagacagugaccuugucugcuuuauucaaugccuggaucuuuuccuagcacagugcccagcacauggagacacugaauuuggauucuccuuuuugaaguccccauauccacuucaguauuggggugauuuugaugggauugugacuuaccaugguggaugcauccugugaguuccaaacucaacuucuuaaaaaaccuugucuaucaucuauccaucuaucugucugucugucuaucuaucuaucuaucuaucuaucuaucuaucuaucuaucuaucaucugucuguauucuauguuccaucuaucaucuaucugucauauaucuaucucuaucuauuaauuaucucuaucuuuaucuauuuauaucuaucaucuaucugccauauaucuaucucuaucucuuaauugucucuaucuuuaucuauuuauaucuaucaucuaucuauaucuaucaucuuuuaaccuaucuguuucuauuggaauaagagacaagugcuugaaaagcagaggagagucaauacacaggccacaucuucucucacucccuccuuccuccucauagcugugagccaccccagucccuguaccugcuuccuuggcuggcaucaucuaagaaaucaucucuuccacaguuuccugcaagggcaucaccccaagggaagcugaacacaugcaacaucugcccacucaggauaagugugagggauaaggaggaaacauuuuuccucuagagacaggacuguuggggcaagggcuggggaagcaagacauggauacuccaggcuacuucuugcuggggcugaggggagugcucgguguggcuccccucugggacguguuuagggcagcucucucgccucugaaacaagccucaucagaucauccccaggcuuccuuccgcauaguuucugaugauauaggaaaggagcccgauuaucuguuugagcuuccuguucuuuguauuguuuggaaggcuaaagucaacagccacuuuuguauucugcauuguuugcguuguuaaaaacucuggaaaacucaucugguuucuucuccaaaaguagcuucccagagcccugggagacacucagaaauaagauccuuuucaaauaggccagcagggaccagggucucucagaaccagcuuuccuaucuucuuccaaaggccggaauugagaagguuuacuccagcccacauaauugagucucugggcugucaaggacgcauuggggaguuugcuucuggugugcugggugcuuagaaagccguaugaauugcagagauagaguuggguuccaguucugccagucaccaauuauguggccuuaagcaguuuacuuaacuuuucugagccucaauuuucucuucucuaaaauagaguuguaauauaccuauggcuuagaguuguguaaggacugacgcgaucacagacuugaaacccuugauagaacgacuggcauggaguaagcauucaacagucauaauuaaggucauugugaugauuacacuuggggccucuccauucaccauuugccccaacuguguuccugcugcacuugaaaaugauuccagcugccucuggaagauuuucaucccauuucugggaaaaacauuagccaauaaacucucauugaauuuggcagggcgggcacaccagcaagcugacacuaugugcauacaggcuuccuggaacaacuguugcugagcaaaugaagcagcauggaauguuccgggaagcaggauuauugcuguagcuggugaaagugaacugggaaacgcacuccagguccugucuuuacuugcacaauuacagucaauccccaaggcugcuugucucagcaggaucagccucuuccugccuucuguccuggcagugggugguggggcuggaggaagaaaugguguuuuccucccucucccauugcaauuguuuccuuacagugcuguucucugaggccagagaacagaagggcucuuuccagaggcaguuuaacagaguagcuuccuuuucauucugagaaguuuggaguuucccagaguccacuuccucccuagaagcgcaagcuuggaauuucuugguugccaaugaggugccagcuucugagugcauaaaguguguccaucguuuuuaaucaauucucucaucuccaaaaauaccuuuaauugccuuuagcugcuuaguucugcuguccucuaaagaaaacaagaucuggccacucccagccacaccucagaagugaguaaggcuuuugcaccuuuuaauaggaguauuuacaugugugucgguuucucaucugcuuuuaauuucauuagagugugauuuuggacuguuguuugagaugaaagagcagauuaucaaagugcagaugauuuuuucauggugcaaacacaucauaaauuagaaacuaugagaccccuuugcagcggggaagacuggggccagucauccaagguuucaucuuccuguaggagaagggaaaaaaaacggacauuuauuaacuaucuguuaugauccagacucucuacuggugcuuuuuguauauuuauucucuaacucccaucaacuucucuuugagagaggcagcaaaugacaacugaauaaaugaauggcugaauuucaucagagccaguuuacaggcagagaaacugaggcucauaaagcggacguaaccugccugagaugucucagcuuuuauaugguggggcuggaauucaauucagagcuccuucucccuuuuaacacuacacugcaaguucccauucagcuucaugggauuaauccuguucuucugucccuagaauggagccuugaaaguucaaggugucuccuuuuccuaagaaacuggauuuuucuggcuccuugagaauugaggagcucaaaacaauugagaacucuugggaggcaucuucaggaaaggaggugguggaaacuuuccucuccucacucuccccaggggcaauggggccuccaaggccaucaaagaucaaggugccaggugggggaugccucccagcuucccauucauuuuucaguugggggccacucagcagcuccucaggugaggauugucucagaacugaagaaugguucaaauuggcccaagaugcugaaauuuauugcagggaucacugggacaguguguagcaauuuaggaggcuucucucuaagggaaucaguagcugcugcauuucucuuaauugaaaccacucuuucccuccagcuucgauggggcagguucucauaucugcgugcugaaaggcguuuauuugguguauucugagagcaggaugcugguaacacuuucuuuuguguuuugccaauuguuucuuuuuacuggcuaguccacccugucugacgcauucauuauaccauaaccaccuugacaccagagugaaaugccauuucucugcagguaggagagagucacacggauuccuugaguguuuguagcguaagugagaaagauauguagccuucuucuagaggcagagggauggguuggcugggacuuagagauauucaaauccaacucuguucuugucugauaaaguaaacgaggccucugaagguaaagugacuucuguaaguacucacagcuuaucaguaagaagccugauauuaaaacuccaggucacuagaccuucaaccuaauguucuucccacuaaaccaaguuaacauuuauuguacaccauacuaaauggcagacacuggggacacaaagaugaauaaggcauggucccaguggaacccacuuugguuauauggguuaggacacuugaggcaggauccuccuuagaaugguguuuuauaaagucucucuuucucuuucucucucucucaucucucuccaaucuauccucucuaucaagagagaacacauguaauguagagugagagcccauguauuggauaauuaggcuucuggcuccuaauuaucaggaagccuggaggucuugagugguuguaaccaaggauacugaaagugguugaccaguuaauaaagaauuaaguuagaguaagaggcacuuuacuuuuaagcugccuuuaauacacuuuaaucuuugagaugauuggcuaauaucuguuaaguaccaggcucuuugcagagagucagguccuuugcuaaaugauuuagguauauuucuucaucuaauacucaaaaagcaccccauaaggaaggcauuacuuuuauuuuacugaugaagagacugaggcuuaaagguuaagaaaacauagcaugcauaacaucccacaagagcucaagccaggacuuggacccaagucuuucuuggaucuuuccgauccaagccauaugguuacugcaaucucacaauacaaugaggguaaauccuugcaaucaccaguuaccagcaauugugaagcaauggauggcauagaugucagggggucaggagagccuugcaagcguucagagggcuugggaguggacacaucacaguugcacucugcugggcagcgcuguaagucucugauuggauuuugccuugaauuuuuucuggucaagacucagaaaggauggauguagcuucacuuacaccaauucuacccagcuugugacccaaauggaacucuuaucccuuaagccaggucauucaguuguuguagccuuugccuuccaaguuucccuugucuacccuacugagucugaauucuaaggacaucuucuuauggacugugggaggcaaagaugaauuccaaaucuuauuuaaucugugugcugggggggaagaggaguguauuuccuuuugccagguaucugagccuacaaaaagccccauaaauaaguaaaauguguccaugaguucauaaaagagugagccuuagacauacagaccaccugucaaaagagcccugucauucucuauuauauuauccucuuuuauuuucuguguaacacuaugaguaucugaaauuaccguauucauguauuaaucauuuaccuguauacuauauccucacucuagagguaagcucuuugagggcacagaucgugucugacuccccagcccccaagauuguaucuggcuuguaucaaccauaucauagggaaggugcugugaauugacaccuugcaccaugcuuuauggaaacuaauggugcuuuaagaggcacagauuucauagaaagagacccaguuguucccacccugaugguucuaggucuaggucuaggucaccaaugucuauggugaaagaaugggcuuuugcgagguauggucuccugucauguaugagggucauuuauuuaagggaaaaccaagaccuuauuuucuuugacaacugcacacaagggucauuuguaauguccuucauuuccaagccucuggaucuuugcauggaucaugcuccuuaaaagaaggaaguuauguuuggccugcuucagcuaagcauggaaugguaaagauuuugguccaaacccugugacuugaguuggauuuaaaagcuugucagaaaugaguucucuggagcuuggcauuugagacuggcauccguuguuccagaugagauuucacggauugaaagcucaggaagaggugugaauuacaagcaauuaguucacagggcaguuggaacuguaguaauccuggaaaccuuuuggcccacauuuuaaaaauauccccacaauccagcuucucccucuguagggcuucugcuugggaaaguuuguguaacuccccaaaacaucugaagagugaauagcaguaguguucuuggacugcgaaggagacccugcuucuuaugugcaugcucuugugcacacagacagaaacacacacauacaugcacacacacacagacauguacacccauguucgcuuuagcaucugauagaaaaagaggaacaugaggaaagacagagauugagucaccaacaugugaccuggugauuucugaguccucugacuuugaaaucaguggaaauuuagagcucuacuuugucacuuguaaugcuuuguuguugcaaauaaauauuuuugcagcugcaucacuucauugcuaauauauuugaagaaggcaagauaaccuaaaggcaugaaucuuguucuguuuuaauccaccuguaagucaguggugguuguaagguaaauuguaaguaagagcuauuggccaccaagugccaaggguuaugaaugauuuaccuuuuuuuuuuuuucuaaacugaaggaaacucaugguuguuccuagaaaaacaugcacacucacuugcuugcauucggauaagcuucuuugaguaacagggaagaggccacuaggauuacaaggcaguuagugcccauuggagugugacuggcauugugcacccugugaaucauaguggugguauggggaaagggguaaaaaagcaucaaucuauggaguaugcgaaccagauggcaucuguccugggaagaacaaauauccuucauaggagaauuagaggacuauacuagucaggcagaaauccaguccauucaucaagcuuuuccucuugcuguggucccuacagggucagcccuguuuaggcucaagccucuuaaaucccagugcaagaccaauuucucuaugaaauucucccugucuucuuuggucucauggcuacuuccugggaggaaaaaguaguaaucagcucccuccccccagcuaaaugugcaugguauuagcaaauucuaacccaagauguuaaaacuaucugagaagaggcaugauucugcuucuugucuguacccuccuaaagucaaggugcagcaaggagagagacauuugcauguggccccugagaaagaagagauuugucugccucacccccugcuggugcaaacuugcaccucucucagccucaguuuucuuauauguaucaaguuucaaugaucgcaauaguacuuaucucaugugacuacugugggauugaaacgagauaguucaugugaaguaccgagcacagagccuggcacacaguagguacucuauuaguguuaauaucacuggaaaacccagcugggggcucagcaguagaagcugccagagccuuaguguuacagccacauccauuaccccaccauucacauacauuucaugccccagggugagaauccacauaucccaagcagagaggcacagcuuugguaaacugagucuuagcuaacucaugucagaaaccaaguguuauccugggguuugacuccuggcucuugccacauucauagcaggaugcugaguggauuguacucagccucacuuguugcaucugugaaaugggggugauuuuuugacuucucaagguauagcaucuauuaaggcacauagacuacaaucugacacaaauuagcagcuccauacauugcagaaucuuuucuuuuucacuuaaggagaugcuaaaagaggcaagaggaaagaaaaucaaauuuggagaugccgugggcuguguguugaaguugggcucugguggaauugguggugaccuuuugcuucucuccaucuggauggcuguaucuucaaagacaacaagucuuaacugcaguuuuugauuguauaaaucuggccaaguccacuauuuacccagcccagucuccuuagaguaggauuggaaacucaaacuuugcuaucuccucugcagagugagcaagggacaaucuuuaugaaaaacuuuaaguugcaagauauuuguguucuuaauaaugaagggaagaauacaaaaaugauaauacuaagccuggcucauggauagcauuuuugcacaauauauuucauuugggcugcagccuuugagcuguacuaauugcucugagcaucuguuuguauguccguugcaugggaugauuuacccuccuagguuuccaaaugcuuuggagccccugguuuauugcaggacuuacuaagugguggccaucgucacuuugauuggccccuaccacaguauuuuccagacuuuuccaccaaggcucuuagggcuuuguggugggugccagaacaauugaugggguagggugggugcuggaagagaaugagcaucugguagauugagucucugggucugcccuuccacccucacuccagcccccauuagcucagcuugauuuucaaccacuugaaauacugugguugugccuaagacaucaugucagggagagaaagaaacaucugaaaaccaucaaucuucucucugaaugcuuccacuggucccauuugccuguugacaacccaaguugaaaaggcagcaccagaggggaauggggaaaauuagcagaacuggaaaaucugaguugagaucuggguuuaccaaacucuccguaagacuuugagucugugaaacuuauguccauuaguuucuucaccuuuuaaaugggucuguaguaccuacccucugggccucacaggcugcuuuugggugugaaagugcuuuauaauuggugaaggaaacugcuacguggcaagaauagcaaagccugauguacuuuaauccauucgguucugcugaggguggagccccaaugugucuuaauucauaugagguuucugagaagcuuuuugagauuuuaauacugucccagguaugcacaucaaccuucucacuuuuaucccccaagcuccaaaauuucauaacuuuuuauuucaucuuggguggcaggaaggcaaggugugccugggggagcuacagggaguuauucaaggucacauaauuagcuuauaauuaacagaguuuaggcuagaaccagugcaucccacucccagaugggggcccccggcuuaucucagcaugucagcaacccaugaaucagcccugaaauauagauauuaccuaugaguaacaguuucucauccuaccucaacuguuacgaaagucuucccucaaacuaaagcuaagcaguuccacaaaaugccagcuauagacauuagcagaaacuguauauugauuaggugauguaucagucauuguaacuacccagaaaaaaaaauacaaugacaaaaccaaguggcccaaccuuauuuucuacuugcaagaggaaaaacccuauuugggccccaagaugcuuuuuucauuucauuuaccacauccuggguuugugcuagucaaucugcuaaaucaauaagauccgaaaaagcagaaaacaaagaucgugaggccagaggauuuccugaucaccauggcaacacacagggguggguacugugguuucucugccugaagacgcacucgucaaagacuacuugguguuacagaauucuggugcagugaagcaacaguucugggacauauacuuucuuuugccagaaagacucuguuggauccaggaccaggagugggggguuaaacaguucuccauacccucaccuccaaguccccaucaucccauuaggagacagggacaguacuguucuccaaacucucaaaacaacccaagagcuuucuaggcugugcauuggguugaucauuugguggccuuggcugaagggccaggguaacagcuaggagaacccuugggauucuucuccaaugugacaggccccuccauguugguucagcguugacugccaugacaggcuccaggcuccacggaaaaaaggcagagaaaucaggggguccagccaggcgccaagacguuggggugccuugcauuucuaagugccaagugaugaauagcucaguugaaagcaacccagggcacauucuggaggaaauucucuggguaugauugugcaugacuguuuucucugcucauuaaacccucaucugccuccagggcaauuccgggagagacugagucacucaagacucauggucugcacugggcagccaaaggcgauucggccaccaagugugauucuggccucauucagaaguggaugcuaaacaauacacccuuucaccaggagcccaucacaugggcaucaggagaugggggcgagugaugugccagccuucuagacuggcaggccuggggggcagcagagggcacaauagcuagaaagacucccagaugaaaacuucugggcuuugaagccuucgaacaaaugaagaagaaaaugacuucuucguguccuauuaagacagugaguuguggcuuuuuugagagcagcuugcucagaccucuuaugaaagauagaucaguagcaacagcacugguguaggagucagaaaucugcaauuaugaaccacugaguuuuguguguguguguguguguuuuuguuuuuguuuuuuguuuguuuuguuuuguuuuuuaacuugcuggaggaccauacucggcuauccuugauuuuauuuucuccugugucacaagagaaauugguuagaagcuucccauugugccuccuggcuuuaaaaauagauaauccaauuaacaauaaugcuuuaaaacaacaaaaccuuguccuuuucccuuccuacuucugaucagaaccagcucaguaagauuuauuaguugugcaaucuguuuuggacaugagcucagcaaaucagaggacagaaauagaauccuggcuuuuuaaugauaaacacuguaaaaauaaaaaauuuggagagcuuaccagugcuucuggcugcccaagugguuugugugugguugacucccaggagcucaaucacuuugggugcaguccacccagagagcuauguuccagcuacaucaaccuggagccuuagcuuggucagucuagauuuuuggguuuggcugcagacaucucguaaugucacaaggacagccuguguccuuggugacccaacccugggccaaccccaaguccuggaguccucuccuaagagcccugccuaauuguagagagagcauucaggcuguaaagggcaggaggccugggggcuacgacuagguuugggcuuucuaaauucccaagaguaugaugggaagaccaacaggcagaaucagagagaagcagucagcccacugcuggggaaagccagucaaggucaagacuucagaaucuccucucuggagagagagugaaaauuccauuagugaaguuuguuccacugaagccuuaccaggccuugguaaaggccccuaucuugugguccagaaucaagggacuucugaucuuaaaauaauauucaauaagcucaaauucuucucucuagggcucucuuuucaugaucaccucuccacacuuuauuaaaaaaucacaugaaggguaagugggcuuccugucauuucagugucugaccugugcauaaguuggaauuuaacacuggaaaaugaucagccagauugcccagucugaaacccaggucccccagugacuagcacaaguuacuuacaucuucucaaugaaucaguuaccucuuguguaaaauggggauaauaaaaaugccugccacacaggauuguuaggaaaauuaagugaaauauuagguguaaagugcugaauaccuugaacccagacuaggcacucagugagugcucacugugguuauggaccaggagcugcaggaauuagaacaccauugaguagcaggaacuggcuuuauucucaucuucaugauaaagcaacuucuccuuacauauagcuuaaucuggaaccaaaaaucuaauucugccucaucccuccugaggagaugacaaauagggaucaggcacaccuggguggcucaaguuagaaaacaaauuaacucauuuugcagaaucuggagacgucuggucuggagaacugacagugcccucucuuugggcauaguaugacuguagguugucuuuggguggucuucauauggaauguacuguguuugccauguucccuaggagaucuggccucagaaauggcccugugaugguaugugaacauacuguccuguaacugagaugauagcuugcacauucagacagacaaagccaguuacaaaacuaaaaguuggucucugaaacauuugcuuucggggaaaacagcaaauguucacagaagcaaaguucuggguuaaagacauuuuaaguauccaauaaggaauucucagcaaacaccagcuggugauuccucagauaugaugugggaaaggaaccugauaggugaucuuuuugcacccuauaagacugcagccugucggggguugggggcagaaagagagcauuuauuaauucauuauuucauucaacauuugccuaccaugggaggcuguacuagguacugggaauauaauugugaagaagggagacaccauuucuguugucaacgaagcccacagagaaguuccaaaauuucagaaugcuggaauuucugguuacuagagaccuugaagauaauaauuucuuguaauucuuuaccugguugugucacagacuuugaaaaccaaugaaaaccagagauguugcccuaccuaaacacacacacacacacacacacacacacauccauacacacaaucuugcauauaaucucacagguccauggauguauugaccagcuccuggauuccauauugaaaaucccuugcagcccagcuccaauacuaguaccaggccacucaccucucaggaaaguuugggaagacguagauaauggcaacuugggugaaaauuacacagugcucucuucccagcacauguugugauuuucuacaacuucagaaauaacugggguggaccaagaagcuauuauuccucgcaggcccuacaaucuaggcaaagcuuugaaaugugcucggacaauuuuaucagagaucuauuuuccuugaucugaggcuuagggggcaguauagaugagauuaauggcauuugggaucagugaugguuuauccaggagagaaugcauaguaccuguaaccaggagccugaauaggaggcaacauagcauagagguuagaauccugacuuucccacuuggaugacauugggcaaaggacuucaccacuuugugccucaguuuccucaucucuaaaauggguuuagcaauagugccuaccucauagcauuuuuaugagaauuaaauuagcugaaguacauaaggcaccuaauaagugugcaaugcucauuggcucugauuauuaagugucaaacaccauaucaaguguuugacauaccuuauuucauguaauagucccauaaacccugacagguucgcauugucaucccaucaaggaagagguggagagucagagagguuaaguaauuaacaaccugugucaccuaaagugaguggcagggucaggaauugaaccagguuugaggagguccuaacuagguugaacuacugaccuucauaaaaguuuggcacuacagaccagcuuuauaggacaaaaaaaccuucuuucagagcuccuuuuucucgccuuccugacagcucccuagcagaccucuucccauguggguagggagauaagguuccuagacacugggacacuggucuccaugaccccucugugcugcccacagcccuauaguaaugagcgugcuaaaggccugguggcauuucuaccacgggaagucuccucuccaaauccaaaaguggccucaaacagucaguguuuucaguugagcucauuuaucgcucagagggaggcacuugggacauuuuauucauuacaugaugcaggagauuuauuggagaccagagggcucaacggaaaacauucuugguuuauuuccagccagaaaggcuuguuugagagaugcaaucagccauuuaguauuagcuucuugaaucaaaguggauccugaaucacagaguucucuguuucucaggagagacacacagacaucugaggagucuugccucucuauagugguuugcagcauggcuagcaccauugccagagacacuggcacucugucaagcaauguucugugguccauggcuauucacaucuuaaccuugccuuaauucuacuucauugugaguuugggcauguuucuuuauuucuuccccucucuguguguuaguuucuccaucuggaaaaugaggauacuaauauuacccaccucauaggaauguuuuaaggauaaaaugaguaaauaauucuaaagugccuaaaauagagccuggcauauacacaaugaaugcacaauaaauauuagccacugcucuugcuguuggcauuauuaauauccucccggguaauaauuuggguuugcguuaguaucaaggaaaccugaugaaaugucuucauaaauuaucaggguuugaaugacacacagccuugaaaauguuggcuccuuuuaagucaagagggaccuagaguagaaggauugugaacauucacaggauaguugaccagaaaugaaguauuugacaccauucuugcaacuccuaaguagcuaaauagcgucaggguuaggaguuggacuuucucaugagaucaagauaaauguaagcuguggaauuuuuacuuugcauaggauuucuucauccaaucagcagcccuuugcagauaccuacaaugugucagaaccugcuuaagccuucacaucuaggaaggcuaaagguugaguuugucuguuucauccugucuuggcugaucacaugcacauacaaccacacacucacuugcauacaaacauauaaguaugaggagaauucaaaauguucauggaaaaaugagauuaaaagauaaaaguuuaaagauguaaacuuuacuucucaacauaagcaccaucacauucaagauacuguuauaagcuaugauagcggccauuuaguccaucccuaaagaacugaggguccugggaauuuaaucacaucaaugcaaucuuucuuacauuguuaacuaaagaaaaaugggugcccuuugaagauuuuuaaagauuaaguaacaaaaaaaaaaaagucagaaggagucaaauuuggacuauaagguggaugccuaauggcuucuccauagaaauucucaaaaaaauugccuuuguuugaugagaauaaugagcaggagcauugucaugucaugauggaggaagacucucuggugaagcuuuucgauacauuuuuucuucaaaagcuugggcuaccuuucugaaaacacucucauaauuagcagauguuaucguucuuugaccuuccagaaaguuaacaaacaaaaugccuugagcaucucagacaacggcugccaugaccuuggcucuacacugguccaccugcuuugacuuguccacuuuugcuuugacuggaccacuuccaccucuugguagcuauuccuuugauugugcuuugucuucaggaucacacacauaaggccauguuucaucuccuguuauaauucucaaagaaaugcuucaggaucuugaucccacuuguuuaaaauuuccauugaaagcucagcucuugguugcagcugaucugggcacaaugguuuuggcaaccacugaguggaaaguuugcucaacuuuaauuuuucagucagauuuguguaagcugaaccaguugagaugucuaugaugcuggccauuguuucugcuguuaaucauugguccucuucauuuaagucacaaauaagauuaauuuuuuucucccaaauugauguggauggcauaucgcugcaggcuucaucuucaacaucaucuugucccuucuucaaacaaguuaucuguuuguaagcugcugauuucuuugggacauuguccugaugaacuuuucauaaagcaucaaugauuuuuucauucuuccaccuaagcuucaccaaaaauuuugguguguguucuugcuucaauuuuagcagaauucauguugcucugagagaggaucuuuucaaacaugucuuauccuuguuagugccucaaacuagauccuguucagauauaucaaguuagugagaguuuauuuuggugcaaaaaaaaaaauuugaaaucuauguauaguuuuuucauagcacguauuuuucauggaacuuuuggaagacccgucauauagacacacucacacaauggaugcauguauugucagugaaguuauguuggcuucugaaacucaagggauuuugcugaaacucaugaaacucaagggauuuuacugaaaagucucagccucaauugguuccucuuacauuugcauauucugucugccagguggcaagguagaauugacuguaauaagaaagaaacuaccauugagcuccaauuauuguccaugccucagaguugauuuuuaaccugagagugacagcagccaccugggccaggggcagacagguaguuugccucaccuggaaucagaggcuccccuaucagccuuaucuucaagaagcugauaggaaugcuuuguuuuucuuuugugugcuggacaaggagaggccccggaaggucugucauguagauugacaguuuccuuuuguaagacuggccaacugaggccaaaguugaaaaugucaguaaaaacaaauaguauugcaaaagggccuuaugcauuuccuucucuauccucucauugccccaucagccgagugcugcaugaguggcuuaagagaacaccauuaggcuugaaaaagagugaacugcaaaaacacauuuucuccauuucaccuaguuguuauuuuccccccaugugcuaaugaugcaaacaaaagaaaauaaaaauaauagacauuggcuuaugucuuuucaaguuccauuucuuguuucuucuuuuacuauuuucagaaucaaggaagauaauacagaauuuuaacaguuuucuuaccucauuuugcauuuguuagacauuguuuccucgugguugagaccugcuuccugcucaggaaagagaaagcagugguugcccauacaauucaauaauaaugacucuuugucauuauuuaacaguuguuuaggugugccucucuccuuucuucaguugcacuaaugauagaaaaggauccuugggcacauaguaaagugguucaaaucauggguuugggugguaaacaggucugagauagauuuccugcucugccacuuaagagcugggugacguuggggagucauuuaauuuuucugagcuucacccauaaauaauacauacauacauaaaacucaccuuucagguuucugaagaugaugcaacacagaaucucaaagguacuggguacccagggacacugcaguaauagguccccucuccuauugcugucagcucagaaauacagaacagagcaacugggauucagaaaggagacuauaggcucuagauagagguacucacucacuuccuugggcaacucacuucccugagccucaacuuucuuguugguaaauaaguggaaucuuccuacccaccacuagaacugugcaaggaagagauggagcugguuaaugccaguucugucugauuccagaccugguucuuaacuaacaacaaggaguggugccuggccaggcacuuggggcauugucccaagaggaugucaacaugucuucuuagagaaggacagucauugaggccugaggaaguguucaggaggaauaagcuucaccaggauaguuucaaugacuuaacccuuugcaugcaguuuccucaaguguaaaccgggggucauauagucccaggaguuuucaauuacagccuuugaagucuuuugagauuguuacacaggaucaaguagaagaggaugauuucuagcucucuauuggaauuucagauuaaugucuacaaaacucacuaaaguccuuguauugaauaauucuuuacccaacugauagcaguuaggcuucauuuucaaugccauuaacucugagagcaaacgacaggcuuuuggucugccaauauauuaaaaguguguuucugaggaaauuucaaugagucauucguuuauauaacaaauacuuguugagcaucuacuuucuauuggguacuguuauagggauuagagauaacagcugcaagcaaguaaaaggcccuugcuuucucagagcuuucauuccaggaaggagagaaagagaguaaccacacacaucaauagaugaccaggcuguugugaagacacaaaagccaaaugaguugagggagagacuggggguuagacaaggguguuuagggaagcacucuaaagugaggugacguggaguuaaaauucugaaugauaaaaaaaaugaaccaccuaugugaccauuugaggauggaacauuccagacagagaggaaggcagauacaaauauucuaggaugggaaggagcucagaaugucugagagaauugaagacaagcuuugugcuuagagcagagcaagcuacuuugagguuagagagggagccaggagccagauuauguugguuuuagccauaauaagaacauuuauacuggguaugaacauaaacucuuggagguuguaagccagggagagaucacuugauugugaaaaaaugcucauaacauaagauuaaguggaaaaaugacucuuaaaucuagaacuguauauucaguaccauuucaauuaugcaagcauaugugugaguauguauauuuguguguauguguguauguguauauagauacauacuuuauguauauaugcauaaaguacgugugugcaugugugcacgugugaauguguguauucaguaaacaaacuggaagaagauauagaaaaguguuugcuguaguuuuuguagugguggacuuauuuuccuucauugcuuuccuguguuuuguaaguuuucuguaaguuuguaugacaucaauaaucaaaauuaaaucauuugcuuuuuaaaaacuuuguugcagagcaaucaauggagagaauguaagagugauauuauuuuaccaugucuuuucucagauuugagcuuaauaucauggugcuuuggaaugcuggagugaauuuugaaggcucuggcuagcagagaaguuuauuuggcuuuuuguuuguuuguucuuuuuuuuuuuuuuuuuuugagauagagucucgcucugucacccaggcuggaguguaguggcaugaucucggcucacuguaaccucugccuccugguucaagugauucuucugccucagccucccaaguagcugggacuacaggcaugugccaccacaccugacuaauuuuuguauuuuuuuuuuuuuuuuuuuuugaaacggagucuugcucugucgcccaggcuggagugcaguggcgcgaucucagcucacuguaagcuccgccucccagguucaugccauucuccugccucagccuccggagcagcugggacuacaggcgcccgccaccacgcccagcuaauuuuuuauauuuuuaguagagacgggguuucaccguguuagccaggauggucucgaucuccugaccuugugauccgcccgccucggccucccaaagugcugggauuacaggcuugagccaccgcgcccggccuaauuuuuguauuuuuaguagagacgggguuucgccauguuaaccaggcuggucuugagcuccugaccucaggugauccacccaccucggccucccaaagugcugggauuguaggcaugagccaccgcgcccggccuuauuugacuuuuuaaggagucuguccuaaacugaacuuauuacugucuccaaauuauuuaugcaaaagaaucuaacauuucuauuucuucccauagauuugaauauaaccugccgcuuugcagguguauuccacguggagaaaaauggucgcuacagcaucucucggacggaggccgcugaccucugcaaggcuuucaauagcaccuugcccacaauggcccagauggagaaagcucugagcaucggauuugagaccugcagguaagagaccagcacccgaccacuggggaaagcuggcggccugggaccaggcagcugggcuuagaacuggaaggcuccuuucccacagcugaauggauuauugccuaaggagucaaccccacguauuaauuuggccaagucaaucugcaaccuguaugacaacuggaguuuaaagucagcuaaagacaccuuugugaaucauagagcgggaacccagaggaagccauuagggguccucucggcuggaauccucuugucuaaccugcuuccacagagcucuccuggcuuugaagaagcugcaguaucauugucagaaccacaagaaaacauaaaccaaauaacaguguuugaaauaaauauguggcuguuagagucuuggcccugcagacuuggaucaaagcagacuuuucaaacuacucucucuuacucucucuuaaaaaaaauuuuuuuugguuucucuucuauguuucucugguuugaaaaaguaaauaaaaaggcaugaaaguuauuaagcuauauuauauuaagauauauuauuuuugggagcccugagagggcuccuaccaguuauucuagagcugcauagagccuuccucaaacuauggcuccaagcaagauaaucacaacaagcaaggacuuuauuuuuugaauuuccaauggccuugcgguaagcggugcacaagaagagcaagccacgguggcaaucacagugaauuguugugguucgauuuguuuucacuagaagaggacugaguaaccucugcaacugcucugaaguuucuaccccagccuguagcugugcuuuugcagugucuuuagguaauaugauuccccuuucucugcaacacacacucacaugcacacagacugcuuuugaaaagucaagcugcagaacucuacggaaaccaugaaguguaaguuaagugcuucuauccuccaacacuggguacagucaugcacccacauuaugagugauggcugagacucuugcugaaagggaaaaggaaagucuuuugccuaaaauugcccugucugauaugguagccacuaaccacauguggugacuuacacuuaaacuaauuaaaauacuaaaauuaaaacuuuaguucuucacuagcacuaacuacauuuuaagugcucgguuagucaccgauggccaguggcuacuguacuggaugacccagguuagagaacauuuccaucauugcagaaaguucuauugaggagcacugcucuaaaauaaagagcagauguacauagacaucuguauguguucagagcuaggucugggggaauaugaaaggagcagagagagggagaaagcucugguggcuacugaacuugcacuguaggaugcaaugaaaaaaggccauuuagcaaauccauuauucuauucccaaggcuaauuguuuaauuauggcccugacuaggccacuggccuaagaaagugaauuuaguaagcugaacuuugauugugaaauacaaacaaggcauacuugcaaaauauagauaugcugccaugugcugaggaccaggggaguucuuacaacugccacuggccaaucaucaagcacuuagaugcugggagcccuacugcccaccuggccaaaccccucacuuaauccucaaacugcaguauuggucaauauuaucaccucauuuuauggaugaagcagccgaggcuuagcgaauuugcacacacagccugccuauggaggaguuaggauucugguucugcuuagccucagcccaggacaggauuuuaaugaccaaguccuccucaggggcuuaaaaggggaggaaaguaugcuuccuggauuugcugaauauucuuuccuccuugugaacaguaacuuacucaugccacauacacacauauaaacuuuaauauccccaauuuacaguuagcaugacccauaaaaccgguaggcaacaugagguggcaaaaacucaguaauagcuuacaaagagaaugcaauagauucuagaauguugguguuauccauacuugaugacaugaugugaugggggugaguugguggguagguucaccaagaaguauuauuuagaaaaacugugccaaagaaaucuaucauuucacccauaacugguauuaaguauugcaaaacucauuuccauaauuucucucagguagcuaugaaucagcuuucugccacaggacagauggcagagucucauggguuaggauaaaaccuuagcagcuacucucuuuugucugccccacccugauugguagcaacucuuagauauaugaaaacuuauuaccauuuaauugugcccacacccccugccaagcuaaggaggcuuuggggaaaccaguuugucuguucagaugagaaauuagucaugcgagcuacaauugccacauagguaggaguucugugugcuuggaaacuucagacucacagacauuuccaugggucgugcagggugaugcacuccaugcuguugccccuggcaggaaagaugaaaagcaucaaugugcauuuuagccagaauugcauuuugaaaaaccugcuggauuuagcuuccuccucucugcccuccugcugcaccacagcuucccuugcacauggcauuuucucagcccacaucucauuuuuugaggcauuuuauauucaaaaaaaauuguguuuuuagcacaauuaaaaaauaagcaaguuuuuagccaccaggaugcugcuagaagaggcugggcuguguauguuguaucuguaugucguauccagcuguaacacacucccagagauaccuugguggggagagaggggcuaugcauuucucuggcugugcuacuucuggaaaguuccugagcuacaugagccguugcuaucugcuuacuuaauugcuaugacucccauuguaaugaugguuaauuuauucccacuggcaauagaauuaugccugcaaugcucaggaggcagugugcugugcuguguacuuggcauauaaacaaggcuucauguuuagggcaauggaguauggaguaaggggacucacaggaaaaguuguggcugagaaagaagugggggaaugggacaugaggcaggucuggaaugugugcacugaaauaaagaagcaccccuuccuaucuauggaagcuggccauuuuguguauuuucuggaaaacaugaagguauuccagagccagcaugaaucuuacaucaaaacuucucucuucugugacucaggcuuccuucuguuuguucaaauagacucaacacugcugaacacaaauuuuaacugaaacuaauuauuccuuucaugauuuuuuuuuaaagcucuuuauaggucucuaaauaaaaucacuuuguuucuaucagucuuguugaucucuuucccucucuaugcuguuauuuuuggauuucaaauaacucgguuguugaaaccuccgauaucccuaggggugaacugaaugaaguguugcacggcauuaaaugucauugaaugggauauuaugaaauucccaucuuagccauuuaggucaauauccuguuguuuuucucuuacagguauggguucauagaagggcacguggugauuccccggauccaccccaacuccaucugugcagcaaacaacacagggguguacauccucacauccaacaccucccaguaugacacauauugcuucaaugcuucagguugguucucaggggggugucuguuggcgugaaaggcugugggagccuggucuuuggagcucagcuuaaguggggauucauguagccuccauuuacauaacaaaugcucacugaauaucuguacagcagagccaacauuccugucuccauggagcuuacaugcuaaauuggggaggcaaacaauaaacaaauaaauauuaaauaccauucaggacuguccaaucuuuuggcuucccuaggucacauugggagaagaauugucuugggccccacauaaauuacacuaaaacuaagaguagcugauaagcuaaaacacaaacaaaaaucacacaaaaaaaaucucauaauguuuuaagaaaguuuacggguuuguguuggaccacauucaaagucauccuggaccacacaaggccugugagccgcagguuggacaagcuugcccuauaugaagucugaaagugauaaaagugcuauaaaaaagaaagcaaaauacgaggcuaaugagugcuagggaugcuuuuauuuucugagaagguggucagggaaagugccuccuggacuguucugagaauaucagugcucagaagggagaaugccaaggaauaaagucagagagcuaagcaagggccagcuaacggggugauucauucucagugugaugggaagucauuacagguuuugaauaagggagugacaugaaucuaaugauagcuuugggguguaagucaaaugucuuagcugagagguauuuauuauaugagagggcuggaaaaaagccuuggagaguauaugguaugccuuugaccuucuuaaauaucccuuacccaacaguugaaagaaccagagaagaagaaaccuaaguuaagauguagaugcuaggacacaggccagccuuucucuaugucuuugugacuuucucccaaccauuaaccuagaaaaucaggcuuaugagccuuauucaaguccuagcaaaauuaaagaauucuaugcaucaugaauuuucagaauuuuuugagaaggaucaaaauauaaaugucaaauaucucgaugccaacuaucaaaagucuuaccucuuaaacugggccuucuguucccauggaagguuugaaguugggugaagggaaagaugaagccuugagguaaacuugguacaucuugcuggagugucaguuuucccuaaagaugugaaggggauguuaaauuagcuggaaagggacuuaagacauuaucagccugagacaaacacagauauauacauauacauauauauauauuuauauauauauuuauuuauauauauuuauaaauauuuauuuauauuuauauauuuauauucauuuauauaaauuuauauuuauauauuuauauuuauuuauauaaauuuauauauaaauuauauuuauauauuuaaauauauauuauaaauauauaaaaauuauauuuauauauaaauuuauauauauauauuauauauaauucuauauauaauauaauauauaauauauauuauauauuauauuauauauaaauuauauauaauauauauaaauuuuauauauauaaauauuauauauuauauauaaauuuauauuuauauauauguauauauguauauauaaauauauacacauuuauauauauaaaaucaagauaucacagauauauauaccauauacaucaaauauaaauauacauauaccauauauaugguaguaaaauauaaaaagcugcauggauuuuuaaacuauaaaaaggacaucaacuuaauuaugagaucuuucuucuacucacuacuaaaaaaaacccaaaaauuaaaauuaauugugagauuacaucaguggcuuuagucuacaccaccuacccuuuguugugugaacaguagggaucagaguggaaauucagagaagaaaucuagaguuuaggacaaaguaucagggcuggcuaguugaaauggagugcgugaagccaguagauuuugacaaaaauuuacaggucacugaaucuaucgagagacauacgaaacaggaacagaaaacuguagaauguuuacuccucccuguuauaugagugaagaacacaaauggaguuugacuaaagggaagggaguccaauuaacacuaaguaguacacgacucauacauacucaguucccauacccaugucuagcaugucguucuaaugauauuauaaugagaaaaccacauauaaaaaaguaagaaauagacauagagcaacauguggucuagcuagcuccaucucagugcaacaggucagagggagacauugggaaaagcuugugcuuuagaugaagagguugacucauugggaaagggcuggcaugaggcuauacacuccugagucucugggcacugcuuauugcaucucccauugagucuugcugagugaauguaugcaauaaauuauguaguugcauacccacauugucuuaccuguuuugcaaguugguuucacuugcuaaaaggaaccucaacucagauagaagcucacacuguuuuauugccuggcaucgaagccaucuaggcaggcugcgacugagacuuguuucuauccuuaauuuuguucaugagguugggcccauaccuggaguugggagcaagagcauugauuaauuuucuucucuuuggaggguuaguucaguugaaaagcuugagaaguacaggggguauguuccuuacuaaaauggaugaauuaaauaauaaagcuagaaguaauauuuuuccuuuugucuauuuuccaaauugacucgauauugauggcuacuuuuguaaguuuuuauuuaaguuuaaagggaauauuuauugaucaccucuaugugcucaguacugcacuaggcagagauggaguaagaaagaacuggaggcuacauuucuugucuuaaaggaguuaacaaucuuguugaagcaaugagacaaaaaaaaaaaaagaaagaaacuggagaagaggauaaauguguuuaaggauaaauaaauucugaaugucuuggauuagagucagaugauagggguauuaagugagcuaaagauuuugauaaacugcccuaugcaaagauuucauugcaaggaucccugaaucuaauuuagccugaaagcugcuagcagguggucaugucccagugcugugaucccccccauaaaacggcuacagggauaaaagucagcuugaucuuaguagauagcuuccauaagcuuaaguuuuagcaguauuuuuagaaaacauggccuguggcuaacaaaugaaaauaaggcagaacuugaaaaggccuuugugauuuuuuuucccucauuuucagugguugaggcccaacgugagccuggugacuucugugugaacacagaacugacuugaauugauucauuuauuaagcuugcuuucagucaagugccucauuuucuuuugaggguagaauuaaagggaagauucuacauguacuuguuuauccauuuccuccuuuauucaacaacuauuugagaauauuuaugagauaccuaaaauguaucaagcauugaagagggugccuuucuaucuggcaaccagagauuagugguuagacugaauaauuaauguuucucuugguuauuuugguguguugaagccaagguuuaugagaaagcccaccucagagaauuucuaacaaguccucagauucaggaacaccucaccaggucuagcuuuccaagcaguacagagcucauuaaauggaaagaaaggcuaucuaauaaggcccuggaauccgacaugagagcaugagucuguuaauugcacauuugggucaauccacuaagcauauuugccagauuugauguucuuuauaaaaguuaaggugaauuggagcaugaaggggguccaugugaacaaaugcucuaauaauuuacaaaacugucuuaggguuugugacaucaugcuccauucuauuacaacuugcugccuggaaauucccaguguacuguuacuugcaguuauauuugaaguuaggggagauuguuucaucccuggcaucaagaagccauaauccaaagccugguuccagguaugcacaacauacaaauaucagaagcaucucauagguugcgucaguuucugcugauauuuccaagagaaacaagauagauacuccccuaaaucucccagguuggcuauaugcccuuauuuucaaguguaauaauuuuggaaaauauuuuugaaaacuguaaaaagcuaaauuaauauuaauuauuacagucccccaugaccuugugaguuuaucagaagcagggacagaaacaugcucaucuucuuuucuccuuuuauauggucuggcauauaaguguugaguagaugcuuaaaaauaauaaaugaagaguuauaucuguaacuuccuuuaauuauuucuuauggcauuaccauuuaaggauaaucuaaaugcgugaccuguacauauuuggagaugcauuuagggggcuaacaucuuagguguguuuacuggaagaauagacccuugggaaauuauaucgguacuuuuuucuuuuuucauccauucaacacauuuuuauugcauguuucucuguccccaucacacauaaauguucuggccaagacagauaaaguuauuacucaucuguggagcuuauacauuucuagggagggaggcagguagcagaaggcagagauugagagaagugccaugaacagccaucaaguaagaugaacaagauaaguuuauauggugguaaacaugaagaagaaaugagagcaagaugcuaugugauggugacaggugugggggagugaugaagcaguuuagauuggaugguaaggaauggccucgccaaggaggugauacuucucuuuaaagaaaucugagaaaucuuuuaggacaggcuuugcaagaaugguguuuccuaaaacuuucuguuuuuuuccaauugaauguauaaaacugccaguuaguuccacuaacugcccaaagaaaugggcagguuaagguuauccuuuuuaucugugggaaaagaugcucccagguacuaggaagcaaacaaaaccuguuuuguucaacuuguguuucuauccacuuuuauaaguacacaaaaauuauagcaggacacuuaaaauacuugugauaacagccuuucuugugauagcagucugucugucugccugccugucuuccucccucccucucuccauccaucuauccauccaucuccauccauccaucuccuucuuccucuuugccaggagcaauucugggagaaacuaaccuaacaaauaaauuuccauuuuaauuuaaguaugcacacacacacagaauaaaagcuguaaugcacaaauggacuuaaccuuucuauaaaggcaaaaccaguuuaaagcucucugagguuuuagagcucaauacaagguauagucacagaauaaagcacuuuggcaugaauagaagguugcuucagcuacacugcagucugcuuuuaagacacaaggaauggaaugcaggguggaaguuucagggccuguuaucagaccgcuugagacagugcugcucagagggcuaccaguaacaucuguggaugaucagucaggcccaagauucaggcagaaaucuuuauuccuaaagcaagggaugaaagaguagaggauaaaacgagaacaagagaaaaaaaaaaccagaaaugcccaugaugagauaugccaaaacaguaaccuugaaaaauauucugggcaccuaggccaaagguggucaaccucagaagcaacaugcugagaagcagucuauacagaguaagcaccuaaaagaucagcuaaauuaauaaauacauuauuacauuaaugaaagacuagagauucauuugguuuuuaauauuucaacugaguaaauucuuuguugugauuauguuauuuuaaccuucagauugucaugcuguucauguugauaaacauuugauugugugucugccauguuuucucaucauuucuguggacuucccagauuauaaaugauuuucucaugauaguucauacuuuacuuuuaaauuuuuuuacaauguuccugcauuacuuuuguaaucacaaauuuuaaaaauccucccuaauguguuugcauuagagaaggagccgugucuaucuuauuuaaaauuguacccccaggcuuccacagugccugauauagaauguauauuuauuaaugaaugaauucacuguggugggaaaauuuccggaaacuucauaaguuccagaaauuuaugaaaucagguaaaaacggaaaauccaucaggaaaggcagagaaauuccuagccaacuuaggaguuucggaaaaagaaaguuauuuggaauaaguuauaguaaaacuccauucuaacugacuaauaaaaaugaggguagauuuuccucauguuuuuaaaggguucucauccuuuuuuuccuaccucauagcuccaccugaagaagauuguacaucagucacagaccugcccaaugccuuugauggaccaauuaccauaaguaugucucucuucuaaucuuaauuaaauuuuccuauuuuggggaaagggcucagguguguucucugugguauauuugaauagaauauuaggccaggugugguggcucacuccuguaaucccagcacuuugggaggcugagguggguggaucacuugaggucagaaguuugagaccagccugaacaauauggcgaaaccuuaucucuacuaaaaauacaaaaaauuagcugggcauaguggcaggugccuguaaucccagcugcucaggaggcugaggcaggagaauugcuugaacccaggaggcagagguuguaaugagcugagaucgugccacugcacuccagccugggcaacagagugagacuccauuuccaaaaaaaaagaaaaaaaaauauuagucauuucccuaagacuaaguaaggacaguuggcuuuaauucagugucccuuccuuuuuuucugcaaugacuugaaacugcucucugguuuacacucaugcaucguuccucaaacuucagucauuugaaaaccacuuucacauuuuuuuuggcaucucuauauguacaaugcucucauuuacuugauauuuuuauuuaaaugauccacuguuuucuaauuaaaauacacuuauuuuuaaaaagaaauugcacauggaaaaccaacaucacaucguaaauagaaggcaaccuuaauaauaaacuuaaauguaagaaaaauuaaauaauguucuuaauuugcagcugcugaaagcucugggucugagucauguucucucuuauaaagagggauuaauaagugucagguguaggggcauuuuggcccuaauuagcaauuuucuguuugauauaacugaaguauugaaagauaaucaugaaggauauaaacuuccugauacguguuuugacauuguuuauaccacauccaucuuaaaucauccugauauaugauuauccacagauguauauauucgggcacuuuuuaaaaauagacaugggggucucacuauguuguccaggcuggucuugaacuccugggcucaagcaauccuccuuccucagccucccaaagugccaggauuacaggcaugagccaccaugccuggccuauuccagcacuuuagaaaucagaaaaucucaaccagaacuuucaaauaggcuaacugcuaacccugaucuuacggccucugagcuucauuuaaugggaaacaguacaguguugagaggucugauuucugcuuccucacagcuggauacugacagugugcacaggcaugauguuggcaguggcagagggaugagaaucuucguagaccauacaaacccagccccacauuguuauguaaggaauugucccugaccugugccuugcaauaggaaggggaggcuucacaccaugauggcuacgacaugagaugugcugucucagcaggccugguaugaaauccuaguucccucaccaugugugagauuuuagaggagugacugauccucaguuuucucauucauauaauggaacaaccuaugagaauauucaggaaauuuguaaaagacacuaugucuaauguauguccagcccauaguagagguuuaauaaaugcccuguuucuuugaugcccacaguucucuuuugaaguccagacauguaagaguguggucaacaauauuuccuugucaaauccucaccugcagagauuaccagggugacugagaccuugauuuuuuuuuucauuuauguauuauuaauaguuccacuugaggcuugccacaguggcucacuccuguaaucucagcacuuugggaggcugaggcaggcagaucaccugaggucaggaguucaagaccagccuggccaacacgguaaaaccccgugucaacuaaaaauacaaaaauuagcugggugugguggcaugcaccuguagucccagcugcuugggaggcugaggcaggagaguugcuugaacccaggaggcggaggcugcugcacacugagauugcaccacugcaccccagccugggcaacagagugagacuccaucucgaaaaaaaaaaaaaguuucauuugagcaagcuaaauauguggccaaaaagaaccuuuagucccaucaaugcaauacagcagaaaauaauuucaucuaaaugcacaccugcauagugaguggcccagacuugagagcagcaaauacuucuagggaggaauaaugaaugaaugcauucaggcuuuuucuucuccaauucauucuagucauuuguugaaaccacagauguugaucuucauguauaucugugcuuguuaauuuccagguugaauuucacagagaacggcaaaugcucuucuguauuuagaccugcugguuuccuagccagaaguggguguuugcacaaguggacaaaacuugccccuuaaaaaagaaaaucaaaaucuucaucauuuugcagauguaucuucccugcugaggcuauuagucugcuacuucaaauccuuuucggaggaauauauggaauuaauagcaacacauuuuauauguacuucagaagggagaguagggaaacaagugggagaaugauuauuuauugagcauccacuguauuuugaauacugugcugagcacuuuacuuacaauguaucacauaauccccauuuuacaaaugaggaaacugaagcucagaguugccuuguccagagcucuaugaagcuaggauucaaacacagggaugggacucuccaguacuuccuuguuuccugccucauccccagggugugugggggaugggagggugcacuuucuuagugcaucugccacucucucccaccacuggauagauagguguuucucauuacaaaggaaaauagcuuugaagucacuauguuaaacgcuaauccacauacucaaaauaugagcugugaaguucuguaaguaccuuuucucucucccagcuauuguuaaccgugauggcacccgcuauguccagaaaggagaauacagaacgaauccugaagacaucuaccccagcaacccuacugaugaugacgugagcagcggcuccuccagugaaaggagcagcacuucaggagguuacaucuuuuacaccuuuucuacuguacaccccaucccagacgaagacagucccuggaucaccgacagcacagacagaaucccugcuaccaguaaggagaauaaaucacugugcuucccaauagcaauucccuggcaaaaugucucugaccuuccugagcauugcacacucacgugcugauuuucucgucucuagacagcuggaagcuggugaugccauucagggaggugggcucuugugguugucaguaaacugccugcauugacuacuacugccuaccuuuuuuccucaucuauaacuguuuuucuuaccuuagcauaagaagugccauauuggaaguuuuauuuuggggagagcccuccuuauucucuuauccccagguauacaguaacaauucaagccugauaugaaaacuguuuucauuuuuucauguuuccuucuuguucuuauccaccuauggauaagauuguuuucauaaaguugggaucauagaguuugcauaccacuccacuagcaccuuuuaaaaaacccacuuaugccugagguugcaauuuuuugaauuuuugcaaucagaccuuggugaugacaaugagcaguaggauauaaauaacucccacaugcuuagcuuuccaauaauggaacaguaggcauacgugggucaacuguggcuuuuuauguuuuaacuugauuuacauucauacuauugauaguguaauauucagugauuuucaccaacgauaauuuacucaacaauuccuuuguuuuuaguccaaggaagcauaucuggaagaguuuucuggugaaauuaaaucagcuuaagagcucuauaauccagccuguuggggaauguucucaauacuuacuugguguguggggguaauucauuacuuaggguugcaagaguggaaguauguaaacauugcguuccauuccuuuggaguuugccccucgcgcuucagcuccacuggaaaguguuuacaucucucuugucuccuguuucccucuuugcuuuucuucuaugguuuguuuugaaaugggcucccagaugggccauguuccuccuguggaggauuaaucaaacucaaauagggcaucugccucuggagcgguuuuccuaguaugguguggauguucucuuuuccuggcuauagcuccugaggggugaaacuugggccuccaaagaguguggcagaaaugcgcuggcuugugaauacucaagacagggcccuucucuauuccuugucacccagaagccagggaaacccccacaguacugugauuucauuuaaggucacuugcgcaauaguguuuuaaauuucugucagucucuggcugagggcaugauacaaauaggcuugggguucccaucacucccugcacauucuuugaagcuuuuuaaaaagcagaguuuucaagcugcccauacuuucuuggguuauuggcccucuugaguuugcaucggcuuauuguugguagucccgugggcaacccuucuugagagaggcuucugcaaaccaagcgggccgugcugcuagcuacucacugcuucuuggguucccugucuuuuuaaaguaaccaugucgaaggugcuuaucauuaugguaggcaauuuugucggauguuagcgaacacaauaauuaguggucucagcaggaaggagaauaggucuacccuaaaguaccacuucccaccaaagaagaaaauccugauaaaacauaacuugggacuauauguaguuaacauucaaaccacuaauagccuauauaaaauaguauuucauguguguuuuaaaaacacacauuucauuaaccccuauagaauaucucuuaagaacuguaucuucccuuccuaaguuagucagcaaacguauuuugagaaccuacuacguaccaggccuauuagaaugcuugggaucgaaggauaaacauaguuaggaaguaauauugaagagaggcaaggauuacugagauauuuauucauucaaucaauaucugaggucuucuguaugccagacacugcucuaggaugcuaggaauucagaguuggacuuaccuucauggagacuacauauuauugguuuagaaaucagggaaaaggaguguuuaugagauuuaacuaaaacauaguucaggauuugagcugagaaaugaauugugccuuucuccucccagauaaauuaguuaaguuuccuucagcagcuaaaaaagaaagagacuaaugagucuaccaaaugaguccagggcuaaccugagagucacugaaguacuauaggacccaaugggaccaguagcagcuccaaguggaucacuucaugcaaagaaacauaccaaggcaaacaaccugguggaaacuugaacguagcauaauggcaugccaggaaaagucagcacuguuagguuccugaguagaaucguauuucuaaaguccagugaggagauuugcaaaaccuuaucacuguuggacugagagcugggacagagugacagggagugauugcaaagccucccucaugcauugcaggagggcaggggucaagaggagugcuggcugagagcacagaagaagcggucuuuggcucggcuggcucauuccuuccugaagggccuguaguggguggcaauagggacagcuaguaagaauaaccaucuggguagcuuuaggcuuccagcaggcuguuuaucuugagugucaucagccucuuccuauuggugaccuggaacucucugggaucaagaaaccuaaacuaauucaggaagcagacuccugccuuggaacacuguauuuccuugucuucugggugucaaaggaauucuuucuuuuuuuuuuuuuuuuuuuucagaucugguauggccuauuuggguggggaaaauuagaaauucugcuggcuaggcaguagcuuuuuccauuuuucccccucauaccacuccuuucaggaagacaaaaauaacgccuauuucuaucuuguucuuguagguuuguuuccucugguacuauuuuuuccuguuguacuauugggugaggguggugggaauuaugcaucuuuaauaaaguuucugaggugagaauguggugucuguggauuuucccggggaugcucagguuugucuggaggcuucauggguaaaauuggcuccuauuucucuacucucuguucugaacuaauguguccuuugcagcagggguguccagucuuuuggcuucccugggccacauuggaagaagaauuguccugggccacacauaaaauacacuaacacuagccauagcugaugggauaacaacaacaaaaaaagcuuauaauguuuuaagaaaguuuaugaauuuuuguugggccacauucaaagccauccugcaucacagguggcccacaggcuacggguuggacaagcuugauuuagaggacagaacauacugugccagcuguuggcauuuuauauagauagagucaaaguuuuuaaccuaggguucauggaccuucaguagguucaaugguagaccauaaggcauucuagaacuaucugaaauaauaugcaaaauuuugaguguguauauguagcaucacuuuuuugaggaaggaggacauaacguagauuuucaaagggauauauaauuuaaaguggcuuuuuaaaaucucagcuggcuuaaauuagauauuuauccugaugguuuuugccauuccauuucaauaagaaaacaugcuggacucaagucaaacuugagagucgaaugagagauuuuaaauugcaaaauguuacugaugauauuuucucuaauuugagaaaagucuggaauuucucuaacuuuggcaacucuaguuuuugguagaaacacauauugaauuagaauaaaaagugacagaaaugauagauggauaccugaggaaguuuuaucugauuucgacacuuugaacacauuuucuuugcaaaguuccugcucaaguaugaaguuugaccugaggcugaugcgugugggcggagcuuugaaaugccaguugucaucacaaacuaccuggguacaaugcuagacagaugugaaaaauacacacuagcaacccaaagauaauccaaagauaaaugcaugaaagcagucguuugaaaugcugcuucgaaaaccuccagcucauggcucagucgcccaaucaaguaaauagaaaaucucuuuccuucacagguuauuaaauugcugcuugauuuugcuuugaucaugaauucaggggauucaguuugaagaaugaguagcaugaaauuuauacccaugaggaauuugcauuucugauguuguccuaagauugugggagacauuaggagucuggaaagauaaaaccaggccuagauuuucuuuucuaauuaucauucaauaauagauacagacaucauauauaggcagaacugaaaguaaagauuuguagagggaauaucacuaagugauacuuucauaauugauccaguuacuucaacugugcacucaaacagccacgcaacagcucaggagcaaaauaacuagauaugguccugguuugguaauucacagccuaagacucaggaucucacaacaacagcaacgacagguaaacugcuuugucuuuugcuuaucagcucuccuggaugucagaccuuuuaguguuaggggagaggacguccauuaucacgucaaaucuccuucaucauucuuagugagaauagggucuuguaccacuucauauaucagaaaggccuguggaucuggggauaugauugauauucuuaaauguccuguauguuuuccuuuuggcaauguguauauagaaucagaaugauuuuuccaucagaggaaggaaaaacuaugaaucaauaguuuugaaugaaugaaugaaauuaugaaaaacuacaaaugaaugaauugacugugugauucaaugagaaaauguccuuuagaaagaagucugccggaaagugcaggcuucuccuuucugcugaucugauucucacagccaguaauaagagaaggaaaugcagauuucucucaucaaaguguaggcccugaacccuucuuuggacacuuaaaaucucaacuguaaaguguaggaaaugaccuguugcuccauaucagaaucuaggccucuaaccagcucccuggguguguggcucuuagcucuauaucccugcaaaguguauuguuacaggagcuuuggggaaaaacgauucaaggccuguaaauaugggagauuacaaggacacccucauuuauuaacuuucauugauggaguuaauggccauauuucaaaauaacuaggcauucuuucugcagagggggauaauaaacauggaaaaauuauucuuuacauuuguuugccuuauaugacauuggauaaauuauauucuuuacuucuauaaauaaucgugaggaaaauagugcucauguuauguuaugguugccauaucacaaugucuaagaucaugcagggguggggaggggggauacagagauugcagaauaaagacaaugcuauuuuuaaauguugacaauguuuaucuucauaggacaaagaaugugaaggaaaaggucuuuuuggcaguguuucaucuucuugguucauuuuugggcuuucuugauagcugaaaaaaaaaucuaacucaccuuacuauuuuguuuggggaugaugguuucagccucucugcuugaacuuguucucaguuuuuugucuacuguuagcucauauucuuccaaugcacauuuuugggcauuauugguuauagaaauggcagucuuuggagauuuuuaaaucaagacucuugcuucuggucuuauuagcaagaucauuggggucacuucaucucugucugucuuuccugauugauuauccuauuuucaaagaaugagacucaaaauguccuguucugcuuugcaaaauauaguuucacauaagaaauuaccuugggcaagguugugagaggauuuggaaucuaaauggagaaaaguguagaggcauauuuuucaaucuucuacuucuaugucauuuucccuguguguuggauugcuaagauuauguaucuauugcuggcagaaauaucauauccuaaauucuuggagaaugauauugguugcccaagauuguauagaagauuaaggagcuaggacucugaagagcuggguuuuagaaucauaaacucucagguuuggaaaggauguuaaauggucugguucaaucaacacuucuaauaauuuaaucucuuacacaacuuucuugccaagugaucuuccugacuaugggaaacauaauacuuuaugaagaaguucauuguuggauaguucagauuauugguuuuuuaaauccaacauuuggaagaacauuccucuuccugaaauuuucaccacagauccuaauuuggccucauggauccagaggcaaaaaaguuuaaucccucuuuuacauuauauagacuuucaaaauucaaagacggcugucaugcguuccuggagcccucacucuugcuaauuaggcuucugacuucagacaggucagaagcucuguccagcaaaauuuuuaaaucuuuaauauaaggagcaugaaccagaugacauuuaagauccuucccucucugacauucuauaaacuucaguuugagucucugaaaaaaauggaacuuuuuugcuuuuucccuuucuuuucaccaucuauaucaaauauagaugauucucuugaguaguaaaagaguacaagcauauucaaugcuauuucuuaggaaccguuaauuaaucuuucaacaaucaauucaaucaugauuacaacagcuuugaugagcacuagugcuacagcaacugagacagcaaccaagaggcaagaaaccugggauugguuuucaugguuguuucuaccaucagagucaaagaaucaucuucacacaacaacacaaauggcugguaaugaguuauuauuaucucauagcguauguuuucuugacagccuugaauaauuuugauugaccucugggauguuauuaaagccuaacguuccuucuauucucacaaauuuucguuaugacuucagaaggaucauuaacucugguaucuguuuguuugcuuguauggcaccaauaagcagauuucuucuuucuaaucuauggauuaguauagaccaggagaaggcuaauacagagacuaugaaacgggaauaaguuuuuuuaacgauauggcaaaauugugacucugaaagaucauucauguauauucuaaaauuaccacagucauaaaaagucuuggacuuucaugaggaaauagcauagcuagauaugaaaaaauauagaaaaucuucaucaauggaacuauucuugggguagacacuaaucauaugaaaagacaaaugcucauucccuaagauagccugaaucucauuuaaaauguagaaaaccccuuuuuaguaaagagacaucuucuacaguaaccacugagaagaaguggaaguuuuucaucuccuuuuuuuauucaaaaagaaaaagaauuucucaauuucugaaccacaguucacuuuaguuaaccccuuugauugccuaauaaugccaaaaaugauuucucuguuaauuggcuucacauuuuugcucuaugcugaaguaguauugggaacugcaguguagcuuccaucucuguuuggagguacacugaucugaucugauacuagagaagauaaaaaaugaauuagcaaauugugaacacaaugaaaugacugacguagguguagauuccaacauuuuucugaaggugucuugaccaaaaaaaaaaaaaaaaaaggcacgugugaaaccuuuccauucuguucuugauggcuuggcuuuaauggcauaugguuaaugaguuaauaauaaacauaucugaaagugugggggaguuuucauuagccuuuaaaaacuuauauggugagauuauguccacacuuauucuuucagcuuucuuaaagagaauauucaguuuuaaagaucauagccacuuguuuugagauuuauguauuagcuucggagaucagaacauaagaauuugggguaugcaagucaacucccucacuuucuuuuaaaaauccugggaaauccauuauaccuucugugccugauuuucuuccuuugcaaguggguugcuuggcguccagcucagccacuaaugcaagucaccacaacagguacgucuucaaauaccaucucagcaggcugggagccaaaugaagaaaaugaagaugaaagagacagacaccucaguuuuucuggaucaggcauugaugaugaugaagauuuuaucuccagcaccaguaagaauaaucaauuacaguacagccauuuaugcaaggcuuauugauuaaucugagugauaccaaauuguaucucucuugagaaguaguuaaugugaaaaaugggugaaccuaugaucauaccuuaguuauaucuugaugagauuauggaagaagaaauagaauguuuugagaaguggggaaaauaucucacaaaauuucucuugucucauguucuuccuguuuuauuuaucuaugggaucuacugcuacagauugucuuugaaugaucaggcuuuaucagagaaugacauuaaaacaguacaaaaaauguacauuguguacuuacugugcuaggugcuggaaacacgaagaugaaaagagccagagccuuugcuuuucagaagcucauggucuguuggagcaauagacuugaagaaugugaugaggaggguauuaauuaaaaguuguaggccaggcgugguggcucacaccuguaaucccagcacccugggaggccgaggcgggcagaugacgaggucaggagaucgagaccauccuggcuaacacagugaaaccccaucucuacuaaaaaauacaaaaaauuaaccaggcguaguggcgggugccuguaguccuagcuauucgggaggcugaggcaggagaauggugugaacccaggaggagaucgcgccacugcacuccagcacucuaaccugggugacagagccagacuccaucucaaaaaaaaaaaaaaaaaguuguggaaguuccuaaauugaaggcccuaaaggcuuaaaugaugggagcuagaacucaagaauuaucuuaguuaaucaaagcccagcugaggucaaaggaacaaauccagaguuuuaacaaaugagcuggacaccaauauagcagaaagaccuugaagggaagggcaaaugucagguuagcuuuagcaagacauugccacuuauuaaaagcaaauaaugaaaccacuauugguacauaauaguauccaaauuuuugacaauuauaaaacuuuuugagaacaaagagauggaaauugagcuuuaaagauauccuuaaaaaguuaaaaacaugcaaagguuggucuaauauucugccagauuacugaguuuuccacacauaccuguaaugacuuaagauuuugcugaacagagcugagaauccugaaccugacuccaucacaguucugcuuuuccuuagaaaaaaggcuuuuggggugcugugugagcucucccaauucacugaaguucuauccauuccauuaaaaucugagaauuucauccucaaauggacagagaagaaaggguccagaaaaaaaaauagcuuaggccuugaaggcaucugaguauauaacauugauaugacaaauacucaaaaggaacuagaauuuucuaucuaaacuuuuaagugauuuuuuuuuuagacccgacaccccuccagagcuuaaucuauggaauaagaaaauuccuuuugguaacuucagaacaaaaaccaaauaaucaaaaacacuggaguuuuacauuauacugucuccuguguucagcauguggcccagcuuugcagaugggcccaucaguaaauacguggucuugauacugaagaaauuaaauucccuugggugguaacccaaacagaucuaccuguaaaugaauuguauggucaggcuucagggaaaaauuucccaugguguuguuuuuuuuuuuuuuuuuuuuuuuuuuuaauuuuuuaaaucucuauggcauauuuuuccaauuucugcuuuucuuuuuuuuucuuuucugcuuagcaccuauggacauaauucaacaugaugcccucuuucuucuggaggggugugauaacugcuugauaauaagcacuuuuucaggccuauugagaaugugguuaaugauucuaaacuugauuuuucauaacuuguaaaauagagcugacaguauuauaguucugaaaacaguuuugcguuauuuggguaucaaaauaaaguuugaaacaauuaggauggauuugcaaauaaccuuucacaaaacauguugacucagauuuugucaugauccuucuguuaggugcaucucuuauuccagcccuaacagauugggugacaauaucagggugcugguggauguacgccucuuucuuuccagugugcugcuaugaugguggcugguuaccuguggugucuuauuuucuuucacuggcuaugaauggcuugcucaugacauauuuuguauuugaugagaauaccauaguguuugauaaauauucagaaauguaucgcuaaaacauauggcuauucuagguauucuuuuucagaaucaucuauaggaaagcucuagcugcucaggcauuccuuuccccacugaaauuacuaacaacauaaagugauuaucaugguauaacuuucaguuaucugccucuucacccggaggaucuacaaacagcacacagugacuaagucccugggcuuucaagugcagagggauacuacagacugcauggaugggcaaaauggcgccuuugguuauccucgguggagggcugguguuuucaaagcuguccuuccuacugcugcagcuucuuugacuguuuuaucuggaagaucucauguucugaaccccaagguauucuaugacagaaugcaaaggacacugagaugcuuaccaauauggcugaauuaagcugaagucacccuccgcuuucccuccauuuccaugcagccaucuauacaaccugguauagaugauucauugcauagccuacagaagcaagacuaugugcgggacaaguggcgaaggcucaagaaauaacauuuuucuaauugcuucaaucaucguuaucacaguuucaaccacaccacgggcuuuugaccacacaaaacagaaccaggacuggacccaguggaacccaagccauucaaauccggaagugcuacuucagacaaccacaaggaugacugguaauggguucugcauauuuaaugaaagauuuuuuuccccucaaagcccaugaugcugcaaaggucaaucaucgaggcacagugggaaauuuaguuaauaucugaucaagaaauucuuaguggacuuuuaugaggauacuuaauuccauuuaggagucauuuaucaauuauaccaugugggcacaggauuuuuuauguugcuucaugauaaaaaugaauauguuugaaugguuugugguucugccuuugacaaacugaucauaguggaauaauaagggaacaugaagaaauuccaagcccauugauuuucucuugagaccaauuagguaaagucacucaaaauuuuugagaguggaugcucagagguaacacuuuggcauagaauuguuaaauagcaugcacuuuaauggaagaauagaaucauuaaagauugguugauaacaagucacaguguauuuaaccaucaucacagcagauguagacagaaauggcaccacugcuuaugaaggaaacuggaacccagaagcacacccuccccucauucaccaugagcaucaugaggaagaagagaccccacauucuacaagcacaaguaagcaagauggcggucggcaguucuggguuagaugaauuaguaaagacauuccagcaauagggaagauuuuguuuagaaauuggccgcaucuucuauuuccacucgguaauuucuuuuauucuuagagccugaaaagcugcuaaacccgcacacaaauuuuaaaaauuggaaggaaaaugauaacucaucagguugcccaaaggccaaaauguuuuaagaaguagaucuagauacaauuuuuguguuaaagguuccuagagguuccauuuggguaacuuguguguguucauugaaauguguggcaaagaguguguucuuuuggugcuuaguaguggaaucuggaaagaaaguuugucaagugaauugaucuuuggaauccuuauuuucuaugaagaucuuugaugaauacagugucuuuuuugcauucugucccugacuguucuauagaaagacaucccuuguacucuuuagagcaaaguugguagcucuuauggucuucauuugaauucuaccacugcuucuuuuucuguuuuuaagcccaugguaacuuggggaaggcuuugaugcucuuacuguuauuucuacuauuaugaaaacucagguuuuccaaaacaaucucaaguugcggcaguggacugugagaauagggggcccccucacuccccaaacauaagaaguaugugcuuuucuucuuuuaucuaucccgcugagauaugucuaucuuauuuggaauaaaaguauuuauuuuggaaaacagcuuuuuagcauuuuuaaaaugaugacccaacugucauucucacagcccuagauacaccuaauggggaaaugugagccacuuaaaagccacuuaaaaaccaaagggcuuugggaaucuauggcuugaggggugccuucagauaacaaaagaaaaguuucagguaucaguuaggauagagguuagacauuguacugaauauauccagcagaucuuacaucccauuacaaaccccaguagguguguuguauacauacggcuuagggguuaaguuaacaaagaagucugauaagaaaaggaaauacagaggaagcauaaaucucuuuggaauaggauuuuguuccacucccuuagagcccuaacaguauaccuuagaaauuauuuuagacaguuuguacuuaaagaccagaaagcuacuuuagagacuuggaaauaaugagccuauugucaaaagguggugcuugcggggcauuaggacuagaggguuggugaaaauucagacagaauguaacuugacaaagagaagacagcaacaacuguaacaauuaucuuaugaauauuugcgaaacucaaagggaucugauuggugaccucugggcuuuaucaaauuaacaucacaacuucuagaagaaagucaaccuucaucuuuuacaauagaaaucauauguuuugcuaacccauuccuauuuaggcugaaaacaauuaagaguuauggguacuuaaaaaaaucauuauguuuauaaaauuagugauagaaggagcauaguguucuauacagucacacacauacacuuccuuauuucuuuuauuuaaacuuugaguaacauagcagucuauguuugggucaguuuucccuuuuuuguaauuacauucagugguuuuuguaacuucauuauuuauugggaauuagugauuuagucagugggaguuuuguaaaacuuaagauuuuggcuuuuuucccccuccuccuggauaaccaguuaacccaauaauggcuuggccgauggaaggguaaaaugaggacaguuauauuuuuuaaaugucauuacugucaccaaaucacacauaucauuuucuaagauaaggaaauacaaccauuuuuacaaguugcaaaaaaguacucuggcuuggcaaguuuauagacucucauuuucuugauaaacuaaaaaaaaaaaagaaauugcuacaagcugcuauagacaaaaauguuggugucuuucugacuuuuccugaagacaccuugauggaauuauauucucuugauuuuguccuuuuuaaaaugaugguugaaauuuuaagccugucacacacuauuauuuauauaaugccucaaacuggcuuggauaguuuucgucaacugaauuaauuuuguuaaaaagugauuuuagcaauuuuaggugccauguggacaucaccaaauacuguguuaguggaauagcauccaagccaucccaccaucuuuccugcugggcaaauccacugcuggugcauuuccagugugugcgauuauggguuacaugaccaccauuugagaaggucuccuaaugugcugaucuuguuauuagcuguuauacaguguuuuccuuucgucaaaaugacuggagcaaagagguuauucuuugaaugguuuucucagacaggguaugugaagccauucacuacaguaaaauaaaaauaauaauaacucauagaacuaugagaauucaucagcuauggucugcuuaguccuaugauuuugaacaaaucaaaacuucuuuggaccacaauuuuccuagcugaaaaauuaaacauuuggaucauuugauuucucauaucccuuuuagaauaucaguggccuguuuccuuggugccuuucuuuucuaccuucccuccccauguguaucugcccuuaaaguagaaagauauguugacagcuauuggugaggaaaauagacaauuaugucucccaacugauauucuucucacaguccaggcaacuccuaguaguacaacggaagaaacagcuacccagaaggaacagugguuuggcaacagauggcaugagggauaucgccaaacacccaaagaagacucccauucgacaacagggacagcugguaauggaugguuuaacaaguaaauuuggauggaaacuuccuuuuggguuaaacgguagacauugaggacauugaacaaaaggacacuggaggaauugucacgagauguuagguuacuuaauaaauuaugcugcaguucacacagagccaaaccuuaaaggcucauaacaagucaccugaacaggaauggauacaagccaguuaugaauaagaacaggaaacacagagaaaaugcccuugaacaugucucuuucacaucgaguuuugggcaucaucuagugagauuguagcagaggcccugauaaaauaucgcugucuguuguauaaaggaaucuacucuauaauguggguccagacuuuacaauaugauucugcaaagucuggcugugagaaagcauuuugucagaacuccaguguuugaagaaauagagccagacauuaugugaaaagugacaccugucugaugucauuuggccuuuuggccaugccuguucaguaauuuguuuuugaguauaaaaaagguaucuucucuauucuugaauugugagauuguggaaauuggaauccagucuuaucaucaucucuaagugauaccagauaacuuggcuuugcaagcucccaugcaggauucuuuugucugugugacauaaguauuaaaauguguccugccuuauaaagaaugugaauuccauauucucacuugguaucagugagaaauauucccauauuucuauuugcaacauagaagauaaugcaucauguccuucuggggcauggcaaguucuaaaugaauuccuggcagagcaauggauucugugauugucuaugugguguaguuguugcuaagaggaugcuauuguaaucuuuucuaccuauacuucuucauuggcucagaaugaagcaaggcaugugcugcuuucuuauaugucauuuaugccauaaaucccauuguuagaagguaaugcuucuaacggauuccauucaugcuuuugagauaaauggcauugacuuucauauugaucacauggaaagcuguuaccugauuccuuuccugagaucacuuccagccuaaugugcauuuggcuggaauaugguugucucagaauaacaucaugcacucgggcuuuuauacuucugccuuuaggggacuguggcagcauggcaugggucaagaaguacuucuccuucaucuuccuuugaugucgguaacucauccuuucugcacugcgggaguuguuaaugcuuuuguguccuccaguucacaugcugauugcuaagaagaaaaugagcaugagugaacccaaagcugcugaaacauucugcguuuaugcaacuuccuugcccucuauacaaggaagaugguuucauugucuugucuagagaauaaagucuuuuuuaaaaauaaaaucgguguaucccugaccaagcguccauuaacacuuugacaauugcucaaacugcauggucacagcagccucagcucauaccagccauccaaugcaaggaaggacaacaccaagcccagaggacaguuccuggacugauuucuucaacccaaucucacaccccaugggacgaggucaucaagcaggaagaaggauggguaauagccucugagauuuuuauauauuauguuuuuugaaauccacugagugacugcugacuauuuuucuagaaauaugcccuugguuuuagaccaaacuacuuuccugaaggaccugagguucuucaaaaauuaguuuucuugguaggagugauacucauauucaccugaauaugaaguucugagcugaaaguaaggaauuuagcaggaggguuggcaaaagaaaaaacuuauugucaaaauauaucugugugaggcaguaaguaauagauaugaaaugaauguugccaacaauaaacgcuaaagaaauucugagaaccccucccugcccaccacagcaucacagaaaggugaauuggacuugguuuaugaaaaauaaaaaaacccuggauagucagagaaaggaagugggugguggggguugguggggggggcaguuuuccuaagaaggagacuccuguaaggagaaacgugaaggaagaaaagccaaggaaugaauaugucagugaguggauccauuuuucacaagggaagauguguuugaauggcuaggcaggggccauuauguugagugacugaaguaccacaggcagacccagcacacaugaguuugcacauggcagcuggagcucugaggacacccaugggggaaaaccaagccaggcaaagaucuucagaaucaauauuaauucuauguacugaugaagagaaagagauuccauuaaauuaaugaacaugucaaggacaauacaauuggcuucaacuacacaaugguaugaugacucuugaaggacucuacuuauaagagggaagaugaacaagagucuagagcccaucaucaagugggacuuuuucugggagaauguccauuugugguuuugauucagguuagcacuugcucuuguuugaaaucugggauaacagggucaccacauuuuuguccuacaaagaucuuuaauauuuuaguguugaauauuuaguguugaaucuugaauauuuaguguugaaaggcugcagugcagaccuggguacccaguauucuggugcuucacugggacugauuaaaucucccccagaggcagugauguggauagacuuugacugaauugacagccagaaauaucgaugggguuuaugaauuguuuggccucuguuucacucaagacuucuuauuucagcagaguagaucugugauaacuguuaaaaacaacauuuacaaguauuucagugaaauuucugcacuacucaacauuguacauguuaaauuuuaaagaccgcuuauacuuggguuuuugggaagaauaauucaaugacguccacugcuucuuauuucuugccccuguauacuuucuguaacuccaccuagguggucuuggaugacgauucuguuuauuugcauauucacuuugugaagaaaaaaagacuaaaggggggaagagggcuauuuuuaaaagucccuuugguugguaagggggaggggauaaaauggugccugagccagcacacuuugucuuuucuccaugugucagauugcauguuucuauaaaaaaggcaauguuucugucucucugcaagauuuggguguuccaucaugcacucauguggaguccuuccagacucagcaaaaacaaacacacagcauagcuuucauauaacucggcccuucaaggaaagccaguuacuuguuguggugcucuuugaugaaacaauaaucuaucucaguucgggagauauagucaguaugugcuuucuuuccucuuggccagaugugaauauuuaaaaaaaucagcuguagaccauaagccaccuucagguagugguuugggaaaucaagcaauaacacuaauauugauuccuucagauauggacuccagucauaguauaacgcuucagccuacugcaaauccaaacacagguuugguggaagauuuggacaggacaggaccucuuucaaugacaacgcguaagaauaacgaugcucagccacuuuauugacuuguauuccugcuucaucucuuacucgcuauuggccaagaugcagagcuuuggugguggaauggugcuauguggcuuacuucagcccagagugugaaacugucuucauugucuguauuucuuguggaggucucucaaccugauuuucccuucauuucuuugugccuuccagauuuaaugacuuuguguuuuaagaaaaaguaggacucuauucaacuccauuuucauucucuaaguaguuaugucagugaaacacaugcccacuuccaggauagugauuucucuauguuuuaacugaccauuuccuuucaauguccaucuuuccuccagccagugcagaagagggguaggauugcuugcaugguuguaaaaagacauuuuuggggccagauaauccuagagaucacaucaguucucagaggagaggcaaggcauguuauugacaaucaacaaagguggcgggaucccuggaacaacaacaacaacaaaacauugcuaguaucucuuucuaucacuaagaaauguucaaauucuaguagccuuaauuucuacucuaugugcagggauguccuagagaucagccuaaagucguucauaauuucuuugaggaauacaaaagaaaucuagaauuaagaaggucccauuuuacugcuugccacacauaaugggcagaguccuucauaugagcccuuuaggcaaaggaaaaaaaucagcaagcauguauugauggucagcaauguaaauagcacagcguuaagcaucaaaggagaugcaaauaagccuaugaaugguccuugccaaagaaggacuuauauuuccguuuuaugucacuguuggcuuuuguucugacauuggguuugggauuuagugacugucuuucuccugguuguaauauuuauucgguggugggcauggcuuaugggugugcuuuaugaaguuuuugcaccugcaacucaggucaguaccuuucuuaaaagaacacaaaagaaauaaacuugaaacaguccaagugauuuuagauaugggcaaugggucaaccuccaguugauauaugucacugagggcccuguguuugcccaggcaagcguuuccuuggugcagugaugaaaaucccaaugcacaggugaaauuaagaaauaacuuaauaauggaguaaaaugguaacuuuaauuuaaugaccuuuacaagguagcuaaguauuuccuuguauaaauuugaucuguguuacuugaguaggcuauucuagauaggcuucuuuuucuuuugugguuacaacuagacuacaggcuaucauaguguucauuuucccugccgucacauuucuugacacacaguuaggugcuuuugguuacugauaggagcauugggauucaaauauucuuuuuuccaugucucuguguucucugguuuucuggagugacugggagcaaugcugcaauugagccuggacaauccaggauaggcaaaguuuuggcucagucuucaccuugccacuuuaccuuugaugauuauacugagaaauaaagggucuucagaaccaaauaggggcaaaauagaauucuucuguauauuucuaucaaucagaggagaauugugugcacaaaccuuggucuuccuaugcaccuauccaucugacucuacucuagcuagauuuuccuugcuagcagauaacaggauuuguaccguagcuucaaauuaacacuggauucauuccucauugaaacagagcagaguaauucucagagcuucucuacaucacaugaaggcuuggaagaagauaaagaccauccaacaacuucuacucugacaucaagcaguaaggauuauaaaaccuaguuggcuucagcuauugauaagaaucaaucaauuauggguacuuuugcagugucuuugguggaggugcauccauuagcugccguuacacuguuacuuuuaaucaaaaggugcgucugguggugguucucugauuuuucuguuuuauauaccucuucguacauuaagugcaaacuacauuucuucaucuuaaaaguuggguuucuuucacucuagaguuagugauuuguuuuaacaauaauggauugcuuauauaugauuuauuuuauuuauuuauuuuuguuaacuugagaucuuucuaacuuuuuuaugugggcguuuaaauuuagugcuauaaauuucccucuuacuacugccuuagcugugucccagagauucugauauguuguaucuuuguucuuauuaguuucaaagaacuucuugauuucugcauuaauuucauuauuuacccagaagucauucaggagcagguuauuuaauuuccauguaauuguaugguuuugagugaguuucuuagucuugauuucaaauuugauugcgcugugguccaauagacuguuugcuaugauuucaguucuuuugcagugugauuuauaauuggcguaaaugucugauuauaucacuuuacauuccucacaauaauauuguuuugccuuuuguccucuggaccuccauggugcugaugacuaaaaagcagucccuucuggaaaagaaaagaauaauuaaauuaguagccucaggccuuugaaaccaugcauuugcuauuuuaauugcaggcagcaaaauuuuaucuuucaauccaaugauauguuuccuccacuacaucaaagaugaauccaauugagaaagaacucaagauuaucuaguaccucagcugacuucaagaucacaguuguagugacauagccuuaccuaauaacccaagcagauguugcaacaaaugccaauucuggguauuaagaucaccaaaaucucuucuguugagugauguccaaguagugucuauugcaaaauauuuauucuguucaauaguaugacaaacuucacucuauuucucccuauuuauggauaacaaguggaaagcuuuugcagcaauuguguguucuggagacaagcacaugguggguggugaucuuacaaauacggguucaucacugauuccaccuccacacagauaggaaugaugucacagguggaagaagagacccaaaucauucugaaggcucaacuacuuuacuggaagguuauaccucucauuacccacacacgaaggaaagcaggaccuucaucccagugaccucagcuaagacuggguccuuuggaguuacugcaguuacuguuggagauuccaacucuaaugucaaucguuccuuaucagguaauuuggcauuuauuaucuaguuugcuuucucuauauagagaaacaauauauaguuucauauuacagaggacauuuucuguguagucugggauuggacuaguuugugauauggaaauaucuuucauuauugguuaucaauucuagugcaaauaaacuuggguauauuuuagauaaaagaaugcuuccuuuugccaguguuuuuuccauuugucuguguuugcauguguguguguguguguguguguguguguguuguguguacaaguuggcuguuaugauggaauugcuuucuuugucuuaucuugugauauaugaaguugaaccacaugaaacugauauuuuugcaggugaaaguagucgaauuuuagcaauuccguuuaauucgacuaauauacucuacuuauuuuguaagguuuuauccuacaggugaauaauuucuauauacuaguaucuuugcucugaaauuauuaucuuguuuugguaauagauugaucaguuuuacuuuuggugauggauaaaccucuucuaguucugaugcacacuuaaaauguucaugauuuaaucuaguauuaaugaauagggaccacuucucuuauuguaauagugaagagaggaacgaagauaauuuauucaaugaaguuugacacggaccuagaauaagucuuuuuuuuucucaaauaaguagucaucucugcuucugcuuuucuuugcuucuccauuuguauuaagaaauuaacagugaagaaaggggaaauggaaaacgcccacuguagugaagaaauaaaaaacagauucugucuuccuaguacuaguuuuucaauugcuuuguaacacaaucacuaggcauauucaagauuagagacuuuagauacauaauuuuggagcagagaucuucucuccuccccccaaaaaagaaaaagaagaauucauaugugugcauauauauauaauuuuuuuuuuugagacggaguuucacucuuguugcccaggcuggaguccaauggugcgaucuuggcucaccucaaccuccgccuccugaguucaagcaauucuccugccucagccuccaugagaauccaauauguaaaacagaugacgguugugaugcagggacagaaaauucagaaugccacaugcuuggccucauuucucuggguggccuacccaagagcuucaagaaaaacaguuuaagaaaaugcuaacuucagcaauauuggcaagacaaagccccuuacacuccuuaguucuuuauucagcauuguucugcucucauuuauuaaaaauuccaaguaccauugucaguauucuucagaaaaucuuauagugcugucucauuucucuuggcaaaagaaagccuguugugcaacccaaugaauuuaauuuuuuuuuuuuaaagagucuugcccugucacccacacuguaguacaguggcgcgaucucggcucacugcaaccucugccucccggguucaagcgauucucuugccucagccuccugaguagcugggauuacagaugugugccaccacgcccggcuaauuuuuuuauuuuuaguagaaaugggguuucaccauguuggccaggcuggucucgaacuccugaccucaagugauccaccagccucagccucccaaagugcuaggauuacagacgugagccaccacgcccagccaugaauuuaaaguuuaaauggcaauuuuaauagucacaguacccuagaaugcuuauagccuaauguuaguaaaucaaaugcuuuuuacaagacugauauucacagacacugauucuuucugauuuccacagugguacggacagauuuuccauaauucuccauggauuagacaauuaagucacccaauucucauccuugguuuucuucaaaaacacucacccacauaaaucucauuuaugucuauacauuuuucucagucuuuacgcuuaauguuaagaacuaaagcauuuguugaagcaagcggaucacuugaggucaggagucugagaccagccuggccaacauggcgaaaccucgucucuacuaaaaauacaaaauauuagccaggcaugguggcaggugccuguagucucaccuacucaggagacuaaggcaugaaaaucacuugaacccaggaauuggagguugcagugagccgagaucgugccacugcacuccagccugggcgacagaacgaggcuccgucccccaaaaaagaacugaagcauuuagaaucauaguggcagugguggugguggugauggugauggugauggugauaaugauggugaugggauggugacggucauggugauuuugguagugggaguauugguguggcauuucagcaaauguuguuuucauuuguuuuaaccaucagccaaggaacaaagcaaucugucucuucaauauaguuacacaggugacuaagugucacccgcuuccaccuucucuaaucaaggaaauggugacgaucagguuacuauagauuccuuauaaggugccuucauaauggauaacuguagccauuuuauguaagcauuguccugugauuaaaaaaaaaaaaagauuccaguaugcuuuugaaaaaugugggugggggagagaguuuuaauaugcugcauucaagauuugaccuauggauuuagauucuagcaauucaugagguugucuuaaucuaaagcuuucuggugauagauguuugagaagcuaggauuauauuaacuagucauguugaaacuacagauuuaacuuuaaaaaauuauuuuaaacuuacuauaauacccauauuccaauacacauuauuaauguuagcuaucaucucaccauuuccuuuuuuacuuauuuucaauuuuuuuugaaaauaaguaguugaccuuucucuuugaaucuuuacaucauucaaucccaagauuccuuauugcauacuaauuuccugccgccaagaaaucucuguuucaugcccuaagccagaguaugcccauuugcagugauuauguuucucauaauccaauucauauuguccuuauuuaaaauguacaaugucuagucucaaccucauaccugcaaagauaucacaauauuuuuguuagcauguuccuuaccacaguucuuggauuucuaccaaaacaaaguuucuacaaaacuuccuguggucauccuucuuagccuuugcugccccaguuuccuuaauucuuauuaaaguucuagcucauuuaucaguggauuaagcaaugaacgguaauuaacauuguggacccauucaaggcuguuuugccaucauuuuuuggaauaccuuaaaaagacuaaacuuugugauaggcuguauaagaaugcaaagguaaagaaaugcagaugggaguguaagugaaaacaugcaguacugaccuuccugauugcucauuacaggagaccaagacacauuccaccccaguggggggucccauaccacucauggaucugaaucagauggugaguucaaaacugcuuuagucauuuacuguuauaaucauugagccuaaugaugacuaccaacgaaguaugagucagugucuccagagaagugguucucaaaccuucuuagcauacaucacaauugcagggagggcuuauuaaaccacaaugcuggaccccacccuuaagguuccugauucaguaggucugggguggagcccaagcauuugcauuucuaaucaguucccugguaauacugacacugcugggacagggauugcacuuugagagcuacugcucuggaggaaagccuugcaucugaaagccucaggaagaauucaagcagugucccaauuuaaccuugcacuacaccagagugauuaagagcuugagcuuuguagcaaaaauggccugaguucgauuccagcccuccgcauauuaacugagcaagaugcuuuaaagggucugagacaacauuucucaacuaauaaacuuggaauaauaacaauugucacaggacauuguuucaaagacuaaaugauagaauacauguaaagcauuuagcauaauccuggcacaugauaucaucacugguauuuguugggaauuuacugugugccagcagcaucuuucuaaacacuuuacauguauuagguugggccaaauggaacugccauuauuguaggucaagaacaggucaauaucggccaggcacgguggcucacaccuguaaucccagcacuuuaggaggccgaggcagguggaucacgaggucaggaguucgagaccagccuggccaacccugucucuacuaaaaauacaaaaauuagccgggcgugguccugcgcaccuguaaucccagcuacucaggaggcugaggcaggagaauugcucggaccuggcaggcagaguuugcagugagccaagauugcaccacugcacuccagccugggugacagagcaagacucugucucaaaaaaaaccaaaaaacaaaaaacaaaaaaacagguuaauaucagcaaauucauagaguuuaucuaguaugaacucauucagucauccuauaaacucugugacauagguaaguacuauuauuauccccauguuacagaugaggaaacuaaggcucagagaagguaaguaacuuggcagaguugacaggaccagagagugauggagccaccuuucaagccuggagggccuuguauuacuucucauagcacagucuggagaaggcauuccauaaugaccauaauuacucccaggcaugaauucuuaaauagacuccuguuuguugugauucagaucacaccccuacaaaccuuaccccagacugcaaaagucugacaugagguagguuuacuaauuacuucuacugcugggcuacugggagguucugccagugcugccuuacuguggucucccugaacaucauaaauccaggugaccccauguaaaugauuuaagccauaucaauuauugucuccccuuuuuaugcccaaguuugagugaggcucaccaucagauuuaaauguuuacacauugaaaacaaauaugaagauggauauuuacaugguggcuuccacaauaacucucuauggaggagcacuaggagguagggauucauuagaaaugcuucugaaauagagacagaagucacagguucacuggggacuuuaggcagggcacuuaaccuuucccagacucaguuuccuuguuaguaaaaaggagaucaaaucaucugccucaguugcuuccuagaguuauugugaggaagacaggguaccagaagugugaaaguacucugaaaaaguagggaguuauuauuaaggggcaugaucucuaaaaccaagagaccccagccacucucuaaguaugauucuuuaaccaucagaguggacaucaccuaggaacuuguuggaaaugcagaauccuuggccaacccagaccuacugaaucaggaucugcauuuuaacuacacucucccacccaggugguuuauaugcacauuaaaauuuggaagcuuagacugugcuagacugcuuuucucaccauugaagccaauugaacaaucucugugcauaugucucagauuacaugucaucucccaacaggaauaucaagugcuccucuuuguggaacuugcuacuguggccaguccuacccuggcuggauuuguagacaucuagggcacaaggcaagaccugcuaucucacauccaucuucuguggcuuuugcuugaagugagaaucaagcagacaggagccagucucuuuuguuuggcuucugagcaggugucuauuguucaaacaggagguuucaucuugcugcacgcacacccagaucuuuucuugcugggagcacuucuucuuuuuuuuuuuuuuuaaaucaaaauaaagugauuaugauccguuaauggccucuuuuuaaauaucaaaggcuucuaugagucagaaaagaaaaaaaaaaaaaagaacagugagagugacuguaccuccuggggaguuuucacggccaaagaucuucaguuuagguggccagugucccaugaguugggcaggugaaaaccugccaaccaccaaggacacuggaaggcauguagggaaagggccuuggacuguuuuggagauuuguaaagucaaaggccacugucaacauaggauaggggauguugaaacacccagaugucugguaggaacugguuuugcucccuuuuaaguuuuaacaaaagcaucaaauugcauaaacaagagccauccuguccccauauaaccauuguaaucaagauuucagugugcacagccuaaaguuuggcuccaugaggaaagcucucauuuaagaccccaccauuuucauccauugaucagccuucaggauucuacagugggcuuccauuugguaggaaaaaaaaaguucauuuugguggaacacuuucaaauuuuguuuugaagcaauggaggaagaauuuuuaaaaauucaugaagcuuucauuuugaugaggcucuucacaagaugucuuagaaguuucuuuuuuaaaaaaauuguuuauuuauuuauuauuuuuauuuuuaacagggacaggaucucccuauguuucccaggcuggucucaaaguccuggacucaagagauccuccugucucagccucccaaagugcugggauuacaggugugagccaccaugcccggcuucuuagaaguuucuuuuagaaccauugugucucccucauuucgauaggccuccaguucugacuugaggauugucugucuugcgauacuuccucccaguuuaaggcauuuuguucaucuccuuauuuugcuuuuuagcaguagaaaauguugauucuucuaacaagguguguuucaguaauauauuagcagggacucuaauagggugauuuuucauagucagaaagggccacugccgcuaaacuccuuauuuauuuauugugagguggagucucgcucuguugccaagcuguaaugcagaggcacaaucucagcucacugcaaccucugcuuccuggguucaagcaauucuccugccucagccucccgaguagcugggacuacaggcacaugccacuaugccuggcuaauuuuuguauuuuuaguagagacgggguuucaccauguugacuagguugaucucaaucucuugaccuugugauccgccugcuucagccucccaaaguacugggauuacaggcgugagcaaacuccuuauuuuauaguguuuauguuggcuccuaugaugcuauuggaugagauuuucagguucccuuugggcuuucuggagcgugugaguccccugggggucuuguuaaaaugaagauucugauuugguagcuuugagaugaggcauaagauucugcauuucuagcgaucuccccagguaugccuguccugauggucugagagccacacuuugaguagcaagguccuaaauuaaaaauagaaaauaacaaccacacacaacuaccaauaccguguauuucuucaaaucucugcaaaauuaugaugaacagcauucuguuauccccaucuuacgagugugaaaagggagacuuggagaagguagauugacccagcacacauggcuaguuagcaagggacagcggugagacuuaaauccaggguuguccagcucuagacaccaaaguccugaacacugugcaacacugcugcugagaauucucauguuccuugacacaaaauaacauuacuaagccuuagccuuaaucaaaugaggugggggggaaaucuuuuguguaaugcuuuauaaacaucugcagcuugaauccauaaauggcuucucagugauucagaauguggagagcugcccuuuaugcagcuccacaaggaacucaugguuacacauuucaaacuuugguugagagauguuguuuuuccccuuaggacacucacaugggagucaagaagguggagcaaacacaaccucugguccuauaaggacaccccaaauuccaggugaguuucaaacuuugaggcagaaaaacacacugaaagcagcuuucucagaaugucccagcaaggacgaagagacucauuugaaagcacauucuccacaaugcccaacauaugaauccaauugcuccucuuuacaaguuaaaggaugaaugagaauacuacacccucuugguaggaaaagauggaauagucuuuucuuccuggguucugcaaacuagcugagcucauacucagaucugucccuggccugucccagagaagugccauguuaguuacuaaagcuuccuuccuaaaugaaugaucaccaagaggaccccaugucauaccuagguccuuucuaucccaauccaauuuccacuuauuucugggguccaaggugaagcauguaauuuuccuuuuacgauuacagacagggaggagcuacaagaggcauuuauguuagauggagugaaaacuuucuuuugguuccccaacuaauuuuuuuuuggucgagggaccgccugcugauguggacagaauaaacuuuucagaaaguaugcaugugcagugaggaggcugggacaccugguucuccugagcaucaagacaaggcauuuguugcaaauucuuuauuugacuuggaauuaaaauugauuugucauagagaauuacuaaagggaaggguucuccuaagguuguaaauuacccuuuuaauucucuccucuucagaggucuccagacugagccucucuuggggaaagagaagaauguggcaugcaccguucuccuuugccccagcuugccuaagcacaccugaagacagaccagacagagacaggggugggcugucccaagggagagcacaggggaagccuuagcugucaucaggcagcaagauucuucccagcuccagugacagugcaggugggauaucucagggcuggaaaccagggccacagugggcaggaguagaaaggaagaacagaaaucgggcccuccugucagucucccccacuucugacucuaccucccucuccaaacucaucuaaaccaggaaaaggugaggcaaagguagugcugagcaggaaaucagagauaaaccaaaauuuccaagaagaaaacagauaaugagacuuuccaugccucuucuuucucaagcccugguucauugcacacauauacaacccacuuugcaacugaauuuaguggaguugucaagucauauuuuaguccuaaaagagccugauuucaaaauguguagaauauuaauccacaagugauauauaauuauugaaaacauuugaaaaaauacaacuaaauaaaauaauggaaauauaaaucaauuauuaucaaucucaccauccagaaauaccaugguuaccauuuuaauauacgucuuuuuuuuuuuuuuuuuuuuugagauggaguuuugcuuuguugcccaggcuggagugcaguggcgcgaccucggcccacugcaaccucugcuuccugaguucaagcgauucuccugccucagccuccugaguagcugagauuacagcaugccaccaugcccagcuaauuuuuguaguuuuagagaugggguuucaccauguuggucaggcuggucucaaacuccugaccucgugauucacccacuucagccuccuaaagugcugggauuacaggcgugagccaccgcacccggccuuuccugucauuuuaaaauguaaaauauauaccaaaaugugauuacaccuuacacgguguuuagcaaacauugccuacugguuaaccauggcuuccaugucauugaauauuuccuccucauauuguagugcguaaugcaauagauguacccuaauuuauuuaaccaauccuuuauugccuccauuuuuguuuuuuaauacaauguaagguggauagguggaugcucuuauacaggaaaaaaauguuccuuucaaaagaagccuacauuuccuuuuauauguuuaauaauauuauaccaaaggcaucuacaagauucaacaagucauccuguccuuuuuuagaaacauaguucuccugaagggacuugaaaauccugacugaugauaaaagauuaaagcaagaaggcuguuggacaaauaccuucagcaaauugcucuuccagaauuaccugccuauuggcuggaccuauuggccagaccccccugcagcgcugacuguggugcuuguuucaacuaggucaauuauaaagugcauuuuuguuuuuacaaagugugucucugaagcucacgcaugucauuuaauuuacucauaccagaauggcugaucaucuuggcaucccucuuggccuuggcuuugauucuugcaguuugcauugcagucaacagucgaagaagguaaggggcuguccugggggcuuucaacuuggaaagggcaucauuuaaaccugggcuuuauauccuugcugcucagagcguagucccuggaaccagcagccuggguacccugggaguuuguuggaaaugcacaaucucagacccaaccccagaccuccuauggcagagucugcaucuuaacaaguuuccagggauucaugugcauggugcagcuuaagacaucuuucucugccccgguuuuuagagacaggagacaccugugauuguuuggcucaucacuuuuagguagugguugaauccuuugugauuuuacauguuuuuuaggguuaaaccucaugcagacucugucugaugaaaguuaugaaguaucucaccaggaaggcacacaaaaguauauacucauucauugauuuguuaaauauuuauuaaauacauucacaaugcacaaauaucguauaaagauucagugauucaucauccccuguagccucucugaggcccagggaaccuuuaagaacuuuuaccagaaggaaguauuggccuugugcuuuuguuugucguuuguuuuuuuauuggccuugugcuuuuguuuguuguuugguuuuuguaaugauaucauuuucuauuuucugggaacuguaguugaagagauucagguuauagcauaagaagagcacuguuucaucgucuucuugcuguuaggaggucuaugaagcagagaagaacuuuccuuuggaaaacaacuaaaugaagacagucaccucgcuagaacugacacaugggcuguuuuuauauucuugaaggccacucucucccuaccugaaccaagaccuauagguuuacauguuauuuacauuuuauauauaauauauauauauauauauacacauacauuauauauacacaauaguaauucuagcaacagaggaaaugaccuuuaacagggguauaaaucuaaauuuauaaaaguauaaaucuaaauuucuuacccaagacacuuuaaagauacauuauuuuucuccaggacguaauucauaggaauauuaagccuuuuguaaaugucccuuuagaugguuucucauaagguaaaagaaacuuauuuccaagcaggaccaccuuuauuguguccccagaucaccucacagggcagaaaaaugccccucagucugggagaagaccuagagagaauuauggacuccuuacugguuuuuggaaagcaaccaacagcuaauuccaacaccaugggcagcccauacagucucuaauuaucugagaaaaucaaaugaugcuguuacaauaauuacgcugguacaaguuaauaaaagugccauguuacagucaaacagcuauguugcuaucuauaccauugagggcauaguuuuaaaaaguaguuaugcuaccugauuguauaaggaacaaaacugagagaaaaaaucuaaaaggccgccuaugauugaauggaaagauuuuuuuuaguugaauuuaaauaaugugacuugggggagccuuuacaaagagucuuuauaccucccuucagcuuccucauuuucccuuggauuacuuuugcucaauuaaauaugaauuuccuauugugugcaaucagcccuuuauugccaagcccuagaaugcaccacuuuugcucacauacacaguccauaagcuuugcacaugucaccauagaaacgcuggcauggaugcugucgacauuuagggagaccucggagaagcaucucagcugucccuaagagcagcuggaguccauacauuggggcuggguaucucccccaucgucugugucuugucagcagcagacagcagagaaggggccucauugcugcccucucccuccucccaagaccagcagucacccuggcaaccggcaaacagggacacacaggguccggcacagcgaguaucucaccaggaaaguagcugcuuggaugccauaaauuacuauguccugauuugauaauugaaaacagauuugccacgcagcuaaaagguggugaacagcuguacgggccccuuaaugggcucugugauucuaaagcugucaacccauuucuaauccccuucaaaggcugaggcuuuucugcuuugagugucacauuuaagagaaagagauacagaauccuauuuucaucagagaaaguuugguugaaaauggggccuccaauagguguucauuuauucagcaaacaucuuuugaguggcuccugugacuaccagcccuggcaaggagaaagagaagguaaaaaacaaaaagaguaccaccccuuuucuaaaagaaucuugagguuuaguggcaguauuggccucuugaauuugaauuggcuaauauuuauugagaacauucccugugccagacacuguuauauaaauuaugguuaaaagacaaaaguggaaaaucauuagucucugaaguugacauacaaggaugggucaugggcuugcaugaugaagugaucugugagucacguugucuuaaagaugcuggguuggggguucuauuacuucuuuagguuuuuccaccccugccaucauccaaaacagcuuucuuugcuguuccucaugucaccugacuccuugaguuacagcucuccaagagaaaucauauuuuauucccuuuucaugagagcacauaauuauuuuaggagucaguuggguugauagauacugcgugaggcuccagagaagauuuuccuuuaaagaaucuaucugggccaggugcaguggcucacuccaugugcaguggcucacuuugggaggccgaggcaguggauuaguugagccuaggaguucaagaccagccugggcaacauggcgaaaccccaucucuacaaaaaacacaaaaauuagccgggcauaguggcgcaugccuguggucucagcugcucgggagguugagguagaagaaucgcuugagccccgggagguggaggcagcagugagccaugauagugccacuacagccugggcaacagagugagacccugucucaaacaaacaagcaaacaaacaaacaaacaaaaaccuaucuuauuugucuaaagaggagaaaaaaacaugagaacuuuacuauguugcuuguacauaaaagcuguucaucagccuucacuuuaaugggaauaaucgucuuuucuauaaaccccagcaggcagucacccacacuccaaucaguaggucuucucuacgcaucgccauaauuuagaaauauuuuccuucucuuaugcuacagucuagcuccugcaaucugagcucacccaaccucguccugcugucuagaacagugcuaugcaauagaacuuucugugaugauggaaauauucuauaccuccacuguccaauauauaacuacuagccacaacugagcacuugaacuauggcuaguucaacugaggaagugaauuuuuaauuucauuucauuguaauuaguuuaaauucaaauagccaaauguggcugguggcuaccauauuggauggcacagcucuaaaacagugcaaaauaaaucccuaaauaucguuaaggauugucagguagaagagucaugagaucaguugccaaguuacccaccuaaaucuuuuaagauaaauucugccaugccauaaaaguauguuaccuggcuucuaaaccccagccagccugcccucucuuuccuggugaggucucagucugccuccuuccacacugugugauugcugugugcucagcuaaugccugagauuuaagggaagaggagauaaagguaagacacagauccaugaggaucucugaucuucagagucagaagauccaagcuguggcugggcgcgggggcucacaccuguaaucccagcacuuugggaggcugaggcaggcagaucauuugaggucaggaguuugagaccagcguggccaacauggagaaacccuaccucuacuaaaaacacaaaaauuagccaggugugguggcgggugccuguaaucccagcuacuuggguggcugaggcaggagaauuucuugaacccaggaggcagagguugcagugagccgagauagugccauugcaccccagccugguugaugaagugagacuuuguaaaaaacaaaacaaaacaaacaaacaaacaaacaaacaaaaacagaaaauccaagcugugauucuugcagugcagugccauaacaagcugugaaacuuuggacaauacuucuuggacuugguguccaguuuacauaaugaagaagcugggcuagaugaucucugaagccccuuaaggucuagugcuccuucuuaaauucuuauaacuaggaauaacuuaaaaauuagaauuugucucuuaaaagcacuuauuagacgccuagagcacugaauauuggaaugaguuauuuaugagaaucauccuacccuccugaaacuacucagacagauagaaacacauaaauccaaagggaaaugcaggccaaccaaaaaccaagcacaauauuccuguguccuauaggucaaauguuauccacugucaagaucagcuucguuuagauuaacaacauuaauccccacccacucccaugcacagacauauuuuuuaugcucauaaaucacuuucccacaauauuucauuccaucccucaaccacccauugguuagggaaaugggaauuacuuuaacuagacaacuuuccuccaaagaacacaggggccagggaauuggaaguaacacaagcaguauucuaccuugagccuuuuaaauccucuucauaguaaauaauaacgagguagguggaggcagccaggagaaacaagcaaaauucauuucauauggcuuuuguuauauuaacaauuauagauagcacuugaaagcuuacugugcuccagauacuguucuaaguguuaacccaaaccuuaguuuccuuaccccgcauaagagcaagaauaacaauuauuuccuuaccccucauaagagcaagaauaauaacaauagacucauuuauuuagugacagucucuguuucaagggcuuuucacaauccuaugauauugcuacucuuaguaaccugguauuauugaugcaaaacugaggcucagagagguuaagugaguugccccaggucacauagcaguaaguucucaaaaccaggccuuccgagccccuuuucuucuuucuuuuuuccuuuuuuuuuuuuuuuuuuuuuugagacggagucuuacugugucacccaggcuggagugcggugaugcaaucucagcuuacugcaaccuccaccucccagguucaagcaauucuccugcuucagucuccugaguaguugggauucagccacgcaccaccaugcccccaugaccggcuaauuuuuguauuuuugguagagaugggguuucaccauguuggccagcuggucucgaacuccugaccucaagugauccuucugccucagccucccaaguguugggauuacaggcaugagccauugugccuggucucuuuuucuuuuuugaaacagggucucacucugucacccaggcuggaaugcaguggcacaaacacagcucacugcagccucgacuuccugggcucaaguaauucucccaccucagcccccaaaguaacuaagacuacaggcacaugccaccacagccggcuuaucuuuguauuuugaauacagacuggguuuuaccauguugcccaggcuggucacaaucuccugggcucaagugauccacccgccuuggccucccaaagugcugggauuacaggagugaaccacugcaccuggccuccaaggcccuuuucuugaccaugcauccugcuggacuccaucuguauuccugguccccaugaaucuguuucacaguucaagcauccuucccccaaccccucaucaagccuuaugcuagaggagacaggaucuaccuccuguugaggagguauaauuuuuauuuccccaaacaagagcuuaaaguuuauggccuuggcaguccuacagggaaugguccaugaucaugaauaauagaggcuuugucacuauuacuccaaauauccagaggcaaagugaacaauucugacuucauacuguuuccaaaucuccagagggcuggcagcauugacagagccaggcagagcccaggcuuuggucauaaaggccuggauuugaauauuggcucugucauucuuacuuucugugugaccucgagcaaguuauuaaaccucuuuuggccucaguuuccauugcuguauuaugggaacaauagcugcuuugaaagaguguuguaagaauuacagaaaauuacauguaaaaugucugguauucaggagguaaucugcuucccugaauccccaucuugcuuguaguugugaagcuaugcaacuuuccuuccucuaagcauagucugacucguauauguguaguagugauauguuacaggaaagaggaagcauugcauuaggcuggguggggugaagcaauggacaguaaccagggaaaagaucaaggucguacucuuccauagcaacuuucuuuugcguuugggucuuaaguaauguuugagaaaccuuaaauuaacgagaauaauuugucuuauguuauuaaacuuccuauaucaggguuguaugaguuagccaauguuaggaaaacaucacuauggccuuauaccucuagaaaaauguuguuuuauucuucucgauacauucaguaauaaugcugacaaggccgacaaaguguugacugggagaggaaguuaugggacuuucuggaauauacaaaucagaaugauuuacaaucaucauguugaugguuuaucuaaaucugcagaaacugcuaaaaugcuuaaaagaggcaaacauuuccauugugaaguaagauagaaagagaaucagaacuugagagucagacagaccaggguuugaauccucuuucuuacuugcugaguuacuugggggaaguuacugaauuuucugauccccaagguuucuucacuuggaauauagagaauauaauaauaacaccggcuuccuggagucuuaguugcugguuugcaaacuugacugugcagagaagccccugagggguugcaaauuugacugugcagagaagccacagauccugggcuccaacucuagaguuuucugauucagcagguuugggguggggcugagaauuuguauuucuaacagguuccaagaugaugcuuuugcugcugguccagggaccucacuuugaggagugcugguuguuaugagucugguuguuaagugcugguuguuaguuguuaaaguagagaaaaccccuagcacagugcuuggcacacacuaaagccaucauaaaccauagugaucaucaaugauggugcucaguaaggaugaugaucugaugccugagucacugcaaucuuucugauaugguacauuuuuuaaauuauuaggugugggcagaagaaaaagcuagugaucaacaguggcaauggagcuguggaggacagaaagccaaguggacucaacggagaggccagcaagucucaggaaauggugcauuuggugaacaaggagucgucagaaacuccagaccaguuuaugacagcugaugagacaaggaaccugcagaauguggacaugaagauugggguguaacaccuacaccauuaucuuggaaagaaacaaccguuggaaacauaaccauuacagggagcugggacacuuaacagaugcaaugugcuacugauuguuucauugcgaaucuuuuuuagcauaaaauuuucuacucuuuuuguuuuuuguguuuuguucuuuaaagucagguccaauuuguaaaaacagcauugcuuucugaaauuagggcccaauuaauaaucagcaagaauuugaucguuccaguucccacuuggaggccuuucaucccucgggugugcuauggauggcuucuaacaaaaacuacacauauguauuccugaucgccaaccuuucccccaccagcuaaggacauuucccaggguuaauagggccuggucccugggaggaaauuugaauggguccauuuugcccuuccauagccuaaucccugggcauugcuuuccacugagguuggggguugggguguacuaguuacacaucuucaacagacccccucuagaaauuuuucagaugcuucugggagacacccaaagggugaagcuauuuaucuguaguaaacuauuuaucuguguuuuugaaauauuaaacccuggaucaguccuuugaucaguauaauuuuuuaaaguuacuuugucagaggcacaaaaggguuuaaacugauucauaauaaauaucuguacuucuucgaucuucaccuuuugugcugugauucuucaguuucuaaaccagcacugucugggucccuacaauguaucaggaagagcugagaaugguaaggagacucuucuaagucuucaucucagagacccugaguucccacucagacccacucagccaaaucucauggaagaccaaggagggcagcacuguuuuuguuuuuuguuuuuuguuuuuuuuuuuugacacuguccaaagguuuuccauccuguccuggaaucagaguuggaagcugaggagcuucagccucuuuuaugguuuaauggccaccuguucucuccugugaaaggcuuugcaaagucacauuaaguuugcaugaccuguuaucccuggggcccuauuucauagaggcuggcccuauuagugauuuccaaaaacaauauggaagugccuuuugaugucuuacaauaagagaagaagccaauggaaaugaaagagauuggcaaaggggaaggaugaugccauguagauccuguuugacauuuuuauggcuguauuuguaaacuuaaacacaccagugucuguucuugaugcaguugcuauuuaggaugaguuaagugccuggggagucccucaaaagguuaaagggauucccaucauuggaaucuuaucaccagauaggcaaguuuaugaccaaacaagagaguacuggcuuuauccucuaaccucauauuuucucccacuuggcaaguccuuuguggcauuuauucaucagucaggguguccgauugguccuagaacuuccaaaggcugcuugucauagaagccauugcaucuauaaagcaacggcuccuguuaaaugguaucuccuuucugaggcuccuacuaaaagucauuuguuaccuaaacuuaugugcuuaacaggcaaugcuucucagaccacaaagcagaaagaagaagaaaagcuccugacuaaaucagggcugggcuuagacagaguugaucuguagaauaucuuuaaaggagagaugucaacuuucugcacuauucccagccucugcuccucccugucuacccucuccccucccucucucccuccacuucaccccacaaucuugaaaaacuuccuuucucuucugugaacaucauuggccagauccauuuucaguggucuggauuucuuuuuauuuucuuuucaacuugaaagaaacuggacauuaggccacuauguguuguuacugccacuaguguucaagugccucuuguuuucccagagauuuccugggucugccagaggcccagacaggcucacucaagcucuuuaacugaaaagcaacaagccacuccaggacaagguucaaaaugguuacaacagccucuaccugucgccccagggagaaagggguagugauacaagucucauagccagagaugguuuuccacuccuucuagauauucccaaaaagaggcugagacaggagguuauuuucaauuuuauuuuggaauuaaauacuuuuuucccuuuauuacuguuguagucccucacuuggauauaccucuguuuucacgauagaaauaagggaggucuagagcuucuauuccuuggccauugucaacggagagcuggccaagucuucacaaacccuugcaacauugccugaaguuuauggaauaagauguauucucacucccuugaucucaagggcguaacucuggaagcacagcuugacuacacgucauuuuuaccaaugauuuucaggugaccugggcuaagucauuuaaacugggucuuuauaaaaguaaaaggccaacauuuaauuauuuugcaaagcaaccuaagagcuaaagauguaauuuuucuugcaauuguaaaucuuuugugucuccugaagacuucccuuaaaauuagcucugagugaaaaaucaaaagagacaaaagacaucuucgaauccauauuucaagccugguagaauuggcuuuucuagcagaaccuuuccaaaaguuuuauauugagauucauaacaacaccaagaauugauuuuguagccaacauucauucaauacuguuauaucagaggaguaggagagaggaaacauuugacuuaucuggaaaagcaaaauguacuuaagaauaagaauaacaugguccauucaccuuuauguuauagauaugucuuuguguaaaucauuuguuuugaguuuucaaagaauagcccauuguucauucuugugcuguacaaugaccacuguuauuguuacuuugacuuuucagagcacacccuuccucugguuuuuguauauuuauugauggaucaauaauaaugaggaaagcaugauauguauauugcugaguugaaagcacuuauuggaaaauauuaaaaggcuaacauuaaaagacuaaaggaaacagacucagaagucucuaauuuaaaagaaugggaggcugagagggacagaacuaugcuuaucuggcaccgucuggguaauuuagaggaacaaagucaaagguaucug

SEQ ID NO: 13300 - RNA, 33346 nt, Homo sapiens
cugagccugaagucgccacggacucggggcaacaggcagauuugccugcugaggguggagacccacgagccgaggccuccugcaguguucugcacagcaaaccgcacgcuauggcugacagccgggaucccgccagcgaccagaugcagcacuggaaggagcagcgggccgcgcagguacacucugugcuccccgagcgggcccgaagguccguuuagaaagcgggggcgucggcaaguaaaggcccggcuucccccggggcggcgcuuggagggacuguaccgcggcucacugggcaggggggauccccuucggugcagacggacuuuuacauucgccgaagcaggggagggggguccggguaguggggcgcgggacugcaggcuuuguuguccgcgacaggcucgggugguugcuucagaauuuugcacuuuugccaacugggacagaggucgcagcuugaggacagauugagggcucauggggaaagaggcagagagcugcagcugcaaggaagucagugaggggagaaguggaaccaggcucuaauggugcccuucuugaaauacuguuuacacgcuuucauaguuguggggucccagcagggcagggauuguguuuuacaaucuugaggucuccagcaccagucacagugacugguacguacuaugcacauuauuaaacgacuaaauaaaagaacuuuuacauucauugucucauuugcacuucaaaaugucaagccuagcauuuuagagcuggggggugacauuagggauugauuaaugcguuuauucuauucuuugagcaccuguaggugcuaggcacuguucggggcaagguguacaaauuccagugcggcaagaacaacacccuugagaagcugagagucuagucugggagacgagacacauaaacagaugauuacacuccagcguggugagggcucuaauagagguuaucuguagaauguagagggagugaccaggugggccggacaaagcaggugacauuugaacaggaauuuuuuuaaaugaguaggauuuuaacuugguggugggggaggcauuccuggccugugcccacggcugcagagucucagagggcaucuaugaggagguuggauuagaugagaccacaucuggucugagucuacuguuggcagauuggcccagggagucuaaaggucuugcccuguucccuggcugcugguuaaugguagacagaggacugcagcccuguuuucccuauucugccuagugcucuugcucaaaacucagguucgugaacugggguauuaaugcuaagugcucauggauugcuuuaaugguucccuguuugggaaaaggcugccauucuccuccaagggccuggaaaaucuccccucuuggcccuguucuuuguuauauaccauuagguugguucaugagcucuuaaaguaaaccagagagagguagagucuuaguaaaggaugugccacuacuuacuggcagagacaagguuagaauucagcuucuuggacccaagacucuuuccuuacccagugggugcaaauccugguucacacugaaguuuucaugaauacucggugaauugagaaaaguguggacaaaguagugagauuuuuacaaaacaaaauauuuucuuuuucuuuuucuuuucuuuucuuuuuuuuuuuuugagacggagucuugcucuguugcccaggcuggagugcagugguaugaucuccacucacugcaaacuccgccucccggauucaagcaauucuccugccucagccucccgaguagcugggauuacagguguccaccaccacacccagcuaauuuuuguauuuuuaguagagaugggguuucaccauguuggccaggcuggacuggaacuccugaccucaggagaucugcccgccuuggccucccaaaguaccgagauuacagguguaauauuuucauuuuuaaaggacuccccuuuauucugagacuagcugccuucuuccuuguuugggagaaucaugaacuguugaagucccugcuguugauuuaccuuacauaguugcccaugugagaaauggcugacuccaaaacacaucuauaguugggaggcucuuaauugaaauacagccauccccuuuguccaugacaucucagggcacuguguacaucguccugauuggcagucacauugaugucuuacuguuccucaguuuuagcugcucuuaguaaaaaccgcuuacuucuuuuaggcacuucucccuccacccagggcccuccaaaaggaauuaugcauaugccuuauagccuauauaauuuucaaacacuuuuuuuaaaugaaaaauuucaaauauucagaaaaguugaaaaaauuuugcaguguauaucuauauaucugccaucuagauucuacaaggaacauuuugcccugugucuuuuauuacguuacuccaucugucuguccauccuuuaauucauucaaguuguuucauguauuagcaguuuguucuuuucauugcugaguaagauuccauuauuugaauauaccaccauuuggauauccuguugcuggacaccugggcuauuuaauuuuuuuucuauuguaaguaaagcugcuguggcugggcaugaaggcuuaugccuauaacccuaccacuuuuggaggcugaggugggaggauaguuugagcucaggaguugagaccagccuaagcaacauggugaaaacccaucucuacaacaaauaaaagaaguagccagacauggugacacaugccuguagucccagcuacucgggaaguugaguugggaggauugcuugagcuugggguguggaggcugcagugagccaugauuacaugacugcacucuagccugggugacagagggagacccugucuuaaaaauuaaaaauaaauaaagcugcuauaaaaauucuuacauaagucuuuuugugcacaggugguuuuauuucucuuaggaaauaccuaggaguagauuuauugggucauaagguaagugaauguguuaugagaaacugcugagccuuuuuccaaagugguuguaccauuuuauacuucaucagcaguguaugggaguuccaguugcuccacauccuaccaacuuuugguguugucagucuuuuacauuuaguuguugggugugcagugguaucucauuaugguuuuaauuugcuuugcucugaugacuaaugaugcaaagcaucuuuuuacaugcuuauugaccauugguauauauuccuuugaaguauauguucaaauuuucugucuuuuuaaaaauugaauugcuuuuaaauuauuaauucauagcccauauuuuaaguucaaucauguggaaucauguguaggcuaaguguuauaauaauaaaucucaacauguaucaugguauaaacauauuagaaauuuauggccgggugcagugacucacaccuauaauccagcacuuugggaggcugaggugggcggaucaccugaggucaggaguucaaaacuagccugaccaauauggagaaacccugucucuacuaaaaauacaaaauuagcugggcgugguggcacaugccuguaaucccagcugcuugggaggcugaggcaggauaaucacuugaacccuggaggcggagguugcaguaagccgagauccugccauugcacuccagccugggcaacaagagugaaacuccaucucaaaaagaaaaaaaaagaaauguauuccuuuccuacaugaauggcccaaagugguuugagguugaaggaggugggugggugcucugcuucccacaguuauugagggcaccaggcugaaggaagcucccccuuggucaaacauggcuuuuaugggcgucacuguccagcacagaaggcucaagagcguggagaaggguauaugagugugggaagguuuaggguccagggucacugccacuuacauucuguuggcuagaacucuguuacaggccacaccugggguagucuacccccuguccaggaagcugacucuacuauauuauccaaagcguacauuucauauuuggugaaaaucuguccagccauuuucuugugaugcggcaauggacaugcaacauaauuucuuuuuaaagaauaugucauuuuuacuuucugacauuaagauauucuguuagaaaauuaugacaguaacagaugguauuaaaaaaaaaucuccccuugcuugguaaaugcuuuuaucuaagugggcagcuuugugcuaauaugaugucuuccacuucccaauuaguugugaugcuuuacugaucuaggagagcuuuaugguuugggacuacuauaggcgaacacucuguugccuccucucucaagaaucagaguguccuauuuuggaaacacagucaaccaugugaaagcaauuuauugggcguaucuucuguggucagauuugguuugcugacaggugaauugggaguuuuguaaacuuuaauaagugagcauugagucagauguguucaugaguaugaccucgauccacuuaaaaauucuuauuucuuuuucucucuuggcaggagggaggugguugugcagguauucccagccacuuugaagggaacuuaaaugggaacuuuauugcucacugcuuagaaugccaugggcucuucuuuugagauacuuaccuuuaacccauuuccuuuuuuuuuuuuuaagugcagcuugcugccagugcucuuuucuuggggguaaaugggaaauguuaauaaguagccucugaucccuuuaaaaugggagaauuugaacauuucaaaccuuaccuuuuuauacaguucucuuauuaccugggagagagguuaagucuuagacuauccauuucugucagugaguugccuaugcauuauagccugugagggucuauauuuuuuuaggguaauccugguaauaacugcauugauguuacacugcuaacauuugggauggagaaggggugacugagugacuuaacccuugguccacaugugcuuucauuucuccugaaauauaccuagguauggaaucgcuaagucauuaugugcagugggagagacuaugggagaugggacagaaauuuuuaagguuucauuucuuuuuuuuagcuuuugcaugguggguaggucuaugcaaaccuacccccaaagucugaggaagcugagaggccaaagaaagaggcugacaaaucaaguuucucagaaagaaauguuuaguagggacuuaggaccagaaaccaugucugugucuugcguguuggcgagacaagaugguggaucccauaccauuaccccucagacccagggcuuaauaccauagggaagggcgauucagaagggagguauggcaugacugaaguaugauaaugucaagguuguuugaccucagggcaggauuuauaguaaauaggggcucuuucacaaggaauaauagauaaacuggaaaucuuaaaacuggaguuaaucagaagucagcaugguggaucaguaucuaagacggaauugcuuuagcuuccacagcagucaauaucuagaccacccuuauuauuuucccacagaccaagaaauuugaaggucaggacagucuuugguuuccuguacguggguguauacguuguaggcacuugaaucuuuguugaauaaauggagaauguuaggcaguuauuugcuagaaaacgcuaggcacauucuuuaucacagaaugaaaagacgucauuaugacuccucugggacugaugggcaauuugcauuaaccaaucuuuuaauuaaaaguggaagaauauguuuagguucuugaaacuucugugagugaagggaacuacuaaguggaaaguguaauauguugauaaaauauuucaccagaugaagccaaccuuacuccucccaggaaaacuucuucauuuauguauuagcucuggccaaaagaagccuauaaaggcagcaaagucaaaauagaauuuuacuuuaagucccuacuucuaauaauugugcuaguuuuuagccaagcuaauuucuguggcaguuuucauaacaagugugucuaaagguguuugaucagaauuuauaaauuaaaauauuucucucauuuuuuggaggggcgaugcagggagagggauagacuguugcugcuuccuccugcuuguuagaaaggcucuuggccauaucauauugguccgugguuuaguuuauuugcaugcugaauccacacacauuuguuuuauguuuguuaguauauugagcaguguauuagggaucagguauauagauguaaaaggaguacacagucuagagaggaaaaauagugacaggcugggcgcgguggcucacgccuauaaucccagcacuuugggaggccaagaugggcggauuucuugaggucaggaguuugagaucaucagccuggccaacaugauggaacccugucuuuacuaaaaauacaaaaauuagcuggguguggugguggucgccuguaaucccaacuacuugggaggcugagacgggagaauugcuugaacccgggaggagguggagguuacagugagcugagaccaugccacugcacuccagccugggcaauagagcgagacuccaucucaaaaaaaaaaaaaaaaaaaaaaaaaaagaaaaacagugacauaaacaggcaauuacaauauuuuguuauauggggcacaagaagaugcccuuggcccugcuucaugagugguguggggcaggguagagagagcaguucaggagagguacguauggaugucaugggagcuagcagccaggaagauguaaacauguuaacaaggaccucuccagagagaggucuuaaaauuauccagccauagagaagcuuuucucucuuuaaaaauauucuggcucuaaaguuauucauugaguuaaaaacaauaauugcaaguuggaggaaaucucuuugccuguccuuacguguuacauguaacaaguaaaccugugccacaacacugacaucucugcaaaguuacuuaaguuuucugaguuuguaguaucgcccauuaaaugggauuaauaauauugaucucuggauuauugacaggcuuaagugagauaacuugcgugguccguuuucuagccccacccucucauuucaucuaguaaaucuucauugcauuaauuauuuucaucuuaaauacaccgcauccugcuccucaccuucuaauauuaauacucuaucuuucaguuuagaucaguuccucuuauccaauguugcgcuaaacauccccugaaguugggggaucuuuuccuuucuaguuuuugcucccuggcuucccuuuucuguugcugacuguugaagcuuuccugccccacuggcuuugaagguaaauuguauauacaugagcuuguggggaaagcuguuauauaaaugaggacaauugaucuaacuguuagaguggggaaauggaagagauucugaagccuccauuuguaacuuaaaaacucagguuucauuucuuaacaggauugauguuaaggaggggauuccuucauugggcaggagggaggacugccauaauuccagcauucccacucuuaauagucagugucaucaggaaagaccaccucaagcuuuaguacuuuauucauuuauccaacucugcaccugcugccuuugggugugguauuuauucuugaccauaucacccugacccgguaaccagaagggaacaugugaugugcucucaucucugccuuaggggcagcucccuccccacguuaagaaugcuggcauguaaauaacacucucaucuguuuagcguuccuuuuacugagcuucuugguaucuuuucucauacuuguaccuuuuaugggaugucccccccuuuuuuuuuuugagacggaguuucgcugcuguugcccaggcuggagugcaauggcacgaucucagcucaccgcaaccuccgccugcuggguucaagcgauucuccugccucagccucccgaguagcugggacuacagucaccccuccacugcaccugguacuaauuuuguauuuuuaguagagacaggguuucuccauguuggucaggcuggucucgaacuccugaucucaggugauccaccugcugcagccucccgaaguguugggauuacaggugugagccaccgcgcccagccuggaugucccuuuauuuuuuaaaggcuuccuuaaauaccuuguuuguaaguugaaaagagcauuuaaagagugaacagauuugguuugcucuggcucucuaauuauuuuaacuuuguuaucacccaauaguucuagguuagugguuuucaauccuagcuugaacaggagucauuuaaaaauagcccaggccucacccagggcacuucuaucagacaucucuaggggggauggcccaggcaucaggaggcuuuaaaaagcuccucaggugauuuuagugcauugccaagguugaaaaccaaggcuuuagguuuaaacuaaaggugaaauugcucuuuuucugguucauuuucuacuuuagaaaguagaaauuuuuuuucugguucauuuucuacuuuaaauuaaaaauaaaccuacagaggguaacacguauuagcacgucacagagggucacacguauuagcaacauauguaucuucaaaagagugaugugacugggugguaaguguugauuggacccuuaaacugugacaguuuagaaggggcuuugcuagauggguuuagggacagagaugguagagugagagaguguggauggaggaguaugcaucugucaugauuacuagaaaaauaaaacuucaaaugcuuugcuccuucugcugcgaggucauguucucacagccagugaagugacagcauauauguguugaauguguggcuugcauuuuacauuuaacucuuuuaauucauguguuaaccuuaggagguacuuauuauucuauuuugcagaugaaaauggagacucauaaauaaguaacuuaccagcagcuacauagcugguaauugguagaacuggaaguuggacccaggcucuagugcuggcacucauaguuucucccugcugccauguuggccucuuccuacuuggaugaagauauaacucuaguggcaagggcauuuacuagugugugagagggucuuguuuauuaguuuugcaaauugcacggucuccuuuauucaauaucuuuuuucaaacagcucacagaucuuuugugguuuuguaagugccuacuccccaccguauugccuucuagagaagaggcaggaauuuauuuuaauguacaggacagacaugcauggggaguaaaacuacagacuccacucuagguguguggaaauacuaaaaauagugcuuuucucugugugugaaguuggucuguugaguuuugucauagacagcguugaguuccucucccagguggagguggcguagcuuugcgucacuuacgugucucuccugauuuccagugacccggggaagacacugcagaggcaguugucuguggucaaaaguauucucugaccauggaacuagaugaagcuaugagcuuccaggaucauguggggcuagaagaaugccgcucuaacccuagaggagggacagcugagugucuucugauguaacugaaauuggagaaucagguggauuaaaauuaauuauuuauuacaguaaaauaaccuaucccauuucagagacauuugcuaucuuuaaaacauuaauacuauaauccaccuuaccaguaacaguuuacuuuuagugacagugaaagccauugacuuuuuuuuuuuaauugaaaagagauguugcaaauagcugguguacauuucuugagaugcacuaaacaagguagcgcacuugaagaucguggcaguaauaaagcguuuguaaguucugaguaaaguauugaccagcacagcuucccuggagaccgucuucucauugcuggauuggacauuucacuguuaagcuuguaggacgcuuuugggcaccucucugacugggagcuuugcagaacccaguggcuuucucuggagcaggugcugagcacauuuucaggcuccaaaaucaucuuucugcucuucagagcaaguuucuuagcagauuaguguugagauuugucaaggguuucuggggcaucacuaaaaguuucaggcaauggcccauccugucagauuuuaguacuuuggacacaggaaauuaaaaaagagggcagaugguauaaacauugcaaagcuauguacccgugacaguguaaaugaaagguuugauugugcuaacucuccugcacuuucuuucuguguuccuguagaaagcugauguccugaccacuggagcugguaacccaguaggagacaaacuuaauguuauuacaguagggccccgugggccccuucuuguucaggaugugguuuucacugaugaaauggcucauuuugaccgagagagaauuccugagagaguugugcaugcuaaaggagcagguaagugcuguguuuauuugcuguaaaaagauuguuucacagcaccugggucaaguguuauuucccaaaggauuggaagaccuuuaacacaagugucaaaucuccauuugugggagaaaggaaaaacauccagcaguagggaaauuaguaaauaaaugaugguuauuuccucagguuaaacauuauauauaaaauaguuucuuuuaaaaauagcagucuuccauuucucccaucauugaaggaauaaaaauacaauaaguccucacuuaacaucaauagguucuuggaaacuuugacuuuaaacgacauguaaugaaaccaauuuuaugauaggcuaauugacguaagcaagaguuaaguuccuauggcauauuucugauugauaaaacaucaucaaacuucuaaauagagacucaaaauaccucuuauauuaaacauugaaauaaaugugagccauacauaccuuuaagaaagauuaguaaaauaagauaguuauuuacuagcuuauuccaguucaagguggugggaggccagagccuguccuggcagguugggguacaaggcaagagccagcccuggacaggaugcuguccauugcaggguggacucacacugggaccauucagacaugccaguucaccuaacacgcacaucuuugggauguggggggaagcuggaguaccaggagaaaaccuaucuagacauggggagaacaugcagacuccacacagaugguggccucagcuaggaauagauuuuuuucucaucaacguuauaaugaaacaacguugaacaaaacaauguuguuugaggaccugcuguacagaaauacagacauagacacaugcacugcaauugcaacuaaguuuaaaugauguacuuacuggguaauuacuggaaugagcugcaaaauuugggguaguuauguuagggugguggguuugugaugauuuuuccuuuccuuuuuuccaacaauuucuguaaaacuuucuuuaucgcuguuauaucagacacaaaagaugggggugguauuugaaagaaagugaaaaacucaguuggaaaaagagcuccacagaaaggaaguuuuucucuuagcuugcugacuuggacuuccaguuaggacuucugcauuucuucaucucuucuuccuggauaagguuucuccccaucuucuccagugguuuguguguauuuuuccaucuugacuuguuuaguuuauugcuugcuuuguaucaucguugcuaaguguugaaaagauucuuucucuuauguuuucaucuccucuucucucuguucuucacuuucucucauagguccuaccuguacuucaggccccucugagacccuguguccuugggccaaccuugacgacuucuagccucacucaccuccuucucuuggcuccagcuauguggcauucgacuuagcacugaaugauagaauagggcuuugcauuucacccucuuuauuuuguguuugggcauuuccccuuccuccaacauacuggaagcucccagaaggcuggugcuaaccaucauuuucucuugucacccaggugccuguugaggaccugaaugucugaguaauggucucaugguaaggauuucugugucuuucucguuaggggccuuuggcuacuuugaggucacacaugacauuaccaaauacuccaaggcaaagguauuugagcauauuggaaagaagacucccaucgcaguucgguucuccacuguugguaaguugguuuauuggcgugauugguauggcuuaacucaacuucaccuuuuggggauguuuauaacuuaaagaaaaaguuauuagaaaauaggaagcaagcacuucuccaaauuaugucaagguuuuacaguagaagacauauuuggagacacauaggaaguuacuuguauuucuguuuguugaggucuuaggaaaucacacuuacacagaggcuaccucugcaauucugugacauuuggaaagagcuuuccuaaaagugguugccucuaacagaagaauagaguggaaaucuuauuuaauaacuaugccuacagcugaccuuuauugagaauuaauucugugccaacugugguuaggugcuuuacagauauaaucucugauuuguagaucuacuuugcagagugggauucuuuuuauuuuugagaggcuaagugauguuucucacguuacagagauaguauuagaucuaucauacuauauuucaacauaccuagugcuucacuaguuccguuucugugucagucucugcauuuuaaaaauacuguggaauguaaaaauaaaugaaauuaagaacuaagaaccaauauuuuaacucauuuucuuaauguuaaccucaucauuuugacaacucacuuauucuguuugucacuacuuuaagccucauaauuauuuucuucccuuauuuuaauuaaaaguucaauuaccuguuugaacaaaguuaucuuauuaugguaaaugaaugacauugucagcuguuauuacauguguucucuuauugcucucaauuaauuauuuuguuugauuuguggacugaauuagcugguggguagaaauaauaacccgggcacuuaaauaccuaauuuaguucuuggaaguggauuagaaaggauggauccaggugcuucuuuaugucuccaggcuucuuggaugcaaagugcuguggcuuaugcuuccuguuuccauuugaauauuguagcuggagaaucggguucagcugacacaguucgggacccucguggguuugcagugaaauuuuacacagaagaugguaacugggaucucguuggaaauaacacccccauuuucuucaucagggaucccauauugguagguaauagaguauuuugcacucaacaaauguuuguugacuuaaauugauuucaaauagguuggcauuugaggagaagccgugggaaaggcagaaagaaaagaaugcgaguugucuggacuacuuuuuucaacacauuuuucuguauuuaauaagauaaaguaagaacaguuaccauuggucuuagauuugucauuuuaagacagauugacuuaaugggaagugaguuuaguuuuccuugcagagcaucgaagauuaguaaaaagagggacuuuacuuuggaaacaagcagagggugucucuacaugcucugagucagcaggagggggugugugugcgugcgcgcaugcgggaggguggguauauuuuuuccgugaagaaauacuauaaaucccagcacuuugggaggccaaggcaggcagaucacuggaguccaugaguucgagaccagccugggcaacauggcaaaaccauaucucugcaaaaaaauacaaaaauuagccaagugugguggcucaugccuauagucccagcuacuugggaggcugaggugggagauuugcuugagcccaggaggucaaagcugcagugagcugugaucaugccauugcaaucagccugggugacagagugagacccugucuuaaaaaaaaaaaaaaagaaaagacuauaguuuugaguauauuugaaauacuuuaggguaucuuagaugcuaguugucuaugcugaguaaauuucauauuaugguuuggcaguuuaaaauucuaggauuguauuuagaauuauaauccauaaaccuaguaauaggcauauauaaugaaagacaccauaauuccuguaaacuuaguuuuuggauuuuuuucucucuuuuuucuauuuaguuuccaucuuuuauccacagccaaaagagaaauccucagacacaucugaaggauccggacauggucugggacuucuggagccuacguccugagucucugcaucagguaugaacccuuuuuugccauuguauuauaucaccugggaugcaguguuuaauuaugccucuucauaaagugucucuccaguuuuggcuauuuuauuggaaucagcuuccucagauuucuugaucgugaagaguuuuguaguaacuggcuuuacuaaucaucccccauucaucggccuuaaaugaugaugaugaugaugauagauagcuagcaacauugucaguugauauuuagcaguaguaaggaugaaagucuguaguguaagguaaagcucuguauuaaggaaguggggggaaaguaguaccaaacaaauuugcuaugcaaauaaauuuugaauaacaaauuaggccaguuuucagguuguuuuggcuuuccuucauagaauuuugagucauaguauuagugauuugcauaucauuuugauuuaaaauuuuucuguuuguuauuuucuacaagugaaauaauaaugguaacccuucccaugggaaauuggcuaguauguuuuaugucauuaagggacuuucuggaaacuaaggaauaucuuaaaaaucaaggauguuuugauuuaaaugaaaacauuuuaggcuuuauauuucuguucuuuagguuucuuucuuguucagugaucgggggauuccagauggacaucgccacaugaauggauauggaucacauacuuucaagcugguuaaugcaaauggggaggcaguuuauugcaaauuccauuauaagguauguguuaccuuuggggcagaggguacaaggcuccuaccgcauaccuccuuauuuuuccugaaggauugagcaaagauuaaggcuucucccacuuuucccucaccuccauccccaaaguugggaaguauugaucucauugaucaguacugauuuuguuggcuaccaucugaggaccuuggagcguaucccaaucucauuaucacuuccaacauccaauagugucuuuccaauaucauuucuuuuaacuuuuuaagucauccaucuauuuacuuagcauuuauugagguuuuauuaugaacaaggcauauaaguaaaaucaauuacaaaugucagaaaacaaaauuauacuguuuuuaaaaauuugcauucauauagccagaucaaaucaguuacaucuggggaggguuuugagaauguuuuaaucaacugaaauauuauaaagggcccucuuuugguauaagcauggcauuuguuacaaugagcaauauugccagugaacccuggcauguuagugauauucccagagaacucccaagggcuagucagaaacaagccugagaaccucuguuuccaaauacugcugcuaagauaagcagaaagaagugggcucgugaccaguacuggauaaucucucucuuagugacauccaaaagcccuauuuucuucuauccugcuuucuucuuuaucugaacaauuuaauguagguauaucaaacaggaaaacuaucaccucuuuuuauauucauaacuuggaucuauaauauuugacaaggaaaaauuuuaugaaacaguugacccauuggcuuguaauugccaaaagggucaauguaguauuacuuagaauaagacuaagugguuguaucuaggacagccagucuaguugguagccuuggaguuaugccagccugaacucaaauuucuacucuccuagauaauuguggccuugggcauaguauuaaaaguucuuugagcuccaguucuuuucacugugaaguuggcauaauauuaccagcuauacaaguccuggaaagauuggauugcuugugggucuuuuauccuagggcccuaagguagccugagaucuacauggauucaucagucuggauuauucugaccuaagauuauucuuuucuaaaccuaaaggauucaguuaaaaucagaaagguauugcaguguuauuguacuacuuaauauauuagcucuuugggcgaucuguacauggugaccuucauuguuuuaauccugaagguggcuuuacuucuuguucaguaguaagaguucaaaccuuuucacugaugagacaguugggauuucugugguagaaauagaccagcguucagaguugauuuuugcuaaggaaaucuuucugcggcacuuggcuuguugggaggucuuugagaauaagaucacauggucaguccaucaaagaacaguaugauaugauaacaggagcacuuaugaagugacacagcuucucuggguuuuaaugucuugcuuggaaagucagaauauuaauuuugccugcucauagucagagaacuaguuccagguggcuguacugaaguucuuuucaacucuaugagcuaugauucuaugauuuauuaaaaaaaaaaaaaaaaggaauaggacaggggugaagggauacuggccgagcacagucucaguaauugauuugagcugucaugaaauggaauuaaaacauuacuucaugauaaaaggcaaguaguccuuuaauuuuauuaaucuuuugccuacuuuuaaguauauuuugauuuuucugauuuggaaaguaacaugaguguaaaaauucaaauaauagaauacauaaagggaaagauaggacugauuuuaaauaugaaauguguagaugggauucccuugacauuuaaaaguauugggauaaucaaguagaauuucuuguugauaaauucauuaguaucagauuugaacaauagaaguauuguuguaaagaaaguucauucuuugggcaguguuacucauaauccuucaaugaauuacugaugaaauuuugauaacuuugacaauaaguuuccauuggagcuucuuucuuucauuuuguagacugaccagggcaucaaaaaccuuucuguugaagaugcggcgagacuuucccaggaagauccugacuauggcauccgggaucuuuuuaacgccauugccacaggaaaguaccccuccuggacuuuuuacauccaggucaugacauuuaaucaggcagaaacuuuuccauuuaauccauucgaucucaccaaggugagucaguaaacaacuauauuguuuucuuuuuuaagucucuucuuaccuaauuagaaaaaaaaucuagucaaacaauuauaauaauggggaagucauauacaaaauacagaggguaccacuucagaguguccuaagcugugaaugagugcuuaccagcaucuuacuuccacguuccuguuugucauuucauugaguauguguauguggcuucauauauuguuauuaacagggaacagauuaugaaaagcugauguacuuuuuccuggggaaacugucaguauuuaccacuuacuauugugaaagauuuaacuaaggcacucaucuuaaauucuuauguuuuauuggauuuaaaaauuauuuucauuggcuugauuguauuugaaaucugguauuuuuguggguagcuuugauuuccuucaguugauugccugguaauugugaauaugacaucauuuucagguuuggccucacaaggacuacccucucaucccaguugguaaacuggucuuaaaccggaauccaguuaauuacuuugcugagguugaacagauagccuucgacccaagcaacaugccaccuggcauugaggccaguccugacaaaaugcuucaggugagccugguggauugagauguucugaggcagguguccaugugagcaugcacacacaaaauaugcagcuuggcaugaucuuuaugugaggaauuaacaagaacauuacuuaaacuuuaaucugggugcuugguuaccuugugggauucacugaggugaacuauucuucaaugagcauuccuugaguaaaccaaguauaaacaaaaguccaugguaagaucccuacauaugugaagacaagaauacuuacucucuuaauuaaaaaaaaaagacauaauagaaauaccuuaaguauugauagagugaagcaugguuuguucugucuguagcugaaguaugguuaauuaauuauaauaccuugguaagccuaacuuuauuuucuuguucuuuuuuuuuuuuuuuuuuuuuuuuuugugacagagucuugcucugucgcccaggcuggagugcaguggcaugaucucggcucacugcaaccuccgccucccagguucaagcgauccuccugccucagccucuugauuagcuacaggcgcccgccaccaugcccagcuaauuuuuguauuuuuaguagagacgggguuucacccuguuggccaggcuggucucaaacuccugaccucaagugaucugccugccuccgccucccaaagugcuggauuauaggcgugagccaccguggcuggccucauuuucuguuucauggugaugcuugaauuuuuccauuuguaaaaagagaucuagggaugaucuuuaugaacuacauguaugcugccagugauaaaagcaguggauuaaccauucaccuugcuaauguuaagccaucaguauguuuuacaucacuuuuuaauaucucuuucaagaguaccaagagugaaaaauuguacuuuggaucagaaucaguaagaaaauaauuggcuuaauaauuacuguauaaaucaaucuuuugugguuuuagacugugaccuugaaacaaagguuaaagauuguacccuaaaucagaccacagcgacugaagguuacuucuuauguaaguaucugauuccaguucagguuucagucugcauggaggacaagcuaagauuccguuuuuaaaaaauaacuuuuuugcuuaugacauuggggaacaucugaggcuuuuauagaaaguaaguuuuucauuaguuuuuaguccaauucaacuguuacaaauugaguaccugucuguuguguaugguggacugucuugggugccauaauguaaggcagaaugccauggugauccagaaagcaaaauuuugucugauaggaggucagccacgaaguuucaugaacgagguagcauuugagauuguuuugaagaauagauaggauuuugauuuuuaguagguaaaaugcggcaggagaaggacaugaguauaggcacaaaggugggacauguuagguguguugaaacuauaaacagucacucucuccugaaugagaagaauagaguuuggguagguucauugaguauaugucagaggggaccuuaaaugcuugaguaggagugaaaagcuuucuucaguuuugagaaguguggucugggauauauugaguagaaucacuccucuuggugauaaauagaaaaagcgacaacuagggauugggaauagcaaaaggaaagucaggcaguucucagaggaaaagcagaaguuugcauugaaaccagggaguagaggaagccaaaacaagguaauccugggcccuaaaacucccuaccugguggcugaacugugagaggaugaggcuaaugggauuugccaaggcaugaaauugucaugggcagagcagaggcugcauaacccugguuacccagggagggaacggauugaggaauacaagguuaccuaaacucuuuucacaagaauccaagucaccaugggucucuggaaccacagugggaccgugaggcagucagcagcacugagucauauaauuugaagaacaaugaagauuugaauggagaacuaggcccccgggaaaaggacugcaaagcaaauacguauucucuacauuccuaagaaagcaaaugucuaaggcagcuauucaaacaguggggaagagaguucugaaaaaggaugacaaguagaaaguaauauaauuucuguuaguauuaauuuuaguucuggcaaauauaucuauuuuaaauucaguguacucuuuauagguuguuuuuuuuuuaaaugaguuuuagaaacuguucgaaagagcuuucauaaguuugucgaguuauuguuucuagccuagcuuucccccauccuucuuaggucauuuagcuaucaguuccaauaccauggagccugugaggagccauacaguuggggaaggacuguuguacucauuuagccauuuggugaccauuaaggaaugauuugagauuuuuugaguaggugaguagggaauauguagauugucuuguuggacaggaaguggaaagccaguuaggggggcuuugggguuauuccugcugagagcucaugaguauuguagccuaggcaguggcgguugauauauuaaugggcaguguuuacaggugccuuuuaacaaggucauguuauuaaguuuuauaacuuuauccaaaguggugagccacaccauggugaaauggacaaauaauauaauacaagucauagagagacuguccuguccccugaguaccugaggacacaggugcagccuuucuugcucucauucucugcauuuugccaagaguuggagaaguugggccgguugcuugggugggaaaggcuuucccacucacgcagguccagcaagggaguucaggcacagggccuuggggaaggccuagauucaagcuggugucaggguauggccucacugugcccauuucccaaccuuuguuggucuccacccauaggugggguaagguugccugauaaacacagggugacacaaaaucagaauuaggugauagaggcuacauccaggagcugcccauggcaggauuguaucuccuauccuguugauggagucaagagcacaacuuuuugagccaaaggagacaaccagcuuccaaccuauagcugaguuuuggucauggccgcauggcuagucaucuaaauaugaccuuaggcuauuugaaaugaugauaagagggagucauucagccaaaagcaaaauauugacagaacacugggacuggauuaagucuguugguaucagugauuuggaacaaaguuauugcuuaaguugcccuauucaauuugguuuuuauuuugccucauagaauuagggauauaaaaauacuuuuaagguucaaggccaaugauaaauucaauggaagaaaaauugcucauagaaaaggaguaugaauaaugagaauaguucaauaauuagauauuaagauuaaugcagaauuuaucauaaagcuuuuguuugagcauuaacugaaagaaauuucaagaugcuugccaucuuugccuugauuaacauggaacauaauuuaaucuuagauugauuaccuuuggcauuguagggcuuucauuuugaaccacagauuuuuuguuauuguuguuuauaucuagaaagucucagagcucaaaguguuucugagauaauucagaaggcagcaugggagugggcgguacuuuuuuuuuuuuuuuuuuuuuuuuucugaucuugcuuuguugcccaggcuggauugcagugacacgauugcagcucacugcugccucaauccccugggccaagcaguccucccacuucagccuguuggaguagcugggacuacaggcacaugccaccaugcucggcuaauguuuuaauuuuuuuuuuuguagagacaggucucgcuguguugcccaggcuggucucaaacuccugggcccaagcgauccucucaccuuggccuuccagagugcugggauuauaauaggcaugggccacugugcccaguuggaagugcuuauuugaagaauuucccaugcuguugguuuuguagaaauguguugcuuuuuguaaagagcaaaugauugguuccuucccuggagugggggaaugaggaggaauagaauuaauucaauauuucaguuaguuaacguucuagcacauuuauuuuauaaugcaauacuuccuugggaauaggaaguaauacuguauaagacaagacacuaacuuguuaugcagaaggaaaaaaaaaagauauuauuaccaaaaacagaugugaagauuuaugguuggccagagggccugggaaauucagaacuguucaguuagggagaacucguuucauaagaguagaggcuucacucuuaaguagcgggaaaggcagaauuuugugguaaccauguacagagugcuuuguacuucaaauuucagaaugaaguuuacagcccauuccuauguuauauguuacugccccuagucagugucuauuguauuuauuacugcagggccgccuuuuugccuauccugacacucaccgccaucgccugggacccaauuaucuucauauaccugugaacugucccuaccgugcucgaguggccaacuaccagcgugacggcccgaugugcaugcaggacaaucaggguaggccuaaagacguugggcucccccugcgugggcagagggcacguggagcagaugggcgggaggccaggccaguggcucucaagcuggccccgcaggaccuccugcuugguaaaggugcuccccaggugcugcuaacugggcgcuuuuuugcccagcagugaagauuuaggcugccugaggacucuccaugcuuuuuaucuauuuuauauauuuuauugagcauuuccaccucagauguuacuuguauccaguaguuaaaagcagggagaaagaucuuucacacuggcuagaguacaguaacauccagcuugggaguuagguuuugaagacacuucaccaaaauggacaauuccuuaacucacugugaaaucaccaagacuuagacccuuggaagugcgaaagccaagaguuggagucuucuguuucucuuugcaguucugcuguggcccuggaggagcaggucuagcuagaauuuggaggggagcuagaauuagcagggaaggcuggggagaagagaguaggggaggcagagcaagucaaaggauuccccucccuucauuuuuuccuaagugaauaaaguuaggugaaucaacuuaccacuuuuuguuuuuuggaacucauuuaucaaacuuaggaucuuuuucuuuuaacuacuuuuuuuuuggugucguauacaaacagccucugguucuaauuacuuuuucuaauaagucaagcagaaugcuugauuaaaguuuuuuccuuuuacuauuccacaguuuaauauagaucuuaguuauuuucuuuucccauuuaggacacguguuuuaguaauauagacugcaugcauugaucccuuuagaaauuuuacugaugauuuauauuuauagccacagaugucuauauucaaacaaaguuuauuuuucuaugauaaaaauaauacaaguguccuaaagaaaauuuggaauauauaggaaaaagaagaaaaaagaaaaauucccauauagucccaacacccaaaggucauagcuauuacauuuugcuauauuuauuuaucuauuuauuuauuuuuuagacagagucucacucuguugcccaggcuggagugcagugcaugaucuuggcucacugcagccucugccucuggguucaagagauucucaugccucagccucccgaguagcuggaaguauaggagugugccaccacgccagcuaauuuuuguauuuuuaguagagacaggguuucauuggccaggcugguccugaacucuugaccucaggugacccacccacuuuggccccccaaagugcugagauuacaggcaugagccaccgcgccuggcuugauuguaaaaguagagcauuugggcugugacccugaagcucagugaaagagcuuaauuguuccuguggucagugcuuuaaagacaacuaccacuuugaguaaaggucagggcucauuuggaaguaggauuuuaaaaauuaacuaggcacauuucaaagagcuaguucuuaaugaagaaaacacugugauggcugguuuuuggagcauuuugcuuuucauguagaugugacugaucuguugaauuuguugagugaauaauugggcucuauaauaguaugguguucuuccuuccccuacacacacacuuggugucuugaugaaugucauacauaggcaccucuugauuauccacuguggauaaucuauuacggcagugagcuggcuaaaauuccaaccccagauugguuugcucaaaccacuuaauauguuucugggccacuccuguuuaggcagugugugcucggguaaugaaagcuucugcuaaugucagccaaagcauaguugagaaaauaaauaugcuaaaacgaaaaaaaagccuuauaauuuauuucaaaagucauagaaaauauuuugauuguauuugucacuguuucuuauaaguccagauaaguaagugcugauauacaauuaccacauuuuaaaaaauucuuuguuuauuggucuguggaggguaugaaagugaagcuacaauggaacaaagucaucauugucaguaaaggagagauacccugagaauccuaaaaacacuuuacggaauagcaaaguagaguucuguaauggaaauacuguauaugcugggcuggaggagacaaaaaacccagaguuccaaccccauaucuaccacuggcuaccgugugaccuugcagcagucaggucccaucacagagcuccaugcuugugucuguagauucaaggagcagaaccagaacuuucagauuucccucaagaauuuugugaugcaguguuugaauugagcccaaguccaaaugacacaauuuuucaagucaauuuugaaaugugucuuugagccucaucccuauaugguggccaaaucaagccuguauaaacuucuacaugugcuguaccccucagaagacuugauagaugagacccuuugaagugucaaaagggacuuugagauucauucauaaagugcggcagccugugcaagcauuuagcagauggcagcguucccuaagaaucuucauacuaccuguagcuaaaugcgggaaauuaaaaauaauaugugugcguuguguuuauaucuguguauguguacguguguauuugauuaccacuugaauuuauuucucaucacagugauuauuugcagacuuacuugacuuuucuuauuccuaagugcaucugggugguuuuguuuugaagguggugcuccaaauuacuaccccaacagcuuuggugcuccggaacaacagccuucugcccuggagcacagcauccaauauucuggagaagugcggagauucaacacugccaaugaugauaacguuacucagguaaugacuucucuuuaucugcuauggaagucaccugcuaauucuccuugucaaugccugcauaaucccccucccugcaaaugccccaacugucugauguaucuuaaauugaauucaaggaagacucaucuguaauaguaaauugggccccuuacuggguggaguugaaggguuauauuacucuggucuuuugccucaaagcaugcagacuccgucucaguuucuucaaacuuuauugaagggauauggggagggggcauuggggaaacaguuaucucaugggaauuuaagaaaugagcauguacagcuuacguggagacaaaucuaagaaucugggcaggacaguccagguucaaggacuagaacuagagauccaaaauagcuccaggagccucggccacaagagugugggcguuuccacugcagggcucguccuucacguggcuuauucuccaucugucugcuucugcuugccaaugcuaauugauuauuuuuaccacagcuuccuguuuucuccuaucugcgucagagcuucuguuuuaucaugguuguggcucuuccacaacaauggaaaacucuccuuuauggcgucuuucuccauuauuacuuuuuuuuuuuggaccaccuuuuacuccuucucucaacaugucuaucucuagauucuagagagauggaauccuauugacuuggcuaaucuuuucaccccagguugcaccauuggccuuggucaggcucuaguuaaccgccccagggcaaaugcucauccucuuuccaguugccuauggcugcccuaagagcuguuucagcacaugcuaugaaggaggcccuuggacuuggaagggcuguaggugggcagcugccuccuuaauguguccagugcaacuuauaccacacacaauaaaauaauaaaguuaaagguauaguuguucuagagcucuguuugagcaguuaguguuaaacuuaguauuuaaauuagauuagaaccuauuucuaguuucucaguuugugaauguggguuccaaguaaaaaauacuuauacaugaauuaauucgcugugaggauaucuuugcuugaaaagcauuuacguauauacauauauacguauauauaaaaaagaaauuacauuauugugggauauaaaccauuuuuagaugagcuuaaaacauuuccugcauaccuuuuauguaacugcauuauuuuuggugaugcagaugacaccaaguauauuacaguacauucccugccucucaaagaauuuugccuaugugaggucaauacagguauuaaaccagcucauacaaccccugcaaaaauuaaugaggcuauugcuuacacaugaaaauuuauuaugugcucauucuuauugagagaauuucuuaucacuauauaggauauagugugguuuuuaaguaaucacaauacuauuguuauagauucauagcauaauucugugaugauguaucacaugggaaauacauaagaagguccagauuuauucucuuaaaaaugauucacuugggcuugcaucugucuauggcagacuagcuuguaucuuacuuaccguuucauggagaacauugaaaagguagguaaaauacauaaagcacuuguuugaaggcuuuggagagcuaacaaagcaacaaggauuuaagggaccaagaucaaagauggaaaagaagugcaggaaaaaaaagugcagugaaguaagcuugacauuugguuuccuuuccucuuaagguauuuguuaauuuguaagcacugguccagaagcugagugguguuuacagcagucucaugagucugaagggacaaaaauuggaauucaaggucugcuaagaagcagagccucuaguuauacucaaggcuuucaguugaaauccuuaaagggccaugccuaggaauaagggcaaacaugaaauaaacuugcuuucacaauacaggaaacauaacuuugccucugcucagucucagauuggauuaaggugaucucuuucuacgccaucugucagaagcaaacaaaauuuucuuugguggaaaauagaaacucaaaugauucuagaccuuuuuauauggaaauguucagcauucaacaauaaaugaccaggcaccuaacacauuaagaccuuaugacugaaaaucaagagggagaaaaaacccccuacaaacugacaguagaaacaaaccuaauggaggcuuaaauaauggaacugucagauacagguuuuaaaaugacugauuaauagguuugagaaaauagaugggcugggcgcgguggcucacgccuguaaucccagcacuuugggaggcugaggugggcggaucacgaggucaggagaucaagaccauccuggcuaacacggugaaaccccgucucuacuaaaaauacaaaaaaaaaauuagccgggcgugguggcgggcgccuguagucccagcuacucaggaggcugaggcaggagaauggcgugaacccgggaggcggagcuugcagugagccgagaucgcgccacugcacuccagccugggcgacagagcgagacuccgucucaaaaaaaaaaaaaaaaaaaaaaaagaaaauagaugacugcuugaagaauuuaguaagagaacuuuaagcuauagaaaaagaguugaauggacauaacuagaaaauguaacaacugaaauuagaauuuaauagauggcuuuuaaaggagguuaacauggcugaagagaagauuagugaauuggaagauagaacaauagauguuaucaagacuacuucaucugaugagucauagugaaaaauuagaauacauacaaggaaauccaaugagaaauuacacaugcaauaauagauggaagaaucauagacaugauaauuggaaagaggcuuuaaaauaaacauacauauuuaaagagaugcaaaaaaggaauauuauuaagacaauaggauaugaggagaaaaacagguagauuugaaaaauaaccaaauaauauuuucuagaaacaaaaauuacaaucugugaaauaaaaagucaacagauauagugacccagucgauguuuucacgcaauaugucaaauacagcugaagagagaauuagugaauuggagauaggucugaggaaauccccaggauauaguacuuugauuagauuguguuaaucgaaaaugucugauuaacuuugguaucagguuuaaacuuuacucaaaaauuuaaaaacauaauuauagccugauauuugaugacuuauggaaaugaugcaucucuuaauauuuuaugaaguugauacuuuggauaauuggauauuauuggacuucauaaacauuaauagaacagcacguagaacagagucucgcacauuauagauacucaauauuuguugaaugaguggaaugaaugaaugaaauguaagaauaaaaucauagcuacaaccuuuugauuucagaauggggcagaggcugcucggauucacauaucugauacuaagcuccuauuuuucauuuuaauuuauggauauuuauuuuagaggucaacccaauaaucuagcaaaauaucacuauuaauaugucuugcuuaagaaauauuggcuucugaauaacuacagauacacauguauaaaugagguaguuuuuuagaugucuauauauagauauaauuaucuauauaucaaauuauaucucuagcuaaauuaguuaauuuuccuccaugguucugggagaauugaacaaagguauugugcuaaguuuacauucaaaggcagcuugcacauuuuagacuugucaguauuaagaauguggugagguuuuaaauuguagaucuauuuauaagagauuuauagcaguuacuauaaaggauauuauuagaaagcagguaugagcuauuaacaaaugaauuuuacuuauuuugcuuaaaacaaaaagugaaggacacaacccaaauuuaaaauuuaaaauuauucuuaacuucuaaaguuuuuuuuaucauugauuuccuaaguguuguaguaggugaauuuuguuggugauaaacuggugauucaauucucugcacuugcucuuuucucugagcaggugcgggcauucuaugugaacgugcugaaugaggaacagaggaaacgucugugugagaacauugccggccaccugaaggaugcacaaauuuucauccagaagaaagcggugagucuuuguaagcugaaggguguccucugcuggcuaaggaagacagugcagcugugugggagaacccuaaaaagaaagugccauuucuguuuuacuugacuuaagagaacuuaaaaaaaaaaaaauaaacuaguaauccccaaccaacuucugauuauuuucuuuccauguuuuaucuggucuggcauauccaucguccuuagcuguuuguccaguguguacuaauuuaguuguguucagacugaauuuuguccuauucuguuuaauucagcugcagccaaguucugugcaagauaguaaaugugcaauaucaaaaugugaguccugcugcaauucuacuuaaacuuuggaugauaauaaauauaucagccggugugauggcaugcaccuguaguccuagcuacuuaggagguugagaugggaggaucgcuugagcccaggaauacagggccagccuggacaacauagggagacccugucucuaaaaucagucaaucagucaaucagucugucuuucuuuuuugcauuuuuaugguuuaaaaccugccuaaaggcuuaaugucauaauaccucgauccuccuucagaugcagacuagaaauuugcaugauuucuggaauaagaacugcaaugcuuccaaaaggcaggcuagacuuucaugcuaaggugcugggguauuucugauggccgcucaucgagcugagugaagcccucucacuucugguuuccuggccugucccagagcuaagcuuuuugcaaaucuagaaaucccccuuuuuccuuggccccuaguugcugcuucucaguuccuaggggcagcugggcuagcagcugucugggcugugucccagagccuggguuccaguaucagcagagagcuugacaggcgcucugugugguaggcagggcaggauuuaucuccuuuuacuggagagaauggauacgacagcuuguaaauagcagaacugggcuggaacccuuggcauucuccuuucacauaugcugaaacuguaaggcuuuuauggguucccaaugcccugccuccucuugcuguccacuggggaauuccugccugaaguguguggaguugugcugcauguaccaguguucuuguauccuucacauuaacuuuaggcugugucugggcccguuucucaauguaaaucacuguaauuuguuaagcgcuuacucugaggucagcucuuuucaugcaguaaaugcaccucacuucucagcauuuuucucacagcauccugugagguagguuguguggguuuuuuuuuuuuaagauggagucuuguucugucacccaggcuggacugcaguggcaugaucucggcucacugcaaccucugccuccuggguucaagagauuuuccugccucagccuccccaguagcuuggacuacaggcaugccccaccaugcccgacuaauuuuuguguuuuuaguagagaugggguuuugccauguuaaccaggcuggucuugaacuacugaccucaggugauccacccaucuuggccucccaaagugcugggauuucgggcgugagccacugcgccuggccuagguuguauggguuuuuuuccccgacaauaagcaauucuguaauucuuugacaguaacuguguguccuauaacucaauucaauucuaacaguagcuccuggagcuagagucagaacccaaagauuuaggggucauuucccacuuuagauaacaaaugagguacccuggcuaugcacacuucugcagauucugacugcaaaucaaacccuuuccucagguuugauaauuugcuggaaagacucauagaacucaggaaaaugauuuacuuaugauuaccaauuuauuauaaagaauacaacucaggaauagacaaauggaagaggggcaugggggaaggccucggagcuucugugccucccugaguggaccacccuucuagcuccuggaugugugcacuaauccagacacucccugaccuugccaguuguggguuuuucuggagguuuuaugacauaggcaugauugaugaaauuauuggcuaugggugauugaauacaaucuccagccccucucccaucccuggagguuuggggguggggcuagaaguucuaaccuucugaucgcgugcuuguucuuccuggugugagccuccaucaggaaucuauguaggcccccaugaaucaucuuaguaguauauaaaagacaguacauucgaaggguuuuagaucugugucaggaaugggggacaaagaccaaauaguauuuuuaaaauuauacugauuaggugucauuuucuugcgcauuucggcagagggacauaagcucaguaaguuaagugaccuauccgagguugcucagccaguauaugucagaguguucacuggaccugcaucuuaacucugaggcuggcauuguuaaacaccuguaguacugccuccugcugaaacgucuuuccuccccuauggaauaaacacugggaaaccacagucccuggggagugauauaguagggaguuagaguaaugcuugcauuuauuuuccuuuggccuuaggucaagaacuucacugagguccacccugacuacgggagccacauccaggcucuucuggacaaguacaaugcugagaagccuaagguaagcugggagcagccuggccaugcagaggcugugugugcuggguuggaguaggcaugacuuaguuaccacuuagcauuacagucugcaggggccauuaccugccacuguuagauuucuuaggcagcugugcagaaauucauuugagagauaaagaauucacuggcaaaacacauacucuucauuuuagcgcugggcaauuuaagacaguuaaagugaaugaauucugaauuauuauuuucauuugcauacauauuaaaacugaguaaauaucacguugcugcccaugaggugauuaaccugcucaucuuguucuuuuaaaacagaaugcgauucacaccuuugugcaguccggaucucacuuggcggcaagggagaaggcaaaucugugaggccggggcccugcaccugugcagcgaagcuuagcguucauccguguaacccgcucaucacuggaugaagauucuccugugcuagaugugcaaaugcaagcuaguggcuucaaaauagagaaucccacuuucuauagcagauuguguaacaauuuuaaugcuauuuccccaggggaaaaugaagguuaggauuuaacagucauuuaaaaaaaaaauuuguuuugacggaugauuggauuauucauuuaaaaugauuagaaggcaaguuucuagcuagaaauaugauuuuauuugacaaaauuuguugaaauuauguauguuuacauaucaccucauggccuauuauauuaaaauauggcuauaaauauauaaaaagaaaagauaaagaugaucuacucagaaauuuuuauuuuucuaagguucucauaggaaaaguacauuuaauacagcagugucaucagaagauaacuugagcaccgucauggcuuaauguuuauuccugauaauaauugaucaaauucauuuuuuucacuggaguuacauuaauguuaauucagcacugauuucacaacagaucaauuuguaauugcuuacauuuuuacaauaaauaaucuguacguaagaacagagaugguauuuucuuucuuucgacuccauauguaacuguaaacugcuaccagacucuuaauuugaacaucaucauuuucagauguuuacccuuaaaaauggaaaugccaguaucucgaggacuccauguuauuuguuuaaaucuauagccuuuggacagccuucugagacacugauaaaauagcaaau

SEQ ID NO: 13301 - RNA, 41358 nt, Homo sapiens
cgacagccuugaggaaggucccuucucgcucgccaucucugcgacuuuaaugcgcuugcgcacgugcugucuaccaguuccugagagggacgcgugccgcggagccaggcuuacuacgugacccggacaccaggcauacgcuaggggcagucagcugugccuucucuuucggaguuguuccgugcucccacgugcuuccccuucuccacuggcugggaucccccgggcucggggcgcagguacccaacgcgggagggccggguauggaugccaagaucggugucuguguucuuccugggucgagaggggaccggccucaggaugaaggcucugcauccggacggauaccuggccuacgccguuuguccuccaccccucuuuuggggcgcuccaagauaacagaaucaccucuccaauacgcagccgcucucggcgcgugcuucucgagcguccucggggauuugcguggcucgauaaccaccucuaaguagugccuguaacuggggagucggggugaaugggugggugacaacaguuguuuuccguggagcuugcccgcagugccuggcugcaggucugggcauuauacuuaggguaaucugauuccagauccuuccacguucuuaaauccuucacugugcacauuccuuuauacucuuuauucagcagucacauucaggacuugguuuuguuugccagugcaccuaaaauggugccugccacauagauguuauguguagauagacgaaugagugagcgaaaaauaaucaucuccuucaaggccuuccccauccaggccuuccaugacagcuucagcccauaguaaucucagcccuuccuucaucugaccggucccucaguauagcuauuuuuuuuuuuuuuacaucuaauuuuaccuguguucuuguuccucaucucauucucuuaaauaccuucuucaagaagaaugcaagcuugaagucaagggccuugugguacuacuucuggggcucccacaguagcuagagcaaaaggcagcccccauuaauuaguuguugauugauuuuugcgggaucuuuauguggccggcaacacaagguuuacaaguugggaagauuggcgaacugggaagagcucaggcuuuggagucaggaagacuugagugugaauucugucugucguuuuucugccucgggauauuugaauucuuuauacuuucuccuuuacguauaaauugggguccuugacagugacuuaguguuuuauaguaagacauaugcuaaaaucuguuuggauuggaagguuagaagggacaguuaagguaugguaaguuucaguaaaugagcuuuauguuuauaaugcaguagguaccagaguuucuaaguagcaugucacuuuuacaucuaaguagcauguuacuuuuacagugauauuucugaugguuuuuuugauguauuuauugggaugaugcaguauuuuacuguagguaaucacagaacuuuuuuuuuuuuuuuuuugagacggagucucacucugucgccuaggcuggagugcaauggcacaccaucucggcucacugcaacuuccgccuaccggauucaagugauucucuugccucagccucuccugcagcuccacuaccacucccggcuaaguuuuguauuuuuaguagagacgggguuucgccauacucuugaauuccugaccucaggugauccacccgccucggccucccaaagugcugggcuuacaggcaugaaccaccacucccggcgagaacuuuugaggucugucuguacaaaggcuucaauaucguuuucccuaaaaugaggaaacaguuggacacauuacaucauggaauuauucauugaugguuauugauuucccugacuuuauuaguaacacgugaauuuuuuaagauuccacaaaaacaaaagaacaaaauaaaagucccaccauccagaaguagcuacuuuauacuuugguauuuccuuccagucuuuuuuauuuuucccucuguuauguguaugcauaagaaauguuaucauacuuuauucugucaugaucuugucauaagcaucuauauccauauccuuaguuguuaaaaaugcuuggcccagcaugguggcucacaccuguaaucccagcccuuugggaggcugaggugggcagauugcgaggucaagagaucgagaccauccuggccaacauaugcgccuguagucccagcuaccugggagguugaggcaggaggauugcuugaacccaggaagcagagguugcagugagccgagaucaugccauugcacuccagccuggcgacagagugagacuccgucucaaaaacaaacaaugcuuuggauauuuggauaucuccuuauguauuuuagucauucuucuacuuuuuugaauauacaaguuucuggcuuuuaaaaaauauuuaauagaggugaauuacaggcuuuccaggcugagggaagguuuucucaccucccaagccuaagguuuccugaguuuaaaacuagaggcugaugucuuccuguggagcucguagaggguuaaguaagacaauacuuauagauaugccuagcacagucccaggccccacaaaaggcagccagcuaauguuccuuagacaaucuagugcgcauggccaguuguauuucuuucucuuuuaguaauaauuuuucaccaugcaucggaaaaagguggauaaccgaauccggauucucauugagaauggaguagcugagcggcaaagaucucucuuuguuguaguuggggaucgaggaaaagaucagguauggccugguaaaugcuuccugaauuacuuuuuaucuuguccaaagaaucagcauguuuaagcacucugcuguuucaggacauaauggcauuaagaucucuuuggcugguaagaugccuagugggaaccuuucuuuauuuccuggaaguggugaauucucuguauuuagauugauucgcagacaagcuaauaccuuuugaagccuggggugguggguugaccacaaagugaacuguaugugaccuggcuucuaguccaaaccuggucauugcucgccuuagaaccuugggcacuucccuucccuggcccucaguuuaguuuccacauccgucaaaugaggucuuaagccuggcggucucuaaagucucuuuugugccugaaauucugugacuuuuuuguuuggcaggugguaauacuucaucacauguuauccaaagcaacugugaaggcucggccuucagugcugugguguuauaagaaagagcugggguuuagcagguaagcugggcucuucauguguuuuauccaacuuacaauuccugcucauuaguuaaaugccaggaaaugauuccuucacauauuuuuuaagggucuuuaguggaggugcuaucucugaggacaaauggagcugauauccuuucuucauuccugaaaauaaguuucaaaucauuuucaugcuuuuuaagucaccaauccaaugccuugccuucugcauaugguuuuccuuccugcuuuucuaggcugauuaagcccaucucauugcaaguuccuucaaacugucuuuccuaccucaaauuuauuccacuuuucacucucucucuuuuucuccccuucuuucauggaggggguauaugccucaucccauguccaaggaaaaccccuuuauguacccugugucuccucccucaccucuuucaggaccuguauugucuuuccucugcuggccacccaauacccuuuggaaacuuucuccuuccuguaaacaugcucagauuuuucuauuaucaaaagcugauuacuuacauacccagauuucucucucagguuagcauuucccccgauuuuuauugccauauaccuuaaaacagaaaucuuuugcacuuaguagccacuuuugcagucugguuucugcuucuauaauugugaucaaauugugcaguuagacauccccagcagcuugaugccuaaugcgucaacuuuucucucucuuucuccuccuuuucagagcucugccucuucuucuaccaguucacugcuguauuugacaguuggcuauuugaagcugugguagucaagacuuuuagucauagauaacauacuuucaacacaaauacaauuuggcacaaagggauuucauugagguauaugggauauuuccuggaauccaaggggauaagauuucagcucugcucacgggugaucuagagucacaguacuaaugcucccagcucaguuugucaucucaguguaucugcucuaugcagaccaacuuucucacugcagaccagcuuucuguuuucuguugucccccuagcagaaacaacacuugcguuuuccuuguuucaggcccagccauguggaaaucagacuuuuucccaaaauucugguggaaaaaugcccacaccuggccagaggagggugggguuggucauagcauaauacaaaguuggaaguucuaccuacaacuuuguguuuggagaaguuuggaugggguggguagugcuguuccuuggcagauaaccaccauggcaucaccuaagaaauagucuccuuuuuuggcuucagugucuuuacucagaccaccuuccggagcucuucucuuucucuggaucucgucuccuuacucuaaaccuagcuggcuugugcgauucuguccuugagccucuucuaauuuccaaaugugcucaucuccgaucugacucugaaagccugucuccagcucugguugcuuuaugcugugacuaaccucccuccuuuucuuugcucaugcugucuccucugcuuggaaugccacuuccaccuccccgguaucaccuauugaaauccuguuucucagggccugccuccuccgugaaacuuuuccugagccccccagucauaccuggugguuccucuaccuuccucugcacuuguccuucuccuauaauguuugccaauggaugcuuuugcuuuaggguaaagucacuuacauacugugacuuacguucauuuuuuuuucuuucccuuuuuuuuuuuuuuuuuuuuuuuuuacuuucaggugauaagcuuauuuaguuaggagcccucuucuauuuaucuuuguauuuucauacuuuuaacugauuuagcauguuuaucauagguacucaguauacauugaguuggauguguuguuaacaggcucuaaaauuauuuuaauuuaaauuaguaccagaggcuaaacuugccccuguccuguggucuuaaagugaagggauucugccuaaaggaaaccagacaaucauaagagccuuacugaugaaaugugaaaagugcagaaaacccaaagaugaaaauaaaaaacaucucacugucuaggcauugucagcaucuagguguaucuuacagggauguaguuuugaaccauaauugguauucuguuguauauacucucauauuuagagagguaggcauuuuuaauacagauugagaauaaggccuguugucuaucccagaauuuuaaguuuuuagggcuucugguuuucacuauuuuucauuuggcaaauaugagauggguguggaauuaggcaguucaaagucuucugggcagauuugccuuuugaauuuaaaccaccuggcuucacuucuaaaaaucuacuuuuguaccucuuauagcucuucugccccaccccugucuuagucuggcagagcauuguguucaagcuaaugccuguuuguaagucacgggcuuaaggccugagccagaagggacaguggagacaaacucacccacugccuugguucauagaugaggaaguggaggcccacaggaggaaaggccuuuguucuagcuauuaaguuagagaacuaugguaaaauuuugaucagcuguaauccuccauucuagaacauucuaauucucucuuuugguaaaggaaagguaaguagcaacuggauaugcaggguuuuuaagaccaaaaaaauucaggaauuccuuagagauguccagauuccauucugaucccuguguccuguaucauuauugucuuauguaagaccugcccuugaagacauaaucccacauucucggggaggaaguccucuaggaaggaugaauaaaguaacgugccaucaccuugucuuuccuaggaucucuggggaacagcacaguguaguugaagcauuggcuuaugacugagauaaugaggccacucagguuugguuucaagcucuggcuuuggccaaaugugaggguuagcuacccuauuacccaucuuuuaaagcaaaguauuugcucaaggucacagggcaaaauagcagaguucacacauagacuuaucacuuacuccaagcccuuaagcacucuaaugccucucaugccucuccacugcccuccaccugaagugggccucacacuuucaaguucccuacuagcucugaaagucuaagugggugaucacugagccuuuccccugguuccagcucuuuagcugcucugguuaacuggcucucaugggauugggggugugugauugcagucaccggaagaaaagaaugcgacagcugcagaagaaaauaaagaauggaacacugaacauaaagcaggacgaccccuuugaacucuucauagcagccacaaacauucgcuacugcuacuacaacgagacccacaagauccugggcaauaccuucggcaugugugugcugcagguggguggcuuccucuaaccugugauugaagucagagucuugaggguugcuugggcugccuggcuuuccacugggaacagauguacaguaaggagaggagagucccauguucccuaugcccaagcauuauuaguggaaguccuggccacuuuccaaaguacacucggucaccuaccccauauaaaaagagaauuuuaaaucagcacuugucuagagacaccagaacugaagugaugaguuauuauaacggguucuaacuagcuaaagcugauaaagcaaaugccagagacuuugagugccucuaggacccuagguccuuauuggcauucaccaaagacuuuuuuuguccagugagcaaugggacuuguuuuccaaccggauauagaccaaugcacuuaaauguccuguccagagugccugaguggcauacccaccaugaaggccccucuccccuuuucuagcccuuaaaaaccccucacuuuaccucucagagacuacuuggugaauuucugcacugguguguauucucuugccuggcaaguuaauagacuaaguuucacuuugugugugugugugugcauguguguguaagcacugguggucuuuguuuuauucuuuguuucuuugauuccugugccaccucccuuccccauucucccaaaaaagacaagacaaaauuaagcacaaauccucacauuuuuguguguuuaucauauacacuuacaacugugcccauuauuaugucaaguuacauaccuugcaaaauauggguugucuccuauacugcuggcuugcaucucaccuuggaggccaagaaagagggcauuaugccucauuuucaccuuuacucagggaaaugcccuggguuaucacugauugguagggaguggucuucuacuugcugccaugaucaauugccugaauaaugacuccugugagcaguagcucccccauguaguauaguuuugucaaacagguuugagcuauaaaugucagaaaauguaagauguuucugaaauucaaguaugaaucagugaagguuggaaaauuuguuuccaaauaggauuuuaucagagacauuuuugacauauaaaacuaacaacgucucuaauaagagacccguuuuuggcauauaaaaccagguauucguauauucgaggguuuggcccucuucugugguaccccuguguguguauccugggaagucaaggugggaacagguauggucuuggcuuugugcucugaagucuucuuuuugccuuaucaccuggcuuuugguuaagagucccuuggguugggccaggcgcgguggcucaugccuguaaucccagcacuuugggaggcucagguggguggugagccaagauugcgccacugcacuccagccugggcgacagagcaagacuccaucucaaaaaaaaaaaaaaaaaaaaaaaaguccuuuggguugcuauuugcaugaccagcccuuucuaacgcccccuucuuccaggauuuugaagccuuaacuccaaacuugcuggccaggacuguagaaacaguggaagguggugggcuaguggucauccuccuacggaccaugaacucacucaagcaauuguacacagugacuaugguaagcaucuguuuuuuaacuuaauugugaggguucaaguaaaucuguuuuugcuguguucugcuuucuuuaaagaauuccuguugggcagcuccagugaguagucagcacagccucugggcuaagagcucuuugauuuuaacuaaugaaaaagucacuacaguuaaaucucaggguccaugaguaugccuaggaaucucugaauuucaccuuuguuuucaggcacuugcaaauucuacaccagugagauucagauaugauacagcuuuuauguaguuaaauuuucuggaaugauauuguacaaggagcaaugccagugccuaaauuuguguauugcaaaaaaaggaccaugugcagacugcucacuggcccuuauccuaauggaugacgaaggaacauuugccaguuguacuccaguuuggcaagaauuucaacuccagcagagauuguguucucccaaagcaaaagacacugacugaggacauggugaggaauuagggauaugucucaccugaugcagagcuggucuccucacuuuaucagcguugccaagucaguguucagaggcaaguuuuaagucaugcccauguccagcagcucaguaaugguggucggauuggacuuaggguuuccugagcugcauuuaucugaugaaauggacuuuccucaaaucuuaggggcuguuuccugucauuacuucucccuucaucacuugcacuacagcccuuuuggccuccucaaauguccucagacaugcccagcacacacuccugcgagggccucggcacuugcuguucccacuggaaugugcuuccucuggaccucugccuggcucgcuuccucauugcauucaagccccugcucagauaucaccucauccauguggucuuuccucacacccuguuuacaguaggcagcuccgccugucacuccuuaaccggcuuuauuuuucuucaaagcacuugacaaugaccuaaaguuauuauuauuauuugucuguccuccuguacuagucucuaaauuucacuggagggccgaucacaguggcucacgccuguaauccuagcacuuugggagccugaggugggcggaucaccugaggucaggaguuugagaccagccuggccaacauggugaaaccucgucucuaccaaaaauacaaaaaaaauuaaccaggugugguggugcacaccuguaauuccagcuacuagggaggcugaggcaggagaauugcuugaacucaggaggcggagguugcggugagcugaggucacgccacugcacuccagccugggcaacagagcaagacuccgucucaaaauaaauaaauaaguaaauaaauuugaugggaacagagaguuaguuuucuuugcuguugcauuuccagaucuuagaagaguuccuggcauuuaguaagcauuccuuagauaguugagagugaaugaaugacuuugugcucacaucaguuuguucuuccucucccucugacauagcuaccuacuuacccuucaggccucagcuuaucucagagaggcccucccucacuacccuacauaagugacccccacuugcuauccgugcagucuauauuucauauguagcauuugucaaaauuuguauuuaucuacuaauuuuucuuccuccauccauuauacuccaagugccaugagaacagaggucaugcuuuguucauuaguguaugcacagcauaucuggcacacagcaugccaauuuuaugaaauaaaugaauauaacuuaggaugcuaggaaaaauguggaaaagugaaagauuuuaauaagcaacguugcauucagugucugaucccaguuucagcaaauaccauuuggcacagcagugugugugggagugauuuuguuuccagcaagauugcccaugucuccuuggauagagcuuuguauuuggacccugguccucagcacuguuugcaugccuuuguuaauggauguugucuuucuuuguuaggaugugcauuccagguacagaacugaggcccaucaggauguggugggaagauuuaaugaaagguaauucuauaguuccccccaauuguggggcagccacauugggagggacauuuuuaucuuggacucaacugaaaacuuugcuuuuauauuggggaaaguaguacaauauuccaaaaaugaugagauucuugacagcagcagcaguugugagacuaacuggaagcagugaaacgugguggaaaguuggagccaggaaaccucaauuuugucuugcugcuggccuugacagcucaguuaaaccagguuacucucucugguucuuagcuuacucaucuuuuaaaugagugauuuuucuggaucacugcuucccagaagauauuucauagagcaguagucuuuccaaacuuuuuauuaugaauaugacguacuggcauaguaaaaaugauuaagagaaauaugggagguggggugagauguaauuagaggcagaaaaaggcgacaaaguguuucuucugagcaaaggaacacccauaauuucaaauaugguguacgguuuguuaucugaaauuaaauuuguauguauuuauuuuuauuuuauuuauuuauuuuuuugagauggagucuugcuguguugcccaggcuggaguguaguggugcgauuuuggcucacugcaaccuuugccucccaggucgagugauucuccuguaucagccucccgaguagcugggauuacaggugcccgccaccacacucggcuaauuuuuuguauuauuauuauuauuuuuuugagacagagucucgcucuguugcccaggcuggaguacagagacacgaucuuggcucacugcaaccucugccucccgcauucaagcaauucuugugccucagcuucccaaguagccgggauuacaggagcccaccaccaugccuggcuaauuuuuguauuuuuaguagagacaagguuucaccauguuggccaggcugguccugaacuccugaccucaagugaucugccccacucagucucccaaagugcuaggauugcauguaugagccaccgugccuggccauuuuuuguauuuuuaguagaggugggguuuucacuguguuggccaggcuggugucgaacuccugaccucaagugaucugcucacuuuggccucccaaagugcugggauuacaggcgugagccaccgugcccgaucauagaacacuagucuuuuaagagggaacauaugaggaggguuuggccauauaugucugggaaacaccuauaccguuuuuuccuuuaugaagauuugccccagccuguuguaaucucugaaaagucuugcagcagcagggaccuguuuaacugauuguuucccaaauuuauuuuaccaaaaaaauuuauuuuuuugaggggugugggaacaccaguuagcacccugugaaacaccuuaggaaauuuugaccuaaaucagugguucucaucuggagccauuuggcccccuggggacauuuggcaaugucuggaaauguuuugaucguaaugacuuugggagggugguggugggugccgugggcauccgguggguagaggccagggaugcugcugaacaacugguggugcacaggacagcuccacaccaaagaauuaucugguccaaaaugucaguagugcugagguguagaaauccgagccuugaugaacccugggggccuuucucauuuuaaccaucugugaugcacuaagucaguagaaugagcagaucaggaggagcagcugugugcuacugaauacaacagaagccuaugaaauccuuuucuugcagugggaggauguuugaauuuuauagucaaacgcauuuuuuucccugcuugcaagaacguuuguauuguauuucuuuggggagcuuuccuuucaccuucuuccuuuuuuuucuuuuuccuagugacaaaagaugaauucauuuguauuuuuucccugugugacuggugaucauauggggguuggguuuggaauuccccauuuaaggauggccugaaacaccucagugcuaaagagcaagccugggaggaugaggagagggccacgugguguagggaauaguggcagucaugcacaacaggagggcuucuaauugaucuccugggaugaguccuugguuuucugauuugcuguauaaaguauguucaggugccuuguggaggaggugcugaaucaucucacacugcucuccaacuagguuuuagcuuuuucuggcuuucuuagagacacuuggggccaguuaauuuuuuugaagaaaaguuauacucuguauagacauugcaugcccuccccaacacuucauugcagcgguuuuguaucucagguuuauucugucucuggccucuuguaagaagugucucgucauugaugaccagcucaacauccugcccaucuccucccacguugccaccauggaggcccugccuccccagacuccggugagucugugcugggguccaggaaucugggggaggcuacguuuucuguguuguuccuccugugacagugacagaccuuccccuucuccucucucugguaggaugagagucuugguccuucugaucuggagcugagggaguugaaggagagcuugcaggacacccagccuguggguguguugguggacugcuguaagacucuagaccaggugaguguggugcucagcacuuccaacacaaagguaguaaaacauagcauacggagcguaacagaagccaagguacguugacucaagacccagacccucccuggagaaggggacuuuuccccuugcucauacucgugugugcucagcaacaguagggcuauuucauguuguguggguucccaaaagaagucuggggauuaccucccccuagucaggcuacagauagagcagaugaauuauuauuauuauuauuuuuuaaaagacggagucucacucugucacccaagcuggagugcaguggcaugaucacggcucacuguaacuucgaaccccuggccucaagcaguucuccugccucaaccuccuaaggugcugagauuacaggcaugauccacuacaucuggacagauuacauugaaagaggaauccucucaccacuuuuuccaagagagggcaacauaccuguguucugaaauuucaguuaaguuuugaugauauaaaggcuuuugccuauagcuuauucagaagugagaggagaacuugaggccccuagucugguauuuacccugguuccagugcgaggccugaugagggcccucugggguaauacguaccuggucuuugagugcaaauagcaggcugggugagagcuuacagguugcauuucugugcucauugagguggucugcacugguaaacuuggcuucucuggugguuccugggccaugaugggaacugacugggcacagcccagaggucuuugaacugucagguguguucaggguucuaggucacccugagccaaaugagcagcaugggucgcugcccuugagagggaagauagcugcagugacaccucccgcuuagggcugagucccagcaggcuggcuucccuuuucauucuggaaauaugaucagcagcuacauagcucucuaugcagcuccagcugcaggcccuaggcuuuuuugauucacuuccugguacccucuuuaucacaaaagagaaggagugagugauaggauaaagcaggagaaacugauucuaguuaaguaguguuauaagaaaacaaauggccuaugaccaaaaaaaaccaaaaaguuaauagaaaaagaguacauaaaaaaauaagaagugguguuuccacuuggcaguuucacucugcagaaacaacugcuauuaacaguuuauuauguauccugcugccucuuuuuucaugcacauaaaugaauuaaaugcgaaggggucauacuacagaguguaagugguccccuguuagacauuucgauugauuccagcauuuccacuguuagaaacagugcucuuaggggauucuuacagauaagucugugggcacuauauuuaggauacguuuccagaagagaaguugcuggaugagagguuguguguauucaaauggguguuguaccaguugauggaacuauccaguguguggaaaugccuuuuucucuacacccucgcagccgugauuccuaguaaacuuguaagucuuuacuaaucugauaugagaacauaggaccguuuuaauuuguguugcugcuuuaauuaggagagaggaggguaccuucuucauauaauuauuggucaucuguuguuuuguuguuguuguuguugcuguugguuuuuuuuuuuuuuuuuuuuggugagccggucugcuuauuuccucugcccacuuuuuacuuggauuuuggccuuuuuuguauugguucuucauuuuaggaugcauuuuagucuagauuugguaccauucuguuaugucauuggauuuuucagaguuuauaacuucuauaauauaaaacaaaaugauaaaauacagccuucaggcaaggccaaguuaaauacgaccuggauucccuuugaguauuuucaucuggagaaacucuggcuuccugaagccucuccccuuccaucuaccuuggccugugucucuucagugucuucuuagcaucauugccuaggcaagcaugacaacuucucaggaccaucuggccuucuucccacccucaaacaccuauucccagcacagauccagcugaggagcaaaguuuggccccuaaguaguuaguggcuccuguccuucagugucacuggcaucuugcuuuuacuucuaggcgcuccuguaggcacugggggcccagcaguagacaagagggaugcaccugcuucauggagcuugccuccuagugagaugagacagucaguaaauaaaagacaugagcagaccauauggugaagcagaagaugcuacguacaaugggaagaaagaaaaaguugcaaagagggauagggcaugccagaugaggguggggcgcugugguucuacauacaggggcagggguggccucauguaggaggugauuuuggagccaagccaugaaggaggcgaggugaggaaacaagcccuguggcucuuggggagccacugcuucaggcagaggaagcagcaugugcaugggccugggggaggggugucccuccgguguccuaggccuggcagggaggcugaggggcugaagcagggugaguagggguggaggaggagauuuuuggaggaucuuucaggccacuggcagggcuuucacacuuacucuauaacagaugggagcaguggaggcuuuuaugcccauagucuccuuucagcacagcugccagaggcauccccaggcuucuuuuuaagaggaucgucuggcugcuguguugaauauagacugguggagugaggguggcagcaggaagacugaucaggaggcugcugucaugauggaagaaggauagggugguggcuuugagcagagcaguagaggaggauagugguguaaguaagaaaugguaggauuuuauauauguuuuggagguaacaggauucgcugacgaaucaaguuaucagggaagaauugaggaggcuuuggcccaagcaguugaacaguuagauggggaagacuagguggaggagguuuggggcaacuuuaggcguucaguuuaaaguuugagaucuguaguguacaaaugggaauguacaggaagcaguugcauguguauaaaagucuggugugggccagccaggugugguggcucacgccuguaaucccagcacuuuggaaggcugaggugagcggaucacgaggucaagagauugagaucauccuggccaacauggugaaaccccgucucuacuaaaaauacaaaaauuagcugggcaugguggugugcgccuguaauccuagcuacuugggaggcugaggcaggagaaucacuugaacccaggagguggagguugaagugagcugagaucaugccacugcacuccagccuggugacagagcgagacucugucucaaaaaaaaaaaaaaaaaaaaaaaaggucugguguggaccaggugccauggcucaccccuguaaucccagcacuuugggaggcugaggcaggcggaucgccugagguuaggaguucgagaccagccugcccaacauggugaaacccugucucuacuaaaaauauaaaaacuagcugggcgugguggcaagcgccuguaaucucaguuacucaggaggcugaggcaggaaaaucgcuugaaccugggagguggagguugcagugagccgagaucgcaccauugcacuccagccugggcaacaagagugaaacuccaucucagaaggaaaaaaaaagucugaugugcagggaagugguccagacugaagcuguaaauuugaguuaucagcaucuauuaaaaauugguaccaaaggccuugagacugaaaugagaugaccaagggagugagaaguccaggugcugagcagugcuuucuggccugcaagaacugccgcccucuuauuuagccuggcaucaaccucacuucuccacagugauggugaugaaugguggaaacuugggucuuucuuggaguucaccuaauauguuucuguuuccacaggccaaagcugucuugaaauuuaucgagggcaucucugaaaagacccugaggaguacuguugcacucacagcugcucgaggacggggaaaaucugcagcccugggauuggcgauugcuggggcgguggcauuuggguaaggggauucagucccccaucuuuaggaacucugggcucuguggggguagugugcaggguuggggucagaggacugguaucucacguuccuaguucugaguucugaguggguucagugugugauuucucuaggucuugauuuccugccaggaaacagcagcacuguuuccccaacccacccuaaaggugcauguuuacuuguguguacacacagacacauauauaccagggccuuuguaaucacuauuuacaguugaacaaacaugcagaggcaaagaaaugggaguaagaaacuuuacaacucagggcaugagaauguguaugaccagccuugcugacugagaaaaguacaaguuugacauuuuaaugauuuugauuaaaagaagcuuucuuuggcuucugaggagcugguuuuaggugugauguuaguuucuguuuuuuucuacuggguuuggaagauacaugcagcugccaauagaguauguucuuccaacuucucggccauaauaaugaaccuagaacuuacuguguuugccuuugugcauuaucuuccuuggugcucuuuagagcucugugggcauuuuauagaugaaucaaccuagguuuggggaguuccagugauuuacccaagaucccccagcaagucagugcugauagagcuggggcuugagcuuagcuccugacuccuuguccuucguucuuccugcugcucuagcuguaacagucagccucuuagccauuagcaucugcuguuagcauccuuuauacucagcaaggcaaagcuaacuuggagguuagcuuuggccuuggccugagcaccgauugagcuccccagcuucaccauuugaaagcgucagcacagcuagugaugagcaugaaacuacuucuuguagcagugcacuggauugggaagcagucugucuguucugcacaccgagggcguugucuccacagugcuucuaagcagcuugcuuucacagauguugguagcuaaaugucuggaguugcuuuacuuuccuucccaaaagguguccugacuuuuucccuugcuguuaccucugguuaucaccuuugggacaggagcaaacaaaaauauuuucuuuuuuaaauuguuucuuuaagauguuccuaauuucuuaaaaauccuucuuuuauuuuguucuguagguacuccaauaucuuuguuaccuccccaagcccugauaaccuccauacucuguuugaauuuguauuuaaaggauuugaugcucugcaauaucagguaggaaauuuggauuaagaauuuuuauuuuggaccuggugugguggcucacgccuguaaucccagcacuuugggaggccgacgcgggcggaucaccugaggucgggaguuggagaccagccugaccaacauagagaaaccccgucucuacuaaaaguacaaaauuagccgggugugguggcgcaugccuguaaucccagcuacuugggaggcugaggcaggagaaucgcuugaacccgggaggcggagguugcagugagcugagaucacgccacugcacuccagccugggcucgaaacuccaucucaaaaaaaaaaaggauuuuuauuuugauacagugcuggguuuaaauccaagugaagucuuuagaauacuugcuuacuuucauaauauuuaguuucugaaacuuguuucuaaaguuugucauugguuugacuccccaccaggaacaucuggauuaugagauuauccagucucuaaauccugaauuuaacaaagcagugaucagagugaauguauuucgagaacacaggcagacuauucaggugaggcuuguucucagacccugaugugcagggccagugucuugcuguauuuaacuggcucuaagauguuuccuguuauagacauguaugucuuguguaauugcaugucuuuuagacaauggugguguuguaugcuaaaccuguuccagauuuucagacucuucuaaagaaaaacauucagcaaacuaacaaauauauguaguuagauugaaaaguuguguuuuuguccuuugaauauggaauaagugggguggaaaguacgcugauuaacuaaaagagaaucuuucuucugacaucagcucuaacuuugcuuaguuauugcaguuuuugaaauguugcaucuguaacuagaacaauaaccuuacagcuuaaaugaaaaaaagaacuuugcaaaaugugcucugaaucuuugugguuuagccaguggccuauuuucuuuuuuaaacaguguuuucccaaaaguucuaaaaaucucuagcacucuguaagccugaauggucugcacuuguccaaaggcugcaguuuugcuaaaucucuaagagaggcaugaggugaugggcuuacagacggacugagacuaaugggcucuuacuggaggagguucauugauuauuuuuggaauuggguugggaagugagccaggugaauuuggcaguuuauacccuagcacuuuaugccugucaaagcauauguauaugcaugucaagaaguuauaccuuuuuaucagaggccagauuauaaacaauguuaaguguuuaugccuuucaccuuaauuuuuucuuacuagccucuuucuagaaucucuucauucuguacauuucugcucacuuuugcucgauucccccagcugggaggaggaaaggcugcuguuggugagggucaggcugcaggcaaugagaacacggagaccuguuaaaacucaagaaaaauacacaaaccaaagaaggaaaacauuucccugaaauacccugccucgggccuugcuccuucuugaauuuguaaucaaauacucucucauauuaccagaguucuuuugucuccagugugagcacagaggaggugaccuuacuuuaugagacuccauuuguguaccuuucaggccucucuuugggcucaagauugagaaaaagaagaauauuagauaaaaguuggcuucaccuccccuggggggcugcuuucugcugcuuuuaugagaugcuuguuuaguuuuucccuugaagaagacaagaucuggggcccuguugaggauguacauucugcugcuagaaaugagcaggguuggccgggcaugguggcucauggcucuaaucccagcgcuuugggaggcugaggugggcgaaucacuugaggucaggaguuggagaccauccuggccaacauggugaaaucccaucucuacuaaaauuuaaaaaaguuagccaggcgugguggcaugcgccugcaaucccagcuacucgggaggccgaggcaggagaauugguugaacccgagaauugguugaacccuggaggcagagguugcaaugagccgagaucacaccacugcacuccagccugggcgacagagugaggcuuugucucaaaaaaugaaaaaaagaaaugggugggguugccgccucccuggcccaucagcuuguagcaaagcagaacaucuuauuuguaaugaaauaguucaaauguauaggagcgugcagagaccaauauaacauucaggcacccaacacucagguuuaaguauuguugacauuuugauguuugcuguguuuguuucauauuucaaaugucauuuagauuuuuguuuuaaagaacuaaaacaucacaaauacaguugaagucccucaaccccuuuccauccuauuuccuucugucccuccccaugggugacuuaguucugauacugguguguguccuuucaguucauguguuucuauguuuacuacguaauuaucuguccauaaguggaaacauacuguacuuguccuccuucagcuuuccuuuuuuaacauuuguuuucaagaucuaugcagauuaaagcuuguagaucugguugauugaucuuuagguauuauaugaguaaauuauauuuacauguauguuucucaaaguggaguuguuggguuuuaggauuguguaguuuuccagcuugcuuaaaauuugccaaauucuccuucaaaguguuuauaccaguuuacccccaugccagcauucauuugaguuuuaauuucucuaagaccucaucaacucuggauguuuuaacagcuauuuaaguuuugugaaaugguaucucccugcugucuuuagcauuucacugauuauuguugagguugaauaucuuuguuuauguuaauugguuauucagguuuccuauaagauaccucuucauugcuuuucaaaccacuuuaaaauuagcaggaagcccugaagaaacugaagagguuguuuguaugcauaaagauauguaaguguuuauguauuaagaaaauaacaaguucuagaaauguccgucagugcagggagacuuggcccuuguaaucaugccaucagagcagggagcacagugcccggcaugagaaauccgacauccuccucuuuagccaccacuggggucgagcuaugccucgagcucaucggcuuuccuuaucugaggcugggggaaaacgugaggagacaaaggagagaaaggaaagggagccaccaucuaucucucagcacugugagucaggcacugggcagggcaucuuuauauaccugcuuuauuuuuccuucaagcagccauaagauagguauuuccuucauuuuacaggaggaggagucugaggcacugugggauuaagugacuuguccaaggucauaugaucaguggccgaacucucugaacccaggugucugacuccaagcccaucccauuuuugcccugccaggaaaaaguagaaaggaggaaugagaggagagaaggaaacagggagagagaggaaagagaacauccuuuaugaugagucgccaguaaucacagcugugacaugaguucacuaugcuaauaaucuaaauuuuccuuccccauaguauauacauccugcagaugcugugaagcugggccaggcugaacuaguugugauugaugaagcugccgccaucccccuccccuuggugaagagccuacuuggccccuaccuuguuuucauggcauccaccaucaauggguaagguacugugggcaggaguccuuacucccguggcaggcucuugcagauuuaggggcauguaguggauguggccugggccuggacagccaagucugauucucagagucucugaguguuugaggcugcuucauucucuacugggcuucugcaaauggaaacuggucucuuaaugaacuguuacacgucucuggcccgacaugaaaugggcaguguaagacugaagaauuuuagucugaugugcugagugucugcuucugucuguaggugugauaaaauguugaaaaauacauggauggugauaccaauaucuuauaucuuagaaaauacaguauuaaaguacuauaauuaucauaagaaagcaagcucauaaugacuuuuuuuaaaauuugaaauauuuaauuuuuuaauuagaaauauuuaguguuggcuauugaaaaauuagaacagguaagcaaaagaaaaaucaccuguagccaggugcaguggcucacaccuguaaucccagcacauugggaggccgaggcaggcggaucacaaggucaggaguucgagaccagccugaccaacaugguaaaaccccaucuuuacuaaaaauacaaaaauuagcugggucugguggcgcgugccuguaaucccagcuacucuggaggcugaggcaggaaaauugcuuaaacccaggagguggaggcugcagugagccgagauugcaccacugcucuccagucugggcgacagagcgagacugucucaaaaacaaaacaaaaaaaaaaaaaaaagaaaaaucaccuguaauucaaccaucuggagauagauuuuguuagaauuuugauguacauuuucucugcauuuauuuuacuuuuuucauuugaacaagaaaaacauuuuuaauuugcauuuugaauauaacaauauugugaaaucuuuugaggucaguaaauauguaucuccaauauugggaagauuucuguauagaaaucacaucuugaagagauuauucuguaugcagauuuauugugacugcuuugcuuacacugaaaauacugaaauaaaauggauuuuuacuuuucaaacagcuuuauugagauauaacucacauacuguacuaucuauccauuuaaaauguguaauuuaaugguuuuuaguauguucacagaguugugcaaccgugcucaccacaaccaauuuuagaacauuuuuaucaccccauaaagaaagccugugcauccuccuccaguuccuccacaccccccaacccuagggagucacuaaucuacuuucuguacccauagauuugccuauuuuggacauuucauauaaauggaauuauaaaauauguggucuuccaugacugacuuguagcauguaucaguauuucauuccuuuuuaugguugaauaguauucuauuguauagauauaccacauuuuauuuuuccauuuaucuguugguggacauuuggguuauuucucccucuuggauauuauuaauaaucuugcuuugaacauuagcgugcagauuuuugcguggacauguuuuucaguucucuuagggauacaccuaggagugaaacuauugggcuaacucuauguuagaccaugcgaggagcugccagacucuuccaaagcaauugcacauucuacguucccaccagcaguaugaggguucugacuuuucuguauccucucacacacuuauuauguaucuuugugguuauaaccauucuaauaggugugaagugaccucucguuauaauucucauuugcauuuccuggugacuaaugauauuagcaucuuuacaugugcguauuggccacucacguauguucuuuggagaaauguguauucguauccucuguucaucucuccaauuggguugucuuuuuuauuaaugauuuguaaggguucuuuauauauucuugauaccaggucccuuuucagauaugauuuacaaaaauuuucucacauucuauggguuuuuucacuuucuucuucuucuucuuuuuuuuuuuuuuuuuuuuuuuuuugagacagacucugacucugucgccaaggcuggagugcagugguguaaucuuggcucacugcaaccuucaccucccagguucaacccauuucuccugccucagccucuugaguagcugggauuacagguguguaccaccaugccuggcuaacuuuuguauuuuuaguggagacgggguuucaccauguuugucaggcuggucucaaacuccugaccucaggugaucuacccgccucggccucccaaagugcugggauuauagguaugagccaccaugcccggccacuuucuuuauaauaaugucuuuuaacgacaaaaguuuugaaguuuuguugcuugugcuuacucuuuuuucuuaaauaaauaaauaggauacuuuugggagagcuuuguuaugugguguggagagugggcauaaaacaucuagcuuuuaucauuauuugaguaagaggaaguauuuuacagucuuugaauauaauaaugaguacuaugaaaugauguaaugaaaagugcuguguguacccuguggugacauaugccugugacuaaagacaaggagaagaaaacucaacaaugaaagcugauugaguuaucagauuauaggugauuuaauuuuuuucucaacauuuuuuagcuauuuuaugucaccuuauaagugggcauagcaaugaaaagaauuacugaggugguggauuuguuuuauuuuccaaacuggaaauguucucaguucauuuccuuaugcaccguacuucuaaaagcagcuccguuaguugaccauuuaacuuuguuccagcuucacuaaaacugccuaaagccuuuaugcuaaaggcuuuacuuacauccuuuuuccaguccuuauuuuuuaaguucacaucacaguccugugagguguauagaauaauccccucuugaagaugaggcgaaaagagauucagcuccuugcccaaagauacuaaguagaugagccaggacgugagcccaggccuggguggccccaagcucagccaccgugccacccugccuccuuuggacaggugccugcuaugcuggaaguucagagaugagcaaggcuguccugggggaagcaggggucugguguuucagcagguggaggaaagcagcucucuguccccuccuagacaguggauuugggaccuugugccugauuccuuuugccuuuguuucuagcuaugagggcacuggccggucacugucccucaagcuaauucagcagcuccgucaacagagcgcccagagccaggucagcaccacugcugagaauaagaccacgacgacagccagauuggcaucagguaccccagaaccugacccgggucccgcgguucacagcaaggcccuucagucuuacugauccucgcuuccccugugacaucaugggaagcaccaaaccuucccaccaucaggcugagagguugaguccccaagaggagaaguagcuuuuuucggaggaacagcaguccagugaccagaugggagccagacuagggccuucugaugguggggcccuuguguguccuugucucagggcaugguugcauugagaucccuuugggguugguaucguggcaaguugaauauccaccaaaaacaauuuuaaaccacccaguuuaaauucuuaccacacgucucuggccaccaugggacaaauauaaagugaaacauuuuuccuugcuuuuuuagacaauacauauuuaaucauuguuucuucuuuugugugugugauuguggggagcagcgcggacacuguaugagguuucccuccaggagucaauccgauacgccccuggggaugcaguggagaaguggcugaaugacuugcugugccuggauugccucaacaucacucggauagucucaggcugccccuugccugaagcuugugaacuguauccuccucuggguuucacuggcccugugaaaaggagaggggcggugaaagaauucaaaggacuugaguccuuuguuucauaggaugcugcucuagagaaaggggaaaguugaacauuuucaauuuccuuuuucucuuccuuuuuuuuuuuucuuucuuuuuuuuuuuuuugagauggagucucgcucugucaccaggcuagagugcaguggcacaaucucagcucacugcaaccucugccucccggguucaagugauucuccugccucagccucuugaguagcugggauuacaggugccagccaccacgucuggcuaauuuuuguauuuuuaguagagacaggguuucaccauguuggucaggcuggucucaaacuccugaccuugugaucugccugccucagccucccaaagugcugggauuaccggugugagccaacgcgccuggcccucuucuuccuucuuuuauguguuucugcuuaggacacugagcuccuguucccagcuacggaaauuuguucugccuccagagaguaguaugaccugucuucggcuauuuguuuuguuuugguuucuuaacuccagacccagguacuauguuaauagagauacccucuuuugcuaccacaaggccucugaaguuuuccuccaacggcuuauggcccucuacguggcuucucacuacaagguaacugcagcuagcccuugugugaaugguagcagggagcuucagcauuuggcaguccccuuuuacuugauuugcauauuuuauuacccaauggcuuaggugacuguuccauugggacauugaugaguuccacugaucuugcuguguguagguauagagcauguagcuccaugcaguaacgggacaggguggaaagcuguguccauuuuuaaaggagugcuuucauuucuugccugccuacuaaacugauaggaugaggugacauugcaguuguggcccgguggugcaguuugaccugagaccagcuuuauagcucugggcuacuuuuauggaacagugaauuugaggguuuagaauaucugagacucuuaaaaacaaaaggguugguuaaaaaggauacuuuuugaaugucuagauaguauuuuuaugaacagcuuuuaauggaaggcuugaagaguugguguuagaaguggugacaguuuuuccugaaauagcagccucuuaucuguaaaaaguucacuuccuagcugugaaauaaguagugcuaaauaaauucucuucuucuguccagccucagugcucggggugagaggacaguaggcauuugaggcuaaguuccacuuaaccuguuaugaagagucucaggcuugccaaaauacuagaaaggugcuuugcuggacuucugcuccucacuuggcuuuggagaaggccauacugcagucauccugugguucugaaucgaaccuuuugcguaaagggcaagaggaagagugcuucucacugacccguguuuggcuuccacagaacucucccaaugaucuccagaugcucuccgaugcaccugcucaccaucucuucugccuucugccucccgugccccccacccagaaugcccuuccagaagugcuugcuguuauccagguauaggagcagaggcguccuuguggcagugauuuggggaaccacugaggcaucaggaauuaguggcuuaauaacugcauugugggaguuuugaaacuguggaguccuggucuggaaccaaggggcugggucugcugagacaggugacuagggugcacuggaagagguuagcgccacuagacacccaaagcuccacuguugacggacggggaaaagccagaaccgaccgcucucuuauuuugacucacagcuucuuccacaaacagacuuguuuguuuucucccuuuauuacaaaagcaauacauggugcauuuugaauuagaggcuacagauuggggaacaaauuuuuaaugccuagcauggauguauuuaugcauuucuauaucacuuuuccuuuucauauacauaguaaucugcuuuuauuuuuaggcaguguauaaaacacucauaaucuacauaaguuuuaaagcuguguaguauuucauuauauacauguaccaugauuuguucaaccauucaccuguuagacauuuuaguuauuuugaacuugugcuguucuguacagagccucaugagcauccugugucuugauggccuucacacacgcacagcauacauagagacucucuucuaauguggcuuuuacuuuuugggucaggaggcugucagucuucugcccuguaacauggggccugguaauuaagcuccuguuaagaauggaugugucaggccaggcgccauggcucacgccuguaaucccagcacuuugggaggccgaggcgggcggaucacaaggucagaagaucaagaccauccuggcuaacacggugaaaccccuucucuacuaaaaaaaaaaaaaaaaauacaaaaaauaagccggguguggugguaggcaccuguagucccagcuacucgggaggcugaggcaggaaaauggcaugaacccaggaggcagagcuugcagugagccgagauagcaccacugcacuccagccugggcgacagagugagacuccaucucaaaagagcggggggaauggaugugucagugucaggguuaaaccugaacauggggguggaaacaacuggccuaguucgagaaacaagcuauauucugugagugggcucuguaucagaguuggccuuucugccugcacuguccugcuucccccacaggugugccuugaaggggagauuucucgccaguccaucuugaacagucugucucgaggcaagaaggcuucaggggaccugauuccauggacagugucagaacaggugacgggcuuucccuggugugucugagggaagcuggugguguccaaagaugucuguguugcuaaguuacugguuugugucucccacacaguuccaagauccagacuuugguggucugucugguggaagggucguucgcauugcuguucacccagauuaucaagggguaauguguccucaggcuccccugaagccguguugcuggcggugcuuuaggguggggguacuugguggcuggaauaagaagcuggucaagcagaagcaagugaaguguaggcacuucccugcucuggagaauugagccaggguucgggguggguggguggacaggaugauggcauaugcucacucuuccuuugugagaacgaggacuugugaaccagaccugcauaacaaaauuaccuucuuagaacaccucacugaguaauuggcuguagaaacuuccuuuucaggcaaugguacagaaacugccucucauuugggcuugcccaucuggagaccagaaagcacagccauccuuacccucaaguggcuguucuugaugagcuagaccaguguuaagaacucgggucacacuacuuucagucuuaagugucucugcuuugaccucacucaggguuuucauugguucucuugccccgugcuguuugacagggagggaagguucucuagaagcaaugcaggggagucacuguggcuuagacugagagcagcucucuucccucggccucuuccccuucacguuugcuccuagaugggcuauggcagccgugcucugcagcugcugcagauguacuaugaaggcagguuuccuugucuggaggaaaagguccuugagacaccacaggaaauucacaccguaagcagcgagguaagcaucuuucgacagaccuccuguguccugguucuugggaggauaauucucuggguuuuuaggggcaucaacaaaaaccaguccagagcuuuggaccccucucucauuuucuucugcugcuuucuccuaccgaacacuuuagauccucagaucaguaucauugggaucaucuggcagcuuguuaaaaauguaaauucuugagccccacuccagaccuacugaaucagaaacucugggguagacccuguaaucuguaguuuaacaagauucucaggugauucugaugcucauucaaguuugagaaucacugcucuauaaucucuuucauccuacaccagacuaagggaaguucugucauuccuugauaagaaugacuaauacuaguaacugugacagccuuucaugugcauucauugauuuucauaguauguauauuugagagcuagacaaggggcuuuuauuuaaguugaggcagcugggcaacauggcgaaacuccaucucuacaaaaaauacaaaaauuagccgagcaugguggugcacgccuguagucccagcuacuugggaugcugaggugggaagauugcuugaaccccaagguugaggcugcagugagcugugaucucgccacuggacucuggccugggugacagagccagacccugucucaagcaaugaaaaaaaaaguucaagcucagagguuugucacuuccuaaggcugucaggugauagaaccuggacuucaugcuggaucacaggagccugccugucccuuuguaaaucuguugggcauuuuuuuuuuuuuuugagauggagucuugcucugucucccaggcuggaguguaauggcgugaucucagcucacugcaaccucugccucccagguucaagcaauuuuccugccucagccaccugaguagcugggacuacaagcacacaccaccgugccuagcuaauuuuuguauuuccaguagcgaugggguuuugccauguuggcuaggcuggucucaaacuccugaccucaggugauccacccgccucagucucccaaagugcugggauuacaggcaugagccaccacucccggccucugucagucguuucuaaacucuuuggcugucuuccugcauucuagaggucugaagcagugugauucuaugcauguugagguguuuugagaaugauugcuugacuccgguguucucauaguuugaaaaccacagcaauaaaccaagaaaccucucccaguuuuuguugugcuaaguccagagugcgcugcggcagggugcuugacgaugucucucucccucugcugaauggacuguguucucuccuuggcaucuucccaggcugucagcuuguuggaagaggucaucacuccccggaaggaccugccuccuuuacuccucaaauugaaugagaggccugccgaacgccuggauuaccuggguguuuccuauggcuugacccccaggcuccucaaguaagugccugcccuccuuccacggcaucacuccuuggcauugagaaagaagaguucugugggcugugugucucuguugguagcugguaucggugcuagccugcuauuuguggcgugcucuuccuggcucuugcccuugugugucuaucagccacuccccagaggccacacacagugaccuacugucuuuguaucuuugcagguucuggaaacgagcuggauuuguuccuguuuaucugagacagaccccggugagugaggcauccagcagaggagaaguuuagguuuaccguuaugguaggugacaggccuguccuugcaaagagcccuagugccucccugcugcaucgcucugagcagguggcugugccucugaagagguuuauucugauggacauggaaacagccauccucagugacaggccacaucaucacacauuucuucuccgacuacacggugcaugcguugagcuuagucauaaaauggcagagguacacguggacuuguucaucagauucugggaaaggagaguggacaggaggaucaaggguaauuccuagaguuuuggcuugagaaacuggguguuggaggugcugucggagaugggacucacugcaggaggagcagauuuggagggaagagugggaguucuuuuuugauguuaauaugagaugccuauuggacauccaaguggaaauguggacuaggcauucauuugacuacaggaauuuggagguagggaaguuuggggcuagagauggagcuuugggagccaucagcauauucauaauagaaugcacugcaggagggcacggagcucuugucuguuguguucauugcuguauuccucgcacuuagaguagcaauugcuguguaguuuguguucaguaaauacuuuuguugagugaaugaaaaauaucuggagccaaugaaaggaugugagagugacuccuuggacccuaacguuuagaggaaugaagaggaggacacagcacauacaagacugagaaggaacagcccugaugcgcaagagaaagucggguguggugucacacgucaaggugaaaaagugggaaugggagucagcccuguugagaggaugaggaggaugaggacagcuggccauuggauuugucagcagcggugagcugcauugaagcagcugcaguggaguggaggcuuuggccuggccagagggaagaggaggugaagaacuagaaggggaacaggcgacucuuucaggaagcgaaagggagcagagaaacaaggucgcuggagggagaugggcgcuaaagaaggauuguccgaugggagauucuagagaauguuuuuugcugcuggguucgauccugcaauuagugguaugggugaggggggcugacugccagagugcaggccuugaggagguggugggugggacucgagauucaggaagagaggugaccaccuacuucauccuucggaacagggaaggcagagagcgugggaauggaaggcaucaguuggcuggcugaucugggguugggaggaugaagacauugucuucugagugcuucugucuucccagaugaggggaguccaucggcugagagggaaguguuggagguuugauuuuggagagggcaaagucaguaucagaggcuaguguccaguguccguccgaggguuuaaagugggacuggugaggacugcuggguguugggcugcuuccgugcaggcagggagcugcagagauggguugagucucugucaguacauuugguggaggcugaggauguaaguuuggcugucagcugcaaggagaacgcaagcuagugagcugugguguggucugcgguguguccguguggucuugcacugugcacuguucauuugugacuuggugguguuuuuaugguguggggcuuuguuguuauggaguaaaaaauguaaaaauagucacaauuuuaacaccuaaagaagccugcacuugcagacuggcugccagcacugagguguagguuuuggcccuggaguuccugcugugaggcaucaaacccauguugacuggauuguguggcgcuuaagcccuaaugacugaguucagcaucuaccugagaggagcacauauuucccucccgcacgucccgagcaagaggcaggcccagaagagccagcagcucuucucugugucugugacacuuuugaggagauugcaggacagugaucuuugcagcuguugugugugaacugaggugauaugaggaaggugaaggcgagggcuguuugagaagggcgccuacccccagccuggaaagaaggagaggccugcggaagcacuaagccuuucuucucugaguguuuacccuucaucaaugauggguuauucaaaaaaaggggguucuuggugccaguuaaaccucuguguugcccagaaugaccugaccggagagcacucgugcaucaugcugaagacgcucacugaugaggaugaggcugaccagggaggcuggcuugcagccuucuggaaaggugacugaggaguagggguuugggggagacaaugaggugauugggggcugccggggaugccuccagaccucuaacucugcgugauggcaccccacagauuuccgacggcgguuccuagccuugcucuccuaccaguucaguaccuucucuccuucccuggcucugaacaucauucagaacaggaacauggggaagccagcccagccuggugagccggguggggacagggaggaggguugggaauggcuuggcugugugggaggugggugugguguccuaggaaggguuugggcuggaaauugagggacugguucuagccugcagucacucgcuggucaccacccgcuugccaggccccugcucugucccaggcugugcugucuuucauuuucaugguaagacucuggcugugcaauuuaaugucagagguguccauuuaguucauguagcugguugguuauggaggccgauuuacaucugugcucuaggggagugaggugcuccaucucugagguuuaguuuccugauucaugaaauuguaauaagaauaugcugcuagccuucuguagccaacagcacacagaagugcuuugugcauacagauuguuugaauacuuaaaaaacaaaaaauguguaagagauuaguuuuauugcauauuuuauauauaaauauuuagguauagcaugcauauauguguauauguguguguauauacuuuuuugccaauuauauuuugauggagaaauccguauaucuugagcugggcagagcuuacacacuuucugugacaccaaaugaagugacaaagcagggaaagaguguaguuguguuccccuaacccugggccacagggagcuuuuccuugguccauguguucaguaugggaacugagcaaggguccuguggcagccguccccuccccacacguggccuggagccgccccuucuauggcaggagcagguuuggugccccucugggccagggcugugugguauggcugccaggcccuguuagaugcuccuguguguuagggugccgccugggggcugugugcuaucucaugagggcgccgggugaccuaaccugucuagcucucuaucccauggacagcccugagccgggaggagcuggaagcacucuuccuccccuaugaccugaagcggcuggagauguauucacggaauaugguggacuaucaccucaucauggacaugaucccggccaucucucgcaucuauuuccugaaccagcugggggaccuggcccugucugcggcucagucgguaugcuaucuguugcuugcguggaggagaagcgaggauuguggagcuguucauuugcuggguguuggguugggcacuuggacauaauugugugccuuuaauuccucauacaucugauagguggguaguggcauccucauucuacaggucaggaaaccugggcucugaagucgaguaauguguccagccauacaaagugagagagcugcagcuuccaccccacuacguugccuugacacuuaacuccaccuuagcagagguucaggaacaucccaaacuuuuaauguaguugugaagcagguauuugucaggauaaaaguuacuuuggggauuuuaggaagacagcauuucuugguggucucaguaacaggaugaaagagaagaugccaauauacacagugcuagucuaccuuuguaccaauagcuuuggucaagagaguacucugguucuuggcgccauuuuaaugggcaagggcguguccuagaggcccacccagcagauuuuccauccuuuaggcucuucucuuggggauuggccugcagcauaagucuguggaccagcuggaaaaggagauugagcugcccucgggccaguugaugggacuuuucaaccggaucauccgcaaaguugugaagguaaccucagccugagggcaggggcuugaugucucucaaauagugcaacaaacccacucccugcucccgagaugaacacauguuagcauuuagcuguguuugcugcaucucgucacacacacacacacacacacacacaaauccaggacuucagaacacauguuagcauuuagcuguguuugcugcaucucaucacacaucacacacacacacacacacacacacacacacacacacacacacgugcgcgcgcaaauacaggacuucagcucuaaagaaucugugaaguucuguguccucucccagaggcaucccuauuaggaauuugguacauauccagucuguguucuucagcucuucccgcuaauauccacauuccuaaacuguagaguguugcuuugugucuucaaaaugcacaccuuucuauaagacaccaagugucugggucacgggugacugggucccugcugcuccuucaucuucugcuucucuguugguugucuuuuguagcuauuuaaugaaguucaggaaaaggccauugaggagcagaugguggcagcgaaggauguggucauggagcccacgaugaagacccucagugacgaccuaguaugucccugcucauggccucgggagucccagcauuuccaucaguugccuuaggcugugaauucagacugucuuccccuuccccuuuagaaagaguccucugcacuaauugagcuaagugcuauucuguagguuuaauuggacaaacggacccagcauugucugagcacacacaggccuagaguugugccucccacugauuguguguguguguugugaauguaggauuccagcaucuguuggaaauguuuugucuuuuuuggugacuucuuaaaugcauaguuuauaacagagcuaccuuaaaauaaucaaagcugccuacaagguuuuugcagguagauggaagagaaggaaauguuuucucaucauugugccauuccaccccagcuucaccuuuuccuguguuugguucaauccuugacucugacuuagucucuuuauggguccuuaaccacaggaugaagcagcaaaggaauuucaggagaaacacaagaaggaaguagggaagcugaagagcauggaccucucugaguaaggcuugugggaagcagaggguuugccuuggcuucuggggcccuaagaaucugccuacacguuucuucuaaucauaucccacgugcccuggaaagugucuuucaugggaucaguuuuagggaugcuaacaguucuauuugaccuucuaauugccuguuuguauaauuuuggaagaguuggguuccggagacuagugccgccacuuugacuuacacauugcacucucugauccccaaggcuccaggucacaccucggguccuuccaggagugggggugccgauuggaugagcaggcccuuuaaugguuacuuacucuauuuggcuuuuacgugugacuuuguuugaagaaaggauucuacugcuaaaaccaaccaaacaagcaaaacaccccuugcucuaaaaccgucugggaauccuagucccuuuugugcuucagcuguaguggugcugccucucccuccacugccuggauugaugugaauaauaacuccagaauucauggccucugagccucugugaccuguaguccuguuucugggucauuagugaugguggcugcuggguaugugagguggagguggccaggaguccuuggacagagaaucgagcucuaguuuuugcccucagcuuugcaauaucaaaaccuugauuugccaggacugcuaaaucugaaagagaagggagggaggggagaggcacaguucaagggcuuguggacaaaugcuuggaggugggagugagugagaagauugugggggugacaggaagcuucuuugguggauguuaaugagagucaugugggaagagccaggcaggcugccuucugugcaggacuguccucacugaccccugccagcaggccuggugacccucgcuccuguggagcuucuauccauagagcuaagcaccaugucucuuggcccuccugcaugcuuguccccucuguccuuucugcuguucaaaugcugacacagcucagccuggcuuucaugacaggaagugucugauaagaauguugucacugucguuauuuucucuuaagcaguccccucuucuuucuagcaggcuuugauaguucccuucuuuuuuuuagauacauaauccguggggacgaugaagaguggaaugaaguuuugaacaaagcugggccgaacgccucgaucaucagccugaaaaggugagggcccagggucugaugugcaucuggcggaagaggcauucuggccucucugcuucucuuuaacuuugacuagaaaauaggagguuggagcaaaagcuuugacagaaaagucaugguucuucccuuugagaguccccuggccauuacccuugcagugcaugucccacagaccaggagggccaucucuuaggcauggaucucuucacucuuuguauuugucagccaugccagggcacugggccugucauggagaagggcuugagggaacaguccagaagcugccacuggcugagacuugcuuaugggcuuucaucauucagcccucaggaugacagcauaagggggcuguuuuauuacugucauugcuuuaagaugaaguaacaaggcucucagggguuaaguucccaagaagcacacagcuagugagagccggagccagaaucaaguccagguuucuccacugcaaggccauagguuuaacuguuacguuguccuuccuuugagccagcaguucucaagguuuugggucuuugaguuccuuuaucucuuaacaauuaagguccccaaaggacuuuuguugguuauaucuauggaaauuucccauauuagaaaugaaaaacuggccaggugcaguggcucacgccuguaaucucagcacuuugggaggccgagguaggaggaucgcuugagcccagguguucaagaccaaccugcgcaacauagcagacccugucucugcaaaaaaauuuuaaaaagaaaauaaaugaaaaacugagaaauuuaaaaaaaauucauuuguucacaguaauaacggacucagucguuuugaaaaauacucuuuuucauaaaaauuuuggugagaagaguggcauuguuuuacauuuacauuuuugcaaaucucuucaauaucuggcuuaacagaaggcagccggauacuaaugucugugucuucacugacacuauuuugcugucauaucuuauacucucuggaaaacugaauauuugugagagaaugaaaaugaaaaaaggcaaauaacuguuuucauacuaauccaaauacauuuugaccuuguggacaccugaaagggucuuagggaccccagcagucccuagaccacucuuugaaaaucuucacuccaagcuucuuaucugcagaguggugcauuuguaaauaacuuaggcuggaaccuucaucaguuuucccugggaguacaaugaggccuccccugcccagagccacuggaauugaggcuuucacagcugauuuggggguugauggggagggugagauuuuggcaauccccuauuuauugguuuccuuaaaagcuuauauuuuggaaacauucgggaagaggaaaccuugugucucuaggaacuauagaucccagaaaucagguacugucuuccagagucuccguuagucacuguggcaucuugaaggauccagcaucgaugccggccucauuucccagaugcuuuguggugcagcacagaagcccacugucagugugaccugucucuguuuuguacaguauggcaaauguagcacagggcccaugauggcuuuggccuugagcacgguggcuuugacuggaacaaaaggccggggagcaugcuugcuguggagacggccucagcuccucacucugcagagcuuggccuuuccugccauuuguuuggccauugcugguagugagaagccucucgagcccaacaaaccaguguugugugguuguucaugugcuugauggcucugaguaaaugugaaagcuugaacuuugugagcuaaaaauacugguagcuaucauuaaguccucugaggccuuucuuuuucuuccuuugagagguacuucauucauaugauguuaauggucucuggacugaacucuucacggucuccuuauagggaaguauuuguucccagagcaaaauuuaaccuguaaguuucuuaauggcagguggccguuugcugagugauuccuaugccaggauaucaaugaagaauccaggggcuggucgcagggugucaccugaguuacuguuguuuggguuuucuucuucucauauaggaaaaauaaaauaauaguagcacaucagaaaguauggcaggguuuuccuuggagucucaugccuuguauuaaggacugucuucagggucauugggaugaauaugucuaguuuccagagucacugcaguggugagaguggugguggggaauccuuguggugccuuaggucugucuugggagaggggagcagaguguacugcacccugaggagaacccggauuucagguguuaagaucgagauuuguucuuccacagacuaagagcuggcucagggcaggagcuggucuguaugguguguccccagccccagcacaaugccugcccccuaauagguuugcagagaacauuaauguccaauuggguggccuacaucaaguuucagacgguggaaacccuuuuugacaaagcaaagcaagcuuaaagcagucucagauguucagaucuguacauauuucauucuuucuauuuuugauuuuucucuagugacaagaaaaggaaguuagaggccaaacaagaacccaaacagagcaagaaguugaagaacagagagacaaagaacaaaaaagauaugaaacugaagcggaagaaauagugaagagaaacucgggcaucuguguuugaucaugggaagauacucucacuaacugaacccucucuggcuggacuguuaaaagcaacgagaggccccggcacaccuggaagcuggccgcgaauucggccucugggccugugugucugugagcucaaccuggcuaaaggcagagucacucccaaaugggucucuuuagaacuugauggcugggcacugccaucucuagaauugccacgagucucucucuuccugcccaguccagggcccuccuuuccuauaaguucauauuuugcuuugagccagcuuuuuagucucauucccacacauguggaagccacguugccucucgaccgccugaggcccuuaaguacaucgcuuucugguggugcccaggaggcugcugcugggccgcugggucucucuuuguggacuuguaccuggagcaggaggaacuccaguccgucccggcauccauggcagcccgcgguuaggugcgccaggguuugcugauguugucuugugcuguuccacucuuggcuccagcagacccacugucccagaaaagccugauccuguaguuuauguagaaugccacaucugcguccucaagaccuguuucauccauuugggaaaagauguugggaaaggccacuuugcucgcaggggugaggggaaggauagagaaucuauuuuuaauaaauaacauucuagaaagauca

SEQ ID NO: 13302 - RNA, 1098 nt, Homo sapiens
aguauucuucuacuugccuacucaucaacucuacacaccuguaaaaaguaaaaaacccuucaggaaaaaaaucaauuucaauaaaaaaacacugcaaguaaauaguucugugcaaaaagcauuuccucccuaaccccauggauuaauccauuuuaacaggguuguuaaugaagcuacagauauuucuauguaaugauuuggccaaacuaccaaguacuuauucagcauauaccaugugugagaaagcgcagcaaaguaauguuaauagucucugcccacaaagagcuuauuaccaauuuagaaaaacauguaagguuaacaacacaaggcaauauaaaaaugucaagaaguuuuggacgccgaggcaggcagaucacaaggucaggaguucaagaccagcauggccaacauggcgaaaccccgucucuacuaaaaauacaaaaaauuagccaggugugguggcaugcaccuguagucccagcuacucaggaggcugaggcaagagaaucacuugaacccaggaggcggagguugcagugagccaagaccacaccauugcacuccagccugggcgacacagcaagacuccgucucaaaaaaaaaaaaaaaacaaugucaagaaguguacagacaauagguaacaggggaaguuaaaggaaacaaacuacuuuagcugagcauggucaagaagcacacccuccccuuuccucaggaaguuugaauuuugaacucuacucaguaaauuaucuuucacccacguuuuuguacucauagucuaucuaacaaaagcacuguaguagagcuagugaaagaaagaaauaaaugagcuaaaacaaagcaauuuacaguuccaacuuuggaugaauuucucuucugcuacuccucucacucuucuauacuguauacacacacaccauucauuucccccagaaaaaggaaccaacuaccaaaaaauacccagaagcuuggaauacaguaauuuggaugaaaagguugucacacuucuuauuucucucuacugguaaugcuuuuuccagauuuuuccggucuacaacauaccaagcuggaguagagucugacaaauguacauaggaagcu

SEQ ID NO: 13303 - RNA, 1098 nt, Homo sapiens
agcuuccuauguacauuugucagacucuacuccagcuugguauguuguagaccggaaaaaucuggaaaaagcauuaccaguagagagaaauaagaagugugacaaccuuuucauccaaauuacuguauuccaagcuucuggguauuuuuugguaguugguuccuuuuucugggggaaaugaaugguguguguguauacaguauagaagagugagaggaguagcagaagagaaauucauccaaaguuggaacuguaaauugcuuuguuuuagcucauuuauuucuuucuuucacuagcucuacuacagugcuuuuguuagauagacuaugaguacaaaaacgugggugaaagauaauuuacugaguagaguucaaaauucaaacuuccugaggaaaggggagggugugcuucuugaccaugcucagcuaaaguaguuuguuuccuuuaacuuccccuguuaccuauugucuguacacuucuugacauuguuuuuuuuuuuuuuuugagacggagucuugcugugucgcccaggcuggagugcaaugguguggucuuggcucacugcaaccuccgccuccuggguucaagugauucucuugccucagccuccugaguagcugggacuacaggugcaugccaccacaccuggcuaauuuuuuguauuuuuaguagagacgggguuucgccauguuggccaugcuggucuugaacuccugaccuugugaucugccugccucggcguccaaaacuucuugacauuuuuauauugccuuguguuguuaaccuuacauguuuuucuaaauugguaauaagcucuuugugggcagagacuauuaacauuacuuugcugcgcuuucucacacaugguauaugcugaauaaguacuugguaguuuggccaaaucauuacauagaaauaucuguagcuucauuaacaacccuguuaaaauggauuaauccaugggguuagggaggaaaugcuuuuugcacagaacuauuuacuugcaguguuuuuuuauugaaauugauuuuuuuccugaaggguuuuuuacuuuuuacagguguguagaguugaugaguaggcaaguagaagaauacu

SEQ ID NO: 13304 - RNA, 9735 nt, Homo sapiens
uuuaggcagucauauauguauuuauauauacacacauacaauguauauaugaaauccuuauacagguguaaacauucuuaauaaauuauaagcaauaaaauaaaaaaaauuuaguauguuugcuuuuuaaaauaaaacaaauucauacuuuaucaaaauuuguucauucuucucacaaauaauucuguugguacauaauuuucucucaugcuaauucaacaaacccugagcuuuguuucuccaucuauggcuaaauacauaucacucuaaccaaauaaaaagguuuaaaauaagggcccugcaucuuggugucugguuauuugaaauccgguuuucauuuugaauaguuuugguuaaguguaugucauggcagaaugucccuucaucuccuuugaucuguguuaaauugauaaaaauacaugcuuacuccuguacaaacaucgaacaauguaauuaaaucaucacuacuugaaauacuuuuacaugaauaauuuaucucuuuacacuguugaagccuugcauuucaguauguucuacagcuucuguaucaucaccugaaauuugccuaaaaaaaaaaauacaaauaauucuuugauuuuagauacaaagaaaacaagucuaaacaucaauuuucuguuccauauaggaaauaguuucagucaagaaaucugcuaugucaaaaacuuuuucgcauucuucauaauauucaauaaagucaauucuauuuuuucuuuuuuuuugagauggagucuugcucuguugcccaggcuggagugcaguggcacgaucucugcucacugcaaccuccaccuccuggguucaagugauucuccugccucagccuccugaguagcugggacuacaggcgucugucaccacgcccagcuaauuuuuguauuuuuaguagagacaggguuucaccuuauuggccaggcuggucucaaacuccugaccucaugauacgcccaccucggccucccaaagugcugagcuuacaggugugaggcaccacacccggccagucaauucuauuuuuaugggaugauuauaugguuuguugaguaagcacuuuuguuucucuuuaugaauccuacauuuggguacaguauuucauggcuaaugaucauuguaaauugaaaagaaauacaauaaagcucaaguccauuuuuucuugguugguagcucuggugaaaagaucuuuagggagacauuuagugauaaaagaauauuugguuuuacuuagcuugauauaauagacauauccuaaacaauuguuuaaaaauagcauuuucgggccgggcgcggugguucaugccuguaaucccagcacuuugggaggccgaggcagacggaucacaaggucaggagauggagaccauccuggcuaacacggugaaacccaucucuacuaaaaauacaaaaaauuagcugggcgugguggcaggcaacuguagucccagcuacucgggagguugaggcaggagaauggcgugaacccgggagguggagcuugcagugagccgagauugugccacugcacuccagccugggcaacagagcgagacuccgucucaaaaaaaaaaaaaaaaaaaaaaaauagcauuuucaauguucuagggaaauuugcuaucuuaaaacacugcaggagauauucagaagaauaucuuuaaaaaaguuacaguuugaauaacuuuagaaaaguuaaaaaucaucccuuaaauugucuuauaaauuuggauuuuaguccauuauucaaaaauuacugaaaaugaauguaguaugcuacauauuacuacacuaaaguguuacauugauaaaacuaaaaugaaaguuucagcauuuuaaauuuccucucaguuaaauuaaaaaaaaaaacagaccugaaaacaaauuacuaaaacauuuguaagaaaggcgaauucaacuuacaagcaggcauugaagacacuucagcuguuacaauacuuuuuauucccaaguuugauaagccaccucugauuaagccacacguaaaugcuaaauacuaaaaggaaaaaaaaucauuaaaaauaguaaggauuuacuaaaauaguaaagcuauugauaaauacaacauuacaugauuuaucaucaguaagucauuccuguuuaaaaaaaggauuuugaagaacuguucaaauuacugaaaaauauugauauauuucccagcucccuggaaacuaaagcauggacguaggacuuaagacuuaagcucagccaauuaaguacuccaguccaggacugugaaucuagacucagugacaaaaacaagccagaaacugaucagaauuaguucuggaggcaguaaagguaguuugugucuacagucccugcugccugcaggauucuaaguagauacagucugcagagugacuuggcuaucuuacuggcugccuuaaccuccccugguuauugccuauucuuugagcuuaucaauuuuguuagcuuacaagcagaauuucuuuccccuauuuacaaccaagaaucuugacuuguucaagacuuauagcuugccacaacaaagaauuaucugguugaaaguaucaacaguuuggacguugagaaacccugucauauagaaacaaagaaagggaauagggcugagcuacaaaaccaaaagucaugacaagaacuggauugaaaaauuagcaauucagggaauuuuugauuacccacaucuauacugcaugauguucaacauacuacauuaucuacgaauaauauaaaauauuaucuuauaaauaauauacauaaaugggcacuaauaaguaacuagaucugagucaugaaauuuuaagcuggaagaggccuuagagauuguucaucccaagaguucuuaaucggggaauuugugaccccuaugaaaauaaaaaccauguauaugugcguauuuauggggaaagguguuccaguucucaaagauguccauaacucaaaauaguuagaaaucacugaauugguccaacuuacucuuuucacagcugaagaaaccaagaucccaaaaaguuaagugagaaccagaaauauuaaacuaagaaguuaguaaaaaagagaaaauaugccaggcauggccuauaaucccagcacuuugggaggcuguaaucccagcauuuuggguggcuuuuguaaucacgucuguaaucccagcacuuugggaggcuguaaucccagcauuuuggguggcuuuuguaaucacgucuguaauccgagcacuuugggaggcugagguggguggaucacgaggucaggaguuugagacuagccucgccaacauggugaaacccugucucuacuaaagauacaaaaaauuagccaggcaugguggcgcacaccuguaaucccagcuacucaggaggcugaggcaggagaaucacuugaacccaggaggcagagguugcagugagucucacacucuguccgaaaaaaaaaaaaaagagagaaaauauacacauuaaccauaaaaauguaauuagagccuggauaccccaaaaauauagaaaauaggcaaucaggccggaugcaguggcucacaccuguaaucccaacacacugggaggccgaggugaggugaucacuugagcccaggaguucaagacgagccugggcaacaucgugggaucccaucucuaaaaaauuuuuuuaaaaauuagccaggcaugguggcccacaccugcaguccuaccuccuugggugacugaagugggaggaucacuugagcccgggggggucaaggucaagauaggccaugauuguaccacuacacuccagccuagaugacagagcaagaccuugucuuaaaaaaaaaaaaaaagugaucuaccauacaucuacauuucacugucauuuaguuauaguguuucuuuuuuuucuuuuuuuuuuuuuuugagauggaguuuugcucuuauaccccaggcuggagugcaaugauagcacgaucucagcucacugcaacuucugccucccggguucaagugauucuccugccucagccucccgaauagcugggauugcaggcgcucgccagaacguccagcuauuuuucauauuuuuaguagagaaaggguuuccccaugcuggccaagcuggucuugaacucuugaccucagguaauccaccugccuuggccucccaaagugcugggauuacaggcgugagccauagcgcccggccaguguuucuuuaauuggucacucuaugacuauuuagcuacaguuuaguguuauuguaacaugucucucauuucauagaaaacucuuuaaacaaaaaagaacaccuuaaaacauauuuuuaauucaauaguuuguuaugauuagcacuguacuuuucccuguaguccuacuauuaacaaaaaccccaacuucuauuccauuaaauaccuuagaugcauguucuaaauacuguuuuccugcagacaucugaguaagcaggcgaaauuuguuguccugaaguacauagaugcccuguuccaaaaauagaaaaaaaauccaaagucaauguaccuagcaguccuuaaaauuauuuuauucuuaugaaacaauuuaaguguuuuuuaaaguuauuaaaagucuccuucccauuggccaaguuuucuuuuucuguucuuugagacggggucuccucugucgcccaggguagaaugcaguggcacaauuacgccucacugcagccuccaacucccagacucaaucaauccucccaccgcaggcucccaaguagcugggacuacaggcgugcaucaccaugcccugcuaauuuuuauauuucuuguacagaugggguuucgccauguugcccaggcuggucucaaacuccugggcucaagcaaucugcccaccuugaccucccgaagugcugggauuacaggcauaagcccacgugcccagccuggucaaauuuuguuuaaaugaaggaguuuugcaauguucaagcugaagaguugcgaguucaguauuuucacaacacuaauguauaccgaacgguuuuauacacugaagauaaaaacacugucugagacauagucccuauccuuaaaaacucauagucuaguacgauggaaucauuaauacauguccacaugaaauaagcuguuuguuuguauaguuauuuauuuagacaugagcucucacucuguugucuaggcuggagugugguggugcaaucacagcucacugcacccucaaacaccuggguguuuagcaauucucuugccucagccuuccgaguagcugggaccacagacacaugccaccacacccggcuaguuuuauuaauuuuuuguagaaagggggucucccuauguugccuaggcuggucuggaacuccagggcucaaguaauccuccugccucagccucccaaagugcugaaauuacauguaugaucaccacacccgaccuaauuuuuauuuuuauuuauuuauuuuuuugagacagaguuucacucuuguugcccaggcuggagugcaauggcucgaucucagcucaccacaaccuccgccuccuggguucaagugauucuccugccucagccucccaaguagcugggauuacaggcaugcgccacuacgcccagcuaauuuuguauuuuuaguagagacgggguuucuccauguuggcagggcuggucuugaacucccaaccucaggugauccacccgccuuggccuccugaagugcugggauuauaggcgugagccaccgcacccggauuuauuuguuuauuugagacagagucuugcucugucgcccaggcuggagugcaguggugugaucuaggcucacugcaaccucugccucccggguucaagcaauucuccuuccucagccuccugaguggcugggacuauaagcgugcgccaauaugccuggcuaauuuuuguauuuuuaguagagacaggguuucaccacguuggccaggcuggucucgaacuccugaccucaggugaucugcccaccucggccucccaaagugcugggauuacaggggugagccaccgcgcccagcuuuauuuuuuuaagagacagaauuuugcuguuauccaggcaaaaguguaguauuucacuguauccuugaacuccucccauguagcugaaaccucaggcacauaccaauaugccuggugaaauuuuuuucaaguuuuuuguagaaauagguucuaaguauguugcucaggcuggucuccaacuccugagcucaagcaauccuucugccucagccucccaaaaugcugcaauucuaagcaugagccaccauguccagccagcugauauauauuaguaaaucaugucuagagaguaaaaaaaucauagucauuucuuccuauuagcauuuccaguaauuccaagcuaaaguugguacaaaaugaauuccaggccaggcacaguggcucacaccuguaaucccagaacucugggaggccaaggcgggaggauccauugagcccaagaguuugagaccagucuggaaaacauagugagacacugucucuaauuaaaaauaaauaaauaaaugaauuauccuauugagaguaccagauacauuuaauuuuuuacuuaaucaaaauuccaaaucuacucuaaguauuuccuugaaguucauaaaauaaaaucuaaugaagcugggagugguggugcaugccuauaaucccagcuaugcaagaggcugaggccaaagaauuacuugaguccaggagcucaagacuagucugggcaacaaagcgagacucugucucccuuuuaaaauuuuaauaaauacauaguuuucuauguaaucuauuaauuuuguaguaagaaaaucuuuuaagaguagaaaauaugacagcaguaauaauccaggaguuauuuaagaguaaaaugcucuauaaauuagacuuuagaaaugacuauaaagaaucucuuccugccacccaagaugccaaaaggaaaggccaagaggaaggagguggcucuggcccuuggugucaugaagaaacaggaggccaagaaaguggugaauccugguugggcgugguggcucacgucuguacucccagcacauugggaggccgagacaagcggaucacuugaggucaggaguucgagaccagccuggccagcauggugaaaccccaccucuacuaaaaauacaaaaauuagccggagugguggcacaugccuguagucccagcuaccugggagccugaggcagaauggcuugaacccaggaggcggagguuguggugagccgagaucgcaccauugcacucuagccugggcaacacagcaagacuccaucucaaaaaaaaaaaaaaaaaaaagaaagaaagaaaguggugaauccccuguuugagaaaaggccuaagaauucuggcauuggacaggacauccacccaauauggaccucacucacuuugugaaauggccccgcuauaucagguugcaguggcacaaagccauccucuguaagcagcugaaagugccuccuacaauuaaccaguucacccaggcccugcaccgccaaauagcuacuuagcugcuuaagcuggcccacaaguacagaccaaagacaaagcaagaaaauaagcagaggcuauuggcccgggcugaaaagaaagcugcaggcaaaggggauguccccacuaagagaccacuuguccuccgagcaggaguuaacaccaucuccaccuuggaggagaacaagaaggcucagcugguggugacugcacacuauguggaucccaucgagguggcugucuuccugccugccuugugucauaaaaugggggucccuuaccgcauuaucaaggggaaggcaagacugggaugucuaauccacaagaagacccgcaccacugucgccuuuacacagauuaacucagaggacaauggagcuuagguucagcugguggaagcuaucagaaccaauuacgacagacaaaacgaaauccacugucacuggggaggcaauguccugggucucaagucuguggcuugaauugucaagcaggaaaaggcaaaggcuaaagaacuugacaccaaacuggguuaaacauacacuguugaguuuucuguauauaaaaauaauuaaaauaauccaaauucuucuucuucaaaaaaaagaaaugacucuaaagacauaaaggugauauauuugugguucugcauauuauuaccacuaauuaacaguaacuaaggaaccaaauaguaaaagcuauucucauccugacuuaugcuacuuuaaaaaacuuaacauagcauauaauugggugaaaggaacagcuaucauuacugauaacugucccuuugucuuuacucaguucacacuauuagaagaaaaaaacuaauaacucauuaauaacauaaacauauuccaaaguuaaccagaaauuauuuuagguuuuaaauaagucacuaaaauacgauauuuauaucaaguuaaaggacuuuaaaauauaggccuuaauuaauuuaauuaccugaugauuuguccuuagauugucgauuuguuucuugaauaccguaguccaaaaaucuuuacaaaugaacuucaugauaucuaacucauccuugaaccuugcaguaucuuuuguaaaccuaaaaagaucaacuagaaguaauacaguauuucuccuccaaaaaaagcaagagggacuaauuauuaacuaauuuccaaaugccagaacagcacugaacauuuauuggguuuuuuaauuuuaauuuuuuuuuugagacagauucuggcucugucgcccagguuagagugcaauagcauaaucucggcucauugcaacgucuaccucccucccaggcucaagcuauccucccaccucagccucccuagcagcugagaccacaggcacaugucaccaugcucagcuaaucuguauaucuuuguagagacaggguuccacuuuguuacccuggcuggucucaaacuccugagcucaagagauucucccaccuuggccucacaaagugcugggauuacaggcaugagccaccacaccuggcugaacauuuauuaacacuaauaaagucauaagcaccagguaacaugauccuaucucaauggauucacauuauguuauauaaauuaugaggccucaaauuagucuaacauuauagccaaaauuucaggugcaaugcauucuagcacaucaaaaaaccacaaaagaacaaagagcugagcauuaucaugacauuguuauauaaaauauacuccgaguuuaacuauucagguagugagaaagaaauacuaaaaagaacugauuuauaaguucaaagauaauuacacgcauaaacauagacuauaguuauuucaaaccuauguacuuaaaaauucuaugcagguuaaagaaccuagcagaucuuaaguugaaaaugcaguaagauuuuagauaguugcuucaauagcuucaggaauaaagucuaaaauagcuucaggaagaaagucuaaaauauauaaaauauauauuuucuuuaaacauuaaaauaaaauuugaauaaaugaguuaaauggcauuggaucuaaaaagaaauuuuaauuuuugaaguaaagagaauaacauucaggaauuaaaauuaaaauaucccaaguuuuaugcaaucuuuugaaauagaucaccuuuguuuauaaccuaccugcaagaaaauuuucaaauccaaccugcucaccuuucuaucaauccuugucccacucgaaaccccauguuuuccagcuuaguaauacaucguccguuuucc

SEQ ID NO: 13305 - RNA, 9735 nt, Homo sapiens
ggaaaacggacgauguauuacuaagcuggaaaacaugggguuucgagugggacaaggauugauagaaaggugagcagguuggauuugaaaauuuucuugcagguagguuauaaacaaaggugaucuauuucaaaagauugcauaaaacuugggauauuuuaauuuuaauuccugaauguuauucucuuuacuucaaaaauuaaaauuucuuuuuagauccaaugccauuuaacucauuuauucaaauuuuauuuuaauguuuaaagaaaauauauauuuuauauauuuuagacuuucuuccugaagcuauuuuagacuuuauuccugaagcuauugaagcaacuaucuaaaaucuuacugcauuuucaacuuaagaucugcuagguucuuuaaccugcauagaauuuuuaaguacauagguuugaaauaacuauagucuauguuuaugcguguaauuaucuuugaacuuauaaaucaguucuuuuuaguauuucuuucucacuaccugaauaguuaaacucggaguauauuuuauauaacaaugucaugauaaugcucagcucuuuguucuuuugugguuuuuugaugugcuagaaugcauugcaccugaaauuuuggcuauaauguuagacuaauuugaggccucauaauuuauauaacauaaugugaauccauugagauaggaucauguuaccuggugcuuaugacuuuauuaguguuaauaaauguucagccaggugugguggcucaugccuguaaucccagcacuuugugaggccaaggugggagaaucucuugagcucaggaguuugagaccagccaggguaacaaaguggaacccugucucuacaaagauauacagauuagcugagcauggugacaugugccuguggucucagcugcuagggaggcugaggugggaggauagcuugagccugggagggagguagacguugcaaugagccgagauuaugcuauugcacucuaaccugggcgacagagccagaaucugucucaaaaaaaaaauuaaaauuaaaaaacccaauaaauguucagugcuguucuggcauuuggaaauuaguuaauaauuagucccucuugcuuuuuuuggaggagaaauacuguauuacuucuaguugaucuuuuuagguuuacaaaagauacugcaagguucaaggaugaguuagauaucaugaaguucauuuguaaagauuuuuggacuacgguauucaagaaacaaaucgacaaucuaaggacaaaucaucagguaauuaaauuaauuaaggccuauauuuuaaaguccuuuaacuugauauaaauaucguauuuuagugacuuauuuaaaaccuaaaauaauuucugguuaacuuuggaauauguuuauguuauuaaugaguuauuaguuuuuuucuucuaauagugugaacugaguaaagacaaagggacaguuaucaguaaugauagcuguuccuuucacccaauuauaugcuauguuaaguuuuuuaaaguagcauaagucaggaugagaauagcuuuuacuauuugguuccuuaguuacuguuaauuagugguaauaauaugcagaaccacaaauauaucaccuuuaugucuuuagagucauuucuuuuuuuugaagaagaagaauuuggauuauuuuaauuauuuuuauauacagaaaacucaacaguguauguuuaacccaguuuggugucaaguucuuuagccuuugccuuuuccugcuugacaauucaagccacagacuugagacccaggacauugccuccccagugacaguggauuucguuuugucugucguaauugguucugauagcuuccaccagcugaaccuaagcuccauuguccucugaguuaaucuguguaaaggcgacaguggugcgggucuucuuguggauuagacaucccagucuugccuuccccuugauaaugcgguaagggacccccauuuuaugacacaaggcaggcaggaagacagccaccucgaugggauccacauagugugcagucaccaccagcugagccuucuuguucuccuccaagguggagaugguguuaacuccugcucggaggacaaguggucucuuaguggggacauccccuuugccugcagcuuucuuuucagcccgggccaauagccucugcuuauuuucuugcuuugucuuuggucuguacuugugggccagcuuaagcagcuaaguagcuauuuggcggugcagggccugggugaacugguuaauuguaggaggcacuuucagcugcuuacagaggauggcuuugugccacugcaaccugauauagcggggccauuucacaaagugagugagguccauauuggguggauguccuguccaaugccagaauucuuaggccuuuucucaaacaggggauucaccacuuucuuucuuucuuuuuuuuuuuuuuuuuuuugagauggagucuugcuguguugcccaggcuagagugcaauggugcgaucucggcucaccacaaccuccgccuccuggguucaagccauucugccucaggcucccagguagcugggacuacaggcaugugccaccacuccggcuaauuuuuguauuuuuaguagaggugggguuucaccaugcuggccaggcuggucucgaacuccugaccucaagugauccgcuugucucggccucccaaugugcugggaguacagacgugagccaccacgcccaaccaggauucaccacuuucuuggccuccuguuucuucaugacaccaagggccagagccaccuccuuccucuuggccuuuccuuuuggcaucuuggguggcaggaagagauucuuuauagucauuucuaaagucuaauuuauagagcauuuuacucuuaaauaacuccuggauuauuacugcugucauauuuucuacucuuaaaagauuuucuuacuacaaaauuaauagauuacauagaaaacuauguauuuauuaaaauuuuaaaagggagacagagucucgcuuuguugcccagacuagucuugagcuccuggacucaaguaauucuuuggccucagccucuugcauagcugggauuauaggcaugcaccaccacucccagcuucauuagauuuuauuuuaugaacuucaaggaaauacuuagaguagauuuggaauuuugauuaaguaaaaaauuaaauguaucugguacucucaauaggauaauucauuuauuuauuuauuuuuaauuagagacagugucucacuauguuuuccagacuggucucaaacucuugggcucaauggauccucccgccuuggccucccagaguucugggauuacaggugugagccacugugccuggccuggaauucauuuuguaccaacuuuagcuuggaauuacuggaaaugcuaauaggaagaaaugacuaugauuuuuuuacucucuagacaugauuuacuaauauauaucagcuggcuggacaugguggcucaugcuuagaauugcagcauuuugggaggcugaggcagaaggauugcuugagcucaggaguuggagaccagccugagcaacauacuuagaaccuauuucuacaaaaaacuugaaaaaaauuucaccaggcauauugguaugugccugagguuucagcuacaugggaggaguucaaggauacagugaaauacuacacuuuugccuggauaacagcaaaauucugucucuuaaaaaaauaaagcugggcgcgguggcucaccccuguaaucccagcacuuugggaggccgaggugggcagaucaccugaggucaggaguucgagaccagccuggccaacguggugaaacccugucucuacuaaaaauacaaaaauuagccaggcauauuggcgcacgcuuauagucccagccacucaggaggcugaggaaggagaauugcuugaacccgggaggcagagguugcagugagccuagaucacaccacugcacuccagccugggcgacagagcaagacucugucucaaauaaacaaauaaauccgggugcgguggcucacgccuauaaucccagcacuucaggaggccaaggcggguggaucaccugagguugggaguucaagaccagcccugccaacauggagaaaccccgucucuacuaaaaauacaaaauuagcugggcguaguggcgcaugccuguaaucccagcuacuugggaggcugaggcaggagaaucacuugaacccaggaggcggagguuguggugagcugagaucgagccauugcacuccagccugggcaacaagagugaaacucugucucaaaaaaauaaauaaauaaaaauaaaaauuaggucggguguggugaucauacauguaauuucagcacuuugggaggcugaggcaggaggauuacuugagcccuggaguuccagaccagccuaggcaacauagggagacccccuuucuacaaaaaauuaauaaaacuagccgggugugguggcaugugucuguggucccagcuacucggaaggcugaggcaagagaauugcuaaacacccagguguuugagggugcagugagcugugauugcaccaccacacuccagccuagacaacagagugagagcucaugucuaaauaaauaacuauacaaacaaacagcuuauuucauguggacauguauuaaugauuccaucguacuagacuaugaguuuuuaaggauagggacuaugucucagacaguguuuuuaucuucaguguauaaaaccguucgguauacauuaguguugugaaaauacugaacucgcaacucuucagcuugaacauugcaaaacuccuucauuuaaacaaaauuugaccaggcugggcacgugggcuuaugccuguaaucccagcacuucgggaggucaaggugggcagauugcuugagcccaggaguuugagaccagccugggcaacauggcgaaaccccaucuguacaagaaauauaaaaauuagcagggcauggugaugcacgccuguagucccagcuacuugggagccugcggugggaggauugauugagucugggaguuggaggcugcagugaggcguaauugugccacugcauucuacccugggcgacagaggagaccccgucucaaagaacagaaaaagaaaacuuggccaaugggaaggagacuuuuaauaacuuuaaaaaacacuuaaauuguuucauaagaauaaaauaauuuuaaggacugcuagguacauugacuuuggauuuuuuuucuauuuuuggaacagggcaucuauguacuucaggacaacaaauuucgccugcuuacucagaugucugcaggaaaacaguauuuagaacaugcaucuaagguauuuaauggaauagaaguugggguuuuuguuaauaguaggacuacagggaaaaguacagugcuaaucauaacaaacuauugaauuaaaaauauguuuuaagguguucuuuuuuguuuaaagaguuuucuaugaaaugagagacauguuacaauaacacuaaacuguagcuaaauagucauagagugaccaauuaaagaaacacuggccgggcgcuauggcucacgccuguaaucccagcacuuugggaggccaaggcagguggauuaccugaggucaagaguucaagaccagcuuggccagcauggggaaacccuuucucuacuaaaaauaugaaaaauagcuggacguucuggcgagcgccugcaaucccagcuauucgggaggcugaggcaggagaaucacuugaacccgggaggcagaaguugcagugagcugagaucgugcuaucauugcacuccagccugggguauaagagcaaaacuccaucucaaaaaaaaaaaaaaagaaaaaaaagaaacacuauaacuaaaugacagugaaauguagauguaugguagaucacuuuuuuuuuuuuuuuaagacaaggucuugcucugucaucuaggcuggaguguagugguacaaucauggccuaucuugaccuugacccccccgggcucaagugauccucccacuucagucacccaaggagguaggacugcaggugugggccaccaugccuggcuaauuuuuaaaaaaauuuuuuagagaugggaucccacgauguugcccaggcucgucuugaacuccugggcucaagugaucaccucaccucggccucccaguguguugggauuacaggugugagccacugcauccggccugauugccuauuuucuauauuuuugggguauccaggcucuaauuacauuuuuaugguuaauguguauauuuucucucuuuuuuuuuuuuuucggacagagugugagacucacugcaaccucugccuccuggguucaagugauucuccugccucagccuccugaguagcugggauuacaggugugcgccaccaugccuggcuaauuuuuuguaucuuuaguagagacaggguuucaccauguuggcgaggcuagucucaaacuccugaccucgugauccacccaccucagccucccaaagugcucggauuacagacgugauuacaaaagccacccaaaaugcugggauuacagccucccaaagugcugggauuacagacgugauuacaaaagccacccaaaaugcugggauuacagccucccaaagugcugggauuauaggccaugccuggcauauuuucucuuuuuuacuaacuucuuaguuuaauauuucugguucucacuuaacuuuuugggaucuugguuucuucagcugugaaaagaguaaguuggaccaauucagugauuucuaacuauuuugaguuauggacaucuuugagaacuggaacaccuuuccccauaaauacgcacauauacaugguuuuuauuuucauaggggucacaaauuccccgauuaagaacucuugggaugaacaaucucuaaggccucuuccagcuuaaaauuucaugacucagaucuaguuacuuauuagugcccauuuauguauauuauuuauaagauaauauuuuauauuauucguagauaauguaguauguugaacaucaugcaguauagauguggguaaucaaaaauucccugaauugcuaauuuuucaauccaguucuugucaugacuuuugguuuuguagcucagcccuauucccuuucuuuguuucuauaugacaggguuucucaacguccaaacuguugauacuuucaaccagauaauucuuuguuguggcaagcuauaagucuugaacaagucaagauucuugguuguaaauaggggaaagaaauucugcuuguaagcuaacaaaauugauaagcucaaagaauaggcaauaaccaggggagguuaaggcagccaguaagauagccaagucacucugcagacuguaucuacuuagaauccugcaggcagcagggacuguagacacaaacuaccuuuacugccuccagaacuaauucugaucaguuucuggcuuguuuuugucacugagucuagauucacaguccuggacuggaguacuuaauuggcugagcuuaagucuuaaguccuacguccaugcuuuaguuuccagggagcugggaaauauaucaauauuuuucaguaauuugaacaguucuucaaaauccuuuuuuuaaacaggaaugacuuacugaugauaaaucauguaauguuguauuuaucaauagcuuuacuauuuuaguaaauccuuacuauuuuuaaugauuuuuuuuccuuuuaguauuuagcauuuacguguggcuuaaucagagguggcuuaucaaacuugggaauaaaaaguauuguaacagcugaagugucuucaaugccugcuuguaaguugaauucgccuuucuuacaaauguuuuaguaauuuguuuucaggucuguuuuuuuuuuuaauuuaacugagaggaaauuuaaaaugcugaaacuuucauuuuaguuuuaucaauguaacacuuuaguguaguaauauguagcauacuacauucauuuucaguaauuuuugaauaauggacuaaaauccaaauuuauaagacaauuuaagggaugauuuuuaacuuuucuaaaguuauucaaacuguaacuuuuuuaaagauauucuucugaauaucuccugcaguguuuuaagauagcaaauuucccuagaacauugaaaaugcuauuuuuuuuuuuuuuuuuuuuuuuugagacggagucucgcucuguugcccaggcuggagugcaguggcacaaucucggcucacugcaagcuccaccucccggguucacgccauucuccugccucaaccucccgaguagcugggacuacaguugccugccaccacgcccagcuaauuuuuuguauuuuuaguagagauggguuucaccguguuagccaggauggucuccaucuccugaccuugugauccgucugccucggccucccaaagugcugggauuacaggcaugaaccaccgcgcccggcccgaaaaugcuauuuuuaaacaauuguuuaggauaugucuauuauaucaagcuaaguaaaaccaaauauucuuuuaucacuaaaugucucccuaaagaucuuuucaccagagcuaccaaccaagaaaaaauggacuugagcuuuauuguauuucuuuucaauuuacaaugaucauuagccaugaaauacuguacccaaauguaggauucauaaagagaaacaaaagugcuuacucaacaaaccauauaaucaucccauaaaaauagaauugacuggccggguguggugccucacaccuguaagcucagcacuuugggaggccgaggugggcguaucaugaggucaggaguuugagaccagccuggccaauaaggugaaacccugucucuacuaaaaauacaaaaauuagcugggcguggugacagacgccuguagucccagcuacucaggaggcugaggcaggagaaucacuugaacccaggagguggagguugcagugagcagagaucgugccacugcacuccagccugggcaacagagcaagacuccaucucaaaaaaaaagaaaaaauagaauugacuuuauugaauauuaugaagaaugcgaaaaaguuuuugacauagcagauuucuugacugaaacuauuuccuauauggaacagaaaauugauguuuagacuuguuuucuuuguaucuaaaaucaaagaauuauuuguauuuuuuuuuuuaggcaaauuucaggugaugauacagaagcuguagaacauacugaaaugcaaggcuucaacaguguaaagagauaaauuauucauguaaaaguauuucaaguagugaugauuuaauuacauuguucgauguuuguacaggaguaagcauguauuuuuaucaauuuaacacagaucaaaggagaugaagggacauucugccaugacauacacuuaaccaaaacuauucaaaaugaaaaccggauuucaaauaaccagacaccaagaugcagggcccuuauuuuaaaccuuuuuauuugguuagagugauauguauuuagccauagauggagaaacaaagcucaggguuuguugaauuagcaugagagaaaauuauguaccaacagaauuauuugugagaagaaugaacaaauuuugauaaaguaugaauuuguuuuauuuuaaaaagcaaacauacuaaauuuuuuuuauuuuauugcuuauaauuuauuaagaauguuuacaccuguauaaggauuucauauauacauuguauguguguauauauaaauacauauaugacugccuaaa

SEQ ID NO: 13306 - RNA, 35442 nt, Homo sapiens
ggcucccggcuagcgggcggggucuccagggagccgcaccucagcccacccugagggcggggcuggcccggcgguuacauaacaaaccugugagagcggcugggggcgguucgggcgcuggugggggcggggcaggggcggggccagggcggggccagaccugcaccgggccaggcaagauggcggccauggagaccgagacggcgccgcugacccuagagucgcugcccaccgauccccugcuccucaucuuauccuuuuuggacuaucgggaucuaaucaaguaaugggacgacacgcauggcaggggugggggcauggggagaggaggcggugaggcagggggaaagggggucggggccgcugacaggacccgagcuuccgcgacaccagaaggugacgccagggccgcccucauccugcggagccaccggggaccggggcgagacgggggcggaaagggccucgcccugagucuuccuccuguccugggcccagguaugagaagcgacgagauaucucucucccaggccucggugaggcccacuugcaagagaaggagguaguggcccucgugccgcaccgccgcgcuccgcggacccccgcuggccccgcaggugcccgcccgguuggggucagucccugcugcuguguaaaagccccugucccggccaggcgcucuucucugcuggguccggggccugcggagucuggcgccggggugggcaggugggugagcgagaggagaagauaggcaaccccuuacuccccuggcgcgacuuccccagcgccagaaucgcuguccgggcucacuuucggacuucagugcgugagaauuguuuugcugucagcauugcuccuuacgguucgauguuggauuuuauguuuugguacugacuuccggugaugccauaccggugacuaucuuuucuccuggacaccuuggguuucccacauuacuagcaucuguuccagaaauaaacaccgguugcugauaagggugguucaaugcccaguuucuucagaacuugggacugucuggggugguggaagaaauggcgcugccagcccgccccccagcugucaggauuguuuacacccuugacaggggguggcauggcugugaguuuccugugcuaccguauauauuugcagaggaugcaaagucgcccucuuaggauaggugggcgagauuuguuuuguguuuggauuaaccauuagauucuagccauuugaugauugugcccuguguuauuagaggucuuuuuauaaauacagauuucuuggagcuacagauaguuguuggccuagcuaaguggugauagagagauaccucaaguuuuuggucacuaccuguacuggucgcuaccuguaccugcuagcaauuuuauuuuucuagaaaauacuuacaauuuaacuaacagucuccaacuuuugauugcugccagaguaaucuuuccaagacacaucugguugucauucuccuuaaaaccugugacaccccuauguuuauagacuauaaccuaaacuucuggggcauugaaagcucuuaucaucuggcuuguauaucuaagguccuccaggacuuauuucuccaccacuaucacauuugcaccauccauucuaaccaaaucagaccucugccagcauacaacacacuugcacuuucuuuuuuuuuuuuuuuccuguggcucaagcucucgaccuugccuggaaugccuugccuaccucuucucaacuuggcaagguggagaagaugcccucucuaccuucuuccugcagaauugauuugccaugucagguagauggcgugcuucuugauuguaagggcugccuugcuuaucuuccuauucaaagauuuuuuuuuccccgagggcuugcuaugugccagucuguuaaguguugaggguacaguagugaacaacgcagauaaggcaacucuuauggagcuuacaguccagugggcaagcgcauaauugcaagagguacuaagugcugugaaggaaauagauugcucuguuaaggaauaggaagugagaagugaucaaaucggaaggagcugccauauaugaagcagggcauaugcaguucuggcagagggaaaaguauguucagagauugacgggacugcugaacgguacuguucaacagcauggccugguggaagauacagaaggcuggcguugcuggagguagggagugacucacagacagugaugagaugaggguggugagaucaugcaggaccuugggaaccaaggugaggaaguaagaguuuacuuuaaaugcuuuagguaguaaucacaauuuuaaacagaagugacaugaucccucuguaaaugucuguggaaauaaauugaguugaauaccauuugaauuuuaucuacagaaaaguauccaguguauugcagcuuuuuuccugcaccauacagcccaauuuugucaagggucuagucuagugauaagcucugaaguuuuugguauuauuugcugaacuggauuggguuggauuggauuaguacacuggaaucauguagcaucaguugccuaguuugaauugagaugaucugauacccucuccauuucagagugauuuauucugaaauggagugaauaaaugccacacugugcgucagaaugaccugugcaucagaauggccuguggcacuuuuuaaacauacagaugccugagguacagaucucaguccaaaccgacuggaucagaaucucuagaacaguaguuuucacucucgaugugcauugaauucaucuuucaugcauauuccagauucuuuuaugucauuuagcuccuagggcaguggagggacaggaaucaagaagaggguauggaaacugaaugcacaaaacuggagggauuccuauguuuacaaaaguuaauuugggcaucuccugagcuuggcagaaaaggaugaggaugauguuucuguaaaaucugaaaaucaaacaaaggcaauuuuguuuacuauagaugguuuuuaacacaccuuagucauggccuugacaaaccugaugugauuuaagauucuguugauagcuauugcccaagugagaucuuugaauaccuacuuucaauuaauauaacuuguaauuucucucuggaaaggauagaguccuaaucuuagguucauucuuuuuacaaauuaauuauguaggguagaauuuacaggauugcaacacuguuguguuagaaaucuuuauauaguaagaaaguuauuugcuucuaacauucgauguuuuggggcagcugauagcuuguguagccaugacuauugagucagaacuguuacgauucaggcacccucuauagguggacuuuccaguaguugcuuuaaugaaaacgugguuuuuguggcaauacuuuuuuccuuuaaguaaaaaauuuuaaaaaacaaaaauaaaaagucuguguauuuaguagcauacaucuuacagaucuugggaaaaaaccccaagucccuuuguuuaugacuaaauaacuuucuuccuauauguagaaaugaguauuguccugauaauaagcauaggacaacuccuugacuugagauuaacuccaauggcauauauggucuguagauauuuuugugaaaaauuacaguuguagauguuucaggguuuauuugugaacucaguuucacuacuaacaaggcaauuauacuacuuaacauguuaaacagguuuuagaaaauaguuuuguaauuauaaggguaauaagugaaaaguaagagaaacaaaaggcauaaaacaaaacaaugaauauuuuaaucuuuauuuuuaaauuguuuucuuacuuuuuuaaauacuaucggugaaucugguuacugccagcuguuguuaugucagucgaagacuuagccagcuaucaagucaugauccgcuguggagaagacauugcaaaaaauacuggcugauaucugagugaguauucgaggaauauguacuucugaaaacuggcccuuggcuucuuccauaacacuaguuuguccugauucuccucucuaacccuugucucuuuaucuccuuugguggcucuucucgugccugcuaguaaauguugguauuugccaagguucuguccuuagcccacugcugcucucccuugcugaacucuacugcaugcauuguugccguuuauagugacuaucugcaugcuccuaacucccaaaccugaaucucccucccugacuuccccacugaggucuagaauuguuugcacaacugucugcuggaccuuucuauuggcugucccacacuuauuaacuggauucaguaaauguuaacaaauuugacagaaucaaaguacagaugacagaaagugggaguugagaaagguggaagaaaugaguaggaaugcugauaucuuuucuuagauuaaguggagucagguagugacuaaaguuggugaaguaagaagcagagguuuaagcauauuauuuaaagcugcaagcuuuagacagaagugaaaauuaauaacagagcuaucaaacauugggaggaaaaagaacaggguaaggggaauuuuaaguauugcuagaucuucccguguuucccuuugggguaucaguagauacaugugaaguugauaaaucaagaauuagaggcauaaacauuuagaacuauagagguaacuucuagaaauaccuaagauuuccuuugaggaguuggacuuaaaacaggagaauaguuuuucaucguaaguucuuugauacuuuuuaguuuuaauaaucuauguguauauuauuuagauuaauaaaaagaugcuccccuucccucuucuacccccgcaaaaaaaaaaaaaaaaaaacccacccugaguuguucuuuuccccauuccuaaaccuguccuucagcauucccagucuucauagcagcaucauccacucaggcauccagaucagaauuaggagucauccuaggcgugucucucucucucuccccacuucucucccuccuucuauauucaucacaaaggcuuaccaagccuuucuuacuaagcucguuaguauguuaccuuaaggccgucuguggcugccuuacccucuaucacuucugauucuuaauuuuauacuucauucuuucucacugguuagacucuuaccuuuuuugaagguaaaaaaugugccuuauuuuuuuauauccucaguggcuaaguggacacucaauaaaugcuuggggaauuuuaccaaauaggaauguugaaucauguaauuacuuucauguucuaugauucucaacuaauucaguguagauauguguuagauuaauauuauuauaucacaagauucuaaguauucucuaaaacaauacauaaugccuuuaaaaguuuauaauugguauauuuuuaagaauaaguugaaauuuauacguuauuacuauucauauuuuauuaaagauuagaaaacugaaaaaaaauaaguagaaagaaaaggagaaaaugagugccuagcaauuccaccaugccaguaguaacuuuuguuaaaauuuuuuuauguauauaucacuuuuugcuaucugaucuucauuuguggcuaaaauauaaugaaaaggaagggaaaaguacaaguuucuauauguuguagguaucuaaaauaaaugcuaauauuauuuuaaaagauuuaaaaucucauguuuuucaucuauuuagggaagagaaaacacagaagaaucaguguuggaaaucucucuucauagauacuuacucugauguaggaagauacauugaccauuaugcugcuauuaaaaaggccugggaugaucucaagaaauauuuggagcccagguguccucggaugguuuuaucucugaaagguacugggaauucagggucccuuuccccguuuccauuacuguuaguauaaauagguuaguuuaaacaacuuugaaucucugucaucuacgcaacuguguuaacccaacuuugucugugauuuacuguucauauuuggccauggaaguaggaccuucacucuagugcuuacccuguuuuuucucauccuugggacccacaugguuauuuaucagaagggaaagcugaacuuuuauccuuauauuuguuuucuauuaagaaaguaguaaugcuaagauugugugagaguaacuacggugauuucuuuuaaaagauuuuuuuuuaauugugaaauuuugccuacuguaucaacacuguugauacaguuucaguacaaguugauacuauuuucaguacaaguaaaugucugauagucuaauauucagaaagacccuugguguuuaccuguguaagagcagccuaguagaguaaggaaaacuuuuauccuuauuuugacauuugcaaaauaguagaacuaagauuugaacugaggucuguucaacuccagaauaugcucuuucuauuacaccauuauuguccaauuuuggcaagaaauauuaagcuauuuccauuaauuugauuuaauuaaugaucaugaaaauagacagauuguagauugauugcuacuuaccugcuuuacccuccaaguuuuuuucagauuucuacacugaaaggcauuguauagauguucgguuuugcuaagcuaaaauuggaaucaguucuucucaaauauuuucuucccuuuagaacuaaagacucuuuugaaacaguauuccuuuugcauuuuguguuuccucucuaauuucccaugcaaauauuacuuucauacaaaucacgguugcaugacgaggugcuugaaacugaauugcuaaaagguagaagaaagaaugauuuggcagaaagaguagggcuuugaaggaaaguacccuugauuaauauucugaauagcuccuuuucuuagaagaaacgaauaauacuauuuacuugguauguagggucgaauauuucaagaggaaacuaaaucugaaaauagauauuuggugaugauaagguaagggcuuacaguagcuauuauuaauuaaacacaaagcuaggcacuggcuaaguauuucuugaguauuacuccauuuaauugcaaaaguccuaugggauaaauaauuacuauucucauuuuauagguggauuacccaaggcaugaaaaacuaaguaaguuguggccaggcgcgguggcucacgccuauaaucccagcacuuugggaggccgaggcggguggaucacgaggucaggagaucgagaccauccuggcuaacacagugaaaccucgucucuacuaaaaauacaaaaaauuagccaggcgugguggcaugcgccuguagucccagcuacucaggaggcugaggcaggagaauggcgugaacccggcaagcggagcuugcggugagccgagaucgcgccacugcacuccagccugggcgacagagcaagacuccaucucaaaaaaacaaaacaaaacaaaaaaaaaacuaaguuguuuaaccaucacaaaggaaaggcaaaaccaggauuuggauauagagcagacuccagggcuaugaucuuaacauuggcugaagggagacaggaccuauccuauuauguuuggaaugucuuagaauguauauuggacuagaagagcuaguuuaaauauuaggacauuuggaauaugauaugguauaugguucugcucuuaggcucagagcuaucaagaagauaaaacuaaggauauguaacagcugcugcugcugcuuguuuuucuuuuccuuuuuuuuuucuuuuuuuuuuuuuggugcaugaauuuugguaguuccaggcucccuguacuaccuagcaguuggaagugagguugucagauaauuccuugacagcuccuguuuuacuccacagugccaguucucuggggcuuugccaugaguuggaauaggauaaaggcucuuugaugucugcagugcuguggguucuuggaacccuaggcuuacgaauuuuaaaaccaagucaggaaccuagcugcucaccucagcugccacagucucugauucaauugcaagguuauagagguugcagauaaaaaggaaaaucagaaagcagauaggcauuggacuuggagaaauuuuuauggagcaucuugaaauuaagauauauuguugucacauauuuucaaaucucauauuuaccuuaaguuuuggcuuagaauuuuagaguuggaaggcaacuuagagacuguuuagacgagggguuggcaaacuuuuucuuuaaaggaccagacaguaaaauuuuaggcuuugugggacacauggucucugucacaacucuucaacuccgcuguuguuguggaaaagcagccaaagaugaugcauaaauaaaugaguguugcuguauuccaauaaaacuuuauucauucaaggaggcagcaggccaggauuuggagugugggcuauaauaugcccauccugauuuaugcuaguaaguugaagaaacauacccggagaguuuaagugacucaugcaagguaucaaacuagugaccaagauacaacucuaaucuaggcuucuuggcuccucauaacuuuuucacuguuuccuucuaugaguagguuaaggggaaaagaaaguaaauaaauauuuacugaguaugaguaaagcacuuuauuaauccucacuguaauucucuaagguaggugguauuauccccuucuugaggaugaagaaacaggauuaaagaggugaaauagcuugcuagaaaucaugcagucaguguguaucaguccauucuugcauugcuauaaagaaaugucugacucuggguaauuuauaagacaagagguuuaauugguucacgauucugcaggcuguacaaaaagcaugguggcaucugcuucuggggaggccucagggagcuuuuacucauggggaaagcaaaguaugagcaggcgugucacauggcaaaagcaagaucaauaggaagagggggagguacggcacacuuuuaaauagccagaucucaugagaagucacucacuaucuugaggacagcaccaagggaaggaugcuaaaccauucaugagaaaaaauccaccccaugauccaaucaccucccaccaggccccccuccaauauuggggauuacaguucaacauuagauuugggaggggacaaauauacaaacuaugucaaagcaguagagcaaagauuaacucuagucuuucugccucccaaauucuauuacaguuggauaccucuuucaaccuugauuuuacuguauuguaaacauacauuuccuuuuaguuuucuuuuugccaugucuauuuuugucucucucucuucuucaagaaauucuuaguuuguuaauguuacauguuaagugucuaacauguggcacauaccauauaaauauucguuucuuuccucauccaguaguucagguugccauucagcuucguuucuuuuauacuaaaauuucucuuuuuuuaaaaugaacuuuuuauuuuggaguaauuugagauuuacagaaaaguugcaaagagaguucagagaguucuauacaccccucacccuuuacccuuauauaucccacugugggacauuuaugaaaacuaaaacaucuucauuggcacauuacuauuaacuaaacuccagacuucacuugaauuucccccgauuuuccauuauuguccuuuuucuguuccaggauccaguccggaauaccacauugcauuuaguugucaugucuccuugguguacucugaucuguggcaguuucuuugucuuuuaugaccuugacaguuuuuuuuguuuguuuguuuuugcuuuuguuuugagacggucacucaggauggaguacaguggcaugaucuuggcucacugcaaccucugccucccagguucaagcgauucuccugccuccgccucccaaguagcugggacuacagucacgaaccaccacaccuggcuaauuuuuguauuuuuaguagagacaggguuucaccauguuggccaggcuggucuugaacucuugaccacaagugaucugcccguguaggccucccaaagugcugagauuacagaugggagccaccgcacccagcaccuugacaguuuugagagaguacuugucagguauuuuguauuagguuagugcaaaaguaauugcaguuccucaaaucagcuucgucuugauauuuuacggaugauuagacuggagcuggaguuauguuuuuuuuuuagaaagauaacugcagacgugaagugcccuucuccucacauuauauccagcgguacaugcugucacuaaugguuuuaaguagcauacagaaauaggcacaaauuguaagugcacaacucauugaauuaucacaagguaaacauguccauuguaacacccuccagaucaagaaguagaauauuaucuguaccuagaagcccuccucauaguccuucccucuuucacagaggcaaccacuauugugauuguuaaugcuauugaguaguuuucuuuuuugaacuuuauguaaguuguaugauuaaguauuuuguauggauuauuucuacuuugugagauucaaucuuuuugaguguaacagaguuuguucauuuuggcugcaguauaguacuccauuaucugaguagacuauuccuucuacuguuaauggauauuuggguuauuucuauuucuggcuauuacaaauaaugcuguaaauuuuuauauacauuguugaugucucuaugaguauauuucuacuggguaaauaucuggcauugaguuugcuggguuauagaguugcuuauguuaaacuucaaaagaugguguuuauuuuugaaaguaguucuaccaauuuacauucuuaccagcacuuuaauguugucauucuuuuuauuuuagccuuuuuggcagguguauaguggugguuuuaauuugcauuucccuaaggauguagaauaaugacaguuguauuucuaucuuuccaagccuuauauaucauguauuucuuuuucuugccuuacugcacuggcgagggccuucaguacaguguuggagaggaguaaugauaggauagcgggcauccuuaucuuucugauugcagagggaaagcuuuaagcauuucaccuuuaaauaagauguuugcuguaggguuuuuuuuuuuuuuuuuuuuuguagauauucuuuaucagauugaagauagucccucugauccuaguuugggaagaggguuuuuguuuuuguuuuuuaaauggauaauuucuaucaaaugccuugucugcauuaugauucucaugauuuuucuccuuacucuguuaaugcagugaaaugcauuaauugcuuuucugaaugcuaaaccaacuuuguauuccuggaauaauccuacuuugauuguaauauauuaucuuuuuuauauguacuggauauaaucugcuaguauuuuauuggaauuuuuacaucuauguucaugagaguuuggccuguaauuuuccuuucuugcaauguucuugucagguguugguaucaagaugaugcuggccuuauaaaacgagucgagaaguguugccucuuuuucuguucccuggaagaguuuauguaagcuuggucuuauuuuuugcuuaaaugauuaguagaaugcaccagugaagccauucaauucuggaguuuucauuguaggaaaguuuuaaauuauggauucaauuccuuuauuagauauaggacuauuuugauuuucuauuuauucuuaugucaauuuugauaaguuguuuucuaggaaauuguccacuucaucuauuuucaaaucuauugacaugaaguuuuucauaauauccucuuaucuuuuuagugcuuguuggaucuguggugauaccaccuuuuccauuucuaauauuaauuauuuauacuuuugcuguuuuucuucaucaaucuugcuagauggggugaauuaauuuuauuaaucuuuucaaagagcuggcuuuugccuuugccaauccuuuacuguauguuuguuuuuuauuucauuaauuucuuugaugucuucgcuuugaauuuacugugauuuuuuuuuuuuuuccugacuugggaucauugcuuagaucauagauuuucagccuuucuuauuuuuuuaaaugaauuuagagcucuaaauuucccacuaagcacauuaguuugucccauaaguuuuaauacauuguauuuucauuaccaugcaguucaaaguauuuucugauuucuuugauuucuucuuuaacccaugaaugauauagaaguguauuacuuaauuucuaaauauuuuggacuuuuaaaguaaucuuuuaaauauaauuuauauuuuaauuccacugugaucacaggauauacuuuaugugaguucagucauuuaaaauuuguuaggacuuauucugugguccgguaugugaucuauuuuggucaguguuuuguguauacuuaaaaacaauguauuuucugcaguuacggaguucaauacuguauauauaauuagguaaaauuuguuaaucuuguucaaaucuucuacacucuuacugaauuguguauuuugucugccuguucuguuaguuauugagagaaguaugauaaaaucuauugcugugguaggcagaauucugagauagucccaaaauucccacccacugguguacaugccugguauaaugaucucuccuugaguguaggugguacugugaaaauaacugauuuucuuccauuagaucauauuauaugaaaaaggugaagggauuuugcauauguaauuaaggucccaaauuaguugaauuugaguuaauuauuaaucaaaaagcaaauuauccugacugggccccacuuaaucagaugagccuuuaaaagggacugggggcccuuccagaagucagauucaaugugccucuccuguugacuuugaauaagcaagcuggcauauuauggagagggccacaugguagagaaugguggguggccuccaggagcugagggccucaguccuaaggaauugaauucugccaacaaccagugagcuuggaagaggauccuaagcauacgaugcauaagaugagauagcagccccaguugaugccauacuuucagccuuuuggggccugagcagaggauccaguugagucauaucuagacuccugaccuacagaaacugugaaauaauaagugcuuuaagcugcuaauauuacagcaggagaaaacuacagccacugugaucguagauaucuuuuccccauuuuauuugucauuuaaaaauauuuuuuaaagcucuuauuagguacauaaaauuagaauuguaacaccuguguagugaauuuaaccuuuuuguuauuacgaaaaguccuccauuagcucuaauaaaguuguuugccuuaaagucucauuucaugugauuuuaguagagcuacucuagcuuuguuuucuguauuuacuuuaagaugugucuuguauauaauuuuuuguuuuuuaucugaucuguuugucuuuucauuagauuauuuagucuauucauauuuaauagauuuacuaauguguuugaguugagcuauaccauguuucuguuuuucuauuugucccaccuguucacuguuccauuucuguaaucuucuuaauuauguuuuauuccauucucuucuccuuucuuuuuuuagugauuauauuagagauuaaaacauugcaucuuugacuuuuuaaagucuaauguaaauuaguauuuuuuccacuuccuggacaaugaaagaacuuuagaaugcuuuaacuccaaucaccuccuaccugccuuuugauuuauuguuuuugugauuuuguuuuuuaacauauuuaauuucccugaaaacauucuuauuuuacauauucaauauucuuuuagacuuaccuucauauuuaucuuuucugguugcccuuuauuccuuccugugucuucaugcuuccaucugggaucacuuuccuuccacaugaagaauuccuuuugguauuucuucuaacugcugcugcugaauuuuucuuucauuuaucuaaaaauguauuuauuucaucuucauuguugaagauauauucacugguuauaggguuuuggucagcagugauuuuucuucaucaguuugaagauaucauucuucugacuucuauuguuucuuuucuuuuuaaagacagggucuugcuuuguugcccaggcuggagugcaguggcacaaucauagcccauugcagccuccaacuccugggcucaaacaauccuuccagcucagucucccgaguagcugggacuacaggugcgacaccaucccuggcuaauuuuuaagguuuuuuuuuuuauagauggggucuugcuauguugcccaggcuggucucgaacuccuggccucaagccacccucccaccucagccucccaaagugcugggauuacaugcaugagccacugaguccagcuaacuucuauuguuucugcagagaauuuagcugucagucuuauuguuucucuuuugaagguaauuauacccucacugcacccacuacacugcuuuuaaaauuuaucuuugucuuugauuguagcaguuuuccaagauguaucuagauaacuuuucuuuguaauuuuucuccauaggguuuauggugcuucugaaucaucguuugacauuuucaucaauuuuggaaaauucucugcuguuaucuccaaauacugcuucuacuucauucugcuuuuccucucccucugggauucuagugcacguaucauagaccuuucugccauguccucccauaugugucuuaggcucuuuuuguguuuuuccgucccuuuuugucuucugaccuggcuuccaguuuauaauucccucuuuagcuuuaaaacuaugauuugcuguuaaacccuuucaguguauucuuauuuuaguuuuugcauuuuucagcucuaagauuuccauuugauucauuuuuauaguuucuaguucucugcugaaaugcuccaucuucauuuaauucauugaauguaucaguugugguuauuuuuaaguccauguuuacuaacuccaauaacgauguauuauggauuugguucuauuuucuauuuuuuccucuuucuuuagucagaucuugucuugguauaggccuaguuguuuuuaauuuauugcuagacauaauuugaauuuugggguaauguuauuuucuucuagagauuacuuuugcuuuuggcuagcagcuagucaaugggcagaucacuguaaugcaaucagggauugacaugauugaaagcugggcuuuagucuuugugaggacuagucuuauuuucaguucauccuuuuuccuaggaugucagucagaauccuagcccaaaaaccuuggguuuuaccaggucccucucuccuuuguggacccugaacucuguuuguuuugcccucuagcccugugguacugccuaaagcuuugcucagcuucuuggccacucaaccucauauuugcuuucagaauugacagcaauucuugucuaaagacaagguggcuuccgaugccuggcccaccucucagucucucucuucuccuggaccccucuccccuaccguugugacucuucgaaagucuucaagccaauuuuuuguuuucacuauucagcaagagguuuaguccaacaaccuggugggcugcugcugaaugucgaucucaucucuugguauuugucauuauuucccacuucucaaagcuagaauauguggcaaguuuacaaauaugcaaaauagaguucaaguuaauggccuccucacacaugaaccauaccuuauguccuauauuucccauuaagagucaauguuaaaacucuuaaauaacaucaguuuagagaacuuccagggguuuugcuguuuuuuuuuuuauuuuaaauaaagcaguaugaauauuuuagauuuaggaaauuuagagguuuguguuauaaugugaaaacauuauuguggaucucauuggugcccacuuuccauguuuuacuaagugccaguguuuucccuguugggaggaaacuaagaaauuugcuuucucagugcuucaaauuaguuuucaauucauuuccuucuauuucagccauauauuuuggacagaauucacucauuccaagauuguuucauuaguuagcagauagauugcauuucuucuuagauuuaaggcuguuucuucacaauucacucuuuuuugugccuuuauagagggugcucgagaggaagaccucgaugcuguggaagcgcagauuggcugcaagcuuccugacgauuaucgauguucauaccgaauucacaauggacagaaguuagugguuccuggguaagauauucaauguuuugguuauuuuuaaugaugcaaguuauuuuuuagaaugaaaguaaauaaauuguauuuguaguuacccuuaacaaauuaaagaagcaugggaauucccucuuucuccuuuauagcaauccauaagacaaaaucuauagcuugaauuagauuuuaccaaaauaaauauaucucauaaaaacacaauuuuuaucaauauauuuguauaguuaaaaugaagucugguaugggaugggggaugggacauacaguaaagguaugugcgauauauuuuaaccaaauucuucagaacucuugaaauguguaucuuauuacaggccaggcaaauuauuuugggagcuugacgcaaauucuaccuacuauacauguaaagagcaaucauuuguccagagcugcauacacuacacuaaauaaaauuguuuugucauauuaaacacagucuauaauugaauggccuguuuaaaauuuaauucuaaagaaugaaguauuuauuguggaacuuuuuuuuuuuuuuuugagacagggucuugcucgguccccaagccuggaguauaguagcaugaucucagcucacugcagccuugacuccccuggcucaagcaauccugccaccucagcugucccaguagcuagaaguacaggcgcaccaccaugcccagcuacuuuuuuguauuuuuuguagagauggggucuugucauguugcccaggcuggucuugaauuccugggcucaaaaaauuccugccucagccuccaaaagugcugggauuacagaugcaaaccacccagacuuuuuuuuuuuuuuuuuuuuuuuuuaagagauggugucuugguguguugccaggcuagugguauuuaacuccugggcucaagcaguccuccugcgucugccucccaaguagcuggggcuacaagcauauaccacugugccuggcucagcuuuuuuuuuuuuuuuuuaagauuuguuuuauaaacuuuuauuauuuuaaauuuuuauuuuuuuauuauuauuauuauuauuauuagagauggggucuuacuauauugcccaggcuggucuugaacuccuaggcucaagggauccuccugccucagccuuccagccacuauauccacuuuacauuguggaacuuuuggguaaaaguagaccaugcaguagucaucaaaacucacccacaguuuuagaaggcauauaugcuuugaaugggucuacuccuuuuguacuuuuaugaaaguaagcuauuucagagacauugugcuugugaaaugcuaauaagaauuuaaggagaacuuugcacuguucuuauuggaaccugguguuccuuuguaugugaagaaucaugugaggcucuguuacaauuucagaugaggguugaaugaguacagggaaucccaaaggugaucacauugagauuauaagguauucagaagucaaaucuugggggcaggguguggucgcucacaccugaaacuagcucuuugggaugccaacgcaggaggacuccugaagucaggaguucaagaccaaccuggguagcauagcaagauccugccugucucuauaaaaaauuaaguuaaaaacaauuugccagacuugguagcaugcacuuauagcuccagcuacucaggagcuguggaucucuugagcccaggagucugaggcugcaguaagcacugcacuccagccugggugacagaacaagauccugucucaaaaaaaaagaaagaaaucaaauacuaggcaugggucagacauagaagucaguuaggacuagaugacccuaaauuauuggcuauuuuuuccuauugaacugaaacuugacaaaguugaaaaacugucagauuuuaagagcaaacaggagagaacuuuguuagaagaguugcccagaacugacaugaccaauaggucauaaauugcaacacagggauuuuuaucuauacauggcucaagcauugagacuuaggaaucucaucaaggaauaccuugauaccuguauugcuauauauauauuuaaugagauuaaucuauaccccaggcauccaaguuuuugaaacuuuggacaagguuuaagcugcuuuacauuuauacugucugguugcauaggguaagcuaaagguuguaucaagauaacagcaucagagaauuuacuucuuuaaacauuaaauuggccacacauacauggcuagcaaaacaccagcaaaucaauauaucauggcaggauagauuguugaaaacaguaaaacuguauuucuuuuuaaaacauugccauuuagacauuuaauuaauuuucaauuuaaaucagaaucuuuuuuccaaucaaaagaguuugaauuaaauauuuagaaauuauagugcuuuggguauuccugauuuagaauugucauguuaauuaguacuuauaaaguugugagugggaaauuauuauucaucagaaagaugaagcacagcucuuuggcacugccguguauuacauguuugagucuguaugcuccucagguuauugggaagcauggcacugucuaaucacuaucguucugaagauuuguuagacgucgauacagcugccggaggauuccagcagagacagggacugaaauacugucucccuuuaacuuuuugcauacauacugguuugagucaguacauagcaguggaagcugcagagggccgaaacaaaaaugaaguuuucuaccaauguccaguaaguagaacguguguuuaaauauggcauuaagauguguucugaugguuguauaaaugcaugcauuagguauuuucaggauuguagaauggguauagaauauuaugcauuuuaguuauagaccucucuaacuagaguuaauauucugacauaauggcauggaacccaagagaaaacuugacaguuggacauaaaaaacugguguauauacagaggaaaagcugcaauuugucuuaagguauuuuaaggaaaauuaaugaggagcuuuuuguugaaguaauuaauuguaauauguguuucagacuuuccaaaaauuuagccuuugaacauccuuugauucaugcuuugagugcaauagaaacuuuuaaaacuuuguucaguggguauuugauguaucgaaaaauguaguucuuuuuuaggagacuuuuauuguuuuaauguaaccacagaaaauaugguauugguuucauuuaauaaaaaugaaaaaauaauuuucaguuaucaguaauuucucaguuacacaaccucugccuucauuuuugccuagauaugaacuuuuuacuuaaaaaaggaauuuaaaauagaaaauucuaaauuuuggcugggugugguggcucaugccugugaucucaguacuuugggaggcugaggcggguggaucaacugagaucaggaguuugagaccagccuggccaucauggcgaaaccccaccucuacugaaaaaaaacacacaaaaacuagccaggugugguggcgcaugccuuagucccagcuacuuggggaggcugaggcaggagaauugcuugaauccgggaggcggaggucauagugagcugagaucgagccacugcacuccagccugggcaacagagcaaggcucccucucaaaaaaaaaaaaaagaaaaugcuuuucauaguugagacaugugacucuauauaacauuuuacauauuuaaagagcuuuuauagcuuuaacuuuuuaaagcauuuucauacuuuuuaucucauuuuuuuacuugaugucucuguaagguuguaggaugguagcuuggucucuccauuuacugaaagaaaugaguaaccuagaacuguucggaucucuugacucugauucagaacccuuucuucuaggauaacaagccauauaucuucuuaucucaacuuuauuuuuaucuguuuugccucgucuccagggaaagauacagauaaugaacaaugaaaaauuaaguaaaauguguuuuuaucgauuguauucuuuuucucaccuaggaccaaauggcucgaaauccagcugcuauugacauguuuauuauagguaggaaagaaaaaagucuuuuuucccccuucuucuucuuccuggauauaauaaaaaaauuaaaaugguaaaaacuuuuucagcuacuuuagcagcuggcaauuucauacuuggauuucuuuaagguuugcugguuuauaaaguacugcaucuagguuuucauuagaaccguuuuuguauugaauauuuuuaauuuugaaaaaagcuaguccauauacaaucucaugcucugaggacucuucuauaaggcaaugaaauauguagaagugcugugaauguguauauauuuuucuuaacaugcacauguauuauucauuauauucauguauaauuggggauacagauauauaaagcaacuuuaaacuuuuucucuuuuggugcuaaugcaguagcauuaagauacuaagucacauuagagaccuccaaagcaagucuuuagggacuaauauaaacucuaugccuuauaaacuccuugguacaacuaguuuuucuuggccuuaaaagaguauuucuuauagguuuugagaacccuucaauuuguaaguaacuacagcucaccccuuugcuauuuaucccgucuuggcuuguuuggauuuugaucauccagagaagauuccuccagacuguccauuuugcuuuuuaaggguacugacugacauauauuaaacaucuacauauaugaauaguaaagaguccuuguagacugaggcauuuguauucacuucugucuucucauuggaacuuugaacaauguauaagucucuauuuguuccauacuauggcacauuccacguucaugguguacuucauaauaucaagaucucacucuuaccuaguaaguuauaaaaagcuuuuaaauguagguccuagguuucagcucacucugacucauguggucucugguuucuaaguuaagcacucucuggagguuuuuccugugcucauugcccucguuguuauuuuugcauagcacacacuuucagagauuaccauaguggcugugguccagcagugcuacucaguuuauaaauggaaggcagcugagugcuaagguaagcugcugcccagccucugugaguuccuuacucuuaguuuggugcucgucugacaugguauguagaaccucaccacuccagcagaguacuaagguguaauaauacuaugccaguagcugggauuucucuuaaaaugggagagcaaagcaaaagauugagagacacugagaagagaugaggugagaaguuaaugcagggaggaaggaugaaaaaggagcuuccuuucagcugccuugauaaagcuccagaaccaucagagagaccccaacacaugggcuuacuuuaaaagguaaauuaccuuagaacauauaaauugcaucuugauucaacuaaguuugcuuagacugguaacacacaaaauggcauauccugguguucaguguacuaauaauagauauuuaagaaaccuggaaucugucagauaaguuuaguagugaaugcugccuagucuguccucaucuuaaagaauacacucugguacguauuguaauaaaauaagguagauuaaaauacaccaugccaauuuuuuuuaugcaaaccacaaauuuguuuuuaguuauauaacuuuuuuccacaaaauauacauauauaugauuuuuaaaaacucuuucagagaaaguacuagugcuaaaaacguaaaauuauaccuucuaugaauuuuaaugacauuauuuauauaacuucuuaauaucuuacucaaaguagguacaugaucagugaaccuugaauacaauaguguuuaauaaauauugggucagaaugggucauuaauagauauugaggaaagagccaacuauuauaguuugccuucucucaguugaugccuuuuaaaaguuuaaagccuuguacccuuagauauaagccaaauuguaucuuuuaucauucccuaaauagaauaauuaguaaacacuauaaauuuagcaucugacauucagugugacagaguguagaaacuggguuaauugaaaccagauuacaaagaaauucauuguugaacaacauuaauuaaaggacuaauacauuccaggcacugagauguauuaacaguaaauaauggggggucugacagaguuauguuaaauauuaccuagaagggguaaacauuauuaauucauguaaauacuuguuauaauccaaucauuagaucacagauauauggucuggacuagacuguuccaguaauccuuuucugcuuugagcuggucacuaagaagauggaggaccgcugugcaauuaaaucuauaguagugugcaacuagaccacuuugggauuggcccgaugcacagaacuccacaaugucaugucccugguagauguccagacugagccuggcuucugccaaaauuuugugcuugagucaggauguaccuggaccagggacgucugagaauaggugcugauauuuuucuuguaguuucuuccuagucauagcuguauuuucuuuguucuauauguucaauaaauuacagacagaaggcuuuucauucuuguaccacaaugaauuaaaguuuaaaauuugauuaauuauaaguguaaaaaaauagucugaaggucauuggaggauucucuaacaauaguuggggggaugaagagggggagaaucccaaggaaauaagguggauagaauugagaauagaaauugaucuuauaaauaauuaguacaauuauaucuauaaauguuucuaguuuugguaucacauucuaaagcauagaggaauuacaauuguuuccuguauagauuuuacaaaacuauuuguucuuuucuuuuuuucucccuuuccugcuuuauaggugcuacuuuuacugacugguuuaccucuuaugucaaaaauguuguaucagguggcuuccccaucaucagagaccaaauuuucagguauuuuauuuugggucuuuuuggauugaaaugauuguaaaucagagaaaaaugauaagucacagaucaugaaaugaaguuucccaagaagguugauaauagaaccucucuauugagguugauaauagaagauugucuucagucucacuauuuuauucucacuuuaaagccaaacaucuaaaugcuuagacaacugguauuuuuccuauccagaagaaucaagaaaaagcugauuuugauuuagaaacuauggguuaauaguaucuauauaauuuauuuuugaaaaacaccaaaaaguuauuuggcaacugauagauuuauuaugaauagcaagucgguaacuguuaauuccuggcaaauauuuauuaucucuaaauggaacauucagguauuguagggaguacuggagguaauacugguucauaauagccugguuggcagaaaugauagauugauuauacauuagaggcuucugagaacagcauacuugcacauuuuuauugucagagccaucauuuagcauuggacaucaugcagcuggguuuucagaugucccaaaaguuuccuuagcccuggaaacugaauaagcucauuuuuguuuccaagcuaauuaccaauccguuauuugaaccacugaucauugaaccuugauugcugucauuacugauccagagucaccaagguuuuguaguuuguuucuaguuuccuucaaaguuuaauaggacuauacccaaauauuauugaacuuuucugggucugaaauaugauuuaaauuuuuuguccuaaaguauaaccuauuuugcaucguaucuuuuaaauccuguaguugauuuuaaaauguuuaauuuuuaaauuaccuagauauguucacgauccagaauguguagcaacaacuggggauauuacugugucaguuuccacaucguuucugccagaacuuagcucuguacauccaccccacuauuucuucacauaccgaaucaggugagaauuuuaaauggggucaccuuucaguuaauggugggauauauccaauggacauguugcuauugucccauuugacaugauauguaagacacauuuugaaagaacuugcugaaguuuggaggaagguggauacauuuucuacaagauaguguucauggaggacuuugacuucauauuaaccucuaaguuaaguuauuucuugaaaauauacuggguaucaaguauugugccagguacuguggaaauggaccacuaaguuguagucgucauuaaagcuucaaguuguaaugcauucuagaagcucucaaauugccauaauaaagucaugcauuuuaaauuucaucuggccuauuuauauucaauuaaaaaaucuaauaaauguguauugagugcuucauggaugucagacauaguguuagacauugaauuuuauuaaauaagaagcaaauauuuuaaauuuacguuaguuagaaguauucugugcuaugacacaaagauaacucauugcccuaagggauuaaggauacugugcuuuaaaauauauuuuuauauauuuuauguaauauauaaguauauuuuaaaauacacauacaugcauauaugcauacuggaaguauuugaguaaaauauaacuaccaggaagcauccuaggauuuagauacuguaugcaaccuuugcuauauccaaauacacauguauagauauuugucguuuacuuguuugauuuagauccugccuaggauugagaugugcucaaaauaaaaauaccaacacauacuuauaggguacucaaagugaaaauaagagacaccagauuccuagggaaaggggaaagugauagcauugggaaacagagucaaaguguaaucccaggcuggacacgguggcccacgccuauaaucgcagcacuuugggaggcuaaggugagaggauugcuugaguuugggaguucaagaccagccuggacaacauagugagaccuuguccuacaaaaauuuuuaaaaaaauuagccaggugugguggcacaugccuguaguccccagcuacuagaggagcugaggcggaagaauggcuucagccuaggaggucaaggcugcagugagcccaagauuacaccagugcacuccagccuggguggcagagugagacccugucucaaaaaaaaaaaaaaaaaguguaaucccaguaacuggugacaucuugucuuaaacugucuagaaacuaauggaaaaaagggaaauggguuguauagucucaugcaguuaaagagagacuuucaguucuccggaaguuuuucauggcacuauuuucuagaaagcauuugccaaauugaucuuuauuugaacagcgaaagauuguugucaccauuauguugcacauuuuauguugcccuuucuguuguugauccacacugacagucaaaugcauaaguugagugaaagcauuuuuguagggggaucaaguuaaugaagccaguaucuuugagaacuuagaaaaauagauggcuaacauggacuuuggguuggguuucuuaauuuuuuggaaauuuuucuucauaguauuagccugaauacuguaucucuuaaaccaaagaaacaaagaagccagauuuuugucucuaccaccccauucccuucucuaggauugaaaugucaaaagaugcacuuccugagaaggccugucaguuggacagucgcuauuggagaauaacaaaugcuaagggugacguggaagaaguucaaggaccuggaguaguugguauggaacccaagauuuagguuuauacauuaauuccuuagaagaaauguuagacuuugcauccuaaauauaacauauaaauguauaaaggucguuauccuauuaauuuaaucccuuaagcauuaacuuuucugaaauaauagcaaacuuaauuauucagggauugauuucccuuuuuguggauuuuauuuuauuuuuuuuaacugguucauuauucauuguauguuguggguuagaacacauagggcagaaagggggaaauaaauuuuguauucgucauguuuuuugaagcuuggggggaaauguuaaaauuaauggcaugaauuuuuauuguuuguagauuucagucacuuuaauucugguuaccauugucauuuggcuuucuuaaagauuaugauuaucugaagucucugagcccucagaugcuucagguuugaauauaugcuccaggaaaauaacauauuuaugcuauguacuucuguuaucaguucuaagcauauacagaauucaguuuaacguuuucuaaauucauugccauggauagaucuacauguuuacuuaacaaauuuuuuuccugggcuucaguccaggaauuuuuucuggaucuagcgcuaagagagaggcuuuauuaaagccacaguucuuuuucugccauuugguccagugguauaaggacucucccuugugagugccauuuugucuggucugaaugcuuaggaugcaucuucacaauuuuauguuuuuguuucuugcuacuuuaaaaauauuuagauuaccuuaucuuuguuugaacuggugucugugaugcuuuuuauuacucaugucuuaaagguugugucuucaaugccucaaagcuuuuugaaaaagaaacaugccuguucuguuuuuuuuuuuuuuuuuacuagauacuucccacuuucuacauuguagggaauuugaggaauacauuaaaaaaauguugagagggcuaagcgcaguggcucacgccugauaucccagaacuuugggaggccaaggugggcggaucaccugaggucaggaguuugagaccagccuggccaauguggcaaaacccugccucuacuaaaaauacaaaaaugagcugggcaucauggcaggugcuuguaaucccaguuacucaggaggcugaggugggagaauagcuugagcccaggagguggaguuugcagugagcugagaucacgccacugcacuccagcgugggcaacagagcaagacucugucucaaaaaaaaaaaaaaagucaagaggaauaaaauaccuacucauuguccuaucacuguuaacauuuuguuacauuuucuuuuggaauuuuuuuuucuaacugugcauuuacuauuauauaguuuacauaaugccauggagaccauaccuuauuuauuguaauaaagaaaugaauuuuauacuuugguuuauuguuacuguuuucccugcaggugaauuuccaaucaucagcccaggucggguauaugaauacacaagcuguaccacauucucuacaacaucaggauacauggaaggauauuauaccuuccauuuucuuuacuuuaaagacaagaucuuuaauguugccauuccccgauuccauauggcauguccaacauucagggugucuauagcccgauugguaaguuaaauuuuccucuagugcugauuuacaugacuuuguaggguuaacacugcagauaagccaggcaaauaguuaguuuauaaauaguguuccagagaacccuagagauuuugagaaaguaucuugggggucaugugaauuuguugagagaaauggacaaguaaaugaggcuccauagucucuaaccagagaauuucugcuguuuuaaagauucaacuuguuuuucacuguucaguggccuaaauguagauuaugagaaauaccacauuagaccaguagaaucagcuuuaagacugggaaaacaacuucuuacaguguuuuugcucaaacuuccaauuuaaugucaaauaaacaaauauuccauaaagaucauuauaaagaaaauuuaauguguggauguguacuuuuggcagucucucugggaucauuucuuaagucaacuagguauauuuuuuaaaaucucguuuuuaggguuaccuuaugacaaguguaacaguaacuccaaccuuagagacuauaacaugauuaaagaaaguuaugaagcuccaguuauacaauggggauaaaauaugaauuauauacccagaaugcaauugaguuguagguguugaaucuuuggaaaaugcccucuagcuucuggaaugacccugauggauggguuuaaguuuggaaagauggacaugauauuaaucugauccagagcugacacauuuucaacuccaguuugaaaagagaaggaugauaaugagacuuugggccauuaccuguguggcauaucuagugaaaagaaucuacagugugcguuuggaagugaagauuuagauuucuucccaguggaggaaugccagaaacuguauuuccaguacugggaauuugcugcuuugcauaacagaauuccuuuuuugacuggcccaguaucuguaugaguuuggaauaaucuuuucccuaaauguuugauaugauucaucacugaaguuaucuggggcuagaguucuguuugugggaaaauuuugaaauuugaauuuaauuucuuuaauauucauauuuucuauuucuucuuguuucaguuuugguaauuugugccuuucaaggaauuuguccauuccaucuaaauguugaauuuauugguauaaaguuauugacaguauucccuugauauccuuuuaauggcuacaaaagccauagucacuuguccucuuuuguucuuaauauuguuaauuuauaucuucucuuuuguucauugcuuuaguuagggguuuguaauuuuuauugaucauuuaaaggagcaacuuuugguuuuacuaauuuucucuauuugcuuauuuucuaucgcauugauuucugcaguuaucuuuauuucuuuccuucuacuuugaguuugcuuuucuucuagcuuuuuuaagguagaaguuuauauuaguaauuuuagaacuuuucucucuccaagcacuguuuuagcugcauuucacaaguuuugauguguuuucaugaacgcguaguucaaaauagugucagauuucccuuguaauuuaauuuugaucuaugacuuuucuagaaauguguuaauuuucaaacauuugggggaguuuucaguuaucuuuuggcuaucgauuuuuuaaauuuauugugguuagagaauuugcucuguauuuucaauccuaaauguuuuauggcccaaaauuaugguuuaucuugguaaaugauccuuguauauuugaaaauaauguacauucugcuauuuuggggaauauuacucuauaaaugauaggucaaaucgguugacaguuuuuuucaagucuucuguauacuugcugauuuuuuuuuuuuuuggucuuuguccuaucaacaagugagagaugauuguugaaaucuccaaauauaauuauaguuuuuuguuucucuuuuuaguucugucagguuugcuucauguauuuugaagcuguauaauuauaugcaaauaugcuaaggauuauuauguauuuuuaaugacauaauucuuucaucauuaugaaaucuccaucuuuaucgcugauaauauuccuuguccuaaaguucaaagagcauugagguguguuuuggcaggcaguugaguuacuauugggucgacuugauccuuuggaaucuuguuuguuuuuaauguuuguuaggguggguguaaaguugucuuuauuuaaggacggugguugucaacuuucagucucaugacccccugaaacucuaaaaacuuauugaggacuccgaagaauucuugcuuauguggauuguauuaaugcuuaccauaucagaaauuaaaacugagaaauaaguaaaacaauauuuacuuauuaguuccuuuucaaaugacaauaauaaacccauuucauguucagcucucucuuaacuauguucuuucuuauuaguuuucguuuccuucuaaccacaaauaaacauauaaaaucuugaccugccuuguggaaaauguuuucucucaaggaugagaaauaaaaugagaauucuggacuuacuucuuaucaacauuaaaaaagccauggggguuguauuuguugaccuuuccuguuuguauauuaguuuucugauauggagaauuguucugcuuuuucguccucuaccagucugauuaauucguaggcuuaacacuuccuuuuucuuucuccuuggaaugccucuugggauaugcauuaguuggucuuaugucuuuucuuggucuaggugguguguguguuuggcuuguuuggggcacuuuuagaggcuccagcugcacauuuccacuccucucuguguguuccucucugcaucugcuguuuguguguguacacuuuuuuucugagcaaucuuucuccuuagccacauugaguucuuuaacaguuuuucuguuuucuucuucauuaagauaauuaauaaucauacuacucacauaucauguuuuagaacuuccuaagccuuucccuuucccaccuuuuggaccuccuaacugaauuucaaagucuucauuccuuagauuaaaaaaauaaauccaaagauaaaagaauguaaugucuuauaagucguaucaguguauauuuucucuguuauuguuguuaguguuauaauaaauccuaagugacacaauuccuuucuccuacauuaauucauuugcuuguacaacaacuauuuauugagcacugugauuaacaauauaaucaaauucccugccuuggaauuuacauuccaauucaaagagacaaacuguaacaauaaacacuauguccuuauauuaaguaguaauaagugcuguggagaaacagcagaguaaaggggauaaagaacguauuguuagguuguucuaauauaaagaugugucaggagaggccuuggugacauuuaagcugaaacgugaaaggagcagagggaauuagguggauaugugggagacgagaggucgaagcaaaggagcagcacguguggagguuccgaaacaguaaugugcuuggugugcuugacccaaggaggccaguguagcuggagugcagugaacaacagggagaggggcuggagauuagaucagaguguuaauggggugguggaucacguaacaccauaaaagccuugguggaaggacucuggcugacaucacgccccaaguugccccauacuuuccagaauaccaaguagguccuugcuguucagaauucuguucaauguagcagccccucccauugcgucuucaaaugugugagagagaacauugacagcagaguaagucauggcuugauuacagacauugcaugggcagaauugacauuuccaagagauauucagaugcauguucaacaucacuacuguccuaaucugagagccuccaacaagguaauuuuaaaauagaggcugucauuuccuuccaguguggguugaucuuagauauauacuuauaacgaaucggcaaagugacacugugauuucugaguuagaaaaagguaauauuccuucagccuaggguucugucuuucucuccugggacaugugucuuugacacccugagccaccauguaagaaguccagcuaccaugaagccgucaugcagaagagaccauguagagacaucacacagagauagagggaggcacccaggagccccagcuguuucagacuccagauauuuggaucauccugcgcggguaccagacaugugaaugaagaagcucgugagaugacugcaguuccagcuaccaucggacugcaacaucacgggacaccccaacccagaaccaccccacugaauacuucccaaacaccaacccacaugaaccaugagagauaauaaugacuguugcuguuucaagccacuaaaaaaauaaaaauauuuuuuuaaaaaguagaggcuacugaugguugaauugaaaugaugugucuuuaugguaggagcucaauaaaaaucuuagaucucuuguugacagugcauaaaaguuaccaguagaggucauacuugauuaauauuuucauauccucuuuucuguaaguauauagcuuaauaauuauuauucaguauaugaauauaagcucaguaaaacuguaucuuggauuguuacaaguggucuguuugcuaccuucugugaauuaccaacuacuguguaaaaaauaaguacuggcuuagugaaauauuuaccauuaaaaccauacugagcugggcugggucgcaugcaccuguagucccagcuacucgggaggaugaggugggagaacugcuugagcccaggaguuugaggcuagccuaggcaacacagcaagaacucgucucuaagaaaaaauaauaauuuuuuuaaaaagaagaucuuccauuaaacaacaacaaaaaaaucacacugagcauuauuuaacacaagauauagaauccacuccagaaucuugcaucagcauguguguugugagaauccacuguucaagucuauggaaauucauauuuggcgugucugguuguuugaauucuagauaaaugagaauuuacaugaaauaacuaaaaaacugauagaugcucuucuuaucaaaagauuguuuucucuuucaaggaaauggguccugaugaauaugaagagauggaagaagaggaggaggaggaagaggaggaagacgaggaugaugauucagcagauauggaugaaucagaugaagaugaugaagaggagagacggaggagagucuuugauguucccauucgcagacgccgcugcucacgccuuuuuuagcaagccuucugcugauggaagcacuaggaugauucuaggcuguuaaauagauuucucaauaauguaaauaacuaaauuguucucugcauauagcaggaaaacuagcaugaaauauuguuucaggcccuggguucuaugugacacuacauuaggaauuggauuguuuggguuugcuuuguguuuuugagguagaggaagaaaugggaaucuuuuuuuucucuuccaggagucaguggaagaauaguucucuagcuaaggaauggacauaccuuuguuuuaaaauauuuuauacuuacaaaaaucuagaaauggagagggaacuguuuugaauaaggauuuaaaauaccugcacaaggauagagagaaacuaugugacucauucugugaaaagacuucuugcaguugugaguuauuuagaaaugaucaaaauuuguaauuaggcuaauccauuuagugauuccuaauauuuuguacucacagagaacuaauugacuaaacaacuugaacgcuagugguuuguccuuagacaaucugucuuugaauuuaaagucuuuaucgcuaagaccuugacuuuaaauuuuucaucacuacaaccuugaauuuaauuucaggucuucaacaugaugaccuuggauuuaauuuaaagucuucaacacuaugcgcuuuaucauauuauucacagaugcauuuuugaaauguaguauguaaaaguauguaacgugcuguuuauuaacaaaagauuguucacaacaucucauguaguuuaaauuuguaaauacugcuucuguuuuguuucuccuuuauacacuugacugucuuugugauaagugacaugaauuuuauguuaggauuaaguauguuuuccugaaacuuggauuuuuuuuguaauuauauaauugagaguuaagaaugaaauccuucaaguguuaaaaacucacauuuuaaaagcaaauuuugguuccaauucuguauuuuguauaauugcuuauuuuccauaaacuaauauuagucagcauuugcuuuuaagguagaagaugggauggauucuugcugaccugcugcaaaaguagcagguccacucaaagucaucuccuagcuuugacuguacugucuugugugccccaccauccauuuucccccaagaacaguuauuuuauagagaaaacuguaagaaaacaaguggcauucaaggcuaagcagcugccauuagggaacaugaagacaaacuuauccuuucauuuucacacaugucaagguguucugaaauagacuaagucauuuuucauguuuacuuuucauuuaauagaguauaaucaggcuaucaaauccuauuauggcuauccuuuuuuuuuuuuuuuuuugagacggagucucacucuguggcccaggcuagagugcgguagugugaucucgacuuacugcaagcuccaccucccggguucacgccauucuccugccacagccucccaaguagcugggauuacaggugcccaccaucacggccggcuaaguuuuuguauuuuuaguagagacaggguuucaccauguuagccaggauggucucgaucuccugaccucaugaucugcccaccuuggccucccaaagugcugggauuacaggcgugagccaccgcccccggcggcuauccuuuuuagaaaaaaagucaauugucuuuauuuaguuuguuauaacaaaauaccuuagacugagucauuuacaaacaauagagauuuauugcucacaguucuggagggugggaaguccaagaucaaggcaucagcaaauuuggugucugguaaguacccacucucugcuucaaagauggcaccuucuugcuguguuuuaugugguggaaagagcaaacaaacuuccucaggccucuuuuauaagggcacuaauccccuucaugagggcagagccuaaaggcccuaccucuuaauacuauugcuuuagggauuggauuucaacaauuugggggaacaaaaacauucagaccauagcgucaaaccacuuaauuuuuucaaaaccgaacuuuuccaauaaagcaguaaucaaaaacuaguaaaucuuggcaauuaaggcuggcccuggaaucccuugccauuuuuucuuucucuuuucugaugaccucucucucuauuuccagaguacuuaugaugccccaaaucucccuuccaacccugucuaaccuuugcuccucagaaugcuuugauuugcuuuauccucucaucagaauucacauucucuuaguauguugaaugagugaccucuaguucauacugagguguaguuuuuuguuuguuuuuucagacagucucgcugugucucccagacuggagugcaguggcaugaucucggcugacuccaaccuccgccucccagguucaagugauucuuaugccucggccucguggguagcugggaucacaggugugcacuaccaugcccuuuuuugcauuuuuaguagagccaggguuucacuauauugaccaggcuggucucaaacuccugucuuuaagugauccuccugccucuggcucccaaaguguugggauuacaggugugagccaccgcgcccggccuaacgugaaguuuguugguaacaagcuucuguauuuucugcuauuggcaagaaugcuuauucacacguaacaggaauuuaacaguuggca

SEQ ID NO: 13307 - RNA, 1282 nt, Homo sapiens
cuccuguucuacagucagccgcaucuucuuuugcaucgucagccaaaccacaucccugagacaccauggggaaggugaaggucggagucaacagauuuggucguacugggcgccuggucaccagggcugcuuuuaacucugguaaaguggauauuguugccaucaaugaccccuucauugaccugaacuacaugguuuacauguuccaauaugacuccacccauagcaaauuccauggcaccgucaaggcugagaaugggaagcuugucaucaauggaaaucccaucaccaucuuccaggagcgagaucccuccaaaaucaaguggggcgaugcuggcgcugaguacgucauggaguccacuggcgucuucaccaccauguagaaggcugggccucauuugcaggggggagccaaaagggucaucaucucugcccccucugcugaugccccaauguuugucaugggugugaaccaugagaaguaugacaacaaccucaagauugucggcagugccuucugcaccaccaacugcuuagcaccccuggccaaggucauccaugacaacuuugguaucguggaaggacucaugaccauaguccacgccaucacugccacccagaagacuguggauggccccuccgggaaacuguggcgugauggccacggggcucuccagaacaucaucccugccucuacuggcacugcgaaggcuaugggcaaggucaucccugagcugaacgggaagcucacuggcauggccuucuguguccccacugccgugucagugguggaccugaccugccgucuggaaaaaccugccaaauaugaugacaccaagaagguggugaagcaggcaucggagggcccccucaagggcauccugggcuacacugagcaccagguggucuccuccgacuucaacagcaacacccacucuuccaccuucaaugcuggggcugucauugcccucaacaaccacuuuuucaagcucauuuccugguaugacaaugaauuuggcuacagcaacaggaugguggaccucauggcccacauggccuccaaggaguaagaccccuggaccaccagccccaguaagagcacaagaggaagagagagacccucacugcuggggagucccugccacacucagucccccaccacacugaaucuccccuccucacaguuuccauguagaccccuugaagaggggaggggccuagggagccccaccuugucauauaccaucaauaaaguacccugugcucagccaaaaaaaaaaaa

SEQ ID NO: 13308 - RNA, 1454 nt, Homo sapiens
ggaagauuaaaccagccuucugcaguggguacucgucagcaaaaauugacaucagcauuccagcagcagcauuugaacuucagucagguauguucauuuguggauauguaggagucugugggauucaaauuuagcaguuguuuuucacguggaggagaaagcuucugaaacuguauguaguguuaaugaauuuuucccuucucauuaucccaaguggcuaaagaguaacuggcuuaauaauaggauaauuaagcaaauuauccauagaacuuguagccuuuuucagaaagauuaaguccuuagguucucuuacauaauauuaacagagugugucuguuaucucagaacaucauuaaccuuccugaauacuuuccaucuuauucaacacuauauuuggcgguuguguuucaguugggaaaagaaaagaucacagauacuggaguuggacggggauucaaaucuugguuuugccauguacuauauauauauauuaccuuggccaggucuuuucaacaaaucugauuuggagcacaguuaaugggaaucguaauuauaucauggguuguuuuagaaguaaauaacauuguguauguaaauguuagcuuuacauauaagaagugcuccacaaaugguagcuguuaguagugauggggauaguaauagguaguacuagcagcaguaauagcaguguuuauauuauaauaauauguaguaauaaauacuaaaauguuaauacuaauauauauggaauugauauuuuucucuccucuaguuauucuuaguauaaguuaguucugagagauccacuaugaguuaucaaucacaaaggguauauuguaauuucccuuucuuucuuuccuuuuaucuuuuaagguauguuauucagucauuuuuuuuuuuucuuuguggauagguucagcacuuuggaucugggcaucaagaguggaauggaaacuuugggcacagaagacagcaagcuuauauuccuacuaguguuaccaguaauccauucacucuuucucauggaagucccaaucacacagcagugcaugcccaccuggcuggaaauacacaccucggaggacagccuacucuacuuccauacccaucaucagccacccucaguagugcugcaccaguggcccaccuguuagccucuccguguaccucaagaccuauguuacagcauccaacuuauaauaucucccaucccaguggcauaguucaccaagucccagugggcuuaaauccccgucuguuaccauccccaaccauucaucagacucaguacaaaccaaucuucccaccacauucuuacauugcagcaucaccugcauauacuggauuuccacugaguccaacaaaacucagccaguauccauauaugugaaaaacaguauauuggggaagcucaaugauacaaacauuugauuaaaaauaaaaacaugguauuu

SEQ ID NO: 13309 - RNA, 2021 nt, Homo sapiens
acacacguaccagggcaugugugcaagaauguucgcagcaguaaauaaggcaaucugaugaagaaaucaggguauagucacccauggaauuauaugcaauauggaaaaaggaaugaacuaaaaaaauguagaugaaucuuaguaacaacguugagugcaaaaagaaggaagucucaaacuuuuuuuuuuuuuuuuuuuugagauggagucucgcuuugucacccaggcuggaguguaguggcacaaucucggcucacugcaaccuccgcuuccuggguucaagcaauucuccugccuaagccuccugaguagcugagacuacaggcaccugccaccacacccagcuaauuuuuuuuguacuuuuaguugauacaggguuucaucauguugggcaggcuggucuccaacuccugaccucuggugaucugaccgccucagccucccaaagugcugggauuacaggcgugagccaccacgccuggccugaagcucuuuuuauaaaguuuaaagcaaugaaacuauaaacaacauauugauuggguaaaauauauacaagauaaugcuauacuuuuaaaagagaaaaagcacuuuacauuguuuaggucuuuggaucugcauaugucccugagguaaguauuccagccaugggaaacugaagcacagagagguagucacccaccaaagcucagggcuggccuccagagcuugaacccuugccugagcuggggucaccagccugggugggccacggagcgaucaucauuucuccaucugaucggaaagucacccaccacucuguucuggggcccagcccgccuggcuccaggcaggcucggaggccgugcucuccuggaccuggugcaucuggcugcagccagcacugggcaggaaaauaccgcuggagcagugccaggugcaggacguccccacuaccugcuuccuccugggucuggagggccaccaugagcccacaaucccggccaggcccaagccgguggcugaagugggcagcugugucuagaaguaaggcaaugagguaggcggcuuccuggggcucugggucuuccgcuagguacucuucuaggccgucgagcagcagaagggagggggcuggccccggggccucaugggcagagcacaggagccggaaaagcucucggguugaggguggguacuggaagcggaucuucuagaaggagaaacagaaggaaagggccggauucagcacaggaagccagacuccuuaaaaguaacccugccuccuugcauacuuuccuugguuccaggaugaaccaguucagagcuguuaaauauucuuauauucgcccguuuuuccagcacucaucacugccgaguauuaguugagggcaagccauuuuugcuuguuuguuuuuggccaaaucucuagcgcaauuuuuccacggaaaacccucccccagcauucucggucugaccccauccuugacacuaacaggaaccaacucagguccagaauggacccaagcuuagccccgccccuugaugggccggacuucaaucucugggcaccgccucuugcuaacaccgcccaucauuggaugggcucucacuucaaucuuaacuaagcuccgcguggugccacuccucacuccgccugccugacuccgccccaucguggcugcccuggcucgcucuuccaccguccucuccauuggcuugucuaccuguuacucaauaucccggaucuacuccaccauuggcuagaacgccucugcucccacccccacgguuaccuggagucgcauugggucuagagucguuccggucccgcggggcaugcuuugaagaggccuucgugucaggaagaggacugggccuuggcccucccccgccgccucuagggccgcagcaaauagcagcgcuguuuuuccagauccugguguaccgagcagcagcaaaggcgguccggcggcaggcauguucuccuccccggaccaggccgcaccgccccugguuagcacccgccucagcgucuccgccau

SEQ ID NO: 13310 - RNA, 10456 nt, Homo sapiens
uauauucggguaaccgaagaugagaacgaugagcccauugaaauaccaucggaagacgaugggacggugcugcucuccacgguuacagcccaguuuccaggggcgugugggcuucgcuacaggaauccagugucucaguguaugagagguguccggcugguagaaggaauucugcaugccccagaugcuggcuggggaaaucugguguauguugucaacuauccaaaagguuuguuaccauuugguuuuuguaaucaugcugaaguguguucaggugugugucucauccauggaucuuagccucuuuugguggcagaaugucuccugaaacuuaaguauuuccuugaacuucaguguuagacaaguuuggaagaccacgagucuaaauuuauggaaacuggggauuguagaucauuuuaaaagagaaaacaauguauuuaaaaaauaucugaauaaacuuugccaaguugaugauaaauuucaggaaucacuaagaauguuuuguacauaaaucauuguuguaaauagauucuucugaagugcuucaguguuuggauuugaucauuguccuuuugguguuacaucauucauucagcaaaucugaguucauuuuuucccuuaaaugagcaaacaguuggaguagccaaaucuugaauuagugcaguuccaauuacaauuucgagguucuggucuuauccuucucucugccucuuaucaaugauguucuaaaucuaagaaaaggaagcaugaaguuuaagaagugugccaaggaaauaccuaauuucagcauuuugaaguagugugcuguuaguagucgaucugucuguguguuccuuuuauuauaacuugguauugcaacaaaguccaucaaauuuggucaguaugcaagacacccuuuuacaugucuaggaaaacuuuagggcuaggcacggugacucaugccuguaaucccagcacuuugggaggccgaggcagguggaucaccugagaucaggaguuugagaugagccuggccaacaugaugaaaccccaucucuaucaaaaacacaaaaucucuggaugugguggugggugccuguaauacuagcuacucaggaggcagacgcaggagaaucgcuugaaccgggaggcagagguugcagugagcagagauugugccauugcacuccagccugggcaacaagagcgaaacuccgucucaaaacaaaaaaaaacgaaaacaaaaauuggcgugguggcgggggccuguagucccagcuagucuggaggcugaggcaggagaaucgcuugaaccugggaggcggagauuacuuuaagcugaggucgcgccgcuacacuccaaccugugacagagcaagacuucgucucaaaaaaaaaaaaaauugauaauguaaacucgggguuuuuaguaugcuguuucuucagccaguggguauagauuaauauuuacucaaauuuaaaaugucaggcucggugcaauggcucacaccuguaaucccagcacuuugggaggcugaggcaagcagaucaccugagguccgaaguucaagaccacccuagccaacauggugaaacccugucucuacuaaaaauucaaaaauuagccaggcguggugguucgcgccuguagucucaguuauuugggaggcugaggcaggagaauugcuugaaccgggagguggagauugcaguaagcugagaucgugccacugcucucuggccuggcagcagagcgagacaccgucucaaaaaaaauuuuuuaaaugucauuuaauuuaucuccccaggcuggacaugguggcucacaucuguaaucccagcuacucgggaggcugaggcaggagaaucacuugaacccgggaggcagagguugcagagaggggagauugcgccacugcacuccagccuaggugacagaaugagacuccgucucaaaaaaaaaaaauuaucuccccuucucuucuaaauaaccuaagguugagguuauuugggggguuuuuuuguuguuguuuguuuguuuguuuuuugagacagucucacucugucgcccaggcuggagugcaguggcacgaucuuggcucacugcaaccuccgccucccagguucaagcaauucucugccucagccucaugaguagcugggauuacaggugccugccaccacgccuggcuaauuuuuguauuuuuauuuauuuauuuuuauuuguuuauuuauuuuuuagacgaagucucgcccuugucgcccaggcuggagugcaguggcacgaucuuggcucacugcaaccuccgccucuuggguucaagcgauucuccugccucagccucccaaguagcugggauuacaggcaccugccaccacgcccggcuaauuuuuucuuuauuuuuaguauagacggcguuucaccaucuuggccaggcuggucuugaacuccugaccuugugauccaccugccucagacucccaaagugcugggauuacaagugugagccaccgcgcccagccaguuauguuuuuuuaaguaagccaaacuuuugguuucuuuuucuuuuuugaaauuagagauggaggcucucgcucuguugcccaggcauauugcaguggcuauucauaggcacacugcagccucaaacuccuggacucaagucguccuuccuccucagccuccugaguugcuggaacuuacaggcauacacaccacuguaccugguuuucuguuuuauuacaaaaguuguguauuuguuguugaauguuuaggaaagauaaaaguuaaaucuucaucaggauauacaaguugcugauauuuaaagucaaagugaaguagaauuauuuuuguuuugauaaaccuuuugagagggagagauuguaauccggaaaugcuacaaaaaacaaacuuggaaaucacugaauuugcaccagaaaagcaccucagacacuaaacuuaagccuuuauucuguccucuagagcaaacaucacuucuugccaaguuuucagugucuuauucuucuuagagucuucuuuuugcuucucauuucuagauguaggagguaguguuuuuaaagaagugcuaagugaagauuucuaaaagguuucugcucguuuuauuuagauaacaaaagaaaaauggaugagacagaugcuucaucagcagugaaagugaaaagagcaguccagaaaacauccgauuuaauaguguugggucucccauggaaaacaaccgaacaggaccugaaagaguauuuuaguaccuuuggagaaguucuuauggugcagguaaacuucgauugcaucaaacaguuuuucuuuaccagugaaugaguaucuagcauuuauuuauugguauaaauagagaugggguaucacuauguucccuagguucuggcgucaaacuccugggcccauacuguccuccugccucgaccccaaugugcugagccaccaugcccagccacaaucuuguuaccuuucuuuuuuuuuuuuuuuuuuggagaccaagucucacuuugcugcccaggcuggagugcaguggcacgaucuuggcucacugcaaccuccaccucccggguuuaagugauuucuccugucucggccuccuguaucugggauuacaggugcccgccaucaugccuggcuaauuuuguauuuuuaguagagacaggguuucacccguuggccaggcuguucuugaacuccugaccucaagugauccaccugccuuggccucccaaagugcugggauuacaggugugagccaccgcgcccggccacauucuuguuauuuuaauggcacuguccuuucuguuacacagaugauacuuccaauauuuguuauauuuauacauauauguuguacccuauguuauugccuuugauauuguaaaauccuacuguugcaugaaggcuuaagggaaguaggugacaauagcuuuucuuuauauauuaaacuaaugggagguuuuuccauuucauuuaaaauuuguaaacauuaaauuuaguuuaucuuugaauucauucuaagacauucuguuaaaauccuguugugguggcucaugccuguaaucccagcauuuugggaggcugaggugggaggguugcuugaggccaggaguucaaggccaccuuggcgaacauauccagacucaguuucucuuuuuucuuuuuuuuuugagacggagucuugcucugucacccaggcuggagugcaguggcaugaucucggcucacugcaagcuccgcuucccggguucaugccauucuccugccucagccucccaaguagcugggacuacaggugccugccaccacgccuggcuaauuuuuuguauuuuuaguagagaugggguuucaccguguuaggcaggauggucucgaucuccugaccucaugaucugcccgccuccgccucccaaagugcugggauuacaggcgugagcuacugugccuggccucucuuuuuuucuuuucuuuuuggagacagggucuggcucugucagucaggcucuagagugcaguggugcaauguaggcucgcugcaaccuccaccuccuggguucaagcuauucuugugccucagccucccaaguagcugggacuacaggugcaugccacuacaccuggcuaaucuuuguauuuuuuguagagacaggguuuugcuguguugcccaggcugguccugaacuccugugcucaagcgauccacccuccucagcaucccaaagcacugggaauacaggugugagccaccgcgccuggccccaucucucuuuuuuaaaaaacucaaaaacauuucuguuguauaagugaguuuugcucuguuguuaacacaguauggauucaauauuaaccuccuuguuuuuacuguuaagacuaacuugguuuaaguuuuaagccacugcauccaguugaaaccauucaaauuguuuucuaaggaacuaugauuugggaauggagugugugaguaugugcacuuuuagaguaaacuuguaucauccuuucuaggucaagaaagaucuuaagacuggucauucaaagggguuuggcuuuguucguuuuacggaauaugaaacacaagugaaaguaaugucacagcgacauaugauagauggacgauggugugacugcaaacuuccuaauucuaagguacuugcgucugugcuuugggaauuuuugccaacaaacuuccuuagaggauuguaagauaaaauguuaaacacacuuagaaaagauagcggcaggguguguucaugaaauccuuuugucuuguugaagucuuuggcccuuagugcaugcugaauauuuuaugcuuguuugaaauauuuaguuuauuacuucuccaaacuaaaccuuuguucauuuuguucuuccuuuucgcuauggauggaaaagagaaaagguuauuugucaaguuaauaguuucuuacauaguuauauguuaaaacauaaagagaaucagaauacauacauuaauuguuauaaagaccuaacuuuuuccaagcaaacaaauaacauuggcuuauuuggaacaucaucaucuuugccaagagauugcuuauuuauuaauuuucucaaauccaaacacagucauguaucacauggcaaaguugaucagucagcagcagaccucguguacagcaguggucccauaggauuauaacacuguuuuuacuguacccuuucuauguuuagauacacaaauacuuaccaucauguuauagucgccuacaguguugaguacaguaacuugaaaguuuguggccugggagcaauaggcuauaccaucuagccuagaugugggguaggcuaugcuaucuggguuuauaugauguuugcacaacgacuuuuuuuuuuugagagagagagucucacucugucauccgggcuggagugcaguggugcaaucucagcucacugcaagcucugccucccggguucacgucguucuccugccucagccugccgaguagcugggacuacaggugcccaccaacacgccuggcuaauuuuuuguauuuuuaguagagaugggguuucaccguguuagccaggauggucuugaucuccugacuucaugauccgcccaucucgggcucccaaagugcugggauuacaggugugagccaccgcaccuggcccuuuuuuuuuuuuuuugagauggaguuucacucuuauugcucaggcuggagugcaauggugcaaucuuggcucacugcaaccuccucuuccggguucaagugauucuccuaccucagccucccaagaugcugggauuacaggugccugccaccacacccggcugauuuuuguauuaguagaggugggguuucaccauguugaccaggcugguuugaacuccugaccucaagugauccacccgccucggccucucaaagugcugggauuacaggugucagccaccacaccuggccacgaugaugaaauuguguaauggcucaugauguauuuauauccaucauuaugugaugcaugacuguguacuuuuguaacuuaaaacguuacucuucacugaagccuuacaagaaaaagaaaugcugauggaaaaaauuaaggguacgucuacuuuuuaaugguucacugcuauccaaggcgaaugauuuuguuauaucccuuaccuuaauguuuuuuucauuguucauaacauauuucugaguuuuuuucuuccuuuugauuugaucagcaaagccaagaugagccuuugagaagcagaaaaguguuuguggggcgcuguacagaggacaugacugaggaugagcugcgggaguucuucucucaguacggggaugugauggaugucuucauccccaagccauucagggccuuugccuuuguuacauuugcagaugaucagguauuuuucuccuuaacgauaugucccggccgggcgugguggcucaugcuuacaaucccagcacuuuggaggccgaggcggguggaucacgaggucaggagaucaagaccauccuggccaacauggugaaaccccgucucuauuaaaauacaaaaaaaaaaaaaaauagcucggugugguggugcacgccuguggucccagcuacucuggagccugaggcaggggaaucgcuugaacccaggaggcggagguggcagugaacugagaucacaccacugcauuccagcccagugacagagugagacucugucucaaaaaaaaaaauaugucccagguaauuagguaauuucucuugaacauugcccaugcagcuaauugcuauucuuagcuaaguuuucugaccuuguaagacguaggguguaugggccuagauguuugugauaccuguaucugauaucacaaauacaacauuuuaagaaaucuaaaaguaaauaugccuuuagauaauuuucaguauguggcauuugggaauguuauauacuuuuuuuuuuuuuuugagacagaguuuugcucuuguugcccgggcuggagugugauggcgcgaucuuggcucgcugcauccuccaccucauggguucaagcgauugucuuggcucagccuccugaguagcugggauuacaggugccugccaccacgccuggcugauuuuuuugugcuuuuaguagagacaggguuucaccauguuggccaggcuggucucgaacuccugaccucaggugaucugcccaucucagccucccaaagugcugggauuacaggcaugagccaccacgccuggccaguuuuuuguaucuuuaguagauaacgggguuucacuguuuugaucuggcuggucuugaacuccugaccucaggugauccaccccccucagccucccaaagugcugggauuacaggcgugagccacugcuccugcucccggcccauuuuuuaaauuauuauuuugagacagggucucacucuguugcccaggcugguggaacacagugguguaaucauagcucacuacacccuagaacuccugggcucagccuccagggggaggauccuccagcuucagccucccaaguagcuaggacagaugcaugccacuacgcccagcuaauguggcuuuuuugugguuuuuuuugauagagguggggucucccuguguugucuaggcugccaggcuagucuugaacuauuggccucacacaguccucccaccuuggccucccaaagcgcuaggauuacaggcaugagccaccaugcccagccuaugucuuuugaaaaucgacugaaauaucacugcugcuguuaauaaaacuaaaagcuguauuggggguuuaaaugaaaugaguguucauugcuuauuuuuccucuggcuuuagauaaauuaaugcuuguaaucuaaguuuuguugcuacuuuaaauauaugaaucagugguuuaaucuucuuuguuuacaucccuuauuucuuauagauugcgcagucucuuuguggagaggacuugaucauuaaaggaaucagcguucauauauccaaugccgaaccuaagcacaauagcaauagacaguuagaaagaaguggaagauuuggugguaauccagguggcuuugggaaucaggguggauuugguaauagcagaggggguggagcugguuugggaaacaaucaagguaguaauauggguggugggaugaacuuuggugcguucagcauuaauccagccaugauggcugccgcccaggcagcacuacagagcaguugggguaugaugggcauguuagccagccagcagaaccagucaggcccaucggguaauaaccaaaaccaaggcaacaugcagagggagccaaaccaggccuucgguucuggaaauaacucuuauaguggcucuaauucuggugcagcaauugguuggggaucagcauccaaugcagggucgggcagugguuuuaauggaggcuuuggcucaagcauggauucuaagucuucuggcuggggaauguagacagugggguugugguugguugguauagaauggugggaauucaaauuuuucuaaacucaugguaaguauauuguaaaauacauauguacuaagaauuuucaaaauugguuuguucaguguggaguauauucagcaguauuuuugacauuuuucuuuagaaaaaggaagagcuaaaggaauuuuauaaguuuuguuacaugaaagguugaaauauugagugguugaaagugaacugcuguuugccugauugguaaaccaacacacuacaauugauaucaaaagguuucuccuguaauauuuuaucccuggacuugucaagugaauucuuugcauguucaaaacggaaaccauugauuagaacuacauucuuuaccccuuguuuuaauuugaaccccaccauauggauuuuuuuccuuaagaaaaucuccuuuuaggagaucauggugucacaguguuugguucuuuuguuuuguuuuuuaacacuugucuccccucauacacaaaaguacaauaugaagccuucauuuaaucucugcaguucaucucauuucaaauguuuauggaagaagcacuucauugaaaguagugcuguaaauauucugccauaggaauacugucuacaugcuuucucauucaagaauucgucaucacgcaucacaggccgcgucuuugacggugggugucccauuuuuauccgcuacucuuuauuucauggagucguaucaacgcuaugaacgcaaggcugugauauggaaccagaaggcugucugaacuuuugaaaccuugugugggauugaugguggugccgaggcaugaaaggcuaguaugagcgagaaaaggagagagcgcgugcagagacuugguggugcauaauggauauuuuuuaacuuggcgagaugugucucucaauccuguggcuuuggugagagagugugcagagagcaaugauagcaaauaauguacgaauguuuuuugcauucaaaggacauccacaucuguuggaagacuuuuaagugaguuuuuguucuuagauaacccacauuagaugaauguguuaagugaaaugauacuuguacucccccuaccccuuugucaacugcugugaaugcuguaugguguguguucucuucuguuacugauauguaaguguggcaaugugaacugaagcugaugggcugagaacauggacugagcuuguggugugcuuugcaggaggacuugaagcagaguucaccagugagcucaggugucucaaagaaggguggaaguucuaaugucuguuagcuacccauaagaaugcuguuugcugcaguucuguguccugugcuuggaugcuuuuuauaagaguugucauuguuggaaauucuuaaauaaaacugauuuaaauaauaugugucuuuguuuugcagcccugaaugcaaagaauucauagcaguuaauuccccuuuuuugacccuuuugagauggaacuuucauaaaguuucuuggcaguaguuuauuuugcuucaaauaaacuuauuugaaaaguugucucaagu

SEQ ID NO: 13311 - RNA, 18741 nt, Homo sapiens
gauaggauuggcucucaaggccccgccccaacaggucgccgcucagggugacccggaagcaguugcgccagcagcgucgcgcggcccaguucccuuuuccggucggcguggucuugcgaguggaguguccgcugugcccgggccugcaccaugagcgucccggccuucaucgacaucagugaagaagaucaggugugcuucggucuacgggugccgccacgguggggugggggauguccuaguagcgcaagggaccgcugccgagccugggccgggcggccggggcugacacccgcagcuguucuacacgcgagaauggggaggccgguggcuggggcgcgcguuccuggccucgauucgcaccagcucgccggccggcggucccagcgcggggcccgacgcuucaccgccagcucccuggucggcgucgggacucauuucugacgacauaguacuuuuagacugaugaggaaugaugucugcuuccguccgucaaaugcagccacauucggagugggagguggugaaucuguaguuagcauaagcaggguagggaaaaguaauuuugugcuaaagaucaaaaugccgggccgggcgcgguggcucacgccuuuaaucccagcacuuugggacgccgaggcgggcagaucacgaggucaggagaucgagaccauccuggcuaacacggugaaacccugucucuauuaaaaauacaaaaaaauuacccgggcgcgguggcacgcgccuguagucccagcuacugccgaggcugaggcaagagaaucgcuugaacccgcgaggcggaguuugcagugagccaagaucgcgccacugcacuccagccugggcgacagagcgagagucccucucaaaaaaaaaaaaaaaaaaaaagaucaaaacgcccguauuacugugcgaucacaggcgaagacgacccguauuuuacacuugcuuucuauuccuacuuguaugagggugagaguuguucuguaccccggaaguaugguaucaguucagcucuuaaauucugugaggcauacaccugauggaccauccugauauuuuuaaauuucccguuuggcguuugcucuuugguauacagggcugaugguucucauuuuccccauaacaaaaguuuaaccuuauuugguaggaguugaacacgacaucguauucuuuaaguuaauuuuguauugcugaaaauucuucugugaaguccuaacuuugucguuuuauuucuguuacuccacuaacacggaaguaacuuccaaaugauuggauaucauaaacuucgcauggaaguuuacuugucuaagacaacuuacagaauugcgggagugaguucccccucucuccuccccccgccccaugguaggaaugcaguuccgaugcucugaagagcaaaguaagaagggaaaaugcaaaaggcggagaaaaggucaaggauggggagguuaagcacagauaggaagauaugaaagacaaaaagauaccugauuagaaauggaagcauguuaccaacaguuggcuguuagguuaacugagaaaguguuuggaauuuuuuuuuuuuuaacauacaaagugaauggaggaaguucuugucauugaucguaucuuaaagugucuuuucucaggcucugcuucuguucuuguaacaucaguaucgcuguagacaguccuuucagggaaauaugaaauugcucaggauuaguuuaacuuuggugaaauucucagcuugauuagaguuaaauggaauucuuuaucuuuuuuuguuuuccuuugcuuaugcugcuuccacaaccacuuguggcagugaggaugacagaaaaacagcaaacgugguucaauaguucuuagaaaaaguuugcuguguaucuguuuccuccauagagaagcaugaagcaugauuucuggagguauuuuuguuuucucugacauggugacaguuuguuuucuuuuuuuaauuuugcuuauaauaccaacucuucuaugaaguuacuguguucuuguuaccugaaaggauaguaccgucagaucugcagguuuaauacuuuccugaggcaacuaaauauacuuggggguuuaaaaaucuugauggcuuugaauuuuuuuuuuuuggcuuggucuagaaaauguaaugccugugcauuuacuaaugguauccuuucauauuccuguugcacauccucauuuuauuaucuuuaaaaccaggcugagcacgguggcucacgccuauaaucuuagcacuuugggaggccgaggcccguggaucaccggaggucagguguuugagaccagccugacgaacaugaugaaacccugccucuacuaaaaauacaaaauuagcugggcaugguggcgcaugccuguaaucccugcuacuugggaggcugaggcuggagaaucauuugaaccccggaggcagagguugcagugagccgggaucgcuccauugcacucaugcuauugcacuccagccugggcaauaagagugaaacuccaucucaaaacaaaacaaaaaaaaacugcguuuguuuggcugccauaaagagucccagaagaaaaauggaauaaauauauauaauucgguaguaggguaggaaauguccaagugacugaaugugcuauuguaguuguguuuuuauagguccgaagaugcaugcugacucagauaugcauuuuuaauuuuaagagauuaguuacauaacagauccaguucgauguaauuuuaaggcagcauucaccgcauugcccuuuugugaaccaaaaugcuuaucucaaauagcuucucaacugauuaacaaaugauuacccuuuugccaagguaaugucuguaacuuuucuaguagcugugguuauguguguacuugagagcaauacuauuguucauuucuuucaaaaaaaugaaaucugccaagucagauugauuucuucuccccagcaaccacacccccaccaaacccuuuggguuauauuaucaaaaagauuuuugcuguaugcuggaaguccagcagggugcagacuacaugagagaaauucugaaggugauccaugggggcuguagugugucuaaggagccacuggaccucauggaggaaaaccuguggcucuugugggauugccaagauggaugaggugagggaggggucuucaacauuauuugaaauaguuguugaauacaguauuuccguuuuaguuuuucagaaagaggacagaauuugagauugugcuuugucauucguagucaguuuuauaauagagcaauccucaacaggcugcugagcuucgugcuuaucugaaaucuaaaggagcugagauuucagaagagaacucggaagguggacuucauguugauuuagcucaaauuauugaagccugugaugugugucugaaggaggaugauaaagguuuguuuuuaauuuuuuucuaauauuuccuaauaaaaucuuuuaaauuuuucuugugaauuauagagucgucccucauuaucugaggcaaggaggauuuggaacccucagauacagaaggcugacuguauuuauauguuuugaauuucagacuacaggacuuuuaaauagauagguagugguuguauguauuuugggggcacaggugauauuuugauacauguaugcaauguguaauuaucaaaucaggguaauuggaauaucacacaucuuuucuuuauguuggaaacauucaacaguucucuucuagcucuuucaacuauacaauacauuguuaaccagagucuaagcacuguuguuuucaaucuuaccuucacacaugcuuucaguuuguguaaucuauuauaccuauaaaguaaaccuauuuugagaaaaccuuuauuuuauacauagguguauuucuuaaguguuauuacacuaaaugcuuauagucuuagaauaaaaugaaaaaaaugaagcucuuuccuguucauaaguuucagauuaacaucaaaugggauacaguuucaaguaaucuaauagccauuuaauuauuaggccaguuuccuguuuauugagauagaaugggaaauuuucagaauuguugaguucggaaaucucuaguuaagguuuagagaucaaacuuggaugcugauuucggcagcacauauacaaaaaaauuagauuaaauuugggauaugauuaauaucuguaauacuuaaaaauaacuaauucaagcagagagcugacagcuuuaauuucugauuuccuauauguauacacaaaguuuuccuuaauuaagaaaguauccuaguccuaaaucauaccaguaacuuccaaaugauugaauaucaugacagugaaaauugaaacuuuauauacauguaaaucagucucuguuuuacuaguuagaaaccacaucauaggccaggcauaguggcucacgccuguaaucccagcacuuugggaggccgaggcagguggaucacauggucaagaguucaagaccagccuggccaauauggugaaaccccgucucuacuaaaaauacaaaaauuagccgggcgugguggcgggugccuguagucccagcuacuugggaggcugagacgggagaaucgcuugaaccugggaggcggagguugcagugagccgagaucgcaccacugcaccccagccugggcaagagagcaagacuucaucugaaaaaaaaaaaaaaaaaaaaaaagaaaccacaucuuagguaucaauuuccuuccucuuuaauaaaauauacaaguugcuuucugaaugcgaaagugucuuacauuugauggucuucauuguauuaaaacacuggaaaugcauauuuaacuagacgcauugaguauuguaguaucacuguugauuguguuauccauacuuguguagauguugaaagugugaugaacagugugguaucccuacucuugauccuggaaccagacaagcaagaagcuuugauugaaagccuaugugaaaagcuggucaaauuucgcgaaggugaacgcccgucucugagacugcaguuguaaguuaagaucugaaagaaacucaguuuuucuaggugcuuuuuucauguuacuaacuuuuaauggugcagagcaggaauucuggaacuugacucucagcuguggcucauauuagcugugaccuugggcaaguggcuugaccuuucugugcccuaguuuccuccuuuguaauaugaaguuguuaacgguaccugccacagguuuguggugagagcuaaccucaacuuaaaacugguugcugauuucaaacauuguuuauuuguuuguuaaccaaccagguuaagcaaccuuuuccacgggauggauaagaauacuccuguaagauacacaguguauugcagccuuauuaaaguggcagcaucuuguggggccauccaguacaucccaacugagcuggaucaagugaguuacuguguggaauaguuguucugcuuauaagaaauguacuuuuuuuuuuuuugagacggaguuucacuguuguugcccaggcuggagugcaauggcgcaaucucagcucaccgcaaccuccgccuccaggguucaagcaguucuccuuccucugccuccugagcagcugggauuacaggcaugcgccaccacgcccggcuaauguuguauuuuuaguagagacgggguuucucuauguuggucaggcuggucucgaacucccgacuucaguugauccuccugccuuggccucccaaagugcuggggauuauaggcgugagccaccacgcccagccagaaauguacuuuuauauguuauacuuuauauguguuacucaguuuucuccuuuugucaaucucuuguagguuagaaaauggauuucugacuggaaucucaccacugaaaaaaagcacacccuuuuaagacuacuuuaugaggcacuuguggauuguaagaagagguauucaaaaguaaugaacuaacauaucacuuaacagacaguauaaguagguggggauguuuuuuaaagagaaguagggccaguaauuuugcuuuacucuguucuccacagaguugcuauaaaucuauuucuauaaauuugaccuaaaguuaaagauaacuauaaagauuaaaaguaguuuucccucaucuuugaacuuuuuaaaaagugaaauuuggcuuuuuuucuaaaaaaagaaagguggggccuuuccaacaugggcuucaaccuacugcuguagcaugagcuuggugaauguggugaagcaucucaucauuuuuggauggugcaguggcagacuacaaaaaacuuuguguuaauguaaauauuccaucucuccacccauguccuuccucuugcuuaucacacucuagacccagcgagccuaugucagguauaaaagcaccaugcucuuugccagucuggaccaggagcuggcacugguucuucuauagcccguguacuaagaaugguuuuaacauuuuuaaaugauugagaaagaaaaucaaagaaaggguaauauuucaugauauguggacauuauaugaaauucagauuucaggguccauaacauugguauuacauccaugccuauucauuuacauauugucugugccugcuuuugccaagaguuuaguuacaacagauaccauauagcuugcaaagcuuaaaauauuuacucucuggcccuuuauagaacguuugccuaccccuugucuaaguagucuuacuauagucagcuucaugucucugccagaaacaccccucucauauuucgguuagugccucccuuuuacagcacccucuacuuguauccuagcauuuaacacccuuaguugaaaguaagguuguaggcuaagugaaggcaaggaaccucaucuguaaaccauugcauucccaagaagauagcacuuauugggcacugaguggauaaaugcuacccacaguagggaacuggaaggggauacuuguuuaaacacgacauuucugacauucugccaaucuaaauguugagaguugguuuucuucuuuagaacacauaaaauacauauuuuaaucaguaaaauucugagauuuuaccuagcaguuaaguaaaaaugcuucaaguuuaugggugcccccuucaugacuuuauuuauauuggugguugaugcacaugguguuuguugugcuuuuuuuuuuuuauuugagauggagucuugcucugucgcccaggcuggagugcaguggcgcaaucucagcucacugcgagcuccaccucccggguucaugccauucuccugccucagccuccugagcagcugggaccacaguugccgccgccacgcccggcuaauuuuuuguauuuuuaguagagacagaauuucaccguguuagucaggauggucuugaucuccugacccugugauccucccgccuccgccucccaaagugcugggauuacaggcgugagccaccgcaccaggccuguugugcauuuuaaaggguguuacugguaacuaagcccuuacaugucagacaccaugcugugugcuucaaguggauuaaaaagauuucuuuagcugagaagguugaaguauacuguaguugcuaaaacuggaaaaugacuugcaccugugcuuacaguguggcacaagauaacuaaugaguaagaugugguuuuuuaaaaguuuuucuuugaauuuuuauaguuaagucauuauacuuuuuaauuuuaauuuuuauugcaaaguuaaaaauuccuuaguuuuuuauuccugguaccacuacacuaccauaauuuacaggguaacaugccugauguaaugaaaagaaaaaggcaaagguacaacagauaaaagaccucaggaauguacaucuaauugacacuacacugcauuaaucaauagugcacuuuuugcaaccuguagcuaugacaguccugaacaagaaggcuuuccuguuuaagcugcaguaacuuuucugacuguggaucaucauuccucuguggcagauuuuuacaguuccucuaaugcauuuggaugauugccucaaaguaacuugcagcuuuucugacuucuccuugcuugcacuccugccaaaaacuguagcccuuuucugcuguuuuuagaaccuugugcuaccauauuuaccaccauagagacugcccaagcuuuauccaccaaaacugcccccuuucaugcauggguccauaauuugguugucauuguccacuguaauauccaaaaucauuauaguucccaccaccaccguaauuaccacuccccaaauuaccuucuucauuguaaccaucauauccuccacugcugccaccauaucuaccaccaccauacccgccucuacuaucaaaaccaggacaacugcgguaguugccaccaucaccuucaaauccauuauauccagcaaccccuccuccauaacuacuucugcugccaccaccccagcaccauauccuccucuuccaccagaguuucuacccauggccaaaacuaccaucuccaaaguuuccuccacaacccauaaaguugcuagauccacuccacaacugcaucuguuguuuaaaaagggcccuuuucacuucacuaacgccuguuaauagaguguuauuucugaaccacaauuuuaucaugaucaucaaaaguuacaaaagcaaauccucucuuuuuuccacucugccaguccuccuguaacuucugugguuucaaucuugcgauacuuuucaaaguagucucucaaauuauguucuucuguaucuucuuuaacaucaccaacaaaaauuuucuucacuguuggaugggcacugggcuuuacagaacucucucuagaaacagcugucuuugguuccauugcacuccucagccuugugugguugagcacacauugcugcauccaccucuucaacacaagaguaagucacaaaaccagaguuuguggaacauuuuguuugggggucucugauuaccacacaaccugugagugugcuccauuucuuaaaauguucucuaaaacuaccaucucuaguuucaaagcucagaccaccaauaaacaguuuuuuuuagcugcucuggcuccuuuggaucauggccucuuccagguugaguucaguauuaauuuuuuauuuuuagagacagggucugaccauguugcccacacuggaguacaguggguauuuggcuguucacaggugcaauuguagugcauuacagccuugaauuccugggcucaagcaagccuccuuaguaggugggacuauuggcaugcgccacugugccuaggcauuuauaucacuacauuuaagaugcggguuaccacuuagccaugccuacagugguauuucugaaucuuaguaaaccuuaguuuugaaagaaguuuuagauagcauuuaccauuuuaaaauaaaugauacaguuccugcugauuuugcccaggcuaaacucagauguggggaguaaguauuuuuagaaaaugaaaaaaggaaaagaaaaaccucuuccuccuaguuagcaaagcuuucuauaagcugaagauuccacaguuuaaagaagucaugaggaguaaagauaaacauuuucuaaaaguccaguuugaaugacugcauuuauuuauuuugcccuauuuacuccagugaaacugauguauauaacuguaagaauaauuuaauuggaaggguaucuuaaguagaguuauuuaaauauuugguauugucucaacuucagccauacuguccuaacaguuucugggacacaaaacuuuuuuugcgccuagggccuuuauacuugguuuucccucugcuuggaaagucaucuuaccccaccuuucaugaacccagcucuuuucauggccaagaaaaggauauuuuacaucauuuuggucucagcuuacuugccaucucuucugagggagacugcuuucccacuguacauaaagcggccuuuccguuuucugcccuuguugcuuugauuaaaucaccauuuauuuccuucauagcacuuauuaguuacuuuuccuuaguuguccaucuuuccuacuaaaaggaagguuuuaugacuuuucccauagacagggacuuugucucucuuagucaccguuauaaugucaucagcacaguaccugccucuuaaaaauauuuuaaaugaaugaauagcaguaaugcuuucaaguuccuaaagcaauauuucuuuuuagugaugcugcuucaaaagucaugguggaauugcucggaaguuacacagaggacaaugcuucccaggcucgaguugaugcccacagguaauguuaaacguuacucugaugaggguuugacagcgauguagagguaagcuacaauauuaaauuaaguaacugaaaucauguuugcaacuaccagugauccagagccauuugauaguguguauuuccuggugauucuaauguagauacuaaaauucaagguuugauauuggaagaacuguggauugaauaugaaguagcugcauggcguuuaccuggcgggggggguauugcugguauggggaugaugaucccaacccaagaauuagaaccuaaucuugggccaauugacccuaauuuuaagguuauagguggaaaguugauggcuugccaaaaauuaacccauugcuaaugaguauaagggcuuuuaacagucuuagaucuaacugguaacaagaauagaaucaguuuucuaaaucuauguaauaaggauuaugaaacuucuuuuuuuggucauugcuuuguguggaccucuacaugauaggaguugguaaaaagggaaguuggugguaaagauccuugacuuugaggucaggcugccuccauucacauucuuacuccaccucuuaaugagcacuucugaacugcuucauaguugauaaagggggcagaguaauacuguuugucuccuagguuguugugaggaauaaaugagauguaaggcaagugaagcacuuagugucuuggcaugugguucugcugcugcuuacuauuugauuaccuuggugcuuucucuccagcuauguuuuuaucuacaauuaauauauuucauuuuguuaaaacagaugaaccugauaaauguguuggccugucuuaacccaauccuguagcuuuuuuaauguuguuuauauguuuuggacuguuagauauuuugccgaauuaaguauauuuuaugaucugcaaaaacucaaugaaaagccaggauuucaaaacccugagcuuacauuuuuguucucuaauuaagguguauuguacgagcauugaaagauccaaaugcauuucuuuuugaccaccuucuuacuuuaaaaccagucaaguuuuuggaaggcgagcuuauucaugauguaaguaguuuauccuuuaaugugaaaaauguucuccuuuccuaaauuuuacauacugaagcaggacucuuuuucuuugcauuaauaaaagugacuaauggcaagauauggaaagauuaagaacuauguauucuuuuuauaucaggaacagacauauuuaggaccagcuuuucuucauccacugagcagaguccuauucuuccucccuuucuuaauuucuuuuuuuuuuuugagacugagucucacucugucaccaggcuggagugcgguggcaugaucuuggcucacugcaaccucugccucccugauuuaagcaauucuccugccucagcuuccaggagaaguagcugggauuacaggcacaugccaucaggcccagcuaauuuuuguauuuuuaguagauacagaguuuugccauguuggucuggucuccgacuccugaccccccugaccccaaaugaucugcccacuucggccucccagagugcugggauuacaggcgugagccacugugcccggcuaccucccuuucuuucaucuucucacuuacucaucauuauagacuuagauaauacaaguuucuuuuuuauuacauauauauuguuccuagccccacuuaggaauauaagucugauauuuaaaaacacaugaacauuuuucaaaugcaaguauaaauauauuuuggacuguugugcaucuggacuaugccauuagccaucaucuuucaguguggauaauuuagagcucaguguauuuacugauuauuucauuuuaaaagugagccaugugaaagcagaugguuugguaauuugaugaaacagaaugauauuucugccuugaacaaaauguaggagucaguaucuuuaaaauaauauuuacaauaucuuagaauaucuuacaauaaaucugaauucuguauugaugguaucuuuuuugucucuuaucuguauagcuuuuaaccauuuuugugagugcuaaauuggcaucauaugucaaguuuuaucagaauaauaaagacuucauugauucacuugguaaguuuugggguuuauucuuugaggcacagaggugggaacaugauacacuaacaguuauguacuauguguuccagcaaguauggcuguggccuuauuuguagauuauccuaaaaggagucguguaugauagaacagcacaaaaauagguagacaguuuaaaauauuacuuagaaugaauugagaaucagaaaccaagaagguguaggagguggcauuugugauagaaagagaaugaaacugggaguaugaaaacaacucggggcccagcgcgguggcuuagagguauaaucccagcacuuuggaggccgaggcgggcggaucacgaggucaggaggucgagaccaucuuggcugacuaacauggugaaacccugucucuacuaaaaauacaaaaaauuagccgggcgcgguggcgggugcccguagucccagcuacuugagaggcugaggcaggagaauagcuugaacccgggagauggaggcggagguugcagugagccaagacugugccacugcacuccagccucggcaacagagcaagagucugucucaaaaaaaaaaaaaaaaaaaagaaagaaaagaaaacaacuuagcacuuguaaucccagcacuuugggaggaugagguggguggaucacuugaggucaggaguucaagaccagccuggccaacauggcaaaaccccauuucuacuaaaaauacaaaaauuagugggcaugguggcacauaccuguagugccaacuacucaggagccuuaggcaagagaaccacuugaacccgggaggcagagguugcagugaguucagaucacacugcugcacuccagccuggaugacagagugaggcuccaucucaaaaaacaaaaaaaaaagagagagaaaaugacuuggaaccuuuuugucucauuuaagagcuugcugaacuuuaggcccuuccagcucuucuguaccaugauucuuugagguaaaguuauaucaacaaucggguguuuggagaagauugaagaaauaguuccauugguacauuuguuuuuaaaauuuagagauggaggagugagcagaaaagcaacugaaagaauuaccauuacuuugaucauaaugguaacuuucagaaauguuuuaagagcugauaaaauuugaugauuaaagguacuuuauuaagcuaaacauuauucuuaaaauaauauuguuucuuuguagaagacuuuauuccuuagauauauggugauuuguauuuuuggucccuuuuuuuaagccauagccacagaaugguaacaaauaguuuuuuccccccuacuauacuauuuuaugcuuggauacccccgccauuaacaaauuacaaaaguauauaguauugccaguuagaucugaaagauggaauuagaaauggaaauguaauuuuacaugauaguaagacuuuucuaacuacguuuguugaaaacagcauagucuuuauuauuuuuaucuuugaauuuucuugucuagcguaucaguucaguaaauguuugucaaauugaaucaaaucuuauucauccuuauugagcaaacccuacauauguucaauauuuuaauuuccuucuggagcauguuuuuaacauacuaaaauacaaagagaaaacucagaaaaucugcaguugaacagguuuuaaauguuguaaacuaccaguuucuuuacacuggagucaacugugaaacuaaggugcuuuguucuccuacuaggcaauaaucaaaacacauuagagauugauuauauuuuccauauuaagacugaauuuuuuuuuguuuuugagacuagucuuccugguucuugacgauacagaugaauguauggucuauuuugauagucuucaauuugguaaucauuaaugcuugucaccuguaaauugugugccuccauuggaauuggggaagauugacuuauucugaacauaauaaggcauuugaaauacaccaagauaaaguagauguaaguguguuuguguagaaagcuuugccaggugcacuagacccagaaaaccacauucugucccaguuaauuuguuuuguggcaugaagcuaugugauggaauguuaaugucagcaaccucuuuauuuacgcaccaaggaaaaaggaguaguaauuaacacuuugacacucccccauugauguguaauugacuguuucaaaggagcacugguucauaagcuauugcaugcauuaaaacuggguuuucuauauugcagcauuuuaagacaggggucagugacaaugcagaaauugcucaaugaugcacuuuuuuuauuacugcauuaagguuuugacauauuaguaaugaauaaauguuuccauaaaauuagauuuuuuauaacuuuaaaauugaaauaugacacaguacacugugacuuccucuuugaugguaguauuuuaguuuuaugaaacaaagcacagcuuccuacaaagucuuuaacucauacuucacugccuuaguaguuugauuuuucagaacaagaguccuaaggguuuuaaguuugguucuuuguuacuuuaaacaucaauuuaaaguguuuuuagaugcaaguuuucacauguaaaauagauaacgguuuuauggaauucagccuagaaauaaucuucauuccucugauaaguuuuuucauuuaugguaagauuguaacugcagaaaagauaagcaguaaaauagauuuaauuucaggaguauuuaaaauaauagaaauuucagaaguuucuaucacuuuauauugaaagagaguugucuguccaugccaauagaacugagaauguuaaggaauuuuugaaaaaaaucuuuaauacuuauucauugauaagaaaaaauucguuaacauugcuaauuuauugugccagcuagaauucaaauuccuucauuugccuuacguuucuugaacaucuaugcaaaucaguauucuauuagaaauuuguuuauaugcuuuucagaaaacaucuuuauauuaauguguauauuuuuuauuuuaauucuauaauuaaacauuuauuacagcugaaagccuagugacaacuaucuagauuccacaaguugcaaucaguuugucagaacauuuuccuuuauuaacacugacaacuuaggccaacaguagcauuaucuugugucaacugaauugcccuaacauguccacauguaaucugguguuauccaguugcuaccuuuugcuucagaaaguuaaucggcaucuaauuugcauuguuaauuaggguuaaugugcacuaauugauuucuuggcgccuguagauuuccauuaaacccaguuagcaauacuuccuuguauaccucauucauuugaguuauggugaucauguuuuuguugaaucugugccaaauaggaagccuguaucauaauuacagcuaauuaacagaugaucauguccuauguuaaugggcuucccuaaucuuccacuaauauaugaauguuauaaauuuaaaauuuauuuauggaguguuuagagagugaacuuuuuaaacaauacagacuugaagcucugaauuuauuacagggcacuugauugaucauuugcugauuuuacauaguucaaaaguucagagaaaaggaacauguaaaucuagauuaguuuuagaaacuuaguuuuauaauuaauaaguuagcaucaaaacaaguauauaugauauuauguuagaauucugcuccuacuuaggacuagguuauauauuuaggauuccuaauuuuuaaaauuucuagcccuuuauuuuagaaaugaaccuauucuaggccuagcacugcuauuuuuugacuauaaguccccauuuaaucucuuugcuccucaguuuuguuuuuaaagugaaaggaucaggacuggguaauuccuuaaguuuucuucuaggccuaacacauuguuguuauuugaauaauuacaacagcauguuucauuagaaauuauaaugcaaaauuugaauuauuugugcaauuuucuacuuuugucuuauaaagaacaaguaucacuuuuaaugguauucuuuaauuauaucuaguacuaacuguauuggccuauaaauguuaaaugacacacacacuuugacaguuuugguuuguaaguaguuuugauuuuuaaauagugaccugaagcaaaauggaauguuuucauaacugaaaauguuugugaaaguauuuuaaaacuucagguuuaccaguaauaguaacacagaaaaaacuaauaaguagauaagaaauccucuguguuuaaaugaagagcuauuagugugaaaaauaagcuuagguaauuuaacuaaauagaaauuguucuuaugaaauguacuuuguagauuuuaucuccuaaaauguauaacuauuuaaaaauguaaaaugugcaaaacuuuuagggucuaaaaauaaucauuuuauggccgauucuuaacuuugaaucuaucaccuaugguacuauagaaaaauuguuuuuaauacucuguggagucaguuuauaguuugcaaauauaagaagcuuugucaaaauuguucuauauaagugcucaaacaauaauuuccacaauuacaaaaguaaaaauaauuuccacagcuuaacaugagauguaauugugcaggucuuuaauuaguaugaacacucaucaggcuucacuauucuguuuucuaggccuguuacaugaacagaauauggcaaaaaugagacuacuuacuuuuaugggaauggcaguagaaaauaaggaaauuucuuuugacacaaugcagcaagaacuucagauuggagcugaugauguugaagcauuuguuauugacgguaaggcagacagaacauuuucauuuauuucuagaauuucucaucuacuacauggaucauaguaagauuuuuaucuggaaacugagccuuacacaacaaagauuuguuuauagcagauguguauuuaguagauuaguggauauauuuguuguagggugaaaauuuaguagaaauauaaacugcuauauucuaucccuugaaaucacguagaacaaagacguuuaggcaauacaccacugugguuaagagcacagauuuuaguauuagauguggauuuaagaccaggcccuuccuuugugaaacaggaauguagggguucauuugugguuguaagaauuaaaugaauuaauacagguaaagcacagugccuggcacauaguaagugaucuuucaaguguuaaccauuaccaguuuuuuuaugauuagccuagaaacaagaacuucuuccccaacaauuagauuauaaagcaacuuaacugcucaggaauuuuuucugagcuuuuuaaauuugaaaguugggauuaugcaauuaagauuaauaaaagguacagaacuauugaccuuuuuuccccuaaugcucuaaguuuucuaugaagaaguaauaacuuaguaggaaauuaguuuauuccccuauaugagaugguaggggaagaacaccuagcauucuuuaaaaaaaaaaaaaaaaaaaaaacagcaaaaaacuguaugcaguauuuauuuaauauagauugucccagcagccauaggacaaaugcaugaccuuucuuuugguugccccauacuguuuugcuuauuagauuuaaacaguguauaauguuggaaaacaguauaaaguuuuauuauggcuuacuuggucacaguuuucauaccuuagcuauuuuucuuggaaauuuuccauauaacauacgauauaaaacaucuuuuuucagccguaagaacuaaaauggucuacugcaaaauugaucagacccagagaaaaguaguugucagguaagauauuuaaugcuuugcagcauuuuauagaacgauuuaguuuguuccgauuauuucacuuaaauguuuagagaaccaaggugguguuaucacuugacuguaguuaaauaguugcuauuuaucauaauuuuauuaaaguucagacugaaugugauuagcuuauuuaaugaaagaguccuauuuuccagcacauuucauuuaauggcugagcauuggcuagaauacuaaugacuuuuaugucugcuuuauauaguugcucaggagaauuagaaggcuuaggaucaauaugguaaagauuuuuuuuaaauaauuauguaauucuuaaauucucuuacuauucuaaauuagguauauuuaaucuugcuuuuaacuggauucaaaucuguaguauuauaaaagaauaccagaggcuaaaagguugacuaacacuguguuuaauuuuucaauuuuuagucauagcacacaucggacauuuggaaaacagcaguggcaacaacuguaugacacacuuaaugccuggaaacaaaaucugaacaaagugaaaaacagccuuuugagucuuucugauaccugaguuuuuaugcuuauaauuuuuguucuuugaaaaaaaagcccuaaaucauaguaaaacauuauaaacuaaaaaaauuugc

SEQ ID NO: 13312 - RNA, 15274 nt, Homo sapiens
auaggcgguaugaaagggacagugguaaggagaugaugcuacugcugguaggggccagaucccauaggccuccuccuacagcgccucauaggcccagggaagaaguccagauuuuccaggugcaaccuuuuucaggaagauuuuauaguuaaaaugaccuagaaaaguaaaggcauuaaguacauacauuuauuaaauuaguaaauaugagucuauucugaacauucuaguaauuggaugaaaaaaaaccccagaaccuuuauaauguuauucaugggauccaaccccacuguuuuaugcuauaugaauaaugucacaaauagcaucugugaagucaaacaccacaggacacaguagaaaauccuuagggggauccuuuauuucauucacuuccuccuuacaaggugaaauuucaaucuguacagguugugucugccaguucaguccacagcucagaguaucaccuuguccucauuccaugguauaagcuguugcggggggacaggucugcgggucguggauucacuggacuggaugggacaugauccagaacuccgcuccguuuggcuucccaaggaucccaccaacucauucuaaucagugaucacugaggaaaugcauuguauuccuauucacuauuucaaagaucaggccuaccucauuggcauauuaagaaaguuuucucaaguauauuuaguguuuaucauuuuacuauaguucuucaaaugucugacauucaucuuuucccuaccucuaaauuccuuucuuuuucacauuaucuuucuugauugcuuuuuaauagaaaaacaaacaaagacauggauuuacugugcauauuagcagauccauacuggaaaaugcauggagguuucauauacaccacuuacaguaaguaauaacucagaguauaaagucgaaaagaaagaaucugaaauauuagacuuguucugaaauaagcuuaccuaggaugauaccacuuucgcuuaaucagaauuuccccuuuccaacuauuuaacaguggcaaauauaaaaaaucugguaguuaaaauacacagcagucacuucauauuacugccucccucaacccacucaccuucugaagaacagggcuuuuucaaguuuuguuccccuuuaaguuuuaauagaaaaaaaaaaguuuuaagucauguuguaccaauauauccccagaaagaauugcaauuuaccaagguuuucacguguuuugagagaaaucuuacugaaagacuagugauguccauuuuccaguaaauacugagcgaaaaacaauuuuuauaccccaaucugagguauaaacuugcuuuuugugggaucacaacugcuguaaauuagacaauuguagcaacaauccaagacaauaacagaaugccuaugacagucugccauauucuggugagugucuaucaaagcucaucaugauuuuuugugagaucuuccccguaauugguagcuuggcuuccgacaaacauguuccaguucuccaauauuuccucuuuaguuagcuucucauccuauagaagagaucaaagagcacugucauggaagcucugguaacuguacuaguucuguaugauguucaugucauuucacugauguacaacauuuaaaauacuauauuuaguaauccagaagcuacugggcaccuccuucaucuaccaugacugcauugcaaaacuccaaaucggaacagccucuugcuauaaaaaccgugcuaacgugucagggaaguccccgaguaauucagaagcuagaauccauuugugcccacaagcaguguuggucuucccaaaauaggcccucaagaaugccacuuuccucuuacagccucgcugccuaaacugacuguuggcauaaccugagaauuugggggcaaucagcaaaguggggaauaggcaggacauuuuucuaaauguauugauuuguuuauuuggauguuuaucaauagauaccgaaguacuaggcauuaaagccagaaaccugagcuugccugaggaugucugggcuuuaaugggaugggcuuccuuguuccugacaccucacagauguuugauaaguauuuggugacaaugaauggauaaauaagcugauccuagggcaacacgggguauacuucuuaaaucguguccugcccacaaaguucugcaaucuuaggaaaugugacuuaauguaagucuguggcucacagcugacuuuccaggaaaguuggggccuaauaauuuuacuguggguuaucacgguauuagcucaaguuuacaggucuccacuguaggacaagaaggaaaagucaauaaagacauggccacaugggucaaugcuaucgccgaaaaagcaaacaaaaccgaucuuauguaaacugucucccuucaaucagugauuccagaagaaugggaaauaccuuguuuuugucugauucauauaccagaugccuggccucagccugugcaugaucauaaucuugagggaggauccaguggcgaaucucaucuuugucuaacuucccguccuuguucagaucccggaauucguuaaacugcucccguucugauaaaacccagucuggcucagggccauucuccucaugggaaaacauauccgcuagaagggaagguuauuguugguuacaaaggaaagugggaagguaaaccucccccacccccauaaaacaaacuugaccuccugagcuuuaggaaaggcgacaaccaauccagagaccuaacucaaacagcugguaggcagcuucuuggggauaaugaugcaguaauuuauucaugaugaaggccaugugguggaguagaaagaacugaguuuagaagccaaaagauaaaucccggcuuuugacuuaguucagugacugagccugaaguuuccuugucuguaaaauggagaugauaauuuauaaaucauggggcuauuaugaucaaaugugccauuuugauguaaaagcccucuacaacccaaacuggcacuacauaagcgaaaacuaauaauaaugacuaacauugaacacuaugguccagauacuguauaaaguguucuacacacaguuuucauuugauuuucacauaacagccuuacaaagugagugcuguuauaauucccauuuuacagaugaaaacaaugagguaaagucuuacccaaugacccacagcucauaugagcuggaggcugcacaggaacauggucacucugcuuucaacccagagucuuagccacuguguuuaguacuauuguuuauaucauuuccaaagggcuuucacuugucauuauauuucauccuuauaacaauucuacaagaugggucauuauccccauuguacaaaauggcaaggaaaagaaaaaggaaacguuuuugcauugugugugugucaguagcucuuggaaaagagagauacccugcaggcaguuucucugucacggaagcagagcuuggaaaugucagguggugaaugaagcagguaguaagugaaggaaaaaaaaagacaagacccuugacuacaagguagaccccuaacugacaugucuacauuguuuuugagaaagaguuguaauauguauuagcuaauucgagcuucaucgaauccuguaaaaaugggcucacuuuuuuucccccauuuuacagaugaggaagcugagguuugaagccauuacaugauuaccccagggucacacagcuaauuggugaagguaggguuccuaauuccagugcucuuccuacuaccaccccccaccacacacuuuccacuuggugccgcuugaagagaagccuccccgagaagugaaaugacgagucaauacauuggguuuccucugccugugagucacuagguauucgauuuucaagcgcaacgccuccaccucccucucccuauucacuguaaagaaugggaugcuucuuuuaggcaaagccacucgaagaguucugccucugacuuugcaccauuucaaugcacaguuccggagggcugggcagagcgcacacuuucaaucaaaagcacuacauuguuuguuuugaucaugcagucuuugcugucagucucauuucauccccagugccacaguaagaggucugcgccuccgaacgugacccucgcacguggacccagcaagaggaaggcucaacugcuugcucugaugagggagcugucagcauauguuauucuaucaggguagugccaccaagaucacuuuaauuacuguggcgagagcuaccuugucuguuaccaaugacacacaaggaacaguguuuggcucaugaucaaacauaauuucuaaugauuagaggaaagucugcucuucauugcugaaggcacuuguucucgugucugggauggcaaaguaauacaaccacaaaaccagagacagcaacucaggcucugaguuuuacauuuaaagguaauuaauggcuuugauuaaaaaucuguacaaaaauuauacauauuucauuucucuuuucauaggucaacaccuaaaccaaaugauuuuccagcuuuuacuuuauugagacuugggaaaagagcugccaugagaagggagccugcagcuggagccaugugccauagcagguggugaggaucaaauggaauuguccuuguugccugcucuaguccuuucuagcgggggguugggcugggggggauuuggggcuaccaggaagggcucuaaccagcaaugguggguucagacccaaauacauuaauuugacacuauaggacucccauccaaaggaugggaaacgaggggcacaaaaugagcauauuauugggcaauugugcacucuguaaagcauuuaucuuucuaagaagaaugccuuucugcaaagugcucagacacauaaacaguucuguuaaucacagcugcaucuacucagaguuucuaggcuccauugacccaguccaguuuuagaggcuuugcccugacacugucuccucuaucuucacuguaaaucuaugggaucuccaauguccuuuugcaaagguaaaacuaggcagugugaugaagggcaccucucagagucauggggccaacuguuggccagccuuguguagggccagccuuuucaucucuucuccacugaaugaggccuaauaauacuucccugauacuacaucacuagggcugaugggacaagcaggcuggaagcucccaggagugacguauagacuugcagcuguugcuaaaagagacgucuggggaaaguagccagacguguggguggggucauguggcccagucaggacagcugagcaagacucuaggucaguacucaccaauauacucauccugauccacaaacccauccccguucuugucgauguccuccaggguuuccuaggaagcaaaagguaaaacagaaugcaagauggccaugugcucuaagaagucugagaauucuauuguccucauuuguccagcuuuuacggcugaaugcuuggugacuucuggcucaucgccuuacuucccugggaacuaguuuuuuaucuguaaaaaacaggcaauaguuucuguuccuaaucccccaccccaguuuccagagcagaaugcuuucuucaaagcaagcaagauguaccuguaaccccagaggugcucugacgauaucaggaggcccugccaggccaacuaacuccaccauccagccaaaacacccacuggggaacaugcgagaaacccagugugagaaccacuggauuagaugaccacaagaauagacucuagugcuaacaggacuaugaauacugaguuggugucaagagaaaugugaaacagugggcaacuaaaaaauaaaaguauaucugacuuuuugauguauugugcucuguauuuaguauacuugaccucuuauucaguauuuuuugauugggucaauaauuaaaugaguuuacuguucauuggcacagcaacucagaggcauccugggucaaaccaaagagccaaccugagagcagagagccacucccaaaggcucguagucuacucgggaucauucaccaccugcacuguccucugccacauuagcuaacacuacaugaauguugagugguaaagagaaaugauucuuggagccacugcccaguccuuacagucauggcagucaggaggaugaagcaugaguggacccuuccaccaccuggauaacuaaaaccauccacagcucguguaaacaaaagcucuagccaucuguuucccaggauugaaacaguuggaacuggguuggugcaucugcccaggaaaacaggugauggcauuuauuuaauugucauggaaaaugaagacauuugggacccaacaagacacuacggaaagcaacuacauucugaggccuuacaagcauagucauuccucaaagccuagggccugauccacccacccuccaaagacccacccgcuaaggguagcaucucuuccagccauaauuuuuacuuuacauuuccauacaguuuuaacaauccaauucauuccauuucugagucuuuuuccaagucccuuaaaauugaaaaauggggcagagacuagcuaguugcucacuuaagccauuugcucuuucuuuuuuuuuuuuuugagaaggagucucacccugucgcccaggcuggagugcaauggcacgaucucggcucacugcaaccuccgccuccuggguuuaagcgauucuccugccucagccucccaaguagcugggauuacaggcacaugccaccaugccuggcuaauuuuuuuuguaucuuuaguagagacagcauuucaacauauuggccaggcugguuucaaacuccugaccucaugauccgccugccucggccucccaaagugcugggauuacaggcgugagccacugugccugggccccauuuacucuuucuaggcacguaucuaaacuguauuucccagccucuucauaucuaggagggaccaguggaacauacgugaaggggaugugucauucccuggccggaagaguaaacaaagacuguaucuucucauucccucucuuuuccuuugucagccagcuggguguugccaggaugacuuugaagcuacaagauggcagagcacaagcaggagugcuuagaggagaacuggguacccaacugugcucagagaacagcccaggagguccaucuggcuggaacaagcuuugcuaguguuaaauggcuacaacugggggcuaucuguuacagcagccagccugaccugacuaauuuucuggguagacggggauuccaacaaacucuacuucagaguccuucuccaauucccuucaggcugaaaaaucuucucucuuuggaagagacaagauuuggaggcaguuuucucccuggucucuucccagcccagacucuucacuuaucuuaccaaaaccacaauuuccuucauauguucaaacucuucaggaugcagaaaggcagugaacuccucccgaguagcugucaggucaccauugaggucugcagcuuugaaucuucucucaucacguggcagcaucuuuuuaaaggugugaugaucugaagaaucaugaaacucugcgggguuuccugcaggauguauguaugcagaaauguuuuuaaaccgugcggucaagaaaggcguuuccugccagaucacucauccugcaugcucaaaugguacauauagggaaaaaaggucccgaccuacugaguucuuuaaaacauucuaugucagaaugccucuaauaucagucccuucaagccaccccauaaucuaggccucauggcauauuaggggaauuacugcaagugguuaagagcgcaggcuuuagacuauauuacugccauacuucucuuugcagaacucuacuuucaucaucucauucuuagaucuggaacauacagaggcucuuugguacccaaaacaucuugucucaacgccgugccuggcuuucaagaucuccccgauucuggccgcgugagugcaucuuugguucuccuugggccuguuucuuugccaaccucaccaugcacccagcaggucugcaccccgugccucuguaaucucauuucuccuuccuucucccgaucuuguuugucuuggaucuaaacccuucccauuacugcaugcauugcugcaucuuugccccuccaguugacccaccuucuccaaauauaaauccauucuccaaggcuccaguuuccaaaccacccacaccaggaagccuucccugacugcuccggcccacucaauccuugcuauccagaauuaggcagcauuuugaaaauauaccacagacacacuuccuuucugcuuucuucuccgugugugcaucugagacgaaguugagauggggucucaaucuaagggauuuuuuuuauuagcccucacagcccuucccucccaccuguaacuucauucaguguaagcaacucaguacauucugaguuuacagaggaggguguuauacaagcagguucuacuuaggaggcugugacaucucccugaagggaguggauaugauaagagaagagagagucuacaaaaagcuugugaucugggcccccacugugucaucgcuccugcagcaccucuuaccuagguaguaaccauagguggcuuguuuguauucuucccaggaaauuuuaucauccuugucccuaucauaauccuuccagacuuuggcgacauuaucaaagauguaucuuuucugcacccguuugauccagguuuucagcuccucaguagugacaaagccauccccaucauugucgauucgaucaacaaucuuccugcaguacaaaaaaaaaaaaaaagaaacccacacacaggcacaaggcuguuauauuaucaaggcuugugugaugcugguccagcaaaagaucaaacaccugcacaauccaaaaugcacauacaacuacaacagaaucaaugauccaaggaggcuggaaggaaucuucaaguuuauccuuccaagguugaugugcuuucccccaaccagugcugauggcagacacugcuaauggaucgugccccucuguccugauaaaccuagaggugcucucagaauucucagcacugugcucuggugauggccauuaucaacggaucagagcugaucuguaagaugaaaccuauuaaucuucccugcuguaguccagcacccucauuuuggaguaacggaaacugaggcccagagaaauggaauaacuucuaagauuacacagccaguauuugguaaaacuggggugagaacucaugucuucuggcuuagguccaaggcaaaaaguggaaacuguauguaaaucaaaagauaagugauuuuuuuuuuuaaaucccaccaccauggauacaaagacuugaaacguaaagcaagaagacaccagaugguggacacagcacaaaugucagggcugaaggagccuugacaucauagaaucuauucacaaaacuugaccagcugauccgcucuaggaaccuuaaacccucugcucuuaggguaaagacuccuauaccagcuccacagcuggccuagguuucacaaauuucccacugaacuccacugagguacccuaaaugcuagcccagagcaaacuucaggcugggaacccacuuuugucaucucuagaccagauggucccaaaccaggacagcaucccaguggggaacuucaaaaacaccuccaagcuauccccaguguuuaaaaaaguuucacccuuguaguccauuuaucugggaggaggucauacaggcuaacucuagauuucuuucuuuguuuugggcuggaauucuaacagcuucagugguaaaacuuucuugucaacagacauucugaguggcaauuaaucuuuaauuaauaaaaaaugggaaacaaauucaucaguuugauaguuugacagagaaaaucuccuauaacuuuuuuuuaggugggggaggguguacacgagaaggggaggagugaauaaucaaugucuccaccuccuaccugaacccaagaacccaagcuccucuuucucaggaagguguaaacaucaccaacagcuugaaaguaccccuucauuugcaaguuuaacaggucucaauccuaaaagauaggcuggaucugugaucccagugcuucaggaggcugaggugggaggacugagguaggaggccaagaguuugagaguagccugggcaacauagugagauccugacucuacaaaaaauuuaaaaauuagccaggaauggccgggcaugguggcucacgccuguggucccagaacuuugggaggccgaggcagguggaucaugaggucaggagauccagaccauccuggcuaacacggugaaaccccgucucuacuaaaaauacaaaaaaauuagccaggugugguggcgggugccuguagucccagcuacucgggaggcugaagcaggagaauggcgugaaccugggaagcugagcuugcagugagccgagaucacgccacugcacuccagccugggcgacagggcaagacuccgucucaaaauaaaaaaauuagccaggaauggugaugcaugccuguagcuccagcuacucaggaggcugaggugggaggauugccugagcccaggaggucgaggcugcagugugagcuaugacuguaccacuguaaacaagccugggcaacaaaucaagacccugucuuuaaaaaaaaaaaaaaagacuaaaacaugaaacuucaagugucuucaggcuucuucccccaggaaaucauagccagacacagcagaauucuuuuaacauugugcaguguugagcccaguuaugugccaagcacugcucugauccuggggacacaguggagacaugccaguggguuacccaacgccaacugggaaacauaaucucaggguaaugacaucagacucuacaauccucuuuuguggaaaggacagcaucuaaucuaugccaaauaaacaucuaggacauagcucagccugacaaauauuagggacucaauaaauauuuguuguaagaauaaauaagaucuuaaccuucucuuuaacaaugucaagggagauccugggaaaggcagcuaggauggagaugaagccuagcacuuucaucagaacaccuggauccccguccugccucugguccccauuaucugcgugaucuugggcaagugucuugacucucugaguuuccccaucuguaaacugaacaccuacuucacaaggaauguugugaggaauaaaggagagaaugcaugcuuuuccucacuaaagacaauaaucuagaucaguggcugaugguagcugcuacacaguagccauucggguguuuguugcaugaauaaaugaaugaaguuaagguguugaugcaaggagcaaacccagaccaacuccaucaucauuuguucucaacaccaacagguaacagaaugagcaaaaccuuuugaugggaccuauggccacuuggagguacccugcuagccgccaaauagggcuggccgacucugcugcagacgaugacugacacaugggaauaaaggugucaagagaagccagauaugggggucuguaugugaaaccauucaaacuuuaaacgugggcaaguaauuuacacugugucgcauauuuaugaaugcaugcagccuacggguucccacuuugcaaccucugguccaggugucuuuaggggccuuagagcugucacauuuucaggacugacaggugauggugacaaaguugccuagauccagccacacucauuccuccucagcccaaucuuggaggggaccacugaaacagaagcuuuggacagaggggcagcuucucacacucagccccaucccaaacaggacccauaauuuccagcaccuccuaccccgccucuaccccacauuuaaccuacaagugaauggugcauccaucacccaucugguggcuaaggccagagacccggauguccccuugauuccuaccucucucuucucccccucauugagucaagagcaagagcugccaguucugccucccacuggugucuagauucauccccuccuggaauccggagagaccaagccccuuuggcauucaccuccucucccugccacuggucuagucugugccuugauuauguucucuguguacugcccuccugccagccugacuuucccaaugaguuuuggggauuaugacauuuugacaauguacaggauaacaucucauguccaucucaccaagguccuuccugcucugcccuugguuuccccuccauucucaccucucacuucccuucccugccccuuugcagacucaccaccccucaugccccagaacgcuuuucaaacccuuuagaaaugggcuguuuucucuucaggaaggccuuccccugcuguacaccuggcaaccuccaagucauccuacaaacucugaucaggugacagccccaauccccucucucuaaccugcagccuuggcggcuccuucuccugaaugugcucacaguagguuuuauaggccaucauugcagcaauugugcauaauggcuaguuugucugugcuucucuccuccacauuugcuuacaagcacuucgacgcccagagcauaagguuucaucuuuguaccugccaguuaucuaaacuggggccugguacacaguagccauucaaauguuuguugcaugaauaaaugaaugaagucaagguguugauacaaggaucaaauccagaccaacuucaccgucacuuuuucucacuacuaggcugaacugucacaaugaaggcauuaacuggaagcugcaugaccacaccuuauaaaguuuuccaaaucccaaaaccucucccugccuccucuccagugacaauguggcugccacucagggcuccaggauaaaucagucuccaagugccucaaagcaauacaauagacugaacucaucaauggccccuauuguuaaguccuaacugagaagagaaaguacucugcaagauaaaagguaauuguuuggaggugacuuugaaguucaaaggucuuuuuaucagagcaggcaaauggugcaccuacacaauagguauaauuuauccucauauuccaaugaaacacuuuggccuuuggaggcccccaggagcacagggauggcuguguucucuuucauguggcagaacaugaagauccuccacccccaggaaucagguucagggagaucugagaccuggugcccaauaggcaggacugcugguuucuuccccagcccugccuccaucugggaccaggcugccugcuggguccucugugcaaggaccaccagauaccuccgcacagugcccaaguguuuccucaggggacccggggaggguguacuaaaaugcgccgaaguuuuguuucccggguuugguuccugacucaacugccuuuaacagcccaagucaaaauccuccaccaccaagagaacccuccagcuuuuugccccccaaacaaaucaguugccaaagaacugagugcuucugcagacaucugcugccaacagaaacguuucaggcgaaccguuuccauuccugcucccucguguuuccaaucggaaacugcgugucccuuuucaaccggauuuuuguaucccuacacuagauuuuauuuuauuuuuauuuuuauuauuuuugagauggagucucacucuagccccggcuggagugcaguggcgcaaucucggcccacugcuaccuccgccucccggguucaagcgauuccccugccucagccucccaaguagcugggauuacaggcgugugccacgacgcccggcuaauuuuuguauuuuuaguagagacgggauuucgccguuuggucaggcuggucucgaacuccugaccucaggugaucuccccaccccuccccccgccucggccucccaaagugcugggauuacaggcgugagucaccgcgcccagacuccuuacgauagauuuacagggcgauuaggcaaaaggcaagaccacugcggccgagaccaggaagcaagccugucgcucgccugccccuucaucuuuuauccauuuauguucaucccugagauuuucuuagcgagugucucaagcccuucuccccgggagugggggaucagagagaaacugcgagagaguggggaggaacucauggcacuaacaggccacuguggacaaacucuucuuuugugcacucuccccucccuucugaugcaaccugggggagggggcgggcccucgccguccuggcucccgcggccgcugccacguucucgccuccccgcgagaaaccaccccggccggggcgcggcggcggcgaucuccaagcuggggucccggggcccuccagcaaguuagccugagccccagcgccgaguugggcagggccccauccucgaggccgcgcgcgcgauuucgcuuucgcuuuggcggugguaucccgcguggcucucgcccaggcggcccucggacaccugcgccgccccccacggggcccuggccgcggccucacccuagccucuccuugcucucguccggggugagcuggucgaaggucuuggaguccuccuugcccaggaaggccucguggucguacuggaagcucugguuguccucagggggccgcucgcccagcuccgagucgggccgcaccacgcgcucuuugcgcaccgugggcuuggcccgcagaacccgcggcgccagcaccagcgccagcagcagccccagggcuaaccccaggcggcggccgcggccaccgcgcgccaucgucccgaggagagggcggccgagagggagacgcugagcgagcgacaacagcggcagcucgggaauggggacucggagcgcggcggcagcgacaggguuggggccggcgcggaggaggggacuggccagucccuccgccagugcccgccccgagccggagcagaggggcgcgccugggccucgggcugggaagcugcgggcggccccgcucgcgcgcccauuggucgcugagcugccgggggaagccggggccgcggagccacgucgccagcugggguggugggcgcggggcucguguuucgccucggccccuccccgcgaucuuguugcuaggggcgggcccgggcgaacugggcuagggacuggagggcucggaggaggauugggaaguucuuugucaagcaacagaugugcaggauaaaauucccucugacuuccuacaguuccgggaaaacuguaaggaaggagacguugcccuuccucaacuuccaacugagaccccgaaucucagcccuagacccugcucuaagaugugcucucaaacccaauucaaccccauuuaguaaaauuuggaguc

SEQ ID NO: 13313 - RNA, 16710 nt, Homo sapiens
uuuuuagauuaauucuaaaauaauuuauagucaccuggaauauuuaugcacaauauaaagaggcucuagaugauuucauuauauuccauauuucuguaauuuuauauuacaaaauaguaagugggcucauuauuuaauuuuuccaaaacauagcuuuauuacagcuuacuguaaaucagauacaccuuucucuguaaacauuuuguaugcucauuaaaaguuugcuucccuaaaugggcaugaugaacaaauauuagcaaaauugcucaagaauauuuuccuuugaaaaacguauuagucuuugaaaaauuacaggucuguucuaaaaaaugcugcaauauggcaauuuuaaagucauucauuccaucaaaaauauuccuauuuuaaguaaaaaaccugauuuuaauuugucccuacgaaaagccuaagcacugucauacuuagaaaaacuaaaagaugguagaaacaauuaagaucuaaugauccuaauguucagauaaaacuggaguguuuauguccucaauaaugaaguauuuccuuacuuuagagaaaguaaucuagcaucugacuuaagugaauaaagcugaaauauucuuuugccaguguucagguaaaucauacagaucaaggaacugacaagcuaacuguauguacuucugguaacaggugagugaacaguuaaaauuauuaaaaauauguaauuccaaggcugaauaugccauucccucaaaguaaaaccagucauuuuaaaagcaaaaaaauuaaaaaacaaacaaacccucuaauggucaauucaaacuggcugcauaaauugaguuuuaauggcuacaaaaucuuucaaauugcuaagagcacauuugauuuaacugaaggacuguauuuaggaugcaaaaaaccccccaaaacccagauuaguggcaaugucccaugugacaaaaagcuuuuagacaaaaugacagcugucuuuaaaaaagugcaaagaccaaggagggcagaucaugaggucaggagaucaagaccauccuggcuaauauggugaaaccccgucucuacuaaaaauacaaaaaaauaagcugggcgugguggcacgcgccugcaguccccgcuacucaggaggcugaagcaggagaaucacuugaacccaggagauggagauugcagcgagccgagauugagccacugcacucuagccugggcaacagaguaagacugucucaaaaaaaaauaaaauaaaagcaaagagacgauaccauucccccauccuccaaauagcauccaagcaaauuccaacaucaagaugcaaucaauuuccaaaaaauuuauuuauacucuguauuaaccaguguuucucuuuuccauccucacucccuaaggagucuuuuuacaauccuaaucaaccacccccaaaauuuuaauaccacagauaugguaucuguuuaaguacuguguguauauucaugcuuuauacaucaaguuuuugucccccagaacaaucuugacaaggacugcguggcgcuaacaaugaaaaguuuauaguauuaaaacuuuuuuauuugaauaaguggggagaagagaaauauauuucagcacuuagauauauaaauuauuuccaaaacaguuuaauacucaacuagucgguucuaucaaaaucaguuuucccugaaguaagcacuguucccagcuacaagcgauccucauuucacaugguacugugggaccauaaaaaugguccugcaaucuuaauaaucaauagggaaaaugaugauuguuccaugaccuuuaagguucugcucaaauauuaaaaacucuuaagaccaguuauaaauguagaaaaaaaugcaaaaauguuuaaaaauauuuaguacacuguaauuuaaaacauuagaaauagaauuaaaguguuuuauuucauuguaaaaacaaaguaguuugaauagggcuugccuuuuuuucuggcaaguaacuuaccauacugaguaagcaucuuuuauguucacggcaaacugccauacuccuucuaaguuugggucagcuuccacccuuuuauugcuugugcuuucaauguugugaaauauuucuauauucacauuaaauaucuuuuaauguaaaguuuuuuuuuuuuaaccaucacuuccucugggacguaucugucuuuauugcaaccacuuugcuuauuuguguugguaaguuugccuucacuaagcuccuaugaauacacagcagcaagaacaacauucccauggucagugacuucuucuacaaauucauuuauguuugauuaaaauuucacuuccaguguuaucauuuuucauugcuuugcugcacuuucaucuuuguugaccaguucuuucgaguguucacuucuauagaaugucaaguagaugacagagagacagcauaacuacaugcucugcuguacgugaacugaauuaacagaugcacagggacaaaccacuggaagaauuugaaagaaauaacaugacuggucacaaucaugaagcauaucuguuauuuacauagcgauuuguagacugaagagcuagcagagagguuuguacuucauguaauuacucaguuacaaugugcuaacuaaaauuuuaaccuagauuuuaacaacaacaguuuccuuaccaguuuucuuuccuuccugguaaggaaacugguauuuaaacuaaaucuaggucacugaaauuugugcccaugggaaacaugcaaauagaggacugccuacacccuacuuguuuauauugauccagacaggcuuaacgcugacuacugaaaaauagccuaucugaauuuauaucaaauagugaaucuuaaagcacccaugaugaaaaauuagggcacacugagaugguuuuaaaaucuuugucauaugauaaucaagcuuaaaauguaucuuagaguaacagauuuuuagaaauaaagaccuuuaaaggcuccauaguuugguaccgcagauuauccagcauguuuauuaugaauuauuucuccuccuucaauuucaauuugcucauacagccacuugcggucacagcggcauucagcuccacacuugguagaaccacaggcaggacaagcauagaaacauccuaagcagucuucauccaggcagucacagagguccaucccacuaaaaaucaggagacccuggcuaucauagaccuuacucuuugcugguaucacuugucuguaaaauaaaacacaaugaauuauaccucauaaauauguuauuuuugauuuaauugaaaauacaguaaaaaaaaaaaaggagauaaaauauuuuuagaugaggucaugccaaaaucaucuauaauuuaucaggcucaaggcuuauucuaucgucagcaguaaaugaacuccaugugagaagaggagaccuaacucuauagaguguugagacaaaucuaaaaauucugaauacgcuucuugaagugcauaauuuucccuuuacuuuaaacaaacaaaaaagaaugacagguuaauagugguucacuuuauuagcuaccaaccucuucacuguuuuaucaacacaguuuuauuuuuauuauaguauaccaccucuauagauuuuuauacuacaauuaauguuucuuguucuuuaauggacucuaguaaauuuggccuaaaaauauuuaaaugacucaaugguaaauuuuaacagauggaauacauggcauauauagaaauguugacugaacuuagaaaaaaaauucugaaugauuauauuaacauuuguuuuagagucauauucuaaacaauuuaguucucccauucauuauguugacuauacagaacugcauuucuauuucagacauguaaaaaauaaaaaccuugcauucucauaaaauguaauuaccuuuuagcugcuacccauagaacggagauauaugaauuacaggcacauuucggagguauuguggguuugguuccagaccacccccaauaaagugagucacacacacacacacacacacacauauauauauauauauuuuuuugcuuuuccagugcauauaaaaguuaagcuuacacuauagccuauuaagugugcaacagccuuaugucuaagaaaaaaauguauguaccuuaauuuaaaaaugcucuauugcuaaaaaaugcuaacaaugaucugaaacuucaaugaguuguaguuuuuuugcugguggaggaucuugccccagugaggacagcugacugaucagggaggucguugcugaaggcuaggguagcuguggcaauuucuuaaagacuacagugaaguuugcugcaucaguggacucuucuuacaaaagauuucucuguagcaugugaugguguuugauagcauuuuaccuacaguagaauguucaaaauuggagucauccucucaaauucugccucugcuuuaucuacuaaguuuauauaaucuaaguccuuugucauuucaguaauguuaacagcauccucaccaguagauuccaccuuaauaaaucacauucuuugcucaucucuaagaagaaacuccuuauccauucaaguuuuaucacaagauugcaauaacucagucacaucuccaggcucugcuucuaauucuaguucucuugcuauuuccaccacgucugcaacuacuuccuccacugaaguccugaaccccucaaagucauccaugaggacucgaaucuucuuccaaacucuuggaauggugaauccuuuccagaagguguucaauuuacuuugcccaaauccaucagaggaaucacucacugucuauggcagcucuggccucacaaaacguauuucuuaaauaacagacuugaaagucaaaguacuccuugauccgugggcuacagaaugaauguuguguuaggaggcaugaaacauuuaucuccugggacaucucuaucagagcuccugagugaucagguacauugucaaugaguagcaauauuuugaaaggaauccuuuuaucuaggcaggaggucucucaagugggcuuaaaauauucaaugaacaaugcuguaaacagauaugcugccauucaggcuuugucccauuuauacaggacagguagaguacauuuagcaucauuaggacccuaggauuucgaagagguaaauaauuggcuucaacuuaaaagucaccagcugcauucgucccuaccaagagaaacggccuguccuuugaagauuugaagccagguauagacuuccccucucuagcuaugaaagacggcaucuucuuccauuagaaggcuguuuguuggcugggcgugguggcucacaccuguaaucccagcacuuugggaggccaaggugggcagaucacgagggcaggagaucgagaccauccuggcuaacauggugaaacccgucucuacuaaaaauacaaaaaauuagcuggcugugguggcacgugccuguagucccagcuacccaagagguugaggcagaagaaucgcuugaacgcagcagguggcggguguagugagcugaguuugcgccacugcaccucaggcugggugacagagcaagacuccaucucaaaaaaaaaaaaaaaaaaaaaaaaagaaggcuggucuacauugaaaaucuguuggguaguguagcuaccuucauuaauaacuugcugcuucaccuugcacuuuuauguuauggagauggcuucuuuccuuacccucauaaaccaaccucugcuagcuucaaacuuuucuucugaagcuuccucacuucucucauccuucagagaauugaagaggguuagaaccuugcuuuggauuaggcuuuugcuuaagggaauguguuguagcugguuugaucuucuauccagaccauuuaaaguuucuccauauuagcaauaaggcuguuuugcuuucuuaucauuuguguucaauggaaugguacuuuuaauguccuuccugaacuuuuucuuugcauucacaacuuggcuguuuagcacaagaggcccagcuuuuggccugucucagcuuuugacgugccuuacucccaagcuuaaucauuucuagcuuuuuuuguaaaaugagaaacuugacucuuccuuucacuugaacacuuagagaccauugcaggguuauuaguuggaccaauuucaauauauuuguuucucagggaauagggacaccugaggagagggagagagucuagagaacagccaguagguggagcaguaagaacacccacagcauuuaucgacuaaguucaccaccuugcauuagugugguuccuagugacucaaaauaauuauaauaguaacaucaaagaucaucauaacagauacaguaaugaaaaagcuggaaauauugcaauaauuaccaaaaugcgacagagauagggaguacaugcuguuagaaaaaugacaccaauagacuugcuuaccaccgaguugccacaaauuuucaauuuguaaaaauaaauagcaccuuguaaagaauaaagugaagcaccaauaaaaugagguauguccguauauauauaauaacaaugcuuuucaaauaagugaauuacuuuaauuguaauuauuuuaacucucaugccaaaauuauuucuucaguucacugcuaccuucuuagaaacaaauuuuuguaguugaaagggauaccuuaauuuuauaugaauaaaaacaaaggccuucauagguuuuuacuaauucuacauuauccaauuuaaaauaugaacccagaaaauucaaaauuuaagagaaaaauaggggaacaaugcagaugugaagcagcaaguuaacaugucuucaguaacacuuagccuaccugucugaaccagcgguugcauuuuuuguaagccuucuuuuuucucuuuuaccaguuucuggagcaaauucaguuugccuuccuggauucguaaauuguaaugaccucaaagcuuuagcaguucuucccugaagaaagguaaacaaauuaucaacucaaaucuugacaacagacaacagauuaacauuuuauuuaauguuaaaccagacgauucccuaacauggaagacagucuggaacacacaaaaaagaaaacaagguuuuagagccuaagugcaagaaaauuuacauggcccuagaccauauucaaagcauauugguuaauguauuaguaacauuuccauuauuuuauuuuagucucugguauauuaggagcagaggaggaaggcauugugaaaacugcaauggcugcugccaacacaggagagaaggcacaaaaacugcuauauaauccaguggcacauaacugauuuccuaacaauccuggguccuuauuauuguauuuuauauauuuuuaagagcagagaauaugauuucaaguucuagaauaguauuauaaucuuuuugaaaaguuuuggugaaacaaaauuucgguguuuaaggguuuauguuuguuauuuggggaggaaagagcugcagcugauauauucuacaagaacauuggauagauaaggugaagacaucuacaaugacacuaucagcaaguaucuaguaugaacuacagauaaacugggcccucaagauguuccucugagaagacaacaacaggaaaauaguauaauuucaaauuucaacuaucuuuuaacuugguuuaauaaaaaggagaaaacugagaaaaauauuccagcaguaagaauuaugaaauaauuacaaguaaaaauucugagaugugcuucuuugauauacuuguccuacacaaaagauagcuuuaugaaaacuuaaguuguucugauaugguuaaauaugcauguaggcaugucaauaggaauagagguaaaauauuuaauacuuuacaauguaaaaauguauuauuuuuuuuuuaccucaaggaguccuaaaauuagccuugaccauaucaaguaggaauucagaacuagaagcaaagaaaauucacaagcauuuaaaaaacucaagaacgagacagugucaaaggagaaaaaaagagugaaauaaaaaacaauuacuguaagucaccucucuaauguuccuuuuaaagcagugauuuccaaguccuucauauaaaggcgaagucauccugcugcaaagacccuuggugguugccaugucccguguaguuacuuugguaucagaaaagaaacuaaauccuggcuuggccagaauauucuaaaacccacuccuaaagucuucgcacuaaaaguuguagcuuggagucuuaggcauauuuuauuauuacuuucccaggccuacuuucuuuaucccccaaucuugaccuucaguauaugugaauaauauuuagaaacaucauccacuuucaccccuccuuuuaauucacuguaugcuaacaaauuuaguaauaauguaaauaugauuuucuuauaguuaagcaaaauccuacaugguagaauucacaauguagaaaaaaaugacuauuacacauacaucugacucagguuuccuuuucuggcggucuucaguaucaacauccacacuuccauugauuaucugugugcauuuuggacaaagcuuccaaccagguacaagcugucuuccaaauuuagcacucagaaaaguggcaucaucuaagucaauuacaugcaaauuuuuuuuggcuaauuucuuguguauguuaaaugggucacaacaugacuucuguaaauccucaaaucugucaauguaaauuuuuacaugaugaaagcaaauuguauuguucccagaaagugucauuccaguucuaaguugaaguaaaagcauaucauuugaugacaauucuugcaaagucuuaaaaccugugugacgaguauaguagguuuuauggcacucauuuguaguacgaagcuggacuccaacugaacauggauccaucauucuugauucuagcaaauuuuccguuuuauuuugucuggagguuuaggucaugggcugaucacccuagagaaaauauuaaagagaaucaaauuugugcugcaaguuuaucuaggaaacugaaaaagcauuugauaaaauucaacaccuaucuaaaagaaaauaaggaauaaaaaagguauuuaucgaagucuuauaauagacauuuaauaaucaaacagaagcguucccuguaaagucagaacuucacgaaaacaucugcaauuacagauuauauuuaagaccacauaagaauuaaaaaggaggaaauaagaaauauuauccuaagauacaugagaaauacaagagguuuaacaaacuauuagaacuaauaagagaauucaccagggaugcuagaaaccaaaaaacacuguaucuuacaaaauaugugacucuuacaaaagacauacaacaagaccuucauggagaaaauuaucaaacugcaagacaaaaacgguacccuaaauaaaugcagcuauauaucauggaguggcucauuauaaaaaauaugucaauuaucugggaauacaucuguaaauucaguucuguuacaaucaaaguuccaucagauauucuacugccacccccuuggaauuuagcaagcuggucuauaugaaagagcaaaggucuaagaaagccaagguaauccugaaggaaaauacaguaacauauugauuuacuuuaaaccuauucuaauuaaaacuaugguauugguauaguauaaacaaacagauccaugaguagaugagggcucaguauaugacaugugguacuauuaaucgauggguaucacacacuaaugaagaagggacuuuaaccauauggaaaaacaauuagaucucuucugcacaaacaaaaaucaauaacaaguggauuaaagauuuaaacaugaaaagaaaaacuaaacauguuuaugagaaaauaaagaagguuuucugacauggaaguauggaagaauuuuucaaacaagcaagcagauaccaaaaaaauaaauaaauaaaaagauggauauauuugauuauauguaaaauuuacacauuucuguauaacuaaaggagaaaaaaaaagacacuugaaagguguuaggauuauuaucauaaauauucgaguaacuccucacuuccaaaaaucaauuagaaaaugacagaguccacuggaaaacuaaacaaauauagucaggcaauucacagagaaagagaacaaaagccaauacaugcauacaaacuguuucccccauaguuccuaggaaaaugcaaauuaaauaucauuuauuaaacauuugcuugaaaucaauuuaaaaaucugauaucugguuaagauguguccaacucucacaugcuccuuauaauaacuuugguaggaauguaaauugcugcaacugcuuuagaacauuuucugcaauuucuuguaaaacugaggaagcauacaccuugggacucagcucuuuucaguucugggugucagauggagaaaaauaucuccaauaagagcacaaguuauauacgaaaacuuucagcauucacugccuuuggcagugaaagaugacaaauaaccuaauuguaaaggaugugaaaucguuacucauacaagggacucccacauaacaguuaaaaugaauaaacuacaugaauuacgugaaucaacaugaauaaaucucaaagacaaucuuaagugaaaaaaguuguaaagguuauauaguaucaucauuaaagguaaaauuuaaaaagauaagauaguacauaagauuuacagaugaaacaugaauauauacuaaaauauacauaagaguaacauauaucacauuuguggauacuucugaggggaaaaaacauuauuuuccccaaaaagauuuacagaaaauaagguuuggugacauguacauaagugcuucacuacuguccauacuuucuauuugaaauuuuucauaaauaauuuucaaagcaaauuaaaaaaaaaaguuggauucucaagaaaauaugcaaccaaugcaacucauuaggaaaaaaucugcuguugagaaaaaaugugaaccacugaaaucugagugguagggagggacugugaagucuaggauucagcaauuuuacaaguguuuuuaagcuuugcaaaauuaaaaaaaaaacaaaaacuggagagaaaucuuaaacacauuuugauaugguuucugcagagaaaaacaauaaucagcaaaaucauauaaaaagaagacucuggccucagguaacaaaaaauggcgaauaaaugucuguguuuuaggucaaaauacuguauuuacaaaguuaaaaaauaaaauacacuuuaaaguguuaaaauauguuacugaacauuuuaacugaaaaaaguuuuaaagcugguaaaaacagaguauauuuauauucauuuacuguguuuuagucaguuuuuaaaaugaacuaauacaggucccaaucaaaucagauaaaauggcuucuaucacaguaauaauuagaaaaguuucuucuagccaggcauuguggcuccugccuguaaucccagcacuuugggaggccaauguggguugaucacuugaugccaggaguucuagacuagacuggcuaacauagugaaaucucgugucuacuaaaaauacaaaaauauuagucaggugugguagugcagcuauaugggagguugaggcaugagaaucgcuugaacccaggaggcggaaguugcggugagccgagaucgugucacuggacuccagcccgggcgacaaagcgagacucucaucucaaaaaauaaaaaaauaaaaaaaauuuuuuuuuucuucaaacagauaauuggauuaagauaaauuaaggaggagaaaaaggaaaucagagguaaaguuacaaggcaacgaacuauguggcaauguauauuagcaaauaagggacacaaucuggcuuugaccuuucuuauuuuuuauauauauuuuuugagacggagucucgcucugucgcccaggcuagagugcaguggcgagaucuuggcucacugcaagcuccaccuaccggguuaacgccauucuccugccucagccuccagaguagcugggacuacaggugcccgccaccacgccuggcuaaauuuugcuuuuuuuuuuuuuuuuuguauuuuuaguagagauggcguuucaccauguuagccaggauggucucgaucuccugaccucgugauccgccugccucagccucccaaagugcugggauuacaggcaugagccaccgugccuggccugaccuuucuuaauacaagggaaacuaggacaacuaucccucaucacuguacagaaaauaaugcuuaguauuuuguuaaugccagagauucuuuuuauuuggagguaaucaucaccaguuuuuagccacagaucuauaauggaacuuuuuuugccauaaagcuauuuccuaauauucaaaacuugggcuaccauggucauauuugauaggaaaagcaucuuggauuuaggaaacuaauuacuuuagaaaccuuaucuguccauaguaauaauacauuuuuacccuuuaggguaauuucauuuacucuauuaauuuuaauuuuagguaaaaaauucuuuuccuuaguuauuggggagucucuguuccauuaguuuccuuuauucauggcuaaauuacuacaaaauucaacagaguucaucaugauuaaaggaaacuaauggaauagacucuguaacuugugccagugaaguugaauaccuauuucugaaauuccuggccucaagugaucuucucaccucagccuucugaguagguggguccuguaaguuguuuacaggaaguucaguuuuucuuaguaacaggcagcacauugagcuagcaccaaagaucucuacuuacuggaugcagaaaauggggucaccagacuuggcaaauaaaaaacgcaggaugcccuguuagauuugaauuucagacaacgaauuacuucuuuacaggaucagcucauuuuaaaauuaaaauauccuaucugauagaagacauugccaacugugauaaaaacuaaauuuuacacagauuaaaauucagcggcaaacuaaucccacucacuugaguaaaacugcacacaccugaguaaaacugcacacaccugagucaagguaguuuuaaagucuuccauagguuagcuuucugaucuacgauuaggcaguuuguucacauacugucaaagaguccaaguccagcuagcucaaggaacaccaaauuucagacacugauccuaaguggucacuguuugcauucuaaaaaucacacccucugguuguuccuccucuguuauauuccucaauguucucauuuccagcucuuucugacuuccuccuauaagcuaaaguucugcauuugggccuguuuccuagcaacuguuuuugcucauuuuggucuguguucuggcaauguggccuacaguuuauauuuuguuuucuucaaaugacaguccagcaaguucauauuguuccuuucaccuacaguacagugcuauguucuuccauaacgaugauuuaucuggccccuuccuuaauauaguuggaaaugcauuacuguuuacucucccugaaucagcacuggcaucagcugagaccucaguagaaauacagaaucucaguaucagcuccagacccaaugagucaggaucugcauuucaaaaagauacccaagugauuuguaagcacauuacaguuugcuauguacugcuucagauaauucaauuaaaaaauuuaaauuuaaaauguuuugauaucuucuauauuuuauagaagauagcaaaaaagaguaagaaaaacacagauauguauuugccuuacaggaagucuaacucuagggaagauuauugagggagaggagauuuaaauucgauacacuaaggacagagaaaaacaucugcuucaauagaaaacugcacuguugagagcacagccuuucagguuuucacauucugauuacaugggaagucugauucuuucagcaucuuggagcuauuuuacaacugucaacuguagauaaccaacagcaaugcaaaauaauugucuguauucuuguaaauucuaucugcugaagguucaauggacuuccgucugacuguggaagcagccaauuuugcccucacuugcacauuuauuucaauauuccugcucuauaaacaugucuacuuuuaauugucauuuaaacugguuauagcaucuuaccaguuccuauuuuaauaaucuuuuaacgcaagaaaagauuaauuugcuccaaacacuuuggucaauauaaaaccuaguacucuucauggaagaaaaaaaauccagcuucuuauaggauaacaagcaaaccaauaacaaaaaccccaguuuuagaaagauucaccaugguauaaauaaaauccagguuuucaauacuuuucaaugucaaauaauaaaaacacuuuuuggcaaguugaauuuugcuugagcccugugcuggcuccuuauuagcuauaauuuaaaaaauccucccacccuugaguuagguaagacucaaggauccccccuuguuuaccuaugaccaggcaaaagaaagacccuccaaauucucauuuuuugcuucaacuaugaauuuaugaauaauuugcugaucugcuuggcccuacagaucaaguggaacaaaauacuuguuaaucaaacuuuaguuucucuccuucccccagguuccugagcuuuggccaacucucagccagagccaaggaauaacauucucagaucuacuauuagaucaagccacccuuauauccuacuuccucacaccaaaacuuucuagcacaguucacuccuuggagauucuugcagaucuuuugguucuacccauugcaaaagucccuuuucuccuuuugugauaacccuuuugaauaaagucucuccuaaguccagauuucuuaucugacauugucuuuuaaaaauucugcauaggagaaaauuaagacuuucugcugccuuaggauugacaucacuuuacuuuagugccuaaauacagcauguuuuguauucuaagauuaacauuuaauauuuuuguagcacuaccuaagaaucaaaagagaaugaaauaaauguagaauacuuugauuagaccucuccuacuaccuuaggcaguaaacaaaaguauuugcuccucauacaauuugaacgcugccagcucagggaauuauccagcuuuacuuuaaaacaucaguaguuuuaaagaguucuuaagcauuuucucuugcugcccauuaccaaacgguaaggaagguagauuagguugaggaagcugagaaaacucacacgcggccaugaugcuugcaaggucuaggacauuaucacagggguuucgggguguuaaugcagaacaccccccccaccacuaacaaaacagcaaaacagccacuaacaaaacaacagcagagggaauugaggauuaauuagggaacucacuuuuucuuccuaaauuuguaggggagaugcagaaauacccguuccaauauguuaauuucccuuaacauaguuuuuuaguuuguuaccagucuccuuauuagugggaaaaguaacauuuagaggaaauuuaacaaaacaaaaaauuuacuucguuuuuaggucaacugaugucucuuuuaugaaaaacauaaaaaaaguuuucaugaaauguuuuaugaaaaaaauuaaaggcuuuucuuggcauagggucuuacaacuuacacagcgucuucccagauuaucucuuauuuaauaaaaauauaauuuaaucuaccccuacuccccaaaucaggagcuuuaguuauggguacauacgccuacaaaagucacgcauccugcaacugugaacuuuuugugccugucaucuucaaauacugauuaccuauaacaugacaauuggcccaaaggcaaagaggagagucucaauccucaggaagaucuagguacaauaagaaagguaaaggcaauuuaaaacaaaaauauaguccauaacaccauugaaaagauuugguucaagugugguagucaggacaugccagguacagugcuuagggcaaacaucauuucaggaaccuucauagccacccugaggaaaguacuaucauucucauuuacagaugaagaaacucaagccuagagcuguuguuaucaugccuaacagagugcccccaaacccugcaaugauucccaacccaacccuguaagaggccacauacauuucuuccuuaguucacggcuauuuacaaaugacuaaaaccaccagauccguccagugggcaccuacuaaguucaugguaccgggauggaaaaauaaacauuagccuuuggccucaaacggccaggguugaaaggauucugauuugaaaaauuaaaaacaaaaauagcagagauaaaggcugucuacggaguucaaggccacaauaacccuaaguaguucacgucaaaaucguagcuuugaagguccugggccuacaggacaggcgacgacccucagagaggucagaggcggcagaaccugugcugggcuuugacacaaggcguugcgucgcagaugaacuacgcggggguaggggugagaggccccggccagcagcuggaaaucccccucacgugugcgggccuccucuuccaccucuccccggguucccccguuacgccgccgggcucccucgccacccaggggccugucuccacucucccacuccucuccagggccucccccguuccccuuccaccuuagcuugagcucuccuccgcccggcuucgggcaagaugcgaguccacacaggccacacucgaccgaccgcuucccagccaguccccgcgcuaccacugagaggacggcaagcgcgggcuagaggagcucaacgccaccacaaagagacguccgg

SEQ ID NO: 13314 - RNA, 449 nt, Homo sapiens
uuucugccaacuuggagccuguggaggccugcugggaacaggaauacuaaaaggaaguaugucuggaaggcugugguccaaggccauuuuugcugaguauaaguggggucuccagaaccaaagacagcacacagcucuuuuuaaaauagaaggugcuuaugcccaaaaugaaacagaauucuauucgggcauaagaugugcuuauauauacaaaacaaagaacaacaaagugacuccugguggcaaaccaaacaaaaucagaguaaucuagggaaagguaacucggucccagggaaauaguggcaugguucacgccaaauucugaagcaaucuuccugcuaaggccacuggacacagaaucugugugaugcuguaccccucaagcauuuaaauuaaugaaaaguaaauaaauaaaaguggauuugugcucuuggaaaaaaaaguaaaaa

SEQ ID NO: 13315 - RNA, 2141 nt, Homo sapiens
uguuauauuuuaaauuauguuaacuaacaacuaugaauuucaagaguaaauuuuucuuucuauggucauaauuuuuauaaguugaacgaugaaaacuuuuugaaugauauuuaugccauauuuaugcaucuuuuuauuucuucucuagaacauaaaagaaacaucuguaaaauaaauccaagcaugguuagaaaauuuggaagaaauauuucaaaaggaaaucuaagauaaaucacuucaaaaccaagcaaaaugaaguugaucaaaucugcuuuucaaaguuuaucaauacccuuucaaaaauauauuuaaaaucuuugaaagaagacccaucuuaaagcuaaguuuacccaaguacuuucagcaagcagaaaaaugaaacucuuuguuuucuucuuuuguguucuaaaaaaauaaaauuucaaaagaaaagguugucuuuuaaguuuuuuaaauauuuguugccuuuuaaaaucccugaguguaaguuaccaugguggcagcuuaguuuuacuaugccacaacaaguugacuaggacauuuuaguaaaugguagugaguuaaauuaucuuuauuauuuuuuaaaaauaagaauuuagaagugguaaaauuauggcccaagauguauuugguucucuauuauguuuugauacauuauuuuaaucauauauaugacuuuccuuuucaaaaauacuuuaauguacaaguguaaauauaugugcccauaaaaucauuguaaauauuauuuagucaucacaaauaaaauauugucccuugcuacuugauauauuaaagauguagauuuuaaaguguuucauuuucuugucucauuacuaccccuuucauacucuaaaccagugguccccaaccuuuuuggcaccagggacugguuuugugaaagacaaaaccucagacugagaguagggggugguuucaggaugauucaaacacauuacauuuauugugcauuuuauuucuauuauuauuacauuauauauuacauauauaauuaaauaauuauauaacucaccauaauguagaaucauugggagcccugagcuuguuuucuugcagcuagacggucccaucuugggguaauaggagacagucacagaucaucaggcauuacguucucauagggaguguacaacuuagaucccucacaugcacaguucacaauaggggucacacuccuaugagaaucuaaugccacugcugaucugauacguggcagagcucaggugguaaugccagcaaugggagcggccaccuaccacucgcuuccugcucugcagccugguuccuaacagaccacgguugggaaccccuguucuaaacuauuauuuuauagaaaaugugaauuuuguagauuuguauuucagguaagaucaagauauguggcgccagagccaagucugaaaauaauccacaggccucguaaugauaaugggaaaagauguuucaaucauucuugcugcuauaggaaguacauggagcugcaacuuaauuauacacuguuuacuugccuugccuguccuguuuguuugcugaauguaacauauuuggccaaaugcacuuuuaauuuuaugcagcacaggacccuucacaccaaagcaagcaagcugaaauauuuuaagccuuucagcuaaucaaguuuauccacuuaaaaucuggcugggagagugugagaauaaucuuugaggucccuuucagcucugacacuggugauuccauauuuauagagcauauucaggaugugucauacagaaaaccaccauaaacacauuuuuuuuuggucccuucgacauuugguuuuugguuguguugccuguuuaacaaucacuuucaccucucuauuccuuucaauuuuagguaaaagaaaccuuuuuaccagauagugacgaguggcuaccaugauuaauaagugacuagaccucaugguccuccucauacuaaaagguaugagcacgauuuucuuauauaccauuuuuaucagguagagauuuggacuucuauaaaaauuaauaaaagggacuuuugucauauaacuauauuaaggggaaguugggguaauaaaccauaaugaaugggaaaagacagcuauuaacuaugugaauuuaaacuaaaacaagaaugcuauu

SEQ ID NO: 13316 - RNA, 2578 nt, Homo sapiens
aaauuuaguugcuacucugauucuguaccaaagagaaauauuagaaaauacuuaaaauuuuuguauagcaauaaagaaucuaaauagauuuucaaucauccuuauuaccucuaggcaaguuaaaaauauaagugucauguacaggcaaagcaacuuuuucuucuucucuuagcaguuaagugcuuuugaaaaaucaguauaccaaaauuaacaguuauuaaggucaaauuaucuguuggaaaaaccaagcagcuccuggaaucaauguuacuguggcuuuaaagguucuucaauuuuuccaaaaauuuuggaauuaagaacaccuuacuaauaggauuacuuauauuuaaaauuaaguccccaucugaaaaucaggaaacuaaguccuacguauuauuguuggcacaacaagauguaauuguuggaauaauugcuuuucaacacaaagacaaucugguauuaauaugaugagggacacuacgugccaggcaaaucacagcuuuccucacaaaucccuuguugauguaucuucauuacuuacauucaugccucacagccuuggacuucuuugugaaaauuacagaacagaaaaaaacugguuaaaaauucaaaaugccugcaucuuuuuaaagaaauaguuugacaacuuucagguucaggaaauucugaguuuuagagugguuuuugugccuccuguuuccuugcgcuguuccaacuucaguuccugccauaauugucccuuuccaccacagucaaguucugggccccuggucccaauuaacugcucccagccccagaugcauuuucccuuccuaaugacagauuagcaggguuuaaagaucauugguccuggugaguaucugauggaagcuuucuuucuaauagagucaagauaacugaaagaacacuuaaaaagggagagcuuaggauauugagcggcugccuuaagaaucuaccuagaaacacacauuuuuagacuuguuuauuuugggggcuuuuagaacuugcccugagacaggcaacuuuuacauaacagacuggccaaguacuggcuacagagcggcaaaguacugccuacagagcuguuuaggagauuugcuuuaaugagcagauagaacuguguucaaacaugugugcacacacacaugcgcacacgcacacacaccccucauggaacuuuuccauucuuaggaagaaaaagacuuaaauacauaaucauacaauuaagcauauuauauaaauaaauauuaauguagcuaaauuauacuuguagauaauuaccugcaauucacucaacgcaguuaaauugagcaucuuguuagguacaaaggauaaaauaguuaacacaacaggcaugaggccuguccucaagagacugacauuccaguggcggagguaacauacaacacaauaaacacguuacaaaaugauaacaaauacucuaaaaacuaccucuggaauagauaaacagggcacugagguuaaagacugagggacucugaggaggaggguaguuacucaaaacgcauuuggucaagaaaaguauuucuaaggugacauuuaaagugagaccuaaagaaaaugcaagaaugagucaaaguaggagcugggcaaggaguguuuuaggcaaaggaaagagccacgucagagacccaguagcagaaaccaacuuaguaugauccagcaacucccagaagguuaagagugauuaaaacacaggaggaggggaguagagggaccagggacacacauguggcaggggaugcaaacaggguccacauuccuuaagucccuauaggccagguaggggguuuggguuguauuuucauuacaaauugaaguuccuuaguguuacugcagcugaaaaguuuaaauuguuuauuuuaucaugcugaugauguauauucauauucaauaaaauaguauguaaugcaccuccaaauaccuacaaugccuccacugauacagaaaauaguauaacaaggaaaguggucagugccuuuuuaauauaaauucaguacuguauacaaccguuaaacucuugugaauucugugucaucaaggaaaaaagauagccuuaacuuacugcuagaaaacuaggugaguuuugagcuaagacaguaauaaagcuaucuucuauacaaaauagcauaauacaacaauaaaagcauggauacaauuuccuccguacuaaaaauuuccaaaaaauugugaagucacauauaaguagggauuaaaaagaacuauggaaaaaugaaacucuuaaauaagagguuaaaugagaaaaacgauuugugaugacucaaaugguuaauccuuaucucucaauucacauguggguguggugaggcacccauaagaguaaagaguauguacuuauacugagaccagugcuucagagcacugucucaguguggcuuuguaacaaugaucuauucuauuaguauucaccccaaauaacagaugaagaaaauacuauaauucuuuaaguagaugcugaaaagcaucagcuaucucacaaaguagaaagaauaugaggguuuauucaagguauuuuucuauuuaaacuccauguggu

SEQ ID NO: 13317 - RNA, 1040 nt, Homo sapiens
uuuaaaauugcagcucuuuuuggaucccccaaaguguaucugcacucuucuucaaacaggccucuuccucaggagucagagucacuuucacaaggucugagauuccauucugucccaaaaugcaaggaacccuaaggacgacaucauccuuuauuccauagagacccuuaaucauggugaaaacugggugcaccugccuaagauucuucacuguaccucugccaaaucugcuacagagaguccaauggcccaggauguguagccuuugaguuugaucaccucauaagcacucucaaccaccaguuugugaaccucuuuccacuguuccuuauguuuaucagucucuaaaucugggugcggagucuucagggagacaccagcaacauucuuuccacuccauacaggugcacuggaaucuccauguuccccaaggacccacccaugacagcuuaaugggugaacucccagccuuucccccaucagguaacggaauugggcugaauccagauugcaaccacuuccaauaacaugguuuuugggaaaaccacuuaucuuccaagccacguaggucaagauauccacuggauuugaaacaauaagcaacuugcaguucgggcuguauuuuacaacauuaagaaugaugaacuuaaagauguucacguuacgcuggaccaaauugagacggcuuucuuccucuugcugacaugucccagccaugauaauuaccaguuuggaguuugcaguuccauuauagucuuugccagagacaaucuuugguguucuaaggaaaaggcugccauguuggagauccaucaucucucccuucaauuugucuucgaugacaucaacaagaucaaguucaucugccaaguccuucauuaagauauugauggcacaggccaugccaacagcaccaaccccaacaacuguaaucuuauucugggcggucuguucuuccuuuagaagauuaugaagcagcugauccuugagaguugccacauuggacuuggaaccaaaaggaaucaggaaugcacaucagg

SEQ ID NO: 13318 - RNA, 2433 nt, Homo sapiens
gcuccgcauucccacccaguccagaaauugaaauacuaucagggggcaagagccuuucucuccagcuacacacuccaucucccgggagcaaggggaaacuccgagaggagggcaacagagccagcaucuugccagggccccggaggagggguuccccgcuacgccugugccggaggaguuccagucaccgagcgaggggcgcaagggugggugcauccugcgcugcggcgggcgcgcuacccagacgcuggugugcagagccacaugaagccugcuggggacugggggccagggagcagcaagccagcugggacugaggcggacgcugucucagggagacgcugacucgcaaagacacucccuuccuugugccuggguaaaaagucuccuccuggggucccuggccauccugaauauccagaaugguguuucugaaguucuucugcaugaguuucuucugccaccugugucaaggcuacuucgauggcccccucuacccagagauguccaaugggacucugcaccacuacuucgugcccgauggggacuaugaggagaacgaugaccccgagaagugccagcugcucuucagggugagugaccacaggcgcugcucccagggggaggggagccagguuggcagccugcugagccucacccugcgggaggaguucaccgugcugggccgccagguggaggaugcugggcgcgugcuggagggcaucagcaaaagcaucuccuacgaccuagacggggaagagagcuauggcaaguaccugcggcgggagucccaccagaucggggaugccuacuccaacucggacaaaucccucacugagcuggagagcaaguucaagcagggccaggaacaggacagccggcaggagagcaggcucaacgaggacuuucugggaaugcugguccacaccaggucccugcugaaggagacacuggacaucucuguggggcucagggacaaauacgagcugcuggcccucaccauuaggagccaugggacccgacuaggucggcugaaaaaugauuaucuuaaaguauagguggaaggauacaaaugcuagaaagagggaaucaaaucagccccguuuuggagggugggggacagaagauggggcuacauuucccccauaccuacuauuuuuuuauaucccgauuugcacuuugagaauacaucuaaggucaucuuucaaaagagaaaaauuggacacuugagugacuuuguuuuuaguuuuguuuuuguacauuauuuaugugauuguuauggaauugucaccuggaaagaacaauuuuaagcaaugucauuucuagauggguuucuaauucugcagagacacccguuucagccacaucuaaaagagcacaguuuauguggugcggaauuaaacuuccccauccugcagauuauguggaaauacccaaagauaauagugcauagcuccuuucagccucuagccuucacuccugggcuccaaaagcuaucccaguugccuguuuuucaaaugagguucaaggugcugcuuugcaugccugccaacccauggaaguuguuucuuacuucuuuucucucuuauuuauuaaccauggucugagaguuguuuuuguucuauguaacaguauugccacaaaacuauaggcaaaucguguuugcagggagauuucugaugccucuguggguguguguaaguuaaaguggccacauuuaagaaggccaagcuuuguagugguugcacagucacacugauaugcugauuugcucuuucucauuguaugucuaugcuuugucaucagugcuauaguaaauuacaaagaaauagguagauuguaugaacauacccacaaaugccuaugauuuagguuaccaauguauucuuucucauuugggguuuugcuucugucugucuguuuauuggaaacuuguacuucaaguagggggaauccuaauucuaauaacuccuuagcuaaguuuuauuauucaggcaauaaacauguuuucauguaauacuggcuuacuuuguaauuuacaucuguaacuuucauauuucuaaaaggggccaaugcaaaaggagagagaaggacuggauuuaagccaguuuacuuagaguauaugauaaagaaggcagaggaauagcuacauauuuggcaauucuccucucuguagucacccugacauccucacaagaaaacaaaucuagccauugcccaaacuuuaaauuugaucucuauaggucugcuuaaagacucaaauuuucuccaguuucucucauaaauucaauugcaaaaguuucugacaaggcucauacccuguacccuuaugcagagcaagcauuccauccuaaguuauaaacuacagugauguuuaauuuugaagccaggucuacauuauuuaauuaauggcuucaaaagguggagaugcac

SEQ ID NO: 13319 - RNA, 63202 nt, Homo sapiens
aguuuuaaucuacuuuuuaagaaaagugguaguccuuuucacagugccugacgguaagucacaguuucuaccuguauagcagaguuuaaucuauugccuuuaaaauaaugauucuggaaaucuuaauuuuaaaaccuuauuugcuuuuuccuucucuaauaauucucuaaggcuuauguggaaagagcauaaguaaagguaccuacuacuuucugggaauuuauuuauaguuaucguucaccaguuucauuaaucuuauggaucuuuuccuccauuuguugaaaguaaaaugcuagaccaugaaaucuguccccuuuuuaugucauuauuuuaaguuuuuuuucuuucucuuuuucuuuugagauagggccuuucucuguugcccaggcuggagugcaguggcacaaucguagcucacugcagucuugaacuccuuggcucaagccauccuccugccucagccucccaaguugcuaggaccacaggcaugcgccaccaagugugucuaauuuuuuuaaacauuuugugcagacaggguguugcuguguugcccaggcuagucuugaacuccuggccucaagugauccuccugccuuggccucccaaaguucugggauugcaggcaugagccacuguggcuuguuguguauguuauccucauuuuauagaugaaaaagcuuuauuuucuagaugagguuuuuccuugggcauguuaaucacagaguuguuuuaaauauucugaucuccagaccuguacacuugcuacuguuacacaaagugauggaacuauuaaggaggauuucuugcucaguguagaggugaaaagcaguucaacaggcagcugauggaagugauggaacuauuauggaggauuucuagcucaguguagaggugaaacacagaugauggaaggaauugggauucauuuccccuaauuugcaaguaacggcuacucuuaauuugcgauuaguaaguuuaaccuuaauacuaaucuauuuuuuauuauguugaggaagaaguggggggaaaacucucagggauaagaugauugaccaacuguuuuauucuuaauguaaaacacugagugaaauaugcacauagcaaccuuuacucuagcuacuggccuuuuacuucuugaagaaucaaacuuuuuuuccuguggcagaacaguuaugcuuuucuuuucacuaaacucauuacuauuuauuuuuauuuuuuuuuaagcauugaguuuacugaacuauccaguuagccauccuagacaucaaagcccauuuugauauuuuuguuauuuauauaguaauacuguacugugucauaaugaugauaguauuugugauuguaguugcauuuguaaaauugaucacuucucuuguuucuucuaguaacuguaucagagggugagguauaagcucacagaauucagauaaaucaucaugaaguuauauguauuucugguuaacacuggaacuacucuaacauuugacacugaacuuacagugcaaacgugaguuguauuucauuuauuuuuuuuucgcauucugucugcaugcagaaaguuaaagaaauauuauucuacuguuuaaaaaguaggauaauggcggccgggugcgguaccucacgccuguaaucccagcacuuugggaggcugaggcgggcggaucacgaggucaagaaagaucgagaccauccuggccaacauggugaaaccccguuccuacuaaaaauacaaaaauuagcugggugugguggcgcaugccuguagucccaguuaaucgggaggcugaggcaggagaaucacuugaaccccggggggcagagguugcagugagucaagaucgcaccacugcacuccagcccagcgacugagcaggacucuugucucaaaaaaaaaaaaaaaaaaggucacauaauggcaagucuuaaaucuuuuaucccaacauauuuuauauguaauuguuaucuuucucuaaaagacuaguuacauucuuuaaauugugcuuuguccuguuggcaugaauauaauauucauguaaacaguaaacagaucaguaaacagaucuacucacacaaaacaaacugauuuccauuguuguaaguaccuauagucaauugcuauucuauuuuucacaggccauuguuaagggaauuaucggaagcuucauaaaacaauguauaucacuuccaugguuuuuggucauuuguuuuuauucaguuuaugaauaaaugucaauagguuuauuuuguuuguuaaggagagaaaagauaaauuuaauauuuucauccaaauuuagugggacucagguaucuaauaauucucuggcuugacaggacaggaaagaaauagaaguaguaaauaucauuuccaacgcuguuuauauuuuuauagugaccauaauagcaaagacuuuauggcaaugcagaauaaaacugacauuggaauuauuauaaauagugugugaaauaauaaucuuuguuguaaaaauugaauuauggauuuuuuuuccagaauuaguuuucauuaaacuugauuuuacacuuacaugaaugauuuuuuggaagauagggauaggaaggaaucuucacauguguuagacuuaauguaguuucuaaaacguguggagauuuuaacaaaaauuauguagccugaggauuuuaauagaccugauaaccaguuugagcauauucuuuugcuguuauuuaccuaagaucagccaguuguuauggaauccuguucauuaaauaggaagcuuauauuuuuauuacuguuuuuggggaagguuuuagagugaaauucauuaaccucuaagguguuuuuacauaguacuacuuggaaaauaaagucauugggcaaauauaaacaacugauuuauuuuauuucauuuuuugaaguguggcagaccuuaagcaugccauucaaagcaaauacaagauugcuauucaacaccaggugcugguggucaauggaggagaaugcauggcugcagaucgaagaguguguaccuacagugcugggacgguagguauucaagaguccuuucacacaagaaugcaacaucuuuacaucacauugggaacucaguguucaaaaguaagguuuauuugcuucauauauugaaggcaaugugcacgcucaguauuuauaacauuuuauuuugguuauuucuccuuuuuuaaaaaauauaggauacaaauccaauuuuucuuuuuaacaaagaaaugaucuuaugugaucguccaccugcuauuccuaaaacuaccuuuucgacagaaaaugacauggaaauaaaaguugaagaaucucuuaugaugccugcaguuuuucauacuguugcuucaaggacacagcuugcauugguaagauauaaacaauuauuuuaacugauuguuucuaaaagcauucggaucuaaauagcacaguagucuaaauugcauaggaaguaugcaaaaaguuugacaaauaaacuuuaaaaauauuuuccgguuaauauaucuaguuuuaaaauuucugggucauacauugcuaguuauucuacuuugauaaugacaguauuuuagaguggaaaagcugucuuaacaugauuuggucaccuucuuuccuagauaauauguaaauaguuacuuuugaacauuaauuaauaaaggaccuacguuagaguagauguuaacaaagagaacuuaaauagcucuaaaaauguauuuauuuuuuccauauuugugguuaguuccuggaggagaauuagguuucuuucuaauauauagcucuuaacacugcuacuugcaguucccacggauuguuucccagucauuugauuuuccuuuuuaauuuacuauuuaccuucuaguaauaucauugacauuaagcuaucagugguaagcuacauuuuucuuuuaaucauggaaaaaauguguuagaaccaaugaaauaauaguauuuaccuuuuguaaaaauaaauaacauuacugaacauuagcuuuaauuaguaaaacucuuagagauuuguuuuaagcaguauauacauuuguacaaauacccccauuuuucacauaggauacaacauuaaaaggaaauaaccucaucugugugaaacauauuuaauaaacauuugagaguccaaaagugcuuugagaggacaaaauuuuaaaaaauauacuuauguaaacugaauuuacauaauagaaucuuuuagaguuguuuuuuugauuugguugaaaaguguacauacuacauuuugauagagaaaguauuaaauaugaaaauaaguuaaaggauaacuaggauauauaauuuucaagugauuagaaagagcaauuaaaacuauauucaacgaaagaaugaaaacaagaaaguaaaaagaaaagauaaaaugucagaaauacguauaucaggaauuaaauauaagcuggcauuauuucucuuuuaaugcaucauauuuaaaauauuuuuuaaauacauaaauaguaaucugagauucagauaccaagcauucuauaucagucuguuuucaugcugcugauaaagacauaacccgagccugggacgaaaaagagguuuaauuggacuuaacaguuccucguggcugaagaggccucggaauuauggcaggaggcgaaaggugaaauuggccaaaacaaagggguuacaggucccaugcaaguucgaaauccagcauggcagccaaguuuugaagcuccaaaaucaucuccuuugacuccaggucucacaucuaggucucacuaauacaagagguggguucccauggacuuggggcagcucugucccuguggcuuugcagggugcagccucccucccggcugcuuucacaggcuggcguugugucuguggcuuuuccaggugcacagugcaagcuguuggugggucuuccauucuggggucuggaggaccgugacccucuucucagagcuccacuagggagugcccccaguagggacucugugugggggcuccgaccccacauuuuccuucuacacugcccuaacagguucuccaugagggcccugccccugcagcaaacuuaccugggcaucuaggcguuuccguacaucuucugaaaucuaggcggugguuccccaacgucaacuugucauuuacauuagguauuuuauugacuuauuauauagagacaggaucucacugcguugccgagguuggucucaaacuccugggcucaaaugauccuccugucuuggccucccuaagugcugggauuauaggcgugaaucagcauaccuggccucuuuucagauuuauaaaauacauugagccaccaugccugcccucuuuucagauuuauaaaacaaauucuaaagcugcuauaaccaaaacaguaacauaggucuaaucaauucauuaugugaggaauuagaggugauauuucuucaugguccgggauguggucucuaaagucagauuuucugaguuuaugucugauuacuucauuuaccuguggugugaccuuuuacucauuuaccuuauugguaaauuuaagaauagauuuuuguuuauugagauauacugaaaaaugcacaaaccauaauuguacauccauucuuagugaauuuucacaaugaacacauugauaaaaauaguuucaggugugguagcuuaugccuguaaucccagcacuuugggaggccaaggcaggcggaucaugaggucaggaguuugagaccagccugacuaauauggugaaacccugucucuacuuaaaaaaaaaaugcaaaaauuagccgggcaugcuggcaugugccuguagucccagcugcucgggaggcugagguaggagaauugcuugaacccaggaggcagagguugcagugagccaagaucgcaccacugcacuccagccugugugacagagugagacuucaucucaaaaaaaaaaaaaaacacacacacacacacacacacacacaaaaccccacaaaaacaaauaguuucaacccagaagcccuacuuaggacuuucuccccaucaguuuucauccucccuguucauuaaugcuaaccaguaucuugacuucuaaaccaacauuacuuggucucuuuuugaauguaaauaaauggaauaauguaguuucuguucuuuugugucuagccucuuuuacgcaacaugauguuccugagaaugauucaugcuguugcauguauccgugguuuguauucuuugcugcauuguauucuauuguacgaauaugccacaguuuuuuuuuaaaucuguucugcuacuaguagguauugagauuguuuccaguguucaacuauugugacuaaaccugcugugaauguccuaguacauucuuuugacuacuguaguguagagaaaucagaauacuuugacaguguuaaaucugucuucucuucuacuucugcaaucucuucuguaccgaaauguccauaguucuuucagauuucaucuugaaauggacucagugcacacugucuuuuuucuuccauauauuagcuaucauuuacaugguaauucuauuaauuucacuugucuugguuguuaaagcuugauuuagacuucucuguuuucagccgugucuucuuccaguguagccuucaaucagugauacguuucuuuuuaacuuauuuccugagcuaaaucucuguguugaguucuuuuuuauaaagcaaaauuagaccaaguucuuaggaaaagaauuugguuauaauuuccauuugcucuuggagaaaguuuuucugcauuuaguuuuuuuuacuuuuaauucuuuuuuucuacacuaaauuaggguaauuuaguguagauuucauguuaaaauuuuugcuuguguuugaaugaauagaauuauuccucuauaagacaguguaggaaaggguauaagauagcacuuccuggugagcaggaagcugcccuggaucacaggggauccccaguuagaagcagaaucuauauguguaagagagggauggagaugacuuauuuuguccuucuccuuggacaaaauuuagcaguucuagggcuuuuucucacguuuuuuccuuuggcuuuuugcaaguauguaacauaaauagguauuauuucuucugcuacucucuaauuucagauagggccccaagagguucuugcuguccacccaagcuucccacaaggaggauucaguucucccaaguuuugcuaaaugucugcaauaguggugugaaccuaaauuaucgugagacaggucacaaucaauuuagaaaauuuauuuugucaagguuaaggacacacccaagacauagcuucaggggguccugguaacaugugcccaagguggucaggguacaguuugcuuuuauacauuuuagggagacaugagacaugauuauguguaagaaguacauugguuugguucagaagggcaggauaacucgaagcggggucuuucgaguccuugaucagccuuucacucaauacauaauuuagucuggcucagugcaucugcauuuuuacauaaacaauaaacaguaagacagaggaagcagauaggccuuuguuucaggucagcagaggugugacuuucugucccgcacauaugaagauaugcugucaguuuacauugugaaggugaaauucagcagaacuguuuuagguuaaagaucuugaagccuacaagaaauuucccuguggcaaaauugugagggagguauguagcuuucuuaucuuuguagcuaucuuauuuaggaauaaaauuggaggcagguuugccugacauaguucccagcuugauuuuuccauuggcuuagugauuuuggguucccgagauuuguuauucuuucacagugggugcccuuuuuauuugacccaaguugaucaguuuucauauucuucacagguuugcugcauauauuguauguguggggugguaguuguuuccugguuucaucaagauggugucuuguuucccuuuuguauuugguugguuucaugaaggagaagcaggcaaagacaucuuuacuucauuaucuuacaacugaaacuauuagcccuuucuuauacacauauggaauuaagaacaggugaagauaagucauuucuucaaggccagauagccagggagaagaagaaccucuuuucuccaaggccagugcucuuuacauucauaucauuguacuuccagaaaguaaacuuucauauuuuaccuguaaagauauuucuuuucaccuaaauuuguucauuaacaauauuaucuucuaaaacagaauggucauaauuuuggcauccuuaucagccaaauauaucagcaaauauaucagcaaaauauauagagaaaauacuuccucuuucguugcaucccccacuccaucuuaaugaugguggaacauuuguuuugcauuuuccuagacuuugauauacacacaaaaugcauuucucucucauaccucuguuguuucacauuucuaacugaccuuagccuccccaaauaaaugaaagcauacuauacuuuuuuuguuguuguuuuugaguuggaguuuucgcucuugccacccaggcuggaauucaguugugcgaucuuggcucacuguaaccucugccuccuggguucaagugauucuccucccucagcuuccccaguagcugggauuacagguacgugccaccacacccagcuaauuuuuguauuuuugguagagauggguuucaccaucuuggccaggcugaccucaaacuccugaccgcaggugaucgcccgccucagccucccaaaguacuaggauuacaggugagagccacugcacccggcccauacuauauauauuauuccuuuuucauuguugcaagguacucccauuuuugaaauaucauaaauuuauuuuccuaguaaacagugcuacaguugaacuuauuuuacauuuauaaauuuuaacaauucauaaaauugaaacauuugaauauuuuauauccuccaucuuuuguguguuuaagaaucuuccuccuacauuuucuacaugcgcugcaagaacuucuugcuuuaauguacccaacagcucuuuuacucgucauuucaagggugucaccucucuuucaucuguuuaaaaaaaucugaaaacauuuuauuuguuauuucauaauuccagaguuuuuuuccccacucuauuuuaguggcagcaugauugauuaauugacauuaauugacauggcacauaaucauuuuacugacauuccuaccccauaaagaccaucuuacuuauuuacuuugguaacuagauaacuuacaguagcuuuuuuacaguuugccuggacaacuuaaaaauaaucauuuuacauccauucuuucaggugccuucccguuccaccuuaugacauuuucuguauuaucagucuucuuaaagcuucuauuugauuacauucuucauguuaaagaguucuugaggaggucuuuucugaguaaaguccaauuccuccuuccuuaccuuaguaucuucugggucuuugaucaucuggcccucuuucucucgcuuuuuccuccagaccauuuguucuuaaccaauagugcuucauauuuccugucuuugccacuucguguuccacucuuuugaaguacuucuuucccuaucuuuguucauauucuuuucauaccuuuauacuuaaguuaaaugccuucaguuaacuuugacuucucauuuccugucucuuuugugacuuuuauaucugucucauaccaguuaacaaagguagaaugaucugucuuauuuccuugccaacuaaaauauuuuauaacaguggacuucuuuauauaucuccauauauaaagcaaucuacauugcugccuuguaauuuauccuuaauaaauauuuuuguacuucauuguuuggaacugaaugucagaugucuauuuucugaagguauuuucacugcuuaaauauuuucuagaaucucauuuaggguuacuaaaucuguuauaguuauacuaaucuagaaguagaugacguauuuuagcuuugccuucaccaaaaauuguuuuuaacaugaaugucuugagauaauaccagaggacagugacauuugagauggcagauguugaucauuagucaaauaauugaaagcccuacuccuuuguuuuucagagguagcgucuuauggauucuucuuuugacugucucuuaggauaccugcucggaaacaccucacuuauguuuaggcugucuuuuacagaagagaacagagauaaacuaaaacaguccuuugaaauacuuuguuaaaugugcucuacaacgcauccacacguacauguuuguaaacauaugcaaacuucugcaaacaaaccauugccuucuuuuacuuucuuuuguauucuuuuucaauauaggaaauguaugaaguugccaagaaacuuuguucuuuuugugaaggucuuguacaugaugaacaucuucaacaccaaggcugggcugcaaucauggccaaccuggaggacuguucaaauucauaccaaaagcuacuuuucaaguuugaaaguauuuauucaaauuaucugcaguccauagaagacaucaaguuaaaacuuacucaguauguuugccauuaaaauggauaauauuuguuuaaaaugccuuugaaauuuaucaguagguuuaauuacugcaaauuuguuucuuauaggccauauauuuauuguaacugagguuuauucuuugagccuuuucugauagugauuuguagguuauaguuuuuaauuuaaaaaaugauaauucucuuuacauguaugagucucccacauuucuuucucuuggguuguuuuacuuguaauaaggcuccaaauacuuuugaaaucauuuauaaaaccaagaaucuuugcuuaugucuuguccacuaaacaaaaggcaagaugugaaaaauaacaucuaacagaaauaggcacauuaucaaacacuggacaauggaggaaaauuuuaaguucuuuguaaauauugccauccugauacagguuugaugagguggaaaaaaagcccuuguguugucuguuuucuuuucuuuuuuuuuuuuuuuuuucugagacggaggcucgcucuguugcccaggcuggaguacaguggugugaucucagcucacugcaaccuccaccucccagguuuacuccauucuucugccucagccucccaaguagcugggacuacaggugcccgccaccacgcucagcuaauuuuuuuuuuuuuuuuuuuuuuuggauuuuuaguagagaugggguuucaccguguuaggcaggauggucucgaucuccugaccucaugauccacccgccuuggccuuccaaagugccgggauuacaggcgugagccacugcaccuggccagcccauguguuuucaaugcucauuaagauggcaaguuuuaguucuuugcauagaaguacauuuaauacacauugauucuuuuuuuaaaagggcuguaguuaaccugaaaauauaaugguaauucagcaugaaacuaacccuuauugugugugugugcauaugcuuuuagcauuuuguguucagguuuuuuguuuuggaucuguagauuuuuuuuucuuuuaauuaucuugaccuugcauuagaggcaaguagcauguucugguuuuaaucuuugucuuuuuguuucuuugauuuuuuuaaauuuggguaaccuuuuaaauucagauuucucuguuuugugguaugaauauuaguuuuuggccuuaaaaauggaaaaaucuugagaggaaagagaaggauucauuaagacuagaaagaucuuuuuaaaguuuaaaugagaaccuuuuccaguaacuuucuaaggguucuguuagcuguaucaguuuaaaguagggaccuacaucauauugcacaucauuuuauagaaguuaaaucaccaggauuucauauuuucccuaugcuuuugacaacauaaaccuguuuucaggguguuaugaguacaagaguuaucuucauuaggauuguuauuuuuauccugugcuuugaauauaucaaauauauuugauuuacuuaaggccauaagguuauauucuaagauacugcuauggugaaucuuuuuguaaauuuaaauuuguuacaucuuuaagguuuuguaaaagccuaguguucacuuguuuaguauagcuacuuuacuuuagaguguuuuuuuuuuuuuuuugagacggagccuugcucugucacccaggcggcuggagugcaguggcaccaucucagcucacugcagccuccgccucccagguucaagcgauucuugugccucagccuccugaguagcugggauugcaggugccugccaccacacucggcuaauuuuuguacguuuaguagaacuggguuuugccguguuggccaggcuggucucaaacuccugaccucaaaugauuugcugcccuccaccucccaaagugcuggcauuacaggugugagccaccacgcccagcccuagagugauauuuuaauggguuaacgauagccucucucugcuaaacuagacuuuuagugaauagcuagcucauagacuaguuuauguauguauaauguuauggagagguggugagauuuguguguauaauaauaugugauuucauucaaacaugcuaauuccuaauuagagcagucucauaguuuuacugacagaucuuuuguauuuuaaguuuaggaacugcaguuucaguaauggccaagauuccacuguuggagugccuaaccagacauaguuacagagaauguuugggaagacuggauucuuuaccugaacaugaagacucagaaaaagcugagaugaaaagauccacugaacuggugcucucuccugauaugccuagaacaacuaacgaaucuuuguuaaccucauuucccaagucaguggaacauguguccccagauaccgcagaugcugaaaguggcaaagaaauuagggaaucuugucaaaguacuguucaucagcaagaugaaacuacgauugacacuaaagauggugaucugcccuuuuuuaaugucucuuuguuagacuggauaaauguucaagauagaccuaaugauguggaaucuuuggucaggaagugcuuugauucuaugagcaggguaaguaacguuaauuugauguuuguuuugucauuuuacuacuuuauauuauuuauccuaaauauuuuauguacugagagaauggguauuaccuuuuaguagaaauaaaugagucuuggagugaaacuuuuaacauagguugaaucaauuuaauucauaauuuuauuuaugaauugauuguaaauuugugaagguuauuugagauuaauaggaaaaauuucuagugcaauaagaauaauuuacauacaguaaacuacacaggucuugagugguucaugcaagaaauaaccaccacacaaauuaagauaaugaaaauuucauugcccagaaaguccccgugugacucuuuccagucacuauuuccuuagaggcaacuucuuucugacuuuuaaagaagaaauuucaaaugcugcaucugccugagaucuuuaaaauucgaaacguagacacuguauuuuuuaguuguguuuuauaguuauagugagcuuguauuuuggauuaaggucuucuccagcacaccugaaaaccuuuuaaaccugaggaauaaauaccccuucauaucugaucugcaaacugaugcaaaaucuuugacaccaggaaggaaguugauggggcauguuucauuguuacagaaauguuaaauaauguugugaaggcugcuguugucaaaagauaauuguuaaaaauaguuaaacuuuucaaggagcaugcagucgaagaagaguucaucuuugauucacuauuuagagcaggauagcacauugucugggaugccuaaaaaagaauacauacauugcuguuaaaguuauaggauauaguaaaauggaaaacaaaaaaucuagguuuugucauucuuucaguauccaguuucuugaugacauucuguaggcuaagcauuucuuucaauuaagacauguuugccagagaaguauguaauauguuaugcaaagauugaucacugccaaaaaugaauuaaaguuaguguuccugcuuaaacuauugacaauguaguggccugaaaauuccauuuaugauuguagauaauugcuuacaugauugugaucagaauaauuaagguauuuuguuuuguuuuguuuuuugaguuagggucucacucugucgcccaggccggaguacaguggcaugauuauagcucauugguucuccaccucccaggcucaggcaacccucccaccucagccucccgaguagcugggaccacaggcacacaccaccauguccagcuaauuuuuucauuguuugcacagacggggucuucuuccuauguugcuuagccuggucucagauugccgggcucaagcaguucucuugccucagccuuccaaagugcugggauuacaggcaugagccacugcaccuggccuaucauuuuuucuguaauuaagcugugccagaugucaaaacagaguuauauauaugaagcgaaccugaaaucggcuuuguauuuccauguucagugugaaauuucacggagucuuagguuuuuuucaauuuguaugacuaaaggaaaggaacagugauucucugacuuaaugaaaagucagccaggcacaguggccuguaccaguaaucccagugacuugggaggcugaggcgagaggaucacgugagguaagaaguucaagaccagcuugggcaacauagugagacucuaucucuaaauaaugaaugaaagaauaaaugucagaaauauuuauaccuucagaaaauagaagguagcuauaguguuauuacuaagcaaucacuuuuuucuuuuuagaaguuaaugcuacauugaauagggcauagcaacaacaucugaagucuuugugauauuuuacaugaccauuauauuaaaaaagcaaaauacaaacuuguauuugguuauuguuguuuguuaucaaauuagcuaacgugacuuuaaaauagugccuauaauauaguacucauuaguuguauaugcccauuagauuuuuuuuuuacuuacucuaucaggaggaguagcuauuggaugcugggcuuaauaccuaggugcuaggaugaucugugcagcaaaccaccauggcauacauuuacacauuuauguaacaaaccagcacaugcugcacguguaugccagaauuuaaaauaaauguuugaaguuaaaaaauauauauuauucugaagcaguuaaaauccaauuuggaaaaauuuauuuauauuuuacaaaguauaugaucuguaaaugugauguauugcguaaugaauggcacuuuaccaugauguuuuuauuagaucaguauuuuucuccucucaggaguacuauacuuuuucuugauaagacuaggggcauuucugaagaugaaccgaguaugagauuucucucugauuggagaugguuuuuuacucucauuuuauuaaacgguuguccaaaacaacuaaccuaccugauaucugaucgcaguagcacuguuuuccaaugaaguaauaaaaauauaugccaagauuuuuuuuccguaaaaggaaauucaguuuaaaucuaucguuuuugcagauuaauuccaauuguaacaguauuuuguaacauguacuuucaacuggcaaauuaaaaugucuuucucaggaaauuagucgagacauagguauuuuggaaauuaggauuuggaauuggaauagcaggggcucaaaucugggcauugagauucauuuacuaucugucauccauaagucacuuaacaugggauuccuaguuuuauauuuuuguggauuaagagaugcuaguuuuguaaauuauuguuuuuccccccauuuuaucugucagaaaaaauuuagaauuguugcugcauuuucguagacucauauuuuuagauuuuaguguauucuugcuaaaaagacucuuuuuuuuuuuuugaguuggagucucgcucugucacccaggcuggcgugcacuggcacgaucucggcucacugcagccuucaccuccuggguagcugggacuacaggcacccgccaccacaccuggcaaauuuuuguuuuuuuuaauagagauagaguuuggccauguuggccaggcuggcuuugaacuccucaccucaguugauuugccuggcucugccucccaaagugcugggauuacaggugugagccacugcacccggccuuaagaugacucuugaguguucuguuucaguuuauacuacaaaaggcacacugauuuguguuucuaacgauuaauaauuggaagugucugcauuuagcacauuucuaaacuguccagguuaaugcagcauaauuuauugagcuuuagcauuucuuucagacaacuugugaucuuaaggaaucuaugcaggggaguggguuuaaaggucagaggcuuaagaauagagaguguaagaaacuuuguuuuauaguuucuuucucaguuaaaaauaauguuagccuuuguagaugccaaagagcccaagaguaaaaauuaauguaucacugacuguuaauuauugaaaauuggcuaaauaauuacuaaugagauucugugguuuacauauauguaauuuaaaacauuucuucaaagauuuuuauuaucugugaacaaauggaauaaaauauuaagugcagugagauuuuaggaagucagcugggcacggugacucaugccuauaauccuagcacuuugggaggccaaggugggaguccauugccugagcccaggaguuugagaccagccuagguaacagggcgauacccaugucuacaaaaaauuagcugauugugguggcacaugccuguagucccagcaguuagggaugcugaggccguaggaucgcuugagccuguagugagcugugaucaugccagugcacucuaucuugggcaacagagccagaacguggcucaaaaauaaauuuuuuuuaggaaguuguguaaacuauuuagugaaucauaaaauacucuccuauguuugucagugcaguuauacuuucaaugaauuauuaaauucagauacguuguauucaggagcccuuguuuuugguuuaaguuguugguauguuaaguuuauguauaauuguaauuuugccuagguugaacauuugaaccaguuuucaucuuuaucaugcuaauaauuuguaaccaggcuuugaugugcauaguacucugguguagaaauacauacacauuggacucaguuaccacaaaauugagaaaagugagaaaauguucacaaauguacaaguagcaguugagacaacauugugcaaaacuaguggugccuauucugaaauaaugguuuuguuaauuuuuucgguaguguuagacaugcacccucuuaacuacacuggauucuugauaauaacaauaaaauaguuuaguuuaauugcuuuuguauguucucuguguacaagacucuaugcauuaaucaguuuuuuccgacuguagagaaggcagcaugaaggagguauuugacuaggaucuuuagagggagagguugacuuaaacaguuaauagaagaauugugaacaaagaucagagauagaaaaacacgguuuaucuugaaaugauagacauuucagcuugaaaagaugagaggcuugaaagauuuuuuucugauaucagaucaaugaagccuuuauuauauucuacauuuauuggauauuaucugugggcagaagaaagucauuugaggguuuuauuaggaacaagcauaguaagucaauaauagaagguuucaugguugcuacccaaauguagauguuaguaaacagucagaaacacaguuugagaaucugugagacugaucagugauugaaguagacuugggaguuaucuccagaaaaguuauacuuaaugcugaaaucauauugagaacaguaaaaaugggcuaaggacaaaauccuucugaaucaucuguuuuagaaagauuagacagagcaaaaggagccagaaaaggaugcugugaaggaaccaguagaaguaacuucccagagccuuuaagguugggaaaagguuaucugccaugcuaacuguugaagagccucaagugaagcaaggucauugguaguuuuuggcugagcaguuuuuauggaaaacgcagacagaaaggcugccagguaaaauauuuuuuuaagggaccaggagcauuaucggaaaauuuuauagguuccaugaauuucagcaaauguguagaauuagagccagggaacaggagagauggaagagugagaaagcauaauugagcaagccgauucguugaggagauagaaauagagaauaaggaaguuuuaucuucuaucuccaggagggagauaaauuugccgaagaaguuuauauguuuuaaagagaaguugcauugauaagagaauuaaugauauuaugcugacauugaaaauaccuuuuucugagagauauugacaagugauuaaauuguagcacugauugaaaugugugauucuugaaaauguauuccuaauuauguauucuaguguaaauucaguguugucaaggauauuuauccuguacuugaccuucuuaugaaaguauaacuuagaguucccaugcuuuugcuuuuuuauaucuuuuaucacuuauuuucucucaagcuguaugucagaauagcaugaaauacauuuuaaacuauuugcugaaaauuguauucguauguguuuccuugucauuuagcuugauccaaggauuauucgaccauuuauagcagaaugccgucaaacuauugccaaacuugauaaucagaauaugaaagccauuaaaggacuugaagaucggcucuacgcccuggaccagaugauugcuagcuguggccgacuggugaaugaacagaaagagcuugcucagguaccuauuuuagacuuuucucaggaaaaggaauuuauaguuuuuuuguacacauguuuuauaugcaguaucaauuuggugugcaccauauuuucacuuuuuccuugaauauuuuuaauguauuaauauuguuuccuuguaauaaaacagaaaagcauguucuuaaugauugaguuuccuauagauaaaccaugaaacugcuacuugaagcugggggcagaaaucaacauuuuuugauauguugaaagcagaugaucauaucaguuauugugcuaaaaauuucaaugcuuccuacuaccccccauaggacgaaggauaagaaaugaaauuuuuuaagaauaggagaauacgaaaucuugaagaauuuacuaauacuucuaauaguaauaccuagguuuuagaucugauuuaaugccauaauccuagaacuguugaaaaaguggauuuuaaaccaaaggaaggugauggaauggcuaaguaagagugguaaauguggacguuucuaagcaaaccagugccucucuuaaauucaugauugccuguccuucacccaccauggcuagcauuguggcaaaaccacccauagcugaauaguugaaugucauaaucagauucugacagcuguuuuucuaguuuaauuuuccuugccaauauuuuuccucuaauuguguucuuucauuggaacauauaaauaauuacaucccccauauuaacuuuuccuuuuuuuuaaggcaaaacauacuucguugauguuauaguuaaggcugauauaaauuagaauguccuuuaguauuuccuuuuagugauaaguucaauuuuguuguuugaaaaucucuuaaaucaccuugauuucuggaggauauuuuuaccugguucauuuaaaauucuggguuguuagcauuuuacuuuuggucuuuuccuucuguuugguuuuuagcaauuuuaguaugaggugccaagauguggcauucuuuguauuuauccuacuuugggcuuguagugcaucuugaaucugugguuuaaugacuuauaccauuugggaaaaaucugagucaguuucucuucagaucuugcuuuucccucacuugcuuuuccuucucuuucagugauuccaguuagacguguuagaccuuucaccauauccguuucauuuacacuuguuuccuguauuuucuuucuuuuuaucuaucugugcuucauucuagauauuuuccuuuaaccuacauuuuaacuuuuucucuuuuuuuaguggcuaacuguagcuaaccacuugcucauuucuuaauuuuguucauuuuucagcucuacaguuucaguuugguucuuuuguauauaguuucauauucucuacccaaauauuuagucuuagccauucaucaucucuuugaucacauuaagcacauagcaguuuaaaagucuguaucuguucacuguauugccuguuccugugugucuguuuauauuuggugguguuucuuucuuucuuucuuuuuuuuuuuuuugagaggaaguuucgcucuuguagcccagacuagagugcaguggcgcuaucucgucucacugcaacgucugccuccugggugcaagcgauucuuuugccucagucuccgaaguagcugggauuacaggcaugcaccaccacgccugguuaauuuuguauuuuuaguggagacaggguuuuuccauguuggucaggcuggucucaaauuccuaaccucaggccugccucggccuccaaaagugcugggauuacaggugugagccacggcgcccagccguauauuuggugguguuucuuauaauucucacucuuauggucuugccuuuucauguaccugauuuuuuuuuuaauaagaaaaaucaaagaaauauugugaggccuaggauaacguuuucuucugcagauaauuuauguuugcuuuugguaugugcuuugggcaguuaccaucguaaauuacuuuaguucaguuucagagauuuggaugauuggacauugguauucuaguucuugggauggccauucuacuuuuaguuuaccccuaaucauaggauauagguuuuaaggaucugaacgcaaauaaacuguuccauuguaccuucccuuggcuggcucuggucuucaacuuuuaauuuucuagcucuucagggaagucaggacugcugacuacuuauuuuuaauuuuggacuccucuucaagaaucagcagaauucuucagagcaaauggcauuccuagucaccuaauuucucucucuugguuucguucuucuccuggauccuagcccuuucacugugccuggcuucuucacugcuuuccuagagccacagggagcuuguugacauuacaggcuaccauuacuagagacagaacucugcauuccugaucuuuugcuucuucugcaguguaguuguuuuuuaacuuccauagaaugaaucaaacaaaauuuauuuaaccauacuucuuuuggugauuauuuaguuuguuucaguuuuuccauauuagaaauauucauugaguaucucaauacacccauuuuuacaugcauguucuaguauuucuuuaggcacaaucuucaauaaugggauuguuggauuaaggucuuuguucauuuuaaauauuaauuaauaauguucuaaugccugccauagaagcaaaaucagucaacacuuccaguaaguaagaagaguaauuucucuguuuucagcguuugccauguauuuacucugaauugucauucgccacauuuucuuuuucauguuuuuguuagaauuuaucauauauugucuagauaguucuuugucuauuauagaucauacagauauugucucuguugauaauuuaucuggaucgaaaaacagaagcuuuaaauuuugaugcagucaaauucauucguauauuuauucauauuaaauuuuaugaacccaucauucuauaaaaucgucuagauuucuuuauaacuguuucucagauugaauaaacuagggcuuucaauuaucuuaccuuagacacucgauuuuucucucucuacuuuuucuuugcuccccuuaaucucucaguauauuaaaauauugcuauuaguccuccugcuuuauaucacuugaacagucaaucaggcagguacauuggaugguuuuauauuuguuaguaauauaaaaagauauuuauugcugauauugcccucaagucuacuugguuucagcaaauggaguuuugucauacaaggaaaagucuuuuucugggaguaugguuggggugauaauacuguuuucucaaaauggaagaaugcauuauuugcgauuugagcuuuucuuguuugcuuucuaaaucugaccauuuaaccucccugaauccaaacugaaguaaaauucagugaaaauuucuuaugcuguuccuauggauauuacaaaauuaguuuuuguugucuugugcucauagagcauccucuuucaacaucuucauucccccuaauuuauuuguaguauuuugcuauuguuuuaaacuaugguagcucauggaauauaccaaaagaauacuauagguaauauuguuacuuuuagaaaauaucuuuucuuucuucgauaccugagugguauaguccuuuuaaacauuucgagacaauuaaauauuuaauuauuuaaguucuccaauggauauuuuuugguacuccuaaguauucauaagaagucaucuacauugucugguuguauauugggagcaaaauuuaagacagaaauauagaccccaagguagacaguuuucaauugagugugccugaaugaaucugaaugugauaggauucaguuuaauaagauuauuuucagugagcucauuagagaaaagggauacccaguugaagcuaggagguauauggugagugagacaacuuuucacaccuauauugucauguauuuggcugccgccaagggauguacagagucaagguuuuagcagaagcaucacuuccucagccaaacuuuccugaucuugaagucuuggucacaucaucagguucauuuucucuuaguaugcuguacuuauccuguaccacaguuguaauuauuaauuacaugcuguuuaauacagucucuucccagaauauaagcuccaaggaggcaggacacuacucuaucuuccauugcuuuaucuacaaggucuuaccacacauuccugauacauacauaguaggaacacaucaauacuuaauaaaaugagaauuuggauuuguguuuuuuugaauuugagaaaugucacaauucuaucuagucuuuggcuggucuggaauuuuuauuuacagaugucucaucaguuacuuuuguugcugcuaaugguauuucccuguugcagauaguuugucaguacuuccuuuagaauguguuuggugaaaaguagauaaauucagauuauccaauuuuaggaguugauuuuacaucuugcuaaacacauuuacaacguaguauaauacauucuagcuacauagcaauuaaaacuuaaaaccacucccaauuaaaagggaaaagaaauuguggaaagggauuuauuauuuauugccugaacaucucauaagauagagaccauuucaaaugccuuugaagggguaauuucuuaaaaccacaacauuuaugaggauuguuguagacccuucuacaugguuuuggcaaaaaaaaaaaccucacucaccaaaccuaugaagcuguguaacacuggagcccugaauauucauucucuagccauucguauccuugaggguuaucagcaaaauuaggaaauaucagggaguuuucuuccugaaccaaauuuggcugaaugcaucuggaacacgauugugaguacuacagugcuaucauguagcucauguagcugucaaaccuuauuugcguguaaaaauauuaguaaugaauuaguacuagaugauuuaugaggauuuuuucuauuuagucugaauuauauugaguaugguugagcaaauaugaaauucaauuuauugaaaaacuuuauuuuuuccuucuuuuagcaauacaguacuuacaugcuuuuggugucaggaaauccuuuacuaauggucuagaauuuaaauuugggauugauucuauauuuuucauggauucaauaaaaaguaauugaaaaccagacuuugcgaaaggaguuaaaaguagcaaauuguuuuuuaauagauuacauuauagaaaaauuauaguugcaguuaaccaaagaguauauugaaagggaaaaaaaaggcauacaguuacuaugaaaauugucuuccuuucagauauugaaccaguuugacuucaguauauaucauucaaaucuaaaugucaugauauuuaggaaaacaugaaacagagaacuaccagaaaauuggaagacacacuuguccuuuagcuggucauaaaguuaaguuccuagaaggauaaugauuuauuuacaguaucaauacagcaaucagauggauguacaaaaccuacaacauuauuacauauaagccacuugguauauagcauaggaaaaaacuuugugguagcaauaaaguauguaguaauaaccuuauuaaguuaucuuuggaccacauauaaagaaaacuaaauauacuugagagauaaaugaaggaagauuauggcagaucuaucuaaauuaauuaguaacuuaaucccuacuugacagauacaccguucaccuacaaaaacaaaugaguaaggacaguuaagaaaaacagaaaaaauguuuuucuaccaaauaauaaaguauaaacucuguguaaaaucacacaauucagucauuguccuagcaaugggagcacagaucaguggaacaaaauauaguccagagauaacuggagagggcagugacuuuucgauaaauauuuuaagggcauuuuauuauuuuuauauuugggaaagugucuaauauacuacuguauaauguuugcuagauuaaaucccuuauuguuuuucagugaccuuguuuuguuugugcugugacugaccgauaguguuauaggauucuagacacauagcuucuaauucucauugacuauuaaguauguccuuggcuaaggggcuuuaucuuucuagccuuuauuuucuucuaguuugaaaaauuaaagaugagcauaggauucuuaaaaauucuaggucuugugccauuuaugcaucuacuacauucgagaaaaauagaggauuuaaaaauauuguuagaaggcacaaaacggguuguguuuaacauaaagauuuuccacuuaacugaauguccauaccuuucaugaaacaaaauuaauguccuuugaaacauuuuuuuucucaaagggauuuuuagcuaaucagaagagagcugaaaacuuaaaggaugcaucuguauuaccugauuuaugccugagucacgcaaaucaguugaugauuauguugcaaaaucauagaaaacuguuagauauuaagcagaaguguaccacugccaaacaagaacuagcaaauaaccuacaugucagacugaaguaagugauucauuuauaucuguuuuaagauguuuagaauugguauuuauauuuauuucucccaaaugauggagugauuuuucccuaccauuuuauugaaauaccuuauugaugaacuuuggaauuagacuauuuuuguagagcuuauauaucuugauuucuuuggcuuaacuaaguuaguaagcuuacuaaguaaguaacuaaguuaguaccaguuuugugaauguugaaaauaauggauuuuauucucuaggugguguugcuuuguaaugcuucaugcugaucaagauggagagaaguuacaagcuuugcuccgccucguaauagagcuguuagaaagagucaaaauuguugaagcucuuaguacaguuccucagauguacugcuuagcuguuguugagguuguaagaagaaaaauguucauaaaacacuacagggagguaugcaaguugaauucuauuuuaacuguauaugaacuuuaacgaauugguguauguuuauguuuaacauaagcuuuccucuucuagugggcuggugcuuuagucaaagauggaaagagauuauaugaagcagaaaaaucaaaaagggaauccuuugggaaauuauuuaguaaguguucauuaauaauuuuaauuacuuuuguaaaggauaaaaguuuuuauaagcuuggauuuucuguagcauacuucauguauaugcuguuaauugccauugauaucuaggaaauauuccuuuuaaaguguauagaauugaauccauuguuaaauuuuaaacuugaaguacugucaacuuuuaauuuaccuuuucaaaaaccagagauaauuuuuugccuuaaauaaagcucuaaaauaaccauauuguuaauuucuuuauacagggaagucuuuuuuaagaaaucgucuguuuaggggacuggacuccuggcccccuuccuuuuguguauguauuuauuuucuaaccaugacuaaauuccauauguuuuaaaaccuuuuuuccagaaguagagacauuuaucagaaacuugcagaaauuguugugguuuaaaaaaaaucaaaauaaaaguguuuuuggcuuuaaaagccaguuagcauaaagcuuuaagauugauauuuguauucauaauuuuuuauaaagaaucuucauaacacaggaagauaccuuauacugcacuguuaggauugguagaaauagauucacuugguuuuuuuguuuucuugucucuuccuuuuuuucuuuccacccuucccucuucuuucuuccacugcucuucucccucccuccuccuuuacagccuccaccuccuccuugcccuucuauauuucuuuucacaccaccccccuuuauauuuugacaaaucagaauaauaaagccucaguuagacuucacuggaauuaaacguuaguuugauauguuucuaaaccauuguuaucuggggucauuaauuguauuacaugagaagaaacguuuccaugaucaaagcaauaugggggcuuuuacccccaucagauguacucuuagcuguguuguuguuguuuuggagacaagagucuugcucuguuguccaggcuggagugcaguggcacaaucucaucucacugcaaccucagccuccuggguucaagcuguucuugugccucagccucccaaguagcugggacuagaggugccugccaccacauccagcuaaguuuuuguauuuuaguagagacgggguuucaccguguuggccagcuggucucaaacuccuggccccaaguguucugcccaccuuggccucccaaauuguucagguuacaggcgugagccaccacgcccagccaugcuuagcuguuaaacauguuucuauacugcaggauuucuuaguguuuuaaauguaugcauuuuuuaauacauaagaauuggugacauagcgauucccauacuuauuuauccgagaacucuuuuuuaugaagagcaucuuggcaucuccacaucugcuugaguaaugauuuaaaacaaguuuuuuuuuaaugcaacucuuggcaauuuuauaaauaaugaauugguaggauuuaccgguuaauauuuuuuacagaagcuaaaauugaccaaaacuuugucuucuggaaaauguaauggaaaagucaaggcaaaagcaaauaagaaaguguuacauggaaaaaaaauacaugugugcauuuuaauauauuaguggcuuuaacaugguaaauauuauauauauacgcacacacuuacauauguguuuaccauauguauauguacauacauacacauacaggauaggaauauuguaauucccauaaaaugaugcuaaaagcagagaaggggaggaacaagugcaucccuugaucacuagcaguucacgucgcaguuuacuaaaggcucaggaaaauaauaugccauaucuuuauugaauggucuuuuuuuguuucuuaaucauuuaaagcacuuuaguuuguuugguauaguaaauuuaauuauaguaagaaaucauauaaauuugcugucuguuuuugguugaaaaaaaauuuuuuaaguaauuaauuuuuuugguacagacucaaaagccucgaaaguuugacugugaacuuccagauauuucauuaaaagauuuacaguuucugcaaucauuuuguccuucggaaguucagccauuccucagguaaaugucauuaguauuuucaguuaauuuauaaccuuaaaauguuuuuauuauucuggaguugugccagguaguaccaguaaucuuaagaggugccaagauaagaaauauuuaagauagacuggcuuuccugugacugcuuugagaaauuucuggggaauaaaaaaugauggaaaaugaagguaaaguaaaggaagacaugccuuacauguaauuauuuuuuucuaguaguuacuuuuugcaugcuguugggaaauuucugacuuuuuacuuuuuuuuuuuuuuuuuuuuuucuugagacggagucucgcucucucgcccaggcuggagugcaauggugugauacuggcucacugcaaccuucaccucccauguuccagcaguucuccugccucagccuccugaguagcugggauuacaggagcccaccaccaugcccugcuaauuuuuguauuuuuaguagagaugugguuucaccauguuggccaggcuggucucgaacuccugaccucaugauccacccgccuaggccucccaaagugcuuggauuauaggugugauccaccacgcccggcccuaaguuuuuacuuuacugauuaugacacaaacuucuuaaaauacuucugguauuaauuuaaaaaggaaugauaaggcucuuguuauuuuugacauauuaaaauauuugguagcaguuaucuacuaguucauuaaaaaaucagaagucuaauugcauugcauucuguuucaggguucccuuacuuugugacuuugaaccucuacaccagcauguacuugcucuacauaauuugguaaaagcagcacaaaguuuggaugaaaugucacagaccauuacagaucuacugagugaacaaaaggcaaauucaauucuuucaaacaguuuucgucauuaguguaaaauguuuguguuccugcagcucuuuaagccuuucuuucuguuuuccaggcaucugugagucagacauccccacagucugcuucuucaccaaggauggaaaguacagcaggaauuacaacuacuaccucaccgagaacuccuccaccacugacuguucaggaucccuuauguccugcaguuugucccuuagaagaauuaucuccagauaguauugaugcacauacguuugauuuugaaacuauuccccauccaaacauagaacagacuauucaccaaguuucuuuagacuuggauucauuagcagaaaguccugaaucagauuuuaugucugcugugaaugaguuuguaauagaagaaaauuugucgucuccuaauccuauaagugauccacaaagcccagaaaugaugguggaaucacuuuauucaucaguuaucaaugcgauagacaguagacgaaugcaggauacaaauguaugugguaaggaggauuuuggagaucauacuucucugaauguccaguuggaaagauguagaguuguugcccaagacucucacuucaguauacaaaccauuaaggaagaccuuugccacuuuagaacauuuguacaaaaagaacagugugacuucucaaauucauuaaaauguacagcaguagaaauaagaaacauuauugaaaaaguaaaauguucucuggaaauaacacuaaaagaaaaacaucaaaaagaacuacugucuuuaaaaaaugaauaugaagguaaacuugacggacuaauaaaggaaacugaagagaaugaaaacaaaauuaaaaaauugaagggagaguuaguaugccuugaggagguuuuacaaaauaaagauaaugaauuugcuuugguuaaacaugaaaaagaagcuguaaucugccugcagaaugaaaaggaucagaaguuguuagagauggaaaauauaaugcacucucaaaauugugaaauuaaagaacugaagcagucacgagaaauaguguuagaagacuuaaaaaagcuccauguugaaaaugaugagaaguuacaguuauugagggcagaacuucaguccuuggagcaaagucaucuaaaggaauuagaggacacacuucagguuaggcacauacaagaguuugagaagguuaugacagaccacagaguuucuuuggaggaauuaaaaaaggaaaaccaacaaauaauuaaucaaauacaagaaucucaugcugaaauuauccaggaaaaagaaaaacaguuacaggaauuaaaacucaagguuucugauuugucagacacgagaugcaaguuagagguugaacuugcguugaaggaagcagaaacugaugaaauaaaaauuuugcuggaagaaagcagagcccagcagaaggagaccuugaaaucucuucuugaacaagagacagaaaauuugagaacagaaauuaguaaacucaaccaaaagauucaggauaauaaugaaaauuaucaggugggcuuagcagagcuaagaacuuuaaugacaauugaaaaagaucaguguauuuccgaguuaauuaguagacaugaagaagaaucuaauauacuuaaagcugaauuaaacaaaguaacaucuuugcauaaccaagcauuugaaauagaaaaaaaccuaaaagaacaaauaauugaacugcagaguaaauuggauucagaauugagugcucuugaaagacaaaaagaugaaaaaauuacccaacaagaagagaaauacgaagcuauuauccagaaccuugagaaagacagacaaaaauuggucagcagccaggagcaagacagagaacaguuaauucagaagcuuaauugugaaaaagaugaagcuauucagacugcccuaaaagaauuuaaauuggagagagaaguuguugagaaagaguuauuagaaaaaguuaaacaucuugagaaucaaauagcaaaaagguaagaauuaaguuuagucuguaauuauaaaauuaaaauaucagugauucguuuguguguaaucacaguaccuugauuuacucauuuaccuuggguaaauguagcaacuaggguauuuucaugaaguaaaaacuuacuuuuuagucaguguuucuugcaaacagaaauaacagacuaaauccaugaguggcuuuuaaaaaaugaaucagcaguuuggauuuucagagaaauuuuuuguugaaaguuugaaauguuuuaaagagcucuuuguuuuuccuuuuuuaauucauaaguuucucucuugauuuauuugcaguuuuuuucuaaacucuucaguagaaaauuacuuauauucucuuuaaauuuaguauauauauuaaagacuaaaauuuuguucuguauauuguuuacuaaaggcuaaaucauaggaacauguagaguguuccuuauuguuauuuucuuaauacaguuucaguuauuuccucugugcuugaaagauguuuuuaaacugcagguuugauacugugguuguggauuggugguguuuuuacauguuuauuauuguuacugucugauauuacugccuuuugaucacagaagaugguuuuuaguauuuuuacuuuuaaucuggguuuaauuggguuuugugacccaguaaacaguuucuagaacauaauuaauaugucaauucauucuaucaugaauucuccaagugaauacauauauauuucaaccugugucuugccuuaucacuuuuauacaaucucuugugauugucugcucuauaauacucauauauugguauacuguuaaaccuccccuuuuggcuuaaaauuagaagcucuuuagguauucugggggagggggcauuagaggguuuaauagaggaauuaggguuugcauguauguuuaaaagcuggaugagagaagguuaacagagucacugccaaaggccaggagagcuugucaaagagaaucagagauggacaguacuuaaagcaguaaaaacagauuauauucagacacuauugcaguauggaaaauagaccucauuauagaacuaggcucaauucugaauacagcaugaacaaguugagauuuauagcuaaggaggguaggggucaguggauggaaaauuacuaagaggaaacauaaggaauaaggggaauuuugguuaaauugaucuaacaggauucuuacugaaggcaggccagggcaauaaaauaccaaggguggggacgauaauuuguucagauauugauggagagauacucucuaaacugaguuagcaagacacuugauacagcuggacagcguaggcccaagaagaauagaugucaaggucgaagccuagaggagccugauugaaguuuaguucaggagagcccuuuucaagcucaaagugaaauaagaggaaaacagaggcugaagcacccaugaaagcugaugguucuccauggcucacugggaagcugcuacaagauucaagaaucucuucaaagcaccagucugacucaaucugcaucacaaaauggauaguucucaguuacuugccaggaagcuacugugaaacugcaucuggcuacagccaccucuggagaauaaaccugugcugcuuuucugccuuccaaaaccuugcacaucuucuuuucauuggcaaacuggaagcuauaccugggauuuugggaaauguuggaucucuguauugcagugcauaugagaucauaaaagaggagcaagggcaaagccuauggaauacuagacaguccagcacuuuauaccccauuuaaaacucagcauuuagacagauaaaugucuuuugcccauauugagcuuccaaauaaagacacuuaaaauaggaaacagcaguuggauugaagacaccaccugaagaaauucauuaaaauccauuguuugucuccaugucuucuggacaggacacauacuuaauguugaauaagaacaugguagaaaccucccuccccugugucgugaagugagaguuuuaggaauuuuacuuggccuuuucuaccauaauaguccuuguuccacgaguaagggaagcaacauggggauucugccaguuucuucugucuauuccaguaacgauucuggaucuaaggauguacagggugaguaucccaaauccaacaugcuccaaaaucugaaacuuuuugagcccugacaugaugcuuaaaggaaaugcucauuggaucauuuuggauuuuggauuuucaacauuugagauauucagcugguaaauauaaugcaaauauuccagaaacugaaauucagaccacuucugcugccaagcauuuccgauaaggguuauucagcuuguuccugucucgaugagggaaccauugggcccaaacucugucacaugagcaccaauaaucuccuccuccuaguggaccacagucacuucagucuucucagagccaguguuugggugaagguuagaauucucuugguaaguuaagccucugaauacuagaucuagaguuuucuguuuugucuuguuuuuacaguuuuaguaggucuuuaaccgguucauucuauuagggccuacggacaaccacuaccacagauuucucugggucaaaaccuucuaauuacugcucuggcucuguugcuugugauagagccacauuauguuucugguggugaagugccacuaacuggccucugccacuccagaagccugucauucccauuaaauucauugaauuucaguguucucaucucccucugcuguuuccugcagagcaccacuacagagccuuuuaagcuuguauuuugcaaagccuugguaaagaacauauucucugggaccucugaggguauaaguaauaaaucccuuccaguauaccugccuuuggaugccuuccuuguagaucaggagucagcaaacuuguuuuuuuguuuguuuuuuguuuguuuguuuuuugagacggaguuucgcucuuguuacccaggcuggagugcaguggcgugaucucucuucaccacaaccucugccucccaaguucaagcaauucuccugccucagccuccugaguagcugggauuauaggcauguaccaccacgccuggcuaauuuuguauuuuuaguagagacaggguuucuccauguuggucaggcuggucucgaacuccugaccucaggugauccaccugccucagccucccaaagugcugggauuauaggcaugagccaccacgccuggccagcaaacuuguuuuuuaaagguccagauaguaaaaauuuuagcauuugcaggucacacacagacuuauucauauaaucugugugcaugcguguuuaccaucuuuuaaauaugugaaaaacaagaacaguggcucucuaacuucugucacaguaucuuuuuacgcucucaaaaauugacuccagacugauuuuguucauagggauuaugucaguauuucuguacuaaaaauuaauggcaagaaauugaaacuuagucauuuucaaauaaccucauuacaugguggcauacauaagacuuuuuuuuuuuuuuuuuuuugagacagagucuugcucugaugcccaggcuggagugcaguggcgcaaucacggcucacugcaaccucccagguucaagugauucuccugccucagccucccgaguagcugggacuacaggugcgugacaccacgcccagcuaauuuguuguauuuuuaguagagaugggguuucgccauguuagccaggauggucucgaucuccugaccuugugaucugcccaccucggccucccaagugcugggauuacaggcgugagccaccaugcuuggccauacauaagauuuuuuaauaaaaacuuucugaaaugaaaacuaguuagaagaguaccauuguucuauguauuugcaaaucucuuaaguuuugauugaaguauaugaaaaaaaauccaaccuuaugcugaaugcaauuggaaaaggaaaggaauauuuaaauagccuuuucagaugauugucgauauucuucuuuguuacuaaaucaaaauucagcaagugguaauuucugaacauuaguuuuuauuguggaauaugcagcuauuaguggauuuucucauaaucuuaacauuuauugguacaucucuuguacuuuuuuacucaugcaugauuuuauagcgucaugaguuggucauuuggaaaacacgaguucacggaguuaaugcagaucuuccaaauguuaacauauuuuagagcuaguaguuuuuacuauucaagaauauucuaagaaaaaacagccuccccuuuuuccuccccacuuugagugcuuuguggugaaagaaaacgacuacaaguaaaguuuggugcuaauggcuuuaauuuguguucagguaccagcaguuugaucaucagugccaauaucaacaaggugaaaaaggcaacacuugguguuacuaugaaaacaguucugacuucacuuguccucugaauguguuugguuaaccccaggcuucuauggaucacucuuugggaaucauuagccuaaagaaaugguuggcaaacuuuuauaaaggcccagauaguaaguaguuuaaguuuugugggccaaauggccucuauccaaacuacccaacuguaccauuuuagcaagacagcagugagacuauauaaaugaaugguuuuggcuguguuccgcaaaaaagcggauuggauuuaccugcccuugaucuagaguaucucauuuugccaucucauuuucauuuaauguugguuauucuuaagucuacuuuccaggcagucaacuuggcaaaguguuaauagccaauauugagucuggaaucuguggucauuacacccguauaaauaauuuuggccucacuccacauugucccuccucuuguaacugucauuagaucuauucccauauguauuuuccauuuuucugccaaaauauauuaaagauucuguaauugcuuugcaauuccuucuuuguuagauuuuuaacucuccagagaucuggcaauuugaguguagcaaugaguauggaaguaauuaaauggugggagagguuguugaaaaggaucaucucauugagaagaggacuaccucaagugaagggacacugauuuccucagacaagguagaaaaaggcuguugcuuccaggaaggaagguuuggugggauuuggaggcacagcugggacaugucucaaagccuugccuuccuuagucacugguuuuucaaacaacuacaaguguguacuguuaugccauguacugcccugguuuuccaguguucuauuuugcacuggcacugaggucauuacugcuuucagaucagagaauuaaucucaguuuccauguuuuaugggauuuuuuuuuccucuagagucauuuuuuuguaucaggauugagcuuauaaaacaaccacuuuuaaauauuucaggauuaaagggauuaauacuagauuuagaguuuacaugaauguugggagaacuaggagacuggauaguaaucuggugaaggccaagagaucuauaauagaaagucaucugaagcaccaaaguugguggcuuaggaaacugauacaguucuuugaagacuuucgucaguugucuaccaagacccccaaacaggugguuuacuuggaagucucuuacgaaucucacauugcccacauguuuggcuacaaccaccuccagagucucucucuucagcaucccaggucagguguggguaucuugcauuggcaaucucaaacauagaaccuaccgaggagggaauucuggauaauaucccuggcuucucugucaugcagaggaaaccuuugaagaagaaagaugcuuaugugaggacacacaguccggcauauuucccuuucaccacuugguucuacauaugccagaagcaacacugaggggccagcugccaaggagaaacauuucuaagauauguauauuagcuaugucuguagcucccacaguaagucaauaagaaaaaggcacauaaucuguuagaaaaauggacagaggauaugaagagaucaaagaagaaauacaaauggccaacauguagauacuguucgguccacuugugauuaaggaaaugcaagaucagaauaucuucuauuuaauuuggaauuauuaaaguuuauauuaguuuugaaauguuuaguuuugaaaauauaggagaaagcuuucuccuguaccuuuguacaaagaaauaagaguggaacguguguaugugguuugcguggguugggaaaucuaccuacuacaugauugauggccuugcucccaggaaguagugauguggaucugagugaguaugggugggagcauuuuaauuuuguaauucuaauuucaaaagagauuuuuauuuuauuauuuuuuugagacggagucucacucuguugcccaggcuggagugcaguggcaugaucucggcuuacugccaccucugccuccaggguucaagugauagaagagauuuuuuugaaaaaacagugaacuaauuguuuacuaggccccauuuuaauucagucaguguuaagaguucaagcaucaagacaaucuaguuuauguucaauguaaauuuucuaguugcuagaaauauuuggauauaauacaguccuuugcuagaacugacauuuuaauggugggaaaaacugucagccuuuagagaugccuuuuuucaaguuuccgugauacuaaaguucccagcugguaacaaauguaucugcuuccuugaguuucaauguccaggccucuuuaaaguauucagguaugcaaagacaggauuaugcaaguuucuuuuaguuggacaaccuuuauugaugaauuucuuagguuucugugguaguguuguuagauuaaauacagucauucccucuugucuaguuucguuuuaugugauuucgcucuuaugguuucacuuaccccaugguucgaaaguauuaaaugaaauaaacaauuccugaguuuuaaauuggacacuguuuugaguagcaugauuuguccaguguauccacacugugggcacucuccacacauuagucacuuguuagccaucuggguuaucaguauugcaguccuuguguucaaguaaccuuuauuuaauggcuccaaagcacaagaguaaugaugucgacaauuuggauaugccaaaaagaagccuugaagugcuucguuuaagugaaaagaugaaaguucuugauuuaguaagaaaaaaaaucaaaugcugagauugcaaagaucuacaguaagacccaaccuaucugugaaacugugcaggaggagcccauucauucucuuuuugccaucacaccucaaacugcaaaaguuaggaccacagugcauauauuggaaaaaauacaggguuuguuacuaucuacaguuucaggcauccacugggggucucggaacauauucccuguggguaaagggggacuacuguauuuuucuaacugaacugugauacgcuguaaccuuuucuucaugaccucccuccccucuacacagcuucuugcuccccauagaaagcuaggcagugaugcuaguuaaaacacaaaaccuauuuuagcuguuagccuuucauugcuaggguuaauuccccugauagcagggccauuucagauccuaggguaauguaaaauuaaaguuguguggcggauagucacuuggaacauuuucuaaugggagcuucaaacaauauggcauaguauguacuuuuggccggauuaauacagccacaagaaaccugucuucaguacaggauaaugauuauuuuucaugucauaaccugugcaaucuuugcuuuuacuuugagucaguaaaugagauacccuaugcuaaucaucuaguguucuuauucugguuuuggggauaugguguuuacagagagugucaggggugucuauaucuguuuguguaccuggaacuguguccucuugucccuguauuaucucagcacagcacugacccugaaauggaguaccccaagcaauccaaagaugcaggacaccuagaaauuauaaguacugccugugcauggccuccccuuccucucuugcacaauuugaaccacacuuuuucuaguacaauucuaggauccuuuaucauguugaaagcucuccuucaggcuucuuuacugugccacauuucuuacuaauauccuuucucacaauagucuuuucaaagccuagauucacacgauaucauucucuagaccaaaccuuucaaugacuuuauaugguacuugcaauaaaauucauaaccuuuacuguucacuaucuguccuucacaucuccaaccucagugcucucuugauuuccuccuuaaaaccuggccuuauuuuuuauuccuaaaaguuucagcuuaccuuagaacuguggagauuucuucaaggaagaaaucggccaagcaggauucuuuguaaacccugccuauaccuauuuuuaucccaagcacuucauuauuaguagucugagucucuuuguaagucucuuuguguuccuuaguaagccuuugauuuauguaguaugucaguuuuccagccauggaguaguuuaaacuugcacaucccccucuucuucagccccaaaggagaaacuuuaaaaguaaauccuucgccuuaauuaauuauauuauggaauauauauuccuuccuuuaauuaacuauauuaugaaauaggggauuccuauuccagccuuucugggaacuaaguaaggagucucagacuuugauagagauauuauguuucaaacugcauauucugcauuuggcuguauaaagcuaucccuuuggaggaaagguuaucugagcagcaaguuuaaguuauuagauuuuuaucaggaaauuuggaagcaugaauaaaaggauuccaauaauuuuuuguaugauuauugauauaguguauucuugucauauaauuagaugaggaaauuacauaagaaacauguagagugaacauuuuaaauacaugcccauauuaauugcagaacacacccugauuucaaaaacauuaaaauaucauuuaaaaacaaagagggacauuuaagccuaaaaauugaccugguaaagugguuuuuaguaacagcaacuuuuugaggcuuagcauguuuuaauacuaaugggauuuuucaucugcuucuuggagaaaccuuuuuuuaaugcuaaggauuaaguugaaaguagauaagauuaauacuuagaaguuauaauuagaaguuaaugaguuauuaauuagaaguuaaacuaaucauuaaccaguguuuguucauuucuucuuacauuguccuauucucaucucuagcacuuugucagcaaccccuaagagguuaguaagucuugaggaaaaugaguaugaguucaggaauauguagauuuguucguguaagcgcuuuucaguuuuagcuuuguguuaccuacuugcuagcagaaaugaaccaaagacuauuuuauggaaauuaaagcauuucaacauaugcaaucuuuagguguuucuuuuuuccuaagucauuguguaaauuucauguauaggaauagcaaaacugacauuugaaguugaguuuaccuaucucuuauguguauagucccuuaccagaaaauacuuuuuccuuauguugcccaggcaggauuugaacuucugggcucaagcaguucuccuaccucagcaugcaccacugugcuuggcuguuguuuuuuuuuguuguuuguuuguuuguuuguuuaagagacggggucucacuuuguugccaggcugaucucaaacucuuggacucaagugauccucccgccugggccucccaaagugcuaggauuacaggugugagccacagagcucggccaaagaauaaaagaauggcuacuccaugggcagagcagccucuugauuuuuauguauguugauauaagcaaauuaucuggaauuuaucugcuauacugauaaaaaucaguaaaccuuguuagugucagcaucuaaucuguauuaaacuuuuacuuauuucccuuuacuuuuuagauucaaagagaggguucacacagauaucuuucaugcuacauuauugagcuuaaggaagauaaauuucccaaauaugauauuugguauauuugugugucuguaauuuuuuuuuuaauuuaaugcuguauuuaauuuguaaguccugccauugacucuaccagaggagauucuucaagcuuaguugcugaacuucaagaaaagcuucaggaagaaaaagcuaaguuucuagaacaacuugaagagcaagaaaaaagaaagaaugaagaaaugcaaaauguucgaacaucuuugauugcggaacaacaggucuguaucucuuuucccauuucauuugagaacuaaagaagguagacauaaauuaacaaauauaauuucuuuauguagcugaggguuucuuauaucuuagaugugauguuccuuacauugauccuguuaauaaauuuccucuugacaaaagcguguauuuuuaagaauuuuuuuuaguuuuuuuacucaucuggagaauaauauuuuucauguuaacaugucacaugacaauaccaggugcuucaaaaugagauagucuuagauuagaagcgagggaauguaaauucuguuccugguuucuucgcuaccuaugugaucuuggguagaucauuuaaccucuugagaacuaagauuaguuuucuaugaaaugauguuuuuaauuuaaaaaaugauuuuauuuuuucucuaagcuucaaauucucuaaacuuuguuauccuaaauuacauucagaucaacauaaauaucuuacccuuucuguaauucuuauccuucugauaggcuggugguagauuaagauggaauauuauugaauuuuguuaauguacuuacuguuguuggucaauaguaagagguagugcuugugaaguauauugggguuagauaaaaaaccagaugccuuguuagagagcuuguacuuuaccuaaaguaccggacagcaacuaauuacaauggcauaauuagauuuaugcuuaaugaagaucacccacuggaacauggagaaagauuggagaacugcaaagcagucagcuggaagagcaauuugguagcuacugcuagaauucaggccagggauaauauugcaguuugggguauacauuuugagggauacauuucugaaacugcauauuuaugguuauuguacacauguaauauuaugugguauuuuuccuuuuccuaaaauguuaugauuaauuagugucuuuguggaauuugaaaaaauguaaaucagagaacagaaagaaaauaaaguauaguugaaaccucuaacaauuuuagauuuuuaaggccuagggaaagaaagaagagccugggaaaagggaaugagaaaagcacaaccagaaaaaaaaguguguggcuuaagggaagccaaggaaaguuaaguguucagggaggaggaauagccaaguuuuaaguaagaauuaacaaugaggaggucaguaguaaccucucucuaagaaucuggauuuauagauucuucucuaugauucauucugcauauugaucucuuuaucuccuuguguugcauugucucuuuguguguucucuuauaagcacauguacaauuucuaaaauuaaguaaagaaugaauuaacugaaaccaaaaguauaguauugacagcugucuaauuuacuucuucauguuuugaugucucuuuuaauauuuauaaaauaagagugggagaaaugacuucuaagguaccuuccaauuuuccaugauguguauguuaaguuguauuuauuuaagguuauuuguaccuagcucuguauaggugauuucugaguuggaacuaauugguucuuaacuagcccccuuuuuucauaugccaauuacaaauugugaucuuccuaaaaauucauuucaaauuacagaaauggcaaaaaucaugaaaauaaacauaaugguuuauauguuuuuguguuuauuuucuauauauaaauaaaauacauagagauggcuuaauacaaagccauaucauaaauguuucuuuuugagagaucuuccuguaugcuuuguggccagaaauuguauuuaauuaaauauuuaaugaauuuauuaaaauuuuauuaaaaaugcuguauuacuuuuccuaaaucucccuauugccagcauuguuagcauuauucauugauccaaggaccguagagcucuuaaaauuuuggaauuagaaaugcugggcagaugagaagagucaguuuagaucauuucaucauucaucuauugcuuuuacauuucaagaagcucaaaaaucuuguaaguaaauuuuuuuuuuuuuuuuuuuuuuugccucuuagagacagggucuuacucugucauucaggcuggaauucaguggugcaaucauggcaugcuauaaccuggaacuccugggcucaagcaguccucccuccuuagccucccgaauggcugggacuacaggcaugugccaccacacccagauaauuuuuguagagacucgaucuuguguugcucaggcuggucucaaacuccugggcucaagcaguccucccaccucagucucccaaagugcugagauuacaggcaugagccaccaaguccggccuaagcaaaauuuuuauacagauucagucaucuuuauuaaagaaacugugcaguuaaaauugccagauugucucaugagauccaugcaggcaguuggauaugugagcuucauaguagaguuuauaaaagugggggaguaauaagucuagccaauauaaaucagcauuccagugaccauugcagauauccaaauaagagaaauaaggaagauagagucauaucuaaaauguuaggguggugaucaaaugcuaaagacaaaaggaagguuucagaggcaggaugauuacuccaggaaaaaaguaagugucuaacagcacucuaaguuauugaugcuucuaauucuucaaaauuucaaaaucucugacaguaaauauauggacaauaauaagaaaauaggauuugcuuucaagagacuuaaauuggaaccaagaaaguagaaccuuugccacaguauguuacauuuucauuuuuaaaacauuucaugaaucauaccccaucaucuccauguacaaaugugccacagaaaagaauauuugcaaguguauuuucuaaguccuagcugcuaaguacauguagauaaauuuaaauaauuauucucuuguuccagaccaauuuuaacacuguuuuaacaagagagaaaaugagaaaagaaaacauaauaaaugaucuuagugauaaguugaaaaguacaaugcagcaacaagaacgggauaaagguuuguacuguuuuguacuauuuuuuuuaauuuuuuaaaguggaaaagauacauucaugcaaagugguuuuuuuaauuacaugauacuuuuuuaaauuuggguguccuucagauuugauagagucacuuucugaagaucgagcucguuugcuugaggaaaagaaaaagcuugaagaagaagucaguaaguugcguaguagcaguuuuguuccuucaccauauguagcuacagccccagaacuuuauggagcuugugcaccugaacucccaggugaaucagauagauccgcuguggaaacagcagaugaaggaagaguggauucagcaauggagacaagcaugaugucuguacaguaaguauggcuguuuucaacuguuuuuaaggcuguugcaauuccaugaguuauaaagcucugaagagaggaaauauuuuuagcauuacugguuguccacagcccauguaucugaaaguugugcuauuuuaauucuuuaaacuguaagugugagaaaacauuacugaaugaauuauuuugggguacucucauacuauacaaaguaugugcaccagaauuaucccauacugccaagauaaggaucauggcaguaguauugagccauucuuauuuacagggaauguugacauuuugggguccauuaccuauaaagggguuauuguaguaaugaauauauucauuuuggugaggaaaagcagggaaggguuuuuuauuauuauuauuauuauuuguuuauucauauauagcaaauguuuacugcauuacauugaaaucguggcagagcuuacuggaauuuagaacuuucuuaccaguucuccuuugaauauagugaaagaccacuaaaauugugcuuacaauuauaucuaugggagagacagaauugggaggagaaagugcuccucuccaaaggacguugcaaguagaguuugcauuucuaguugcaccucugggauuucagauaugggaacugagauuccaagggcagaaaguccagaucauuaugccacacaaagaauuaugcccagugggucagugaacacuacacccccaugugagaugaaguaauucgaacaagugauuaccaaaagauaucauagaaucagcgugguccccucguucaaacagauccagguucaaguccugagucuagcaccugcuugggaacuugagcaagucaucaucccuuauuuuuccaucaagauaacaguuaugauaacaagacaacaguuaugauacaccagcaggguugcuuugggcauuaauauuuuauuuuauuuuauuuuaauuuuuuuuuuuuuuuuuuuugagaugaagucucacucuuaucccccaggguggagugugauggcacaaucucggcucacugcaaccuccgccuccuggguucaagugauucuucugccuuagccuccugaauagccgggauuacaggcgccugccaccacgccuggcuaauuuuuguauuuuuaguagagacgggguuucaccauguuggacaggcuggucucgaacuccugaccucaggugauccacucaccucagccucccaaagugcugggauuacaggugugagucaucgcgcccggccaggcauuaaauuuaaugagcacccgugagaaggugugguacacaguaagaaaccaguaagugcaggguccuucguaccccaccccugcccacucagaggaacgcaguuaguugcaucuucauauaagcccauuaucugccugaccuuugagaaacuuugguaggggaguuuuuuguuuguuuguuuuugaaaaauaaaauuacuuagguuucugucugguugaaaggaaaauaauagaaacugguuaccuuuagacuuugaaagguauaaggcuuaagaauguauauuaaaaauaaaauagaacaaaaaaaguaauucaaaaaagcaaaucaagaaaacaugguuaagcaaaucaagaaaacaugguuauuuagcaaacaugaaugacauaaauauguccggacaugugugaaaaaagugaaccaccguaugaaaaccucuuuaaaaaaauauauccaacuucauucuacauauaggagagguaccuagagccaaaugauacagaaaguuuacuauaauaugauucagaaagauauagaagggaaaaauauaaaagcaauucaaagcaaaaggcuuuaaaaagcuuuaggaauuuaaggcuuuuuugauugacacauaaauuauacauauuuaugguuuacagugugauguaguuacauguguacauucaaauuagaguaauccaucaccucaaacguuuaucauuucuuuauggugagaacauucaaaaugcucuuuucuagcuauuuugagauagcgcaguacauuauugaacaccaaaacuuauuccuccuaucuggcuguagcuuuguacccguugaccaaccucuccucaucuccucuccucuguacucuccccagccucugguaaccacuauucugcucucugccuccaugagauaaacuuaagauucugcauauuagucagaucauauguagguuuuuuuauaaauaugaaaauugaguuauucagaaccaaaguaucaaaaacagauaugacgaaagugguacucugagagaacuguguaguuccuuuauuuuuaaaugaauuaauaaaaacaaaugagccacaauaaaauaaaaguuguuuaguagauauugggauaaauagaagguacaaauaaauauauguaaugaaaagagggacauaaccuuaguuauaguuuuaaaaauuacagagaacaugauacaaguuaaucucaccugugaauuauaaauacaaggaauccugaagacaauuuuagcuuaucaaaugccuugugguuuuaugaugauauagucaucaugacccaguggaguauuuuaggaaugccagaguaauaacuaaacaguacaauaccuaaccauacucacugauuacuugagaagguuuauagagucaugucaguagaagcugaaaugacaauugauauaaugcagugcccauuuauuuaauaauuuaacaaaauccuuagcaaacuaggaguagaugggaacuucuuuuuauuuguaaguauaugggagagacauagcaagcaucguauuucauauugaaacauuuagaaguauuuuucauaaauucaggaagaacacaaugccagcugucaccauugcuauucagcaagacaauaaauaaaauuuggaaacaacuuuuucuguccucauuuucagacaguauccuuuacaaaccacaaagaccuaaagacauauuagaauuaacagaguacaucagaguguagaucauagauauauccaaagaggaguaguuugcauauuuaccagcaaaagcugacuuuaauauguauaaaagaucccaauaaaaauuuaaaggaauaacuuacuuguaauuaauuuaacaaaaaugcgcaagacuucgugaagaaaacuaauuuuaugaagaggccugaaagcuguacguggaaagauagauggaaauggaguauuauuaagauaucauuuuucuccucagauguauucagugauuuaaucuauuacucaauuaaaauucuaacaauauguuagguuaaaaagugauguuugaugcuagaauucauauugaaaaauguguaaaaauaauugauagcauuucuaaauaaagaucagagaguagagauuuguccugcuagguguuaagauauagucuuaaacuacauagauaguauuuaaugcaguacauuauugguauagccacaggcaaauagauuaauagaguuaguaaucuugaaacaaaccaguggauauauauggaaaucuacauguagcauuuuaaaucaguuugguaaaaggauggacuccucagaaugggacauuagaggcauuguugaucuauuggugagaggugagccauauuuuacauuguauauauaaacaaaaugauagauguaguaaagacuaaauuuuuuuuugaacuuacagaguuucuuaaagaaaauaaaagacuacucugaaaucagaguaggagagcacuuggaaaacaauaaucaauauuacauugaaauuuaaagcuugaguacaacagaaaacaaacagcagaagucuggugguuaauauuuuuaauaaauaaaagauaaaaaccaaacuuuuaaauaaugccaguuuuuuauaaucucuuuuaaaaaauaggagagaacucuucccaacuuauccucugaggccaguauuauauacuaauaccaaaucagacaaauauaucaaaagaagaaaauacaucuucuauaacuauugacacaaauauuaucggcaaaauacuaauagauccagucuggcagaauacaaaaggaauuccaauuggcuuuauuucagaaaugcaagguugguuuaacaucuaaaagucaauuuaugucauacacuauaucaguagaaugaaaggacagaaaaacacaugauuaucucaauagaugaagaaaaagcauuugacaaaacccaacagccuuucaucauaaaaacacucaacaaacuaggaauugacuuccucaaccuauugaaaggcaucugugagaacccacaauuaacaucauacucaaugguguaagacugaaugcuuuuccccuaaaaucaagaugaagauggccugcucuugccacugcugcucaacauuguacuuggaaguucuaucacgggcacuuaggcaagaaaaagaaauuaaaggcauuggccaggcgcaguggcucaugccuguaaucccagcacuuugggaggccaaaguaggcagaucaccugaggucaggaguucaagaucagccuggccaacauggugaaacccagucucuacuaaaaauagaaaaauuagcugggcaugguggugggcaccuguaauuccagcuacaugggaggcugagacaggagaauugauugaaccugggaggcagagguugcagauugcgacccugcccuccauccugggugacagaacaagacucugucucaaaaaauaaauauauaaauaaauaaauaaauaaauaaaugcaucuagauugguaaggaagaaaaaacacuauuugcauacauagccugaucuuuuauugagaaaauccuaaggucuccucuaaaaaaauacuguaauuaacaaacuaguucaguaauguuggaggauacagguucagugugcaaaaaucaauuggagcuggcugugguggugcacagcuguggucccagcuacucaggaggcugaggcagcaggaucccuugagccuagggguuugugaacagggaugacauaacaagacccugucucuuaaaaaauugucauucuuucuacuagcaaugaaucauccaaaaaugagauuuaaaagacaguuucuuuucugauggcaucaaaaagguaaaaauacuuaggaauagauuuaacaaaagaaguucaauacuuguacaaauuacaaaacauggaaaaaaguuaagacaguagggcauccuguguuuacugacuggaagacuuaaucgccuuaagaugguagcccuccccaaauuggucugccaguucaacacaauucuuaucguaaucugaacuguguuauguugcagaaaagggcaggcugauccuaaaauucauauggaauugcaagagucccaaaauagccaaagcaaucuugaaaaauaacaaagucucacacuguuugacuaaucuuaaaauuuguaagcaaggguaauaagacacuguagugcuagccugacuguaucaguggaauagaauugagaguccaaaauuagcccucguauucauggucgguugaacccuugcauuuugguuaaaggugcugagacgguuccgugaaggaaauagcuuuuucagcaaauggugcagggauagcauagcuggauauucugaugcaaaaggaugaaguuggacccuuuccucaccauaugcgcagguugacuuaaauagaucauagacuuaaguguaaaagcuaaaauuauaaaacucuuacagaagucaaucuuuaugaccuuauauuaggcaaagcgucuuccuaaagaaguagcauguugaagaagacagaauaccugccuugcaucaaguuacuugaaauauaauuuggggauuauaccuguagaugaauuuuaaaaccuaaauaauaauuguuuuucucuuuucuaauuuuauagcauuuuuuaaaauuuucuaauuuguuuuuggauguuuuaguguauugggcaaauucacaccuggcauaguaacuagugaguacauagcauccacuuaguaaaucuacugaagucuuuagccacucaagaacuacgacuuuaucauggauucacucacaaauauuaagaagagugguucuuaaugccugggaaaaauaagaaauuuaaagacaucucuagauaaaugcauacacagaguuuuacuuauuauuucaaaagguuuauagaucuaggucugcuacagagaauauacaacauugaaauuacaugcuaacugaaauaagcuacuuuugaaaauuuaugaaaacccuuaaauuguuaaagugaucuguauuaauauuuuaauuucuaaaaucuugaagaauguaaaguuuagaauuucaaacugaaacucaauuauucucacuuuuagagaaaauauucauauguugucugaagaaaaacagcggauaaugcuguuagaacgaguaaguaaauuaucuucuugaaguaccauguuuaauauguucacuuuuggauacaguuaaacuucauucuggaaacauacaauagacuauuuguguuuauaaauuaagccuuuuuaugauuaacuuauuuuuguggucacuguuuugggaagucuugucauuuuaugaucuuacuagcuaaacaguugacaguauuucagcccucccauuuguuguaauuucccaaugaaugaagucuguaugagaggaaaaaguugguaguuuuuauuaaaucaauguguaaaguaauaguuuuaccuaauaguugagaauucagcaaaauaacaugaauggcaauuuuaaacaucuauuucaaaaacaaaguauuaaauacuuuuuagaaauuggcaaaaacaaaaauaaguaaugaagggaguuauguuuuaaauaaagaauugaaauggacaagaaaaaacugauaauaaaggguuuccuuuauuaaggguacuauaagaucaaauugguacacauuuggcagaucauuguucauagauuacuuuucauucuuuaggccuauaagauuuucaacaaugccuuuuuuucuuuacaaguguaauugucugauaaaaauccaaauucagaauuguacaacuucauuugaauauagcauguuuucuauuaugaaaggguuaugugauuuccuaccucagcauaaccugagauguauguuacagaugccagauguauucucuuaggcacgacuuaguuaacaaagucucuggggauagaucucagauuuuuacuacauauuuauauauuccacagguguuucuaacgcauauuaauguuugacaguccuugguaaauguaucuaaaauugcucugguucucauuuaagcuaguagauaaugaaaacauuuggaaagaauucauagaaaauaauauccccaucaacuuuucauacccgaaccaaacauuuuugucugaugaaaacuuugacaaucacuguuuagauuuauuugaguagguacaaggauaaaccacaggucucuuuuuuccaccugcagacauugcaauugaaagaagaagaaaauaaacgguuaaaucaaagacugguaagauuuuucuucuugguaaauuggucuuaacauuuuuaaaugauuugcauuauauuucauuaugaagauauuccaucagaggauguaugcuuugauugacuuaucuauaguagguuuguugguccguguuggucauugaauccuauugauuuucagaaugcugaagucaggccagaguuaucuccugacuguagagucagacuuuuuccuuagcgugaaauuaaauaaugucuuggcgaauuuacggcuguaggucugaccaguugaagcaccuaagauucuuaaaaucaucaaaaucaguuuugaguuauguuucauaagucuuuugaagauuaauauauuuacucacaagugugcguaauuuuaauacauuguaucuuuucaugauuuuuuuuuuuuaagacagucuugcucuguagcuuaggcuggaguggugugaucucgacucacugcaaccuccaccucccggguucaagugauucuugugcauuagccucccgaguagcugggauuacaagugugcugcgccgucacacccggcuaauuuuuacauaauuaauagagacaggauuucuccauuuuggacaggcuggucucaaaccccuggccucaggugaucugcgcaccuuggacucccaaagugcugggaguuacaggugugaaacauugcacccagcccuuuucaugaaucuuauuuuuaagugaaagugccugaaaggcaagagaucccaugugguacuguaaauugcccugguuuuuauugauuuguuuuguuucguuuuuaauuaaaaaaaaaaaaucgagacaaggucucucucuguugcccaggcugaagugugguguugcgaucuuggcucacugcagcuucaaccucuuuggcucaagcaauccuccugucucagcucagcaaguagcugggaguacaggcgagugccgcugcacccagcuaauuuuuguuuuguuuugguuuuagguuuuguuuuuuuguuuucguagagaugggguuucaccaucuuguccaggcuggucucgaacugcugagcuuaagcgauccgccugccucagccuccccaagugcugggauuccaggcaaauuggaauugccuggaauuuugcugcacccaaccaaacugccuuggcuuuaaccugugaauuuaaccaauuauuugaacagcccauuuuacagccaauuauauguuuuaauaaagcaauaacuuuauuuuuucaaguucuauuaauuacaguuuacaagguaguaggaacaguuuaaggcuucuguucagugcuuuugaaaaguuuugaaauacuuuuuagaauuuaguuuguuuaaaaaauaaaaauaucuuguagugagacaucuccuuucuucuuuauaccuuaacuugaacagcaaaaaucacauauuuuguagugauuauacugugaaucauuaauuuuaucacaaagacuuagaagaauggucuaucucagacaugacucaauacguguuuuauguaguaugcuuuauuuauccucaauagaauauaagcucuguuuggcaacgauuuuaaucaguuuuggucaccgcuacauucuuagcaucuagaaugguaacugguauacuauagaugcuuggcauauguuuguagauuaauugugaacccaaaaguaucugagacaggucucaaucaauuuagaaaguuuauuuugccaagguuaaggacgagcucaugacacagccucgggagguccugacgugugcccaagguggucaggacacagcuugguuuuauacauuuuagggaaacaugagauaucaaccaguauguguaagauguucugucuggaaaggugggacaacucaaagcugggaagagggcuuccaggucauagguagauaagagacaaaugguugcauuauuuugaaacugugauuagccuuucacugaauacacaauuuacaugucagaggaugguagaggaauugucacuuaugcuucagucugacuuagugaagcaguggggccgagaaagcaaucauauacgcauuugucucacaugagcagaggaacagagggaugacuuuaaguucugucuguuuuuuguccacaaggaauuuucuugugggcaaauugugaggucuuuguagcuaucuuauuuuaggaauaaaaugggaggcagguuugcuugauguaguucccagcuugaccucccuuuuccuuagugauuuuugguucccaagauuuauuuucuuuucacagaauaaauugucuuucagacccagagagcaucacagucacauucagaaagguguccaaauguaaaucacacuuucacauagaauuacagcuauauuaacaaauuuuuucuuccauugucuucauuuguaauauauaaaaaacuuaagcuuuuaaaaaacuaaaguugaauuauggucuuaaaaaugauggucaaucuuaucuucacuggcaggauauagaccauuugucuggauaauuuuaguaaguugcuauacaguuuuaggccuuccuaguuauuauuuguuguguuauuucucuuuuuaaaacccugcauuguaccagauagcguucagagggaaguggaggaaauucagagcaucaaaauuugacuuaauaaacaaaauauccuuaucuguccuugguuugugcaaccaugcauugggcucacuuugcuugggaaaaauagguguuuuuaucacccuuucaagcuucaaagaccuugguuuccaugcuucaggucuuaugagaugguguggauaaauggauugaagcuuguuugaagaggagaacagucccggcuaagccauggcuauagcuuaucagcuagcaaguaccauuugauugugcucaucaucaguagaggaaguggguggcuaucacaaaauucauuguuucgugauuguucacaaauuuuuuuaaacugagacaucucagaaguuucauugaagaugagaaaagagguuuguucucagccuucagaacuuuaugcucccaccccaguuuaaccagaguaguaguguuugcuaggcaaggugucagagcgcuggcauugcaaagugguugacucugguuugguaagaagaauuuacugacaacaguauagguuugaaaaaggaaaguuuuauuagagcgaaugaugcugaagaguguagcggggugccucagcaagagaggacugagcacgcuguggugaauuuucccgacgagcauauauggaccuuaaggcaggaucuuaaagguaguuuggaccaauguuggccguguaggucaugauaaaugauuacauuuguagacauuuuugugucuugaugucagcaaggguugcucagugaguuuuggcaugcauacauuccagagauguauagaaauucuaguuacuuacaacauuuuugaaagagaccuguaaccacaugcuaggaaaguuuaauuacuucuaaauuccucagcguucugccuccagauggccuguuugauggucaccaggugucuuugcuugcugcauuauacuucuaaccucugccuuccaggcucaagugaucuucccaccucagacuuccgaguagcugggaccauaggcgcuugccauuaugcccagcuaauuuuuuguauuuuugguagagaugggguuucaccauuuugcccaggcuggagauuuuaaaucuuuuugguuuuuuuguuguuguucguugggacaacuaaguuccucuucaaagacucaacuuccuggucauaaguuguaagauuguaaaucaaccccauccccuucuccccucugccuucuccuuuucucacaaaucgcacauuuacccuauuuggaaaaaguuuaggucuaagcuaaccgggaucagcuuagauugugugguccaaccccagccaauaggggaaggacacagaaacagaaacugcauuagagauaaaaccccuuccuuccuuuguuugguguucucuugcaauugugacggcugugagcagcagccuucugcagaaguaaaguugccuugccaagaaauuuucuaaguguggguuucuuuuggcuacacugagcacuuguuuccaacauuguuguuuuuccaaaaugaaagauuuugaaucuaaugcauuagaauuuucaaagucuucuugaaaaaucuguccuuuucucuguguuuuauuuuuaagauuaaauauguaauauaaauaaaaugugauucaaaaaucaguuuuuaaucuaaccaaauuuacuaaugguugaaauaaaggaauuauuaaugaacauaagaacuauauuaguuugggcucuuuaaagcuggacacaggcuugaauguguauaacagugggugaaauuuuugcaguaagaaugcaugugguacucaaauuguguaaguucauaaacuuuuuuuuuuuuuuuagaugucucagagcaugucuucaguaucuucaaggcauucugaaaagauagcuauuagagaguaaguauuuuaguuuugugaguauuuuucugugaaaaacauucacugaauuguuaaugaaaauguauuucagugacaguaauucagguccagguucauugagcugaguguuuugcacucaguaguaguaaaaguuuuuuacuggaaagcaggauuuuucuaaauuguuauucuggaaacauuuagauugccaaaacuuuccaguuauagcauuaugauuaacauaaauauccuugaagccuuuuccuccaguuaacuuuucagcaugugcuaccucuuuuaaaucccauuuaucuccuuagucuuguuaaucuauauuggagaguuuugauuuguuuuuaaguugcaguguuuccucauuuuuaguuuuuagauuucauuuuauuaauauucuacaaauucauaauaaacaaauugucaaugaaaaagucaaacucuguaaaauauuugaagauauuuauucugagccaaauaugagugaccauggccugugacacagcccucaggagccccugagaacaugugcccaaggugauuggaugacggugagggggaaacuugguuucauacauuuuagggagacaugagacauugaagauacaaguugguuugguccagaaaggugggacaaaugaaagcugggaggguagcuuccaaaguauagguagauuuuuaaaguuuucugauuggcaguugguugaaagagcugucaguagaaaggaaugucuagguuaagauaagagguuguggagaccaaaguuuugucaugcagaugaagccuccagguagcaggcuugacagauaauaguuuguaaauguuucuuaucaggcuuaaccucuguguuaguguuaaauucuuguugacuuuuccugaauucuaagagggaagaggacaugaugaggcaaguccaaccccugccuuuugucauggccugaaccggucuuucagguuaaauuuauagggcacuggccuagaggaggaaguucauucagaugguugguugggggggcuucaaauuuuauuuuugguuuacagaauuuaucaauugaaugguuuaauaauuuuccugcacuguauuaccccauaguuaaaauuuuucuuuagcuuugguuauuuaaauggagcucuggaauaauaaaagcauuguuagcaacuuaugaauaguguucagccuuuuauccugacaggaagguugugaaaguuaagacccuuuauuuaacuucuuguauuuuauuucuaaauuucuaaauuuguugaccacauuuuugguugucagauaucugugauucugacuuuucaugucucauuaaaauuucagcuucucucagugauuugaaagggcuuagugguaucugucuuuaccagcuguaugucaugucaaugggccguucauuaauguucuuucagagacuagagagagaggagcuccaaaaauacugccucauagaggccccauuucccaucuccccauuuuaaguuauuagcuuuuggcauuuagccaaaacagugccugccacaugguuguuagguaaucacuaaguauuuguaggguaacuuaauaaauaaaagacauuaaaaguuuccccagcugauuuugaugauuuauuagguauaggaucuaccaauuuaaaugaucuugacaacugaaaaauaugagauugauuuucaaggccuuuugauguuuugaacaacaguucugaaaaaggcuguaaagagacaaacaccacuuaagcauguaauugguuguacccacuucucucuuucccugucuucuuucgggcuuauaccccaaaauaguaauaucuguugacuuguuuagaccuaauuaagcaccugacuucuggaccuagcucaguugcuuuuucuuguaaauugaagagcacuacgcuuggagacaagaucuaauuuuucuuugacacugugacuguauaugagaugucucucugaauuuuuggugugaaaugaaagauuaggagaaaaaaaucuugcuaugacuggauaaacuguaaugggugcuuuuucugcuuuucauccaguuccuuaacguuagauaauggaaacuuuauuaaagaaauuuuugguuuuugacagccccugacaucauccuuugaauaucugugcaugaccagcagucccauuaggaccugggcagaaugcaaaaagaguaucauguaaaugugaaauuuaauauugcauuaauaucuuaauauguaguugagcauuaaguauauaugcuaaguuuucagaauagggggauugaaaguaacucuaagucaauaaaauugcauuucuuuauucaguuuucaggugggagauuugguacucaucauccuagacgaacgccaugacaauuauguguuauuuacuguuaguccuacuuuauauuuucuacauucagagucucuaccugcccuggaucucaaaccaggugagggugguaagugucauuccaugacuaaaauauaaaccuggaauggaggaaauuauauaaguaaagauuuuuuuuucccuguuuaauuacauaagaauuaagucacuaagagggaacccuguguaaucugcuuuuuuauaaaaucuguauuaucuagauuauuuucauggauuccauuuacaauucagaauuaaggaguguagcuuauacaagggaccaguugaucagaaugugcagugauucggacaucucauaacccuagcaguuggauaauuauauugucaaaguucucauguacagacuauucaaaauuaauguaugcuuauuuguuuauauaaaagcauuauuuuuuggcaaaaaaaacuuucuuaaauuauaaaaugucuagucuauccuauaucauccuauguuccuaccuuguuuaucauuauacuguucuauacacuuauuuuuuuaaaaaggaaauaagcuuuguuaaaauauacuaaguaacaaugucuauuaucuauuugauuuuuaaaauacuaaaaaagaacagaauagauauccugguguacuuagccuaaguagaauuauuuuuaacacuaaaacgaaguaaguccauuuagauugauguuccuaaucuaauuggacugacucgcaacaaagucaaguaucuuaucuauauauuuauagguagauauuuuuuuucgaaacggagucuugcucugucgccuaggcuggagugcgguggcacgaucucagcucacugcaaccucugccucccagguucaagcaauucuccugccucagcuucccgaguagcuggaauuacaggcgugugccaccacgcccagcuaauuuuuguauuuuuaguagaggcggguuuuuaccuguuggcuaggcuggucucaaaacuccugaccuugugaucugccugccucaggcucccaaagugcugggauuacaggcuuaagccaccguacccggccuuuuuuuucuuuaagacaaguuuuugcucuguuacccaggcuggagugcaguggcaugaucauuggucacuguagccuugaacuccugggcccaagcaauccuccugccucagccuccugaguagcugggacuagguacuauagauuugcaccaccacuaugcccauuuuuuguuuuguuuuguagaggcagggucucacuuuguuggccaggcuggcaaauuccuagucuugaacuaggccacuuuccccaugacaacuccaucauggcuauuugugguuggcuguuuagaguauccaugaaacaguaaucauguaaccaugaaaaaugagaagauagcuuauaacuuacuauuuuuacuuaguacuuuuuaccuugaaaauaaugaaccugauauuucuuuugucuuuuaugggguuuuuuguuuuucaguuguuuaaaccuuuuauuugaauaugauuuuuaaacuuagaaaacgucgcaaagauuaauauaguacaaagaaaaccuauauuucuuuacccagauucaucuguuaacauuuuaccccacuugcaauaucuuuuuauguguauguaucuaagauauaaauauacacaaaugugugcacacuuuuuucccccagaaccguaugaugauaaguuacaucuuagcccauuaccuuucaacauuuccauguucauuuugaagacuucaguguuuaaaucugggaaacauuaaaaaacuuuuuuaaaaaugcacacugccauuuuaaaggcuuucacaaguacugcagaaaagaauuuauuuauuuagcagucuuacuuaaccauuaauaaacccccguuccuuuuuuccuuugaggaaugccaguugggaucaugcuaccccuguguuguugccuugggagagugcggauuaccagaguguuuuuaugccuuuuguuaguggggcucauuacucuucuggcaucauacaagcauuuauuuuuagaugauucuuuuuggauguuaguaauuggcugugaagugcuaguuugcucuucagagaauucaccacauccuauuguccaggggcuuuucuguuucugucaugugaucguauucuucagguucauuucugauuauuuauuugggauaucuuucguguauaucuucccaaauuauuuguauggaauaaaaauccguaugccuucuuucaaaggcuuuagccuaaacacaauacagacaguucccaacuuaugguaguucuacuuaaaacuuuuugacuuuaccauggugugaaagugauacacauucauagaaacccuacuuucgguauccacacaaccauucuguuuuucacuuuuaguauucaauaaauuacaugagacauucaacacuuuaaaauaugcuuuuuguuagaugauuuugcccaacugaaggcuaauguaaauguucugagacuaggcuaagcuaugguguaugguagauuagaaguauuaaaugcauuuucaacuuagauauuuucaauauaggauggguuuaaucuggacauaaccuuaucauaaguugaaaggcaucuguaguuuauugccugaauacuuuugaagucaacuuuaauaagacagcuucuuuucugaugaauuuaaaaagagaauggguaccacuuggcuugucacauuuuggcuuuaugaggacuaggauuauccugucuucucucacauuuuucagcuuuccuucauucacacaaguacugcccuucuagaauuuuuugguucuuagcccuuauuaauuuauugaguaccaacuguauacacacugcugugccaagcacuguggcauacagaugugagaacuguucacuugcugccuuugagaacuuguauuaaaaauacugcccaucaaaaaugaguguuuugcuuugaaccuauacauuuuguuugcuuaaagaaaugggaaaggucaucuuuauuaguucuuucaauagauggcacuacugaguuagccuagaauuccuacauauuuguucaugauuuguauuuagauuauuaguguuuccugaacuguuauuucugugauuugacauaucauguauauuuaaugaguaacaagagcuacgcacacauuacugguugaaaaguaacaugaauuuaguuuuguaaauuguuaagcauuucagugauuucgguaguuuuuaaagucuuacauauucuuccacucaugagagcuuuuuuagucuguuuuaauucuggcaguuauguuuccaugaauaauuauaaucauacuuucaaaaagagauuaacuauuuaauuucauuagcuucaggugcaucuagaagacccuggguacuuggaaaaguaauggaaaaagaauacugucaagccaaaaagguaaaaacgacaucaugugauacuaagccugggaacuguaaagaagauuuuaauacugcuuuauauagaaaucauuaccacugcuguucuuggccuuuaugcucauuucaguuagagcuugaauuuaaugagagugaguuugaacuggcaauuuauaaguauucaugcugcccuuagauaguagagauagauuaacuacaagcuaucaacauauaauggaaaacuacuacgaagucuguguucuaugacuguuggguugcuaguguaacuaauuugcaagaaaaaaaaucccugcauaacuagagacaaaaagggaauuuuauuuauaaauacaguugaucuuuuauuauuuucauacucugcccccauugaagaaagguaguguaaaguauuugguggcuuaacaaauggacugauuguauaacaauaucagugcucuagagucagugaagucuucugagcauucuuccugacucacuauaauuuggggccucaauguacaaaauacgaauagaacuugaaccauauaguauugagguuucuuugauacuuaaaacaaugauguauggcccacuuuguauuauauucuuuagcaguggcuaccaacuuugucuuuccuauucacucaauauauucccuguucgugagggguagaucuuacauaguuugauaaagacccccacaucccuccaaccccucaauacucagcaaugaguaauaugauaggaggguacuugugugaugugguuuauuuauuuuuuuguuucuuuuuguuuuuugggugugugugugugugugugagagagagagaugugguuuaaucacucuagugauuccauuuuuucuuucccucuuaggcacaaaacagauuuaaaguuccuuuggggacaaaguuuuacagagugaaagccguaucauggaauaagaaaguauaacuuauggacaaaauuaauacauucuaugacauuuuuuucugauuuguccugcagugcucauucaucacuccaaaaaca

SEQ ID NO: 13320 - RNA, 934 nt, Homo sapiens
uguugauucagccuucucauugcaaacuucauaucuuuguuccuuaaaguauagauggcaggauuuacgacaggggugacaacaaaguucaugauggcaaaaaauuuauccaaugacuuaguagggaaaggccacacguagagaaacaugcauggagcaaaaaacaaaaccacuacggugaugugagccgacgaagugaagaaugcuuuggauaaaucauuugaggaaugucguuggacagugaccagaauaaaaauguaugauacaauuaagaaaaagaaggugcccaucgauaugaauccacuguuggcagugaccacaaauucuagcccauaaguguccaugcaugcaaguuuaauaacccgaggaaaaucacaauaaaagcuccccacauuauuagggccacagaaggguaaauuuaugacaaaaacaaacugagacauagcaugaaucaccccaaugacccaagcugcugcuaccaaaaacaugcacauuuugggauucauaauaguuggauaguggagaggcuugcagaucgcaguguaccuaucauaugccaugacuaucagcagcaccauuucaacuccucccauaacauggauaaagaacuuuuguaucaugcaauuauggaaggaaauaacuuuacaaucaguaaaaagaucguagaucaaccuaggaacugugguagaugaaaggcucaagucaaugagcgauagguuggccagcagaauauacaugggggaguguaagugaggaucaaagaucacugugaacacaaugaagaguuuucccaggauaauucccacauagaauaaagagaagaagagaaaaaggaaaaacugcauuuccaaggauugugcaaguccaaguaauacaaauucuguuaccagagagucauuuacuugguccacugaaucagauagaagggaagacu

SEQ ID NO: 13321 - RNA, 10016 nt, Homo sapiens
auauuuaaauugaauuuaauuaaacacaaaugucacauacucccagcuucccagaaauagucacuucauccuaauuaaggaaauggaaacuaaugaugacuuaagccuuauucuguggaauguguuuagacaaguucaggcaaacagcaaaaacugaaaagucccaccaccauaccuacaacauucugaaaaugcuuaaauguuaacuccauucuuugucuagcaguucaauaugagcugccaaaauuuaguccaaugagucaguuccaaauaauguaggcuccuuggagucuauaaccuuggaguugugacaguucucccuugacaguggaccaggacacaggagcuccucuuccagauucuuucaguuggcuugggcaacucugcuuucagaaccauggaaguucaacauggcagucaccaacucuggaagaucaaagucguguuuccacccccaguccuuccgagcauugcugucaucaaaguucaucggccaaccauccgcuaggaaaagauacgcaagacuagcuuaaguuauucagguuguggauuugcaaaaaggucuugaccauuguauauaaaggucuaccguacaagguacaaaacaggaaauuccuucgaguaaagcagaaccgccauuaugcacagucacccuccuagggccgaagacuauuaacccaucuuucgucaggcacugugaauuuucacacauuaucaaaaucucacacaacuucauaagaaguuuuauacucaaagaggugcuuccauccacaaauuggcaaaguuacaguauuugaaaaccuggggcuguuuucauacuaccucuguugcuucuauuuuuccuugcuuuauguuuaaacuguaaaaaugaugaaaggcuaacaagcuguuuauuuggaauggaaugauuucacccacuuuagauaucauuccccaaaaucaaagcaucugcuagcuugggcucaacaauuucuugggcuaggcuccuucuccaaaaggugucuggacccuugggaaggaucuaugcucucuucaaccuuccaagguuuacauucuccagggacucacaguaaaggccuuugccaccggguacgaaccuauggccuggcgaacggcauccacguuguaugugaucuggaauuccggcacgugcuugaggaccuccugggccagcuccucgggugugaagcucauggcgcugacauuguagguccucauggaaagggacucagcuggggccuccaugaccuccaggguggcucugaggcagucgucaauguacaucaugggcagucucgugcaggcuuccagguugcacucgaauuugccaugcuuuguggcaucauggaaaaucuggacugcauagucugaaagggaaucccguauguagguuauaacaaaacaaugaaugagccucuuggaucaaggcagcaguucucaaauguucuagucucagagucuuuuuauaacagauucuuaaaaauuaagaaguccagucaagcucaguaacucaggccuguaguccuagcacuuugggaggccgaggcaggcagaucaccugagaucaggaguucaagaccagccuguccaacacagugaaaccccagcucuacuaaaaauacaaaaauuagccaggcgugauggcacacaucuguaaucccagcuacuugggaggcugaagcaugagaaucgcucaaacccaggagagauggagacugcagugagcugagaucacgccaccgcacuccagccugggugacagagcaagacuccaucucaaaaaaaagaauugagaacucccaaagagaucugacuaauguggguuauaucaauauuuacugaaacagaguuaacugagaauuguuuagaauauuaccuuuuuaaacgacaauaagccuaucacauauuaauauguauaacauuuuauaggaaaaaggguauauuuucuaaacaaacaaaauuuacugagaaggauggucugcuguacauucuaaaaaucucuuuagggucuggcuugauagggguccgcuggagcccccaucugcuucuguauccaguccguucuuaucucacacgccacaccaccucuggaaaacucuacaaugcauuugugaaaguagagugaaaaaggccaguaacgucuccauauugauaagauuuuugacccccaagaccccuugaaagugcuggaggaugaccggagcuccccagaucacaccuggagaagcaccauauuaaaaagcagaagcuuuuuaaggccugcuuccaaaucccucugaugcggucaaguaccuuccauauucauucucaggaccacagaugugggaaggauaccugaugugggacuuaugaaacagaaugaguguuugaguccaaaauaauaaucauacuuauguuccuuucacauacacaaugccuagagucuauuuuaauagggcucucucugcguguuaagaaacgagaggcugcugcuugcugggggucuuccuacacugugagucacagauuuguuguugaauauuacguuuuauucugccacuguggguggccaaucccgagcugaacugacaacgcuggcaugugcuacccuuagugaguguaagccaauuggguucacugugcuuuuaaaaugcauaucgggagauauuacagaaaaacucuggucagcauacagcuaaaaagauagcaaauucauuuacuacgaagacaacuccaccuagcaauaagucagucuauuuuuuuuuuuuuugguggguguuuuuuuguuguuguuuuuuauuuuugagacagggucucacucugucacucacccaggcuggagugcaguggcacgaucucagcucacugcaacccuggccuuccgggcucaagaggcccuccugccucagacuccccaguagcugggacuacaggugugggccaucaugccuggguaauuuuuguuuauuuuucauagagacaaggucccacuguguuguccaggcuggucucuggcuggagugauccuccugccucagccucccaaagugcuggaguuacaggcaugagccuccgcaccuggcuggaaagccuaucuaacauauaagagacauaagaaauagaaaacacuuaaccaguuguuccuccuccaggcugggagucagcugaaaugauuccaggauaucucaggcaucagaaaucuaacccauaccgguaaugauaauaccaugaaaaagagaaaacguauucaaacacaaauauuuuaaaucagauagaugcaaaaaaaacaaaaacaaaaaaaaccaaaaaacacccugccuuuuucugaaaucucauuccaugcaguuauauuuaaauacuccuaaagaaaauaaagacuccuaaguuuuuaucuuuuaaaagaaaucaacuuuuaggugguacaucaaugcuguaaaugacacauuagucuacaguaggcauuuccagccacucuuuggaaaggcgccacugaucaucauucugaacgauucagccugagugcauucccacaagcagcacggggaaaagcagaggagagaacaguggaugagagggccauggcuaugacagaacuggaggagcaggcagcaacucgaaucuacuagaguuauaaagauaaagaguauuuugcaguaguucacaccuauaaucccagcacuuugggaugcugaaguggguggaucacuugaggucagaagcuugagaccagccuggccaacaaggcaaaacacugccucuacuaaaaauauaaaauuuagcugggugugguggcacgugccuauaaucccagcuacuucggaggcugaggcaugaggaucccuugaacccaggaggcggaggcugcuaugagcugagaucacgccaccacacuccagccugggugacagagcaagauucugucucauaaaacaaacaaacaaacaaaacaaacccaagauguuugagguuuuagaguuacuaccaauggcuaccaauacuaggagccagaaagaaugguggaguacaagacaagcagcaaaugaagagaucggggcugggcacggggcacccaggaagugcugaguguucccauauggcugaggagguuucaggagcuggagacaccugcuacauggcaaacccagugaguuaaguaagcgacucuggggcugggauccaagaagagguaaaguuccuccagggaugaaucaccaggccuuggaggcaaaacgaaugagaaagcaaacagcaaaucgugacagccagggcacauucagcaauccagcugagugaugcuuacuucucccaugagcuccgcguggaccuuggacaccccauagaugguccugggucucugaauacagagaucggggguuggguuccggggagagguggguccaaaagccccaaucgugcuaggcacaaacaauugcagauuguguuccgcagcgacauccaggauguuaugcaggccugaaaugaacagacacuaucagaaucugaaaacaucucuucuuaaagaacuagaaaaacuggcaaauaaaucacauccagccagagccagaugcuuaccaguuauauucacugcucucgccagggaaacauuugcuucuccaaaggcgcugagcaaagcgcuguaaugaaacagccaggugaugcgguuguuuaccacgaucucccgaagauucuuguaauccaagauaucagaauaaaugaauggaccugcaaggaacauaaauugaaaccacgaacgugaaaaggguugugaacuaaauggaccuuuccccuuucccccguugacuugugaauuucacugguagccacgcaauaacuaagacagcugggcacuaggcagcauuuuucuuacggaagaaucacaagucacaaccaccccgcgccagguaaugacagcaaaugcuccuauaggaccugccugggccagacccuguccuaaggacauaaguccauuucuuucccacacagccuuggagguaaacacauuuuacugauaaggaaacaggcaccgagagguuaagcaacuugccaggaucagagaacaaguggaggaaauggggcugcagcuaggcaucgggcuccagagugggugcuguuccucccagcccuguauacacagaguggcuucacucugcuuccaaggugcacauuugaaaaggaauagagaaacggacuuauucaccaccaccaccaccuugguauagaaaacccacaaaccaugaguuuaucauacuuaauuacacagagguaaaguugaucuugcucugugccaauuuuccccacuuacagcaaacugucacucuuccccauggugagcagcaaaaggcugaugcugaaccaggaaggacugggggcauuacaaaaccuuauuuuuggggcagcggggacagagucuugcucugucgcucaggcuggagugcagugaugcaaucauggcucacugcagccuccaucuagugggcucaagugguccucccaaguagcuaggacuacaggcacgugccaccaugcccagcucauuuuuaauuucuuguggagacagggucucacuauauugcccaggcuagucuugaacucccagacucaagugauccucccaccucagccucccaaauugcugggauuacaggugugagccaccaugccuagacauaaaaacauuuuugaagcaguaaaauccugauuagaagagcuugagaggugugugugugugucuguguggauguguguguauguguaugugcgugugugugcguguauguguaugugugugugcguguaugugugugcauguguguauguguguguaugugugucugugugugugcguguguggguaugugugugcgugugucuguguauguguguaugugcauguguguauguguguaugugcguguauguguguaugugcguguaugugugugugagugucuauguguguguguguguaugugucuuuucguuucuauucuugauuuuuguuuguauucucuccaagucaauaaguuaacuuaaaacacaaaaagacaggaaacaaaguuuucauuuccaauaacaucaaaauauauuauuccaaaaacuucaaggucaaaagaauucuucuguucuuuuaucacuugaacaagcagcagcauuaaaaauauauauuuuuuuauuauacuuuaaguuuuaggguacauguguaaaaugugcagguuuguuacauauguauacaugugccaugcuggugugcugcacccauuaacuagucauuuaacauuaggugugucuccuaaugcuaucccuccccccucccccaccccacaacaggccccagugugugauguuccccuuccuguguccauguguucucaauguucaauucccaccuaugagugagaacaugcgguguuugguuuuucguccuugcgauacuuugcucagaaugaugguuuccagcuucauccaugucccuacaaaggacaugaacucaccauuuuuuauggcugcauaguauuucaugguguauaugugccaaauuuucuuaauccagucuaucauuguuggacauuuggguugguuccaagucuuugcuauugugaauagugccgcaauaaacauacgugugcaugugucuuuauagcagcaugauuuauaauccuuuggguaaaauacguauuuuuaagugaaauaccagugccucaauaacuucucuuugagucauaaauucagcuaugagcugcugcacgcaccaauuucacgagccaccucuuugugccuugaaaauuagagauaaaaauaaaagcaagaccuauugaucucuuaccacugugaaagacaugaucgggggguuuccuuaugucagacaaaaucacacuguccuuuccaaaucguuuccuaaagggaaaauuaacccacacaaguuggcaacaucuagaaugcaaugaguccugugagaagucuuuuaaaauaagaacuguaauuuucugccagccuccaaaucucuacuuccucuucauccucaauucccacaccuucaauucuuaucucucucacacucaggccucuauuucccugcccacgacucucucuucuguuucuccucucaccugacuguuaacccuaugcuugucaccgguuucuucccauuaccccccagaguuuuuaccucuuccucaucauucuucuuaucuucucuccccucuucuuauucucuuaccccauucucuccaaaucccacacucuucccuuccaguuugcaccuguacuucccuugguucucaaacaacuaaaagucaaagugauucacugggagaugugugucucacuuugccuaaguuaggaaacagaaagagagcaaaggaccagucuggagauguuaagucaagggccuacgacaagucugggauauucagaggcaaaauaaaauguauuuuaggcugggcacaguagcucacaucuguaaucccagcacuuuggaaaggugaggugggcagaucacuugaggcgggcagaucacuugaggccaggaguuagaagaccagccugggcaacauagcgagagcccaucucuaccaaaaauaaaaaaaauuagccaggcguggugguaugugccuguagucccagcuacucgggaggcugaggcaggagaaucacuugaacccaggagguggagguuauagugagccgggauugcaccacugcacuacagccugggugacagacugaggcuccaacucaaaaaaaaaaaaucuguaucuauaucuauaucucuauauaucuauaucuauagcuauauauagcaguuauuuagauauaucuuaacaaugguaaggagcaagaggagagagaaaagaaguuuaaaaggcaucccaaugagcuccauauacuuaacaacucagauuuuaaauuucaaguuuuuagggcucuuaccucaaaagauuagcaagccccacucccagcuggccaagagccccuagaugaagaagaaaaaaaagugaagguuuaaugcaaaucuaaacaguucaauuauucccagaauguaauaacugagugagacuaguuuucagucuuagcuaacuacguaaguccuagguugcacugauauaacugcugcuuacuuccaaucuucccaggaacguggugcagcgcuuagaaaugcaaugaucucccccaugcuaggacagagaccaauacagguaacauucguuucagagacaacacuuaccagcauggagugguuccgagaaagaggagaagcaagggcauuagaagagaaaaaucucaugaaagccagacacaggucuggaauuucuuggggcaggaacucaaucuuggccuucauuauuuucaugaacuuugaagcuuaucugcuaugggugacaaaaucauucaaaaccaguaugaacagauucauauccaccucuggugacaugaggcagaaucccauccuccauuagaaguggacugggauaugaaagggaaaagaggcagggagaaaccaagaagucauuugaaaaaggggcagacaacugaaucaacaaggcaccacugagaaaguuaaagugaauagugcagcuucuaguuugaagaauuaaacaugccacugauagaaacgggaggccagugggcuaggagcacauuuggguaaggacaacaguccauuucauuugagagaaacugaugaggcaggaagauauaaaagugggacuuccuguaaccauuuguuaacuugggaauaaaaccaggacacccugaaagaugcaucauuaggggaggugagagggaauaaaacaaacacucggacaacacgaugggugaauccgaggaaaggcagagagggacaucuacuaagcuugaaacuuauuucagcaccagaaguggacaaggcagucaaagaguacacacacacacagacacacgaaaaugagaaggauaaugcuguaaaaccaagggaagaaagccuggcaagaaagagaaagaaguaaaacauguccaucaaacuggagguagguuugggcuggcuggaagugacagaguaaagucuggagugagaaggauacaaaaucaggggcugaacauauuugaggugaggagguucagggagcgagucacuggcaaugaugaccucaauggcaacaaugagcucaagggccaugaugggcucgaggacaacaaugaacacugcagcaacaagucccuugaccagacgcuaacuuaccuucucuauuuccaacaugcaaaugugcaauaacaguuugggauuaaugacucugaguuuagguucaggacucuggccaaggaacagcgugccuaacaccagaaucaauguucuagccccagcacccuccuguccacuagccuucacuccccagacugauccuaauauggaaggaaaccaaguuccagagcagcuauuuggcccccaguuuccuagauuccuucgaacaacaacaaaaauuacggcaggcaaaaccaagugcuggcaacagugaugaaauaaggauuuggauuugcaaaauucuaagaaacaaacaaaaaagccaauagugaaaaagacagugucugaucaauaagaucagcugcucuaauuuaaaacuuuuguauuauaaaauaccucauucugaaauccuuuucauaguauagagaauagauccagauucugucaucuggccaagccuguuuuugcugcauuaucggcuacagagacaggcaguaugguucagauagcauauuacacauuccaaaagcaaaggcacagacacauagcacaggaaagaaucaagccaugcaaauagaaaaaagaaaagaaaaacuaaccuguaauuaagacucguggauggucugugucagagaaagacgcagaguggaaguuagcaucugcuggaauuugccgaggggagaugcccagaaagcggaccggcaggacaggcguccaacagccacaggcugggcucugccccgcucgccucagcauccuaaugaacagcauuuucuuuucaaauaccuugugagaaaagagcagaguuaaagaugugaac

SEQ ID NO: 13322 - RNA, 943 nt, Homo sapiens
cuuaggagaucuuccugugauuuacuaguugucggcauacuuuucucauugccaccuucauuucucaauuccugaauguguagaugauaggauuuaaaacaggagugagaacugcaucaaagauggccagaaacuuauccagguguguggagggagauggccacguauagacaaaaaucaaaggaccaaagaacaaaacuaccacacugacgugagcugaaaggguggacagagccuuggauaaaccagcugaagaguguuucagaacagugagaaugaugaccacauaggaaaugaucaguaugaagaaggagcccagagagaugaauccacuguuggcuguaaccaugaacuccagucgguagcugucugugcaggcaaguuugaugaaccgaggaaggucacaguaaaagcuguccgauacauuaggaccacagaagggcaaguuuacuacaaaaaccaauugaacuacagaguggauaaggccggucacccaggcagccacuaagaagaacaugcacauucuugggcucauaauggucagguacuggaggggcuuacauauggccacauaucugucaaaggccauggcuaugagcagcaccaucuccacaccgccaaugacguggaugaagaagauuugagcgaugcagccuccaaaggagaugacuucgugcuuucugaacaggucauaaaucauuuugggagaagugacagaggaaacacccaggucaaugaaggagagguuggcuaacagaaaauacaugggggagugcaagugagggucagaagucacagugagcaaaaugagagaguuucccaucauacuggccauguaaaacauggaggagaacacaaggaggagaagucggaucucccaggaauuggugagucccaggaacacaaacucugacaccacggagugauuugccccaaccauugg

SEQ ID NO: 13323 - RNA, 8729 nt, Homo sapiens
gagcccauaggaagagcggggcgccgccucacccgcgagcugccggccucugcauccggcccaccugucccucccugccuaccaacccaagagccucaccccgaucugcgcuugcugggugaccucgacgcccgggcggggacagagggcgcucugagcucugcgcucagcucccagacccacucccacuccgaggcggaggccaggucuucagagaggaacgacggaggcgcagaagcccaggggcagcccgcuccagcccuggcagccgcggaacaauggcccgagcggcugcgggcgccgcggcgggcgcggaggagcaggggcgccagggcgcuggaagccccgccccucggccggcgcccugacaacgcgggcgggcugggcugcgccgccugcuccccgccccucggccgccugcaccgggcggggcccgggccagagcgccgccgccgccgcugcugcagcagcagcugcucugcagagugguggccggggccagggccggggugcccucccucccaccuucucccgccaugagccagggaaguccgggggacugggccccccuagaucccacccccggacccccagcaucccccaaccccuucgugcaugaguuacaucucucucgccuccagaggguuaagguaauguguggggagcgggcgucggaaggacccgugaggauaggaaaauggggccauuugagcccuggcaaaggugggcuuggggauccacgagaaggagauggcugagaggcuugcggagcgggaguccgggggugcgcacgugggggcggccgcgguugggcaaggaguccuggagaggacgcugcgggcuugggcgauagacaagcucgaagauguggaaaaacugaguagguggggauggagggcugcaggggacccugggguuggagagaugaaggacgcuggggaaugcggauuacauucugcagagccugauggcuaggauggaguuagagucuacgggaagccgggggugggggcgggggcgggggcgugccgaguauuccuccgaggcaugacuuagagggaagacguuucugggccgggagccugcgacccugugcccuuccuacacucccucuucccacucccuccaaccccccuccaccccgcacugcagcaccucccggugggggcagggaggcugagagggagguuggcuacaggaaguggagggccgcgccagccuaggggagcugggaggugguguggggagggaguguccaagguuucugcugucaucaccuccccggaggcaggcuccaggggcuagguuugcuuaccugcuucuuccccaaggcagccuauggagucauccuggcuccuggcagccucucucccuugcagaguggggccgagcucuugucucccauaucccccgguacucuaagauugcuguugagcagugucagaaaaugaccucgggucugaaaacuggaccucuggcuguuuacagcccucugccuccuaggcccaaaguggaaagaucugugcaccugguuucuguugggcauaggagcuauuuauggaauaagaugugggggaggaggaccugucucuaaccuacuguacaucaagcacagcgcccugcacuuucgcaugcauucuuauuaaauccucuaagugcuagaugcuuuuuauggcuuucgguuuuauaaaugggguagggaccaacugaaagacaggaaaauaaggcccuugaugccauuaaucuuuuauccucuugcccucauugguaucuucaucccaccuugggucccaguccccucuccuguucccacaccaccugucacaugcaagggaugauggcugucugcuccugggucuaugcuuuguggaagaaggaugcuguggagggagcauauccaagcucuaaaguggcauucucucccacccuuugcaguucugccuccugggggcauugcuggcccccauccgagugcuucuggccuuuaucguccucuuucuccucuggcccuuugccuggcuucaaguggccggucuuagugaggagcagcuucaggagccaauuacaggauggaggaaguaagugagggaucagcccccagagacccuacuucucuucccugcugucuauucggcucccucuuugagaagaagaaaagagagcauucugaaacuauucugucuagcuuggguagaugagaugagucagccaagcucagacgugguucccagaccucaccucuaaguaaugugcccugauaggucccaaaguggccagagaccuuggccccuuggucacauccuauuuaaggguaaaagaggggugcccuacuuucccggugucugaaccugggggcgggugaggguuagaaccacugcuuccgcugauacccagccuugcccuggcaggacugugugccacaacggggugcuaggccugagccgccugcuguuuuuccugcugggcuuccuccggauucgcguucguggccagcgagccucucgccuucaagccccuguccuuguugcugccccacacuccacuuucuuugaccccauuguucugcugcccugugaccugcccaaaguugugucccgagcugagaaccuuuccguuccugucauuggaggugagagaguucaaagggggugaagggcagggugacaacucugggcaaaaaaagucaggaauggagacacuggagugaagaacuggccucaaaguggggagggacuguuggcaagugaaauauaaauuaacaccauuagucaaccagucuuagauucugagggcugggacagagagaagguguuggagggaguucuggucaguucucuaaaaggacaacuacuauaaagggauugucccagggcaaagauaacaggccaggcacgguggcucgcgccuauaaucccagcacguugggaggccaaggcgggcggaucaccugaggucgggaguucgagaccagccugaccaacauggagaaacccugucucuacuaaaaauacaaaaaaaguagccgggcguaaaaaaaaaaaaaaaauuagccgggcgugguggcccaugcuuguaaucccagcuacucgggaggcugaggcaggagaaucacuugaacccaggagguggaguuugcggugagcugagaucgagccauugcacuccagccugggcaacaaaagcgaaacucugucucaaacaacaacaacagaaaaaaaaaaaaaagagauaacagaaacuucucaugcuguugaggaaguggaggcugcagauguuacugccccuggguaggaaagaagugauuccucuuuguauccuucccaaccccagcccuucuucgauucaaccaagccauccugguaucccggcaugacccggcuucucgacgcagagugguggaggagguccgaaggcgggccaccucaggaggcaaguggccgcagguggguaagggucucaagaccaucuucucacuuuccaugugcuccugaagaggcuucccuuuccucucuccacagccuucuucagucuucuucaccucauucugcucuuuuuuaccccaggugcuauucuuuccugagggcaccuguuccaacaagaaggcuuugcuuaaguucaaaccaggugaauaaaaugauaguggguggugggcuguaggaaaaagaaguuccagauuuggggagggacucugaaauaacccaagaaguagaagagggggagggaugggagaggaagggagaccaggaaccuccuagcuaaugcugucaagucgaggagucagagagaaaauuaucaaugaguggaacaaaaccauaucucauuugagaacugucccagacugccauaccucaugcccucuagcuacuucuguguacuaaccucugccuuguggggguggggguggaaaugggauuuaggagccuucaucgcaggggugccugugcagccuguccucauccgcuaccccaacagucuggugagucuuaguccaagaaagaguggaaagggggagcacaaauccaccccaaauggaaauaagugaaaacuguuggugcuuuaaugggaugugcauugggggcugugaccagaggugggaucaggcccucuguucaaaggugauuggccaguuccagggggaaaaaguaaugcucuuaugcccucaccuguguuucucccauaggacaccaccagcugggcauggagggguccuggagugugaguucugguauuccugggggugaggguggggagcaggguccaucagagaauuccuggcccaucuuccaaucucccgacaaggugaauggcccuucuucaucugaggacugagagaacucuagaggagacaccacuuucccccugauguccccauauaaucuggcugugcuuagauuagcuaucccaccuaaacuguuccugcugugauuauggcugcuaugcauuuaucuucccauguuucugugauuuucucccucaauuaucccuuccugagaaccaucaccaucaggcaugccucucgccuuuuucuuccauuacucaaaccuccucuugccuacaguucuuccucuggcauauccaugcagcucugcucucuuucccuaccgcguuucuggccguuccuugugucucccaacugcauauucacccaccugacuguauggcuaggagucugucccuauuaucaaugggcagaacuuuucccacuccccaccuggguuggggaaggggaguggggugugggagccagggaaggagcccauaguuagagauuggugaguaucgaaaucucucuucucuuagacucaaaguccucuggcucacagccucucagcccugcagcauuguggauguggagguauggcucccgugggggcggugggagaaguacaucucagacuccugaaaccuugggaaaagagggugggaguggucauaccucacuuugagguucugauaagaauugugugugucuguguuucaguuccuuccuguguaucaccccagcccugaggagagcagggaccccacccucuaugccaacaauguucagagggucauggcacagugagugccccacaaacuauuuccuggagcaguugcacagggcaaaggaaccacaggggcguggagggggcgagguuuucaggcaaagaucgaggagcaggcagugggaagggcucuugaacagcugagacagaggcagggagauuuaaaggggccugaucuacuccagucagcgggccagggucaggaaccaacccucagaaguuucuucugcuuccuuacccuccaucccaucccucuucauccuguagggcucugggcauuccagccaccgaaugugaguuuguagggagcuuaccugugauuguggugggccggcugaagguggcguuggaaccacagcucugggaacugggaaaagugcuucggaaggcuggguaaguggucuuggaaaugaggguaugagcagugucacagagagagagagagagagaauaagaaggggagaaaugagaaggaagaaggaaaaucuuaaaaaugaaaaaaacugggaagaaagauaauagaauaaauaaaaggaaguggggaauaaauggaaggauauguaauaaugcaggugaaaaaaguaagaaggggccgggcacgguggcucacaccuguaaucccagcacuuugggaggccaaggcggguggaucaccugaggucaggaguucaagaccagccugaccaacauggcaaaaccccaucucugcuaaaaauacaaaauuugccggguuugguggcacaugccuguaaucccagcuacuugggaggcugaggcaggagaauugcuugaaccugggagguggagguugcagugagccaaggucgugccacugcacuccagccugggugacagagcaagacuccgucaaaaaaaaaaagaaaagaaaagaaaaaaguaagaagugcucucaagggacugugagucaguacaucuuagaaaaacagcagcuaaaccuguacugauagaacucuugguacuggggcugaaguccugcugaugguguguccagaaggaaacugagacagcucucugccuucaacaauuccaucguaggcuguccgcuggcuauguggacgcuggggcagagccaggccggagucgaaugaucagccaggaagaguuugccaggcagcuacagcucucugauccucagacgguggcuggugccuuuggcuacuuccagcagguaaaggagcuggaacaaagagcagagcagaacccaggcuucccuccaggcugacauguuccuaguggccguaucagucacucacaguuuggaguccucaguggauguucucacagcuguuguuagauggccauccccugagauccacugaagauucauuuuuuaaucaggcauccagugcauugaagagcaauguuaucaucaugaggaggaacaagggagaaauaaucaguaaggacuauaaauuucugaaaccacuuuagagaguggcgaagguggggaaucauaagaccuuuuggggugcugggugagggucuuugaaggagagucaugaagguuacgugggaagaugacauguagaagaaacaacaccggacaguuagaugguugagagcuugagacccagcuauaucuguaggacuugggcagauuauuuuaaauauccuauagcuucucuagaggaauuuucucaagauucuuagcaagccauguauuucucaagauuuaaccaaguucccuggucaacuuccaaaaauccuaaaagauucuuaaugcuuaugaacaaccaacaguggucccaaggagcuuuuugaucugagaugcagaaugugacccucaacauccucugaagggacagagugaccagguaucuagauuccuuagauugaggcggacuguccccgaaaagagcuucccccacuuggccuguagcagagcagaaacaaaaauucaaaugccauggucucccauggagcugguacagcaggcauccuccuuguguuuuucauaagaaauuaugccugugucccccuuucaaucuguuggaccaguucuucuacauaggcugagucagagagaaccaguuugucuagccuggggaccaggacugcccuccgcuggcaugucagagacuucauaguagcuucagcauuccugagggauucccuuacauuccuaggagaucccuuuaugggagggcuuugucaccaggugaccugauauagcuugagaaagccuaugaccugagagaaauuccagggauccuaaagaguuuggagcucacaguucugaggggagcagucacagggaucacccccauuauuugcugagaagagggaggagucaaaauccaaagagcaggaagggaggcgcaggguccccgcauugcccugguuucuuuuucacaccaggauaccaaggguuugguggacuuccgagauguggcccuugcacuagcagcucuggaugggggcaggagccuggaagagcuaacucgucuggccuuugagguaaugggggguggcggugguggggggugcuuaguggcuaugcucaccccgcuccaggaggccuauuuugguaugcuguuuccaguagcuucuagauacuaggcauuugguauccaaccuagugccacagugccuaaaacugcagacccccggccucuauguugagaccuagcugggcacaagaagaaggaagaagaaggaaaaagcuauaaagucuacaguucugcagaaagggcacuggagggucagggaaggcuugugcaccacccuuuuggaagaggaggagccugucaggccagucuguggggcagggugaggccauggcaugaggagagaacuugacucuuaucccuuucucucccaagcucuuugcugaagagcaagcagagggucccaaccgccugcuguacaaagacggcuucagcaccauccugcaccugcugcuggguucaccccacccugcugccacagcuuugcaugcugagcugugccaggcaggauccagccaaggccucucccucugugagucacugccuucucagccccacacgggcacuuggggcaccaucagcauccaggaaagcacugggcugggagggaacaaggguuaguggccagugcuggagaucagaaccuaugagaaguaaggcugggaggaacaggcuagaaaggaagagaggaccugaaccuggauuugagaaguuaaacagaguagaggcacaagguguuuuaguucugagaaaaaagcagggagauucucuucucguucuuagaucuuuucacuuuuccccaucucuuauuuguccaggucaguuccagaacuucucccuccaugacccacucuaugggaaacucuucagcaccuaccugcgccccccacacaccucucgaggcaccucccagacaccaaaugccucauccccaggcaaccccacugcucuggccaaugggacugugcaagcacccaagcagaagggagacugagugccucagccucucacccccuccuccucagggcagcgcuaggggccuccccuaugccucagccccaucucugcuccuguuugaauuuuguuauuguuguuugguuguuguuuuuuuaaguugauuuuaauuuuuuguuugguugauuuuuuuguaaaaaacuauuuuauauauaaauauaaaucuauaucuauaucuauuaaaaaaaaugaaguccag

SEQ ID NO: 13324 - RNA, 8729 nt, Homo sapiens
cuggacuucauuuuuuuuaauagauauagauauagauuuauauuuauauauaaaauaguuuuuuacaaaaaaaucaaccaaacaaaaaauuaaaaucaacuuaaaaaaacaacaaccaaacaacaauaacaaaauucaaacaggagcagagauggggcugaggcauaggggaggccccuagcgcugcccugaggaggagggggugagaggcugaggcacucagucucccuucugcuugggugcuugcacagucccauuggccagagcagugggguugccuggggaugaggcauuuggugucugggaggugccucgagagguguguggggggcgcagguaggugcugaagaguuucccauagagugggucauggagggagaaguucuggaacugaccuggacaaauaagagauggggaaaagugaaaagaucuaagaacgagaagagaaucucccugcuuuuuucucagaacuaaaacaccuugugccucuacucuguuuaacuucucaaauccagguucagguccucucuuccuuucuagccuguuccucccagccuuacuucucauagguucugaucuccagcacuggccacuaacccuuguucccucccagcccagugcuuuccuggaugcugauggugccccaagugcccguguggggcugagaaggcagugacucacagagggagaggccuuggcuggauccugccuggcacagcucagcaugcaaagcuguggcagcaggguggggugaacccagcagcaggugcaggauggugcugaagccgucuuuguacagcaggcgguugggacccucugcuugcucuucagcaaagagcuugggagagaaagggauaagagucaaguucucuccucaugccauggccucacccugccccacagacuggccugacaggcuccuccucuuccaaaaggguggugcacaagccuucccugacccuccagugcccuuucugcagaacuguagacuuuauagcuuuuuccuucuucuuccuucuucuugugcccagcuaggucucaacauagaggccgggggucugcaguuuuaggcacuguggcacuagguuggauaccaaaugccuaguaucuagaagcuacuggaaacagcauaccaaaauaggccuccuggagcggggugagcauagccacuaagcaccccccaccaccgccaccccccauuaccucaaaggccagacgaguuagcucuuccaggcuccugcccccauccagagcugcuagugcaagggccacaucucggaaguccaccaaacccuugguauccuggugugaaaaagaaaccagggcaaugcggggacccugcgccucccuuccugcucuuuggauuuugacuccucccucuucucagcaaauaaugggggugaucccugugacugcuccccucagaacugugagcuccaaacucuuuaggaucccuggaauuucucucaggucauaggcuuucucaagcuauaucaggucaccuggugacaaagcccucccauaaagggaucuccuaggaauguaagggaaucccucaggaaugcugaagcuacuaugaagucucugacaugccagcggagggcaguccugguccccaggcuagacaaacugguucucucugacucagccuauguagaagaacugguccaacagauugaaagggggacacaggcauaauuucuuaugaaaaacacaaggaggaugccugcuguaccagcuccaugggagaccauggcauuugaauuuuuguuucugcucugcuacaggccaagugggggaagcucuuuucggggacaguccgccucaaucuaaggaaucuagauaccuggucacucugucccuucagaggauguugagggucacauucugcaucucagaucaaaaagcuccuugggaccacuguugguuguucauaagcauuaagaaucuuuuaggauuuuuggaaguugaccagggaacuugguuaaaucuugagaaauacauggcuugcuaagaaucuugagaaaauuccucuagagaagcuauaggauauuuaaaauaaucugcccaaguccuacagauauagcugggucucaagcucucaaccaucuaacuguccgguguuguuucuucuacaugucaucuucccacguaaccuucaugacucuccuucaaagacccucacccagcaccccaaaaggucuuaugauuccccaccuucgccacucucuaaagugguuucagaaauuuauaguccuuacugauuauuucucccuuguuccuccucaugaugauaacauugcucuucaaugcacuggaugccugauuaaaaaaugaaucuucaguggaucucaggggauggccaucuaacaacagcugugagaacauccacugaggacuccaaacugugagugacugauacggccacuaggaacaugucagccuggagggaagccuggguucugcucugcucuuuguuccagcuccuuuaccugcuggaaguagccaaaggcaccagccaccgucugaggaucagagagcuguagcugccuggcaaacucuuccuggcugaucauucgacuccggccuggcucugccccagcguccacauagccagcggacagccuacgauggaauuguugaaggcagagagcugucucaguuuccuucuggacacaccaucagcaggacuucagccccaguaccaagaguucuaucaguacagguuuagcugcuguuuuucuaagauguacugacucacagucccuugagagcacuucuuacuuuuuucuuuucuuuucuuuuuuuuuuugacggagucuugcucugucacccaggcuggagugcaguggcacgaccuuggcucacugcaaccuccaccucccagguucaagcaauucuccugccucagccucccaaguagcugggauuacaggcaugugccaccaaacccggcaaauuuuguauuuuuagcagagaugggguuuugccauguuggucaggcuggucuugaacuccugaccucaggugauccacccgccuuggccucccaaagugcugggauuacaggugugagccaccgugcccggccccuucuuacuuuuuucaccugcauuauuacauauccuuccauuuauuccccacuuccuuuuauuuauucuauuaucuuucuucccaguuuuuuucauuuuuaagauuuuccuucuuccuucucauuucuccccuucuuauucucucucucucucucucugugacacugcucauacccucauuuccaagaccacuuacccagccuuccgaagcacuuuucccaguucccagagcugugguuccaacgccaccuucagccggcccaccacaaucacagguaagcucccuacaaacucacauucgguggcuggaaugcccagagcccuacaggaugaagagggaugggauggaggguaaggaagcagaagaaacuucugaggguugguuccugacccuggcccgcugacuggaguagaucaggccccuuuaaaucucccugccucugucucagcuguucaagagcccuucccacugccugcuccucgaucuuugccugaaaaccucgcccccuccacgccccugugguuccuuugcccugugcaacugcuccaggaaauaguuuguggggcacucacugugccaugacccucugaacauuguuggcauagaggguggggucccugcucuccucagggcuggggugauacacaggaaggaacugaaacacagacacacacaauucuuaucagaaccucaaagugagguaugaccacucccacccucuuuucccaagguuucaggagucugagauguacuucucccaccgcccccacgggagccauaccuccacauccacaaugcugcagggcugagaggcugugagccagaggacuuugagucuaagagaagagagauuucgauacucaccaaucucuaacuaugggcuccuucccuggcucccacaccccacuccccuuccccaacccagguggggagugggaaaaguucugcccauugauaauagggacagacuccuagccauacagucaggugggugaauaugcaguugggagacacaaggaacggccagaaacgcgguagggaaagagagcagagcugcauggauaugccagaggaagaacuguaggcaagaggagguuugaguaauggaagaaaaaggcgagaggcaugccugauggugaugguucucaggaagggauaauugagggagaaaaucacagaaacaugggaagauaaaugcauagcagccauaaucacagcaggaacaguuuaggugggauagcuaaucuaagcacagccagauuauauggggacaucagggggaaaguggugucuccucuagaguucucucaguccucagaugaagaagggccauucaccuugucgggagauuggaagaugggccaggaauucucugauggacccugcuccccacccucacccccaggaauaccagaacucacacuccaggaccccuccaugcccagcuggugguguccuaugggagaaacacaggugagggcauaagagcauuacuuuuucccccuggaacuggccaaucaccuuugaacagagggccugaucccaccucuggucacagcccccaaugcacaucccauuaaagcaccaacaguuuucacuuauuuccauuugggguggauuugugcucccccuuuccacucuuucuuggacuaagacucaccagacuguugggguagcggaugaggacaggcugcacaggcaccccugcgaugaaggcuccuaaaucccauuuccacccccacccccacaaggcagagguuaguacacagaaguagcuagagggcaugagguauggcagucugggacaguucucaaaugagauaugguuuuguuccacucauugauaauuuucucucugacuccucgacuugacagcauuagcuaggagguuccuggucucccuuccucucccaucccucccccucuucuacuucuuggguuauuucagagucccuccccaaaucuggaacuucuuuuuccuacagcccaccacccacuaucauuuuauucaccugguuugaacuuaagcaaagccuucuuguuggaacaggugcccucaggaaagaauagcaccugggguaaaaaagagcagaaugaggugaagaagacugaagaaggcuguggagagaggaaagggaagccucuucaggagcacauggaaagugagaagauggucuugagacccuuacccaccugcggccacuugccuccugagguggcccgccuucggaccuccuccaccacucugcgucgagaagccgggucaugccgggauaccaggauggcuugguugaaucgaagaagggcugggguugggaaggauacaaagaggaaucacuucuuuccuacccaggggcaguaacaucugcagccuccacuuccucaacagcaugagaaguuucuguuaucucuuuuuuuuuuuuuucuguuguuguuguuugagacagaguuucgcuuuuguugcccaggcuggagugcaauggcucgaucucagcucaccgcaaacuccaccuccuggguucaagugauucuccugccucagccucccgaguagcugggauuacaagcaugggccaccacgcccggcuaauuuuuuuuuuuuuuuuacgcccggcuacuuuuuuuguauuuuuaguagagacaggguuucuccauguuggucaggcuggucucgaacucccgaccucaggugauccgcccgccuuggccucccaacgugcugggauuauaggcgcgagccaccgugccuggccuguuaucuuugcccugggacaaucccuuuauaguaguuguccuuuuagagaacugaccagaacucccuccaacaccuucucucugucccagcccucagaaucuaagacugguugacuaaugguguuaauuuauauuucacuugccaacagucccuccccacuuugaggccaguucuucacuccagugucuccauuccugacuuuuuuugcccagaguugucacccugcccuucacccccuuugaacucucucaccuccaaugacaggaacggaaagguucucagcucgggacacaacuuugggcaggucacagggcagcagaacaauggggucaaagaaaguggaguguggggcagcaacaaggacaggggcuugaaggcgagaggcucgcuggccacgaacgcgaauccggaggaagcccagcaggaaaaacagcaggcggcucaggccuagcaccccguuguggcacacaguccugccagggcaaggcuggguaucagcggaagcagugguucuaacccucacccgcccccagguucagacaccgggaaaguagggcaccccucuuuuacccuuaaauaggaugugaccaaggggccaaggucucuggccacuuugggaccuaucagggcacauuacuuagaggugaggucugggaaccacgucugagcuuggcugacucaucucaucuacccaagcuagacagaauaguuucagaaugcucucuuuucuucuucucaaagagggagccgaauagacagcagggaagagaaguagggucucugggggcugaucccucacuuacuuccuccauccuguaauuggcuccugaagcugcuccucacuaagaccggccacuugaagccaggcaaagggccagaggagaaagaggacgauaaaggccagaagcacucggaugggggccagcaaugcccccaggaggcagaacugcaaagggugggagagaaugccacuuuagagcuuggauaugcucccuccacagcauccuucuuccacaaagcauagacccaggagcagacagccaucaucccuugcaugugacagguggugugggaacaggagaggggacugggacccaaggugggaugaagauaccaaugagggcaagaggauaaaagauuaauggcaucaagggccuuauuuuccugucuuucaguuggucccuaccccauuuauaaaaccgaaagccauaaaaagcaucuagcacuuagaggauuuaauaagaaugcaugcgaaagugcagggcgcugugcuugauguacaguagguuagagacagguccuccucccccacaucuuauuccauaaauagcuccuaugcccaacagaaaccaggugcacagaucuuuccacuuugggccuaggaggcagagggcuguaaacagccagagguccaguuuucagacccgaggucauuuucugacacugcucaacagcaaucuuagaguaccgggggauaugggagacaagagcucggccccacucugcaagggagagaggcugccaggagccaggaugacuccauaggcugccuuggggaagaagcagguaagcaaaccuagccccuggagccugccuccggggaggugaugacagcagaaaccuuggacacucccuccccacaccaccucccagcuccccuaggcuggcgcggcccuccacuuccuguagccaaccucccucucagccucccugcccccaccgggaggugcugcagugcgggguggagggggguuggagggagugggaagagggaguguaggaagggcacagggucgcaggcucccggcccagaaacgucuucccucuaagucaugccucggaggaauacucggcacgcccccgcccccgcccccacccccggcuucccguagacucuaacuccauccuagccaucaggcucugcagaauguaauccgcauuccccagcguccuucaucucuccaaccccaggguccccugcagcccuccauccccaccuacucaguuuuuccacaucuucgagcuugucuaucgcccaagcccgcagcguccucuccaggacuccuugcccaaccgcggccgcccccacgugcgcacccccggacucccgcuccgcaagccucucagccaucuccuucucguggauccccaagcccaccuuugccagggcucaaauggccccauuuuccuauccucacggguccuuccgacgcccgcuccccacacauuaccuuaacccucuggaggcgagagagauguaacucaugcacgaagggguugggggaugcuggggguccgggggugggaucuaggggggcccagucccccggacuucccuggcucauggcgggagaaggugggagggagggcaccccggcccuggccccggccaccacucugcagagcagcugcugcugcagcagcggcggcggcggcgcucuggcccgggccccgcccggugcaggcggccgaggggcggggagcaggcggcgcagcccagcccgcccgcguugucagggcgccggccgaggggcggggcuuccagcgcccuggcgccccugcuccuccgcgcccgccgcggcgcccgcagccgcucgggccauuguuccgcggcugccagggcuggagcgggcugccccugggcuucugcgccuccgucguuccucucugaagaccuggccuccgccucggagugggagugggucugggagcugagcgcagagcucagagcgcccucuguccccgcccgggcgucgaggucacccagcaagcgcagaucggggugaggcucuuggguugguaggcagggagggacaggugggccggaugcagaggccggcagcucgcgggugaggcggcgccccgcucuuccuaugggcuc

SEQ ID NO: 13325 - RNA, 1723 nt, Homo sapiens
cgguuaugcaggaaggaaauugacgaacacgugacgcggucgggcggaccacugcagacugagcgguggaccgaauugggaccgcuggcuuauaagcgaucauguuucuccaguauuaccucaacgagcagggagaucgagucuauacgcugaaggugaggagagaaaacaggguguaaauaggcauggcgagaaauguagaugggaggagugggugaggucauacguggaguuaccuagcugggugcggggaaccagaaaguccagaaccgagguggggaagaaccgggaccgcgcgacucauuuuuuaauuaaaagaaaaaauucuggcggggcgcaguggcucccgccuguaauccuagcacuuugggaggccgaggcggguggauugccuuagcucaggaguucgcgaccauucugggcaacacugugaaacuccguuucuacuaaaauacaaaaaauuagccgggcauggcggugugcgccuguuaucccagcuacucgggaggcugagacaggagaaucgcuuaaacccgggaggcagagguugcagugagccgggauagcgccauugcacucacuuuuccuuuuuuuuuuuuuuuuuuuuuuuaaagacagggacucgcuuuguugccuaggcuguagugcgguggugcggucucggcucacugcaaccuccgccuccugggcucaaacaauccuucugccucagccucccgaguaguugggacuacaggcgugcgccaccauacccggcuaauuuuugguuuugggguuuuuuguuugguugguugguuuuguuuguuuguuuguuguagagacgagguuucgccauauugcccaggcuggucucaaaccauccucccgccucgaccucccaaagugccaggauuacaggcgugagccaccgcgcucggccuuuuuaaauuuuauauuucucuauuuauuuguacaacuuuuugaguugaccauugcaucuucuauuuucauguuugcccuuuuucgcgcuggccccaccccauuucaucacuccuguacugacauacauucuguguuccuggagcagaaauuugacccgaugggacaacagaccugcucagcccauccugcucgguucuccccagaugacaaauacucucgacaccgaaucaccaucaagaaacgcuucaaggugcucaugacccagcaaccgcgcccuguccucugagggucccuuaaacugaugucuuuucugccaccuguuaccccucggagacuccguaaccaaacucuucggacugugagcccugaugccuuuuugccagccauacucuuuggcauccagucucucguggcgauugauuaugcuugugugaggcaaucaugguggcaucacccauaaagggaacacauuugacuuuuuuuucucauauuuuaaauuacuacaagauuauuaaagauaaaaugauuugaaaaacucuuauuuugugaguuguuggaggaaaggauuggcaguauuuuuuuaaagggagggagaugauaaaggagaguaccccagagaguugcaacaauaccacuuggaagaaaaacuucaguccugcuguugcaagaguggucaugugcuguucaugauaggaggguauuggggaagaaagauuaagacuuucacagcugucagcauucacugaaaaauaccucuguugucacuuaacguaauuucuugucccuugaaauaagauuuuga

SEQ ID NO: 13326 - RNA, 3867 nt, Homo sapiens
auaauuuuucgaauaauucauuuuuauugcauuuuacaaaaguucuauuuauaauaguuucaaaguuuuuaaaaaauaauaccucaccacagauaguuugagaagcaccuuuaacauaggcuucuuuuucagcuacuuuaaaagauacuuuuuuguuuuuaauuuucuagggcccuuucuuucaugggaaugaguaucugucuggcucugauguucauuucuuccugguauuaugccauuguagccaugguaauagcugguaugaucuacaaguacauugaauaccaagggugaguguggauuuaaucuugaucacugcuaaaaguagcaagacuagcuaguuugguuagagccagcucagugaaaauaucuuaaggacucagguaacuucauuuucauaacuauauuuuguaccccuaauucuuuaaccaucuuaaugaugcaagcuuuucaucacaagggagauccauugagaaaguaugaauggaucaauggaaaauaacaaaggacauuuccaaauaauaauaauuaguacuaaacaaaguacaacacaaauguaaauauuuuugcuuaucucuucagucaagggguugucucugaaaugaaaaagaaauuaguucugaacaacuuaguaacuacuaagacuuacagcuuucaaaaaugaggacgaaauaacauucuuauucagaagaucacauugaacuuuacuuucucugcauuauuuucaaaguaacuuaaacuccaggucuguuauaauuuucuaaucuaaauugcucuuuuacauuauuguuuugaacaauuacauagaaggacugaaugagugaccccuucaggcuuuauugggaacuguuugugcagugcagucuguuggugcuguugaucuaccuacaucagguucauuauguuaguaaagaacauuauguaaaucauuaaucugagcuuuaaucuucuaccuugcacaugugugauuuuuagauucagaaaaaaacuuuauuuuuuaaaauuauacuuacuauaguuuaaauuugucucugcucuuuucuuuuucucacagagcugagaaagaauggggugaugguauccgugggcugucccucagugcagcccgguuugcuuugcuucgauuggaggaaggaccuccacacacuaaaaacuggagguaaagaaaucaacacuagcaguauuuggcacaugguuaacacacaaaaauauguguuuuguugauuuuaggauaaggaaaccauauguggcucaaggaauugguauaauggaccuguuuugaacuauucuaaauccuuaauuuuuuuauucccuuuucuucaugucguuuaugaucaagauuucuacaauuuauuauucuuccuugaagacugaucaacuugagauaguacugggagcauucaaaauaaugcccuuauccugucaucuccugugaucucuuccuucugucaaauuaccuguuucauacagaucuccugaauuaaaggguggagucugucauucuguuccccaaacccaaaauguuuucuccuccccuccaacccccaccaaccucuucacaggccucaguugcuuguauuacugaaacuagaugaagacuuacaugucaagcauccucgccuccucaccuuugccucacagcucaaagcaggaaaaggucucacuauugugggcucugucaucguggggaacuuccuagagaacuacggugaagcuuuagcugcugagcagguaagagucaggcuuuugagguauuggaacucaguuuacagcuuugugauguuaaguaguaagaccucaaacuucuacuugaaucuuguuccugagugaucuaggagguuucucacuuagugcugaccuuugaaaggacacuuuuucccaaauaauaagaugagccaaaaauaguuauuuauuauuucuuccuguuuaaagcauuacuaaauuauaagauuauuaagucuaaaccuuauguucaaauauacuccaaacauuaaucuaagcacugagaaaagucauguaaauaaauugaucccuugaacuauggagaggguuccucucaaucuugugacaacaaggaguaaugaccaaauuuucuuccucuuuacuaaucuacgugguaucaugagcaagauuccuuugccacuucugguuagcuguauugaacauuaaaguucuacuuuaacaaggaaguuguuuucacucuaauacuuauuauauaugauagaacuaauccuauuguuuuugaaaugccauuguguucaauggcauuucaaaaguuuuacuguggggggaggggggaaggauagcauuaggagauauaccuaauguaaaugacgaguuaaugggugcagcacaccaacauggcacauguauacauauguaacaaaccugcacguugugcacauguacccuaaaacuuaaaguauuuaaaaaaaaaaguuuuacuggauuucauuuuggaauccuuugaaauccuaaacacuagaaaugcugaagaaacauuacuccagaaugaugguaaaaauuaauaaaagguacacaggauugaaaaucaggagagccuaguucuuagccgcaucacugauuuaaucugugccuuugcaaaaaucauuccauuuuccauaccauuauucccaggguggaguaagaguaaaugagaugauaucuccaaauugguuugacuaaauaaaggaagaguaaugcaaauacaagugucaugaauaaucaccauuaaaaugucaaaaagcauaugggaaugggagaggcgaaaaagaaaacauaccugagaaaauucuaaagugaaacugaaucaucauacugaguuucugguaagaugagucagggcaugacuggggcugaggcaggaaggagaucguguucacaauagugaaucacccuggucaacugagaaagaauguugaauauucacuuuguagagaucccuguucccaguuuuuugguauggugcaaaggaacaaaagcagaacagaggaaaaagcagagaaacuacauguagacaaccagcuacagaggcaaaaauacguaguaagcaaaaagacaaaagaucaugaaauuccuuugggauaauuuuaacuuuuuggacuuuucuguagaugauauaguauuaugaagacuuuggaaaaaggugggggauauaauauggagaaggaacaauggguuaaaauguccagagugaaccaguucaguguugcgguccugugucucuuucagaccauaaagcaccuaauggaggcagagaagguaaaaggauucugccagcuggugguggccgccaagcugagagagggcauuucccaccucauccagucauguggccuugggggcaugaagcacaacacgguggugaugggcuggccuaauggcuggcgucaaagcgaagaugcccgcgcuuggaagacuuuuauugguacuaaccauuucucauacaaaccuaaaggcccaagucgaggguauauaguuaaaucucugucacccccagccuccuaaaguagagacuaugccauugcugaagcauagucuuauaaggcaaccugaaaaacuauugguaguaauacccagauucuaccuacccccuucagcuucacauuauguucaugaauuauuucugucaagucuugugcuaggaauuaucuccaaaauugccguguuuucauuugugauuuuccauauugauguucucacaggaauugcaagaauuguucuucagcaucauaaucucucaaauucacauauccccccuuagaaauguaguaaugggaauauaccuaguaacauaaacugugguucucagucuguuagcuauucagauuuuucacaaugguuuuugauacguaaugagaaauaacc

SEQ ID NO: 13327 - RNA, 4424 nt, Homo sapiens
cuauccacauaguucaccuccauacuguguucuuacuauaaaauaagccaacagagaaugagaaaacccagauauuaauaucauaaagaaaccauuuuagccugggcacaguggcucacgccuguaaucccagcacuuugggaggcagaggcggguggaucaccugaggucaggaguucgagaccagccugcccaacauggugaaacccuguuuuuacuaaaaauacaaaaaaaauuagccggguaugguggugggggccuguaaucccagcuacucgggaggcugaggcaggagaaucacuugaaccugggaggcggagguugcugugagcugagauuguaccauugcacuccagccugggugacaugagcgaaacucccucucaaaaaaaaaaaaaaaaaaaaucauuuuaucagauuauccauagucaagugaaaaagcucaggaucucaaguuuuuaacguugacuuuauggcuaguugucuuuuuaccuuaacaaccuuuauuucuuccccacucagggaccaguccaaugugaggcggaugcauacagcagugaaacucaacgagguuauaguuaacaagucccaugaagcaaagcugguuuuauugaauaugccagggccaccccgaaacccugagggugaugaaaacuguauccuuuccaagaguggggcuuccaguagggaaaaucuccuuaaccucuuucugagauaacuagguaacaauaaaagucauugucuaugccccacuuucccucuuuaaggaagggagacuuaaaaguccuaggcaaggauuuuuacaaaguuauaagauuaaacucuuuuaggggaguuggggcaaauauaauucaguucuaguuuuaggugguguauuugcaacaugacaucuaauauucaguguauaaaacccuuccugacaauccuacagacagcauacccacauccuuucgccuuuuuagguucuacccgcuuugcaaagccuuucuuuuggauagaguuaggggagaagcugagauagaaccuccuuuaacugaggggaaaaaagagauagggauucuuccucauaccuucaucccaggacuccugggauacgggaaacccuucagcauugacacauaaauuagcuuauucccaccaguaccauuaagaaagaagagguuuaggccaggugugguggcucaugccuguaaucccagcacuuugggaggcuaaggcagguggaucaccugaggucaggaguucgagaccagccuggccaacauggugaaaccccgucuccacuaaaaauagaaaaguuagcugggugugguagcaggugccuguaaucccagcuacucgggaggcugaggcaggagaaucacuugaaccaggagguggagguugcagugagccaagaucgcaccauugcacuccagccugggcaacaagaggaaauucugucucaaaaaaaaaagaaagaaaagaaaaagguuuaaaaagaaaaagacaaaccgaacuggcagaaaaaucugacuugagcagcuucacuuagaaauuacuuggguucucucuaggaaucuuguuagcugcccuauuguggcuuuucuucuucuuucaucauuuuuaucuuauuuagaguaacacuucuagguuuucccauuuuuuaaauacacaaaugggagucugguauuauguaugcaaaaggacuggaucucugguuacuucacaggguuaaauucaauccaaaguucagacuuuucugaauauauaauaauuaagcagcuaauuuuguagcucuaugaucagauaaccucagauuaugaugaugccagguuuuaaguuugugcucuucuuuugccugucuccuugacaaguuuugaagacauggaguuccuagaggugcuuaccgagggacuagagcgaguccuacuuguccggggugguggcagugaagugaucaccauuuauucauaaccuacucugaaugaccgugcuugaccuguuuucuuaaaaggccuacguccuccauggaagugccagcucauuacuaccacucccacucaacuagaagccuguguucuguacacaucauacugaacucuugaugagcugagccucaaguaccuguguaaaagagcucccaucugaucugcagucauuacagaaaaagcaaauauucccucaacaucagaacaaugcucaagucuuucaagccacgucugagcagucaaaggcaaauuagaauuaacaagcugagccaauaaaugaauugguaaaagggaugcuagaaauucaacugaagaaaaaaagcaagucaaguacguauucagcauuaaagaugaaucucagaagucaugguucaauguugacacugugaggauaacaacuagagacagcuucaucuuacuaaagaauuuauggucaaguauauuuggaccuauuauccucggcaagccaagaugcaaacauuuuuuagcuauauuucuuuaguauacccacugcuguaauuuuauauuaggauacuaacuugaaacauggcugcagccucuacuucuucaaaaacauccccccaaaauaccagauuuaaauauccaaauacugugucaguguauacuucaacuguuuuguuucucuuaacucaaaacccauucugucauuguaacacaggcaguguuaccauggaaauuguuuuugguaagguaaaaauuauuucuuucagguuccuuucaaauggccgaacuaagagaacuccaaaaggaagcuauuaacauuuacugaaauagucugugguucucuauacaacauggacaaaacauacaagcuguugucuaagaaaugcaggucauggugcacauuaaucaacagguucuucuccccccgcccccacccccgcgccuuuuuuuaugcccucuuauuaagcacaggucaaaaaaucuuaaggaacaaauacuaggaaaacuggcuaaacauccuucccugaaagcacuggaccaucuuuuaaagggcacaucuagcaauggaauuggaaguucuagagccacacucuuucuuuagugccaacguuacugagcggcuacucuccuuaccuacuuuacuaaaauggcauacagauuggcauugaccuguugaagaaauuuuaccacuaagaaaucuuuugccucaucuacaaagccauaguuaagacuugaggcauucaacuuaaugccaaguauaagcauuucccccuuuuucuuucaauuuuauucuucauucugacuacagaaacuuggcccugaacuacgagauuagccaagccaacagucuucuaauuuguuuucagaaacuucaggccgggugccguggcucacaccuguaaucccagcacuuugggaggccaaggcaggugaaucacuugaggucaggaguucgagaccauccuggccaacauggugaaaaccugucuauacuaaaaauacaaaaauuagcugggcaugguggugcaugccugugaucccagcaacacggaaggcuaaggcaggaggaucauuugaacccaggaggcggagguugcagugagccaggauugcaccucugcacuccagccuggguaacagagugauauguuucaaaaagaaaguucagugugccaaggaaauacuuguguaagcucagcuuuuuauuuacuaauauacugaucaaacaucuggcuuacaagcauagggaaacuacuuauguggcuggcugagcaguaauuucaaguaugugaaaucuucauuucuuuuacagaauaguuauuuagagaaacuuuucuugccuguauucauggcuguuuuugaauuucaauuuauuagucauaaauagugccacucuucuuugauuacuaaauaggacauggagcaagcugaccuaggugucacaaauuauucauuugaccuguaaggacagagaaaacccuucaauauagcuuaagaaauugaguaauuuugggccgggugcagugacucacgccuguaaucccagcacuuugggaggccgaggcaggcggaucacgaggucaggagauuugagaccauccuggcuaacacggugaaacccugucucuacaaaaauacaaaaaaauuagucgggcaugguggcgggcgccuguagucccagcuacuugggaggcugaggcgggagaauggcgugaacccgggagguggaacuugcagugaaccgagauugcaccacugcacuccagccugggcgacagagggagacuccaucucaaaaaaaaaaaaaaagaaagaaagaaagaaauugaguaauuuugauuuguucccuuugcuugcuucaaccuccaggcccacugaggauggcaaagcggauaggaucuuaagucuuuuuuucuguuacuuccuacagaugguagaagcauuauuuacaacucccacugcaacacuccauugcuuaguugaguuuaa

SEQ ID NO: 13328 - RNA, 4424 nt, Homo sapiens
uuaaacucaacuaagcaauggaguguugcagugggaguuguaaauaaugcuucuaccaucuguaggaaguaacagaaaaaaagacuuaagauccuauccgcuuugccauccucagugggccuggagguugaagcaagcaaagggaacaaaucaaaauuacucaauuucuuucuuucuuucuuuuuuuuuuuuuuugagauggagucucccucugucgcccaggcuggagugcaguggugcaaucucgguucacugcaaguuccaccucccggguucacgccauucucccgccucagccucccaaguagcugggacuacaggcgcccgccaccaugcccgacuaauuuuuuuguauuuuuguagagacaggguuucaccguguuagccaggauggucucaaaucuccugaccucgugauccgccugccucggccucccaaagugcugggauuacaggcgugagucacugcacccggcccaaaauuacucaauuucuuaagcuauauugaaggguuuucucuguccuuacaggucaaaugaauaauuugugacaccuaggucagcuugcuccauguccuauuuaguaaucaaagaagaguggcacuauuuaugacuaauaaauugaaauucaaaaacagccaugaauacaggcaagaaaaguuucucuaaauaacuauucuguaaaagaaaugaagauuucacauacuugaaauuacugcucagccagccacauaaguaguuucccuaugcuuguaagccagauguuugaucaguauauuaguaaauaaaaagcugagcuuacacaaguauuuccuuggcacacugaacuuucuuuuugaaacauaucacucuguuacccaggcuggagugcagaggugcaauccuggcucacugcaaccuccgccuccuggguucaaaugauccuccugccuuagccuuccguguugcugggaucacaggcaugcaccaccaugcccagcuaauuuuuguauuuuuaguauagacagguuuucaccauguuggccaggauggucucgaacuccugaccucaagugauucaccugccuuggccucccaaagugcugggauuacaggugugagccacggcacccggccugaaguuucugaaaacaaauuagaagacuguuggcuuggcuaaucucguaguucagggccaaguuucuguagucagaaugaagaauaaaauugaaagaaaaagggggaaaugcuuauacuuggcauuaaguugaaugccucaagucuuaacuauggcuuuguagaugaggcaaaagauuucuuagugguaaaauuucuucaacaggucaaugccaaucuguaugccauuuuaguaaaguagguaaggagaguagccgcucaguaacguuggcacuaaagaaagaguguggcucuagaacuuccaauuccauugcuagaugugcccuuuaaaagaugguccagugcuuucagggaaggauguuuagccaguuuuccuaguauuuguuccuuaagauuuuuugaccugugcuuaauaagagggcauaaaaaaaggcgcgggggugggggcggggggagaagaaccuguugauuaaugugcaccaugaccugcauuucuuagacaacagcuuguauguuuuguccauguuguauagagaaccacagacuauuucaguaaauguuaauagcuuccuuuuggaguucucuuaguucggccauuugaaaggaaccugaaagaaauaauuuuuaccuuaccaaaaacaauuuccaugguaacacugccuguguuacaaugacagaauggguuuugaguuaagagaaacaaaacaguugaaguauacacugacacaguauuuggauauuuaaaucugguauuuuggggggauguuuuugaagaaguagaggcugcagccauguuucaaguuaguauccuaauauaaaauuacagcaguggguauacuaaagaaauauagcuaaaaaauguuugcaucuuggcuugccgaggauaauagguccaaauauacuugaccauaaauucuuuaguaagaugaagcugucucuaguuguuauccucacagugucaacauugaaccaugacuucugagauucaucuuuaaugcugaauacguacuugacuugcuuuuuuucuucaguugaauuucuagcaucccuuuuaccaauucauuuauuggcucagcuuguuaauucuaauuugccuuugacugcucagacguggcuugaaagacuugagcauuguucugauguugagggaauauuugcuuuuucuguaaugacugcagaucagaugggagcucuuuuacacagguacuugaggcucagcucaucaagaguucaguaugauguguacagaacacaggcuucuaguugagugggagugguaguaaugagcuggcacuuccauggaggacguaggccuuuuaagaaaacaggucaagcacggucauucagaguagguuaugaauaaauggugaucacuucacugccaccaccccggacaaguaggacucgcucuagucccucgguaagcaccucuaggaacuccaugucuucaaaacuugucaaggagacaggcaaaagaagagcacaaacuuaaaaccuggcaucaucauaaucugagguuaucugaucauagagcuacaaaauuagcugcuuaauuauuauauauucagaaaagucugaacuuuggauugaauuuaacccugugaaguaaccagagauccaguccuuuugcauacauaauaccagacucccauuuguguauuuaaaaaaugggaaaaccuagaaguguuacucuaaauaagauaaaaaugaugaaagaagaagaaaagccacaauagggcagcuaacaagauuccuagagagaacccaaguaauuucuaagugaagcugcucaagucagauuuuucugccaguucgguuugucuuuuucuuuuuaaaccuuuuucuuuucuuucuuuuuuuuuugagacagaauuuccucuuguugcccaggcuggagugcaauggugcgaucuuggcucacugcaaccuccaccuccugguucaagugauucuccugccucagccucccgaguagcugggauuacaggcaccugcuaccacacccagcuaacuuuucuauuuuuaguggagacgggguuucaccauguuggccaggcuggucucgaacuccugaccucaggugauccaccugccuuagccucccaaagugcugggauuacaggcaugagccaccacaccuggccuaaaccucuucuuucuuaaugguacuggugggaauaagcuaauuuaugugucaaugcugaaggguuucccguaucccaggaguccugggaugaagguaugaggaagaaucccuaucucuuuuuuccccucaguuaaaggagguucuaucucagcuucuccccuaacucuauccaaaagaaaggcuuugcaaagcggguagaaccuaaaaaggcgaaaggauguggguaugcugucuguaggauugucaggaaggguuuuauacacugaauauuagaugucauguugcaaauacaccaccuaaaacuagaacugaauuauauuugccccaacuccccuaaaagaguuuaaucuuauaacuuuguaaaaauccuugccuaggacuuuuaagucucccuuccuuaaagagggaaaguggggcauagacaaugacuuuuauuguuaccuaguuaucucagaaagagguuaaggagauuuucccuacuggaagccccacucuuggaaaggauacaguuuucaucacccucaggguuucgggguggcccuggcauauucaauaaaaccagcuuugcuucaugggacuuguuaacuauaaccucguugaguuucacugcuguaugcauccgccucacauuggacuggucccugaguggggaagaaauaaagguuguuaagguaaaaagacaacuagccauaaagucaacguuaaaaacuugagauccugagcuuuuucacuugacuauggauaaucugauaaaaugauuuuuuuuuuuuuuuuuuuugagagggaguuucgcucaugucacccaggcuggagugcaaugguacaaucucagcucacagcaaccuccgccucccagguucaagugauucuccugccucagccucccgaguagcugggauuacaggcccccaccaccauacccggcuaauuuuuuuuguauuuuuaguaaaaacaggguuucaccauguugggcaggcuggucucgaacuccugaccucaggugauccacccgccucugccucccaaagugcugggauuacaggcgugagccacugugcccaggcuaaaaugguuucuuuaugauauuaauaucuggguuuucucauucucuguuggcuuauuuuauaguaagaacacaguauggaggugaacuauguggauag

SEQ ID NO: 13329 - RNA, 2402 nt, Homo sapiens
cuagcgcacggucggucauucguugaccuuuacccacccucaguuccuaucgcaguaucacuucucgcgccauagcaaggcuaccgugcgaagcucuagccaccagggggcacuguggccacagguccuuuuccccuccggcccuuagcgacccccagaggggcggagccaacguugggcggagcccgcgagccgcccacagcgccagcuaucccggcgggccgcgcgcgcggccgcguuugaauggcccugagugggacucggcccagaagccgagggacucucuaggcugccgggcgcuggucgucagcgccgaggcugggcugaggcgccgcgguaccaugaggcgccgguaagugacugccgagccggugcgagccccgcgcccgcagcugcccugcccuggcagggcuacuccagccgggcuuggccgcgcccugggcccaccugcaggccccgcggcggccucggcucggccgggcucgcggcagcgcugccgggucccggggcggggcggcaaggccggggcggagccccucugccggucccugcggggagagucgggcagcgggcgcuggggggcuccaggggacugggccgggagaggcguggaccgaaccuguugucacuuauuuaucuucggguggagucgacagcugcaccuggggaaggggaaggacagaacgaguguggggcgagcauuuuugaggacagguuuuccgcagagcgccuaggcccggcccaggcauuuccuuauuuuccgacggguccucggauuccugacggaugagcuuuuguuucgcaggacaaaaacuugacauaacugcauaagaauugucgauugcaacuuuaaaaaccuuacuguauuuucugaaaaguuguucuguaaaguaucuaggcuuuuacuacgcucuuauauugcuuaaauauggagauaacaaagaguugguuuguuuucuuguggcuuauaaaguuccuugaaaacagagauaccuaugucaguuucuuugcugauuuaaaaaaaauuguaagagaaauuagguguguaauaaucaucaguucagcacuugcgagaauuaugagaaacuaguccaccuaauagcuuaaaucugcuggguuuuuuggaguuucuuuggauagccagcuucagacuugaauugaaacgucauccauugaggcuuuuacuuggcuaauaacuaauauuagccaauaauaauauuagccagugugaucauaaugaugggcaauauuuauuuugugcuuucuaugcgcugggcguauuaagagcuuuacuuugggauauauacuguuguccccauuuugacagugaagaaacuaaggcacaggaaauuuuaguauuguaacuuuuguaccguacaggguuacacagcuaauauaauuaacacccgagcaggcuggcuccacgcuuuuaacucuguugcucuacuaccuccuuuaucuguggcucuuuuuaguuuacaaagcccuuucauuucauuuacuuaaacuucggagaccugagugugcuuuuguguacacauacauucauucacacaccauucauucaaguuuucugcucuugaugauuauacuuaagguuugugccugagcaaaaaauccauugacuauuuuaagauaaauggaguucauaagcuuuauguguguuauaauuuauguuuucaauuccuuuauauccuuuccugaaaguuuugaaaguguuagucuuagcaacuuauguauuacuuuaaaauaaaaaauuacauguuaaauguuuucaucccuaaaacuuauugagugguuauucuguacuugaaaugguuauacuuaaacuaauaccuccuugacaaggaauaaauuucaaaagcaaaaucacuuaguaagaaaucagcaguuuauacuuaucuauagcagagcuuuuaaaugucauucaucaguuacaaagcuuucgauugccuguaugcccaacagggugguagacccaauuggcuauacaaaagaaaugugccgcaagaaugacacuauggacuuuggggacuugguagaaagagagugggagggggaugaaggauagaagacuacacauuggauacaguguucacugcucagguaaugggugcaccagaaucucggaaaucaccccugaagaacugauucauguaaccaaacaccacuuguuccccaaaaaccuauugaaauaaaaaauaauaaaaauaaaauaaaaaaugugccaggacaaccaaccuuagggagauuaaucuaguuuggguuaugagauuaacaacaaaaaauauauaugacacucuucguuaguacaguggaugaaugcagaacugaacuggguaaagcuucugcgaaaaacuaacaauugcaggauuuauguagggcacugaacagaagggugg

SEQ ID NO: 13330 - RNA, 2402 nt, Homo sapiens
ccacccuucuguucagugcccuacauaaauccugcaauuguuaguuuuucgcagaagcuuuacccaguucaguucugcauucauccacuguacuaacgaagagugucauauauauuuuuuguuguuaaucucauaacccaaacuagauuaaucucccuaagguugguuguccuggcacauuuuuuauuuuauuuuuauuauuuuuuauuucaauagguuuuuggggaacaagugguguuugguuacaugaaucaguucuucaggggugauuuccgagauucuggugcacccauuaccugagcagugaacacuguauccaauguguagucuucuauccuucaucccccucccacucucuuucuaccaaguccccaaaguccauagugucauucuugcggcacauuucuuuuguauagccaauugggucuaccacccuguugggcauacaggcaaucgaaagcuuuguaacugaugaaugacauuuaaaagcucugcuauagauaaguauaaacugcugauuucuuacuaagugauuuugcuuuugaaauuuauuccuugucaaggagguauuaguuuaaguauaaccauuucaaguacagaauaaccacucaauaaguuuuagggaugaaaacauuuaacauguaauuuuuuauuuuaaaguaauacauaaguugcuaagacuaacacuuucaaaacuuucaggaaaggauauaaaggaauugaaaacauaaauuauaacacacauaaagcuuaugaacuccauuuaucuuaaaauagucaauggauuuuuugcucaggcacaaaccuuaaguauaaucaucaagagcagaaaacuugaaugaauggugugugaaugaauguauguguacacaaaagcacacucaggucuccgaaguuuaaguaaaugaaaugaaagggcuuuguaaacuaaaaagagccacagauaaaggagguaguagagcaacagaguuaaaagcguggagccagccugcucggguguuaauuauauuagcuguguaacccuguacgguacaaaaguuacaauacuaaaauuuccugugccuuaguuucuucacugucaaaauggggacaacaguauauaucccaaaguaaagcucuuaauacgcccagcgcauagaaagcacaaaauaaauauugcccaucauuaugaucacacuggcuaauauuauuauuggcuaauauuaguuauuagccaaguaaaagccucaauggaugacguuucaauucaagucugaagcuggcuauccaaagaaacuccaaaaaacccagcagauuuaagcuauuagguggacuaguuucucauaauucucgcaagugcugaacugaugauuauuacacaccuaauuucucuuacaauuuuuuuuaaaucagcaaagaaacugacauagguaucucuguuuucaaggaacuuuauaagccacaagaaaacaaaccaacucuuuguuaucuccauauuuaagcaauauaagagcguaguaaaagccuagauacuuuacagaacaacuuuucagaaaauacaguaagguuuuuaaaguugcaaucgacaauucuuaugcaguuaugucaaguuuuuguccugcgaaacaaaagcucauccgucaggaauccgaggacccgucggaaaauaaggaaaugccugggccgggccuaggcgcucugcggaaaaccuguccucaaaaaugcucgccccacacucguucuguccuuccccuuccccaggugcagcugucgacuccacccgaagauaaauaagugacaacagguucgguccacgccucucccggcccaguccccuggagccccccagcgcccgcugcccgacucuccccgcagggaccggcagaggggcuccgccccggccuugccgccccgccccgggacccggcagcgcugccgcgagcccggccgagccgaggccgccgcggggccugcaggugggcccagggcgcggccaagcccggcuggaguagcccugccagggcagggcagcugcgggcgcggggcucgcaccggcucggcagucacuuaccggcgccucaugguaccgcggcgccucagcccagccucggcgcugacgaccagcgcccggcagccuagagagucccucggcuucugggccgagucccacucagggccauucaaacgcggccgcgcgcgcggcccgccgggauagcuggcgcugugggcggcucgcgggcuccgcccaacguuggcuccgccccucugggggucgcuaagggccggaggggaaaaggaccuguggccacagugcccccugguggcuagagcuucgcacgguagccuugcuauggcgcgagaagugauacugcgauaggaacugaggguggguaaaggucaacgaaugaccgaccgugcgcuag

SEQ ID NO: 13331 - RNA, 3038 nt, Homo sapiens
ucuuucaaauacuuugcucaauuucaaauuuauuguuuuuuaagauuaaaagguuguaaaauacuuccucuuccccaacgcuuuaucucugcaagguuaagaauuguauugaggguuuacaaauaggagcuugguagauuauuuucuaauucucagaugauuuuuuucugauuugugagcuaugggucaguguccagauugacuauguccuacugugaccuagaaucaaacauuggaguccaacagcaucacucacucccugcuuauuagcaaccuaauuaccuaaaaaaagaaaaaaaaaaaaaaaaaaaaacuggagagacaggcugccagcugucaggaauaccuuuuaacauuuuuuucuccuaaaccugcaacgaggcacuacccaaagcaaagaacuuuaaaacaccaguacugagaaacugugacuguugcuagaggauuuugcauagcaaacccaaaaaaccaucuuuugaaacuaaauuauacucaacgacagaaagacauguuuccccuuuuaugagcuccaaguuuuaguacuggccuguuaaguguuucuucauagguaaauauucggauuuaauucuaugcuuuuauucuuaccuguguuacacugaugugaaaaucugaaaaauacaugagacaaauauaaaaaagugauucagaagaaaguaggcauuuguuuuuauacuuggcaacugcaguugagaaggggguguauuuuaucaaaguaaauuucaacugagaagaaugaucuucaugccaaucuuuauaaaaaucaaaguuuuuuucuuucaaacaccucaguccuccuaaucaguuucauauguuguguuaguguuauguucaaggacaggcagucagaaagccuucugcucugaugugcagucgggggaaaggugauggucuaacguugaaauuccuagugaucuaaauauuuagagugugaaguaguuuguaauuauucggaguacaugacuggcauggauacuugagccaguucauuuuuucauaaaggguacauggcaccaaacaagcaugucaucucuuguaacugacaaauacauuccacaaaacagcaacaugucaaugguaugaaacgcuacagcggucaugugguuucauguggauguuauacagcugaccuuguaucauuaaccuuuaugguuagguauuaaccuuugaaacacuuaagaaaaaaugauguaugaguuuuaagguuauccugucucugccuuuucacauuauuaauaugggcagcuaauaacauuuaaaauagaaaaauugccugggagaaaaaaauguagccaucuauaacccucagucaaacuaaaauugaagugacauuucaaguuugaauaggauaguuaaauguuuauuuugaaaauauuucauaaauuauaguccauguuugaucaguuaggaaauaagucagauuuaaauucauaccuuccaauuacuagagaaaaccugaaauacguaauucuuauaacaauuauucuuucaaaaagcacaaauuauggagaugaauaucaaucaaaaguaauauaguauaaucuaaggugggggaggaaaagaaugugguuugucuauauuccaggagaagagaaucaagucaaaaugagaucugaucuuuuccaaguuauucugucuucaucuuaguagaguguaauuccacaugcaucuugauguuccaaguaucauuaaacaucuaguaaucagaacaaauguucugccaaauuccguuuauuauuuuaacugguuaaggcauugagcacucuagauuuauacauguauaauuaaaauuucuauuaaaaaauaaaccuagaugggagauuuacauuuuucuuaaucuauguuuacacaaagaagagaucuguuuuuaaauauuacaucagaucuuugugaauucaaauaaaucagugugacacuuugccaaaacuauuuguaaaaaugauggguauugaugcccuguggucagggaaucuucucugugggguuuuagaauuugcuuguuacucaaaaauacccuuauuccgguucucacuguuguuuucaagcauauaagcuuagccucaacggauacacuuuaucauuuguacacugucagcccuuauauguccucaauugcaaguauuccacaugaaacaagugcagcuccagaaacuucugccucuuccuggauagauccauaacuggauauuuuugguaagcuuaauugccuguauacaggaacucaaaaagagccuugccaccacaaagaauaaaucuauaaccccuauuaucgugggugcuguuucaaggcucuuuuuguugcucagcguauuuucaugaccccucuucccaucaucuuguugucucucagugaaaaauaacuccuaacauuuggaugcacauggacgaaaacaccugcauuggccccuuaauguuauugaagugggaauauauuuagaacuauaaaaauucuuaccaauuaaaaugugaugugcauucacaguuauggcaauauuaauaucuuuauuuugacccauuugagaucaauugaucgacugucaucugggcccuguccauauuguaagauaagucaguugggaggggcacuaaacaaaacaaacuuccaugucuguguggagauagaccugucaauuuggacuuaagagugccagauuuguugaaaagaauguagucacagucagcuaugcacuuagcagcugugaccuggcugaggaauaauugcaguaaucauacaaaucaguuuuuaucauguauguaacaggcuguucaugggcacuacuuaauauuacaguuccuucuuccuugguuuucuuuugcuaacagaacccaguagucgugggcacuauagcuuuaaggauuucuaacagucaacuaggauauuggaagaauucauucauucagugaccccugcuacagugauacaucagugaacaaaaaauaaaaacaugaguccccauaaaguugacauauuuaaaagauggaaggaggaagagacguuagcacagcaggcaggauaaucu

SEQ ID NO: 13332 - RNA, 16702 nt, Homo sapiens
ccggcauuuaaacgggagacggcgcgaugccuggcacucggugcgccuuccgcggaccgggcgacccagugcacggccgccgcgucacucucggucccgcugaccccgcgccgagccccggcggcucuggccgcggccgcacucagcgccacgcgucgaaagcgcaggccccgaggacccgccgcacugacaggugagcgcggacgcacccggcagggaugugagugggcggagggaagagggccgcaaaccaacccaggacccgcucaguuccacgcgcggcagcccuccgugcgcgcaggcucgggugcguuguucgcgggggugaauugugaagaaccaucgcgggguccuuccugcugaggccgcggacaccgugaccucgcugcucugggucugcagggaaacguaggaaaaaaaguugucaggagcgggcaggaugacccccacaucccguuuccaccucccggaggcccccgaacacgcuccuggugcugguggcagcagcgccuggcagacgcgcccgcuuagcgagggcgcgaaguccaggccgccagagcgcaggagcauccggaccugcuagucggccgcugacugcgcggcgaguugccuugagagggucccaugugcuuggggcgccgcgcugggucugggggcgucuuggggcgcccauuggaguccgcggguuggagcauccggagaauccaugaugugugcauuugccgauccccgaggugagauggagacuggcaagggcagagccgcuguguucagccacagcggaaaaccgaacgguggguaauccgacagcugcggugcggggcgcggcccuggccgcgggguccagcgaacccgcagugcucacaaggcagacaccacacgcgcucgcggaccggccacgcacucgcgggcgcucgcuucucuacuccagccucuuccccgccccgcgcacgcccgggcugaaugguagacguucuggcgccgggcagcggccaccggcugguucccacuuccgcgcgcaccccuuaaacuguguucuagaggccccagccucgccuugcagcgccucacuagcuccugaggacuagggacuggcggcugaggcggguuggcggcugcaacgagcugggcgucuuucguucucucucgcugccuggcuggcuccgcuggccccuccacagcuugcggagcaaggccauagcaggggagugggagguauauuggggcugucaccuccuugcuggccggaguuauuuguagacuacagacuccggaagaacagacgcgccaccgcucucgcuuggcauugccuucggaucgcagcuccuccuugggggugccccagcuuggcguuuauuugccugcgccaggcucuggcgacggucaccgggccaggcggggagggacggacggcaggugaccagccucugcugugaagaaauuccugcgcgcccggagcugucccuaaugcauucccgggucgaauccgucuacugccuuccccuccucgaccgacuccgaaucucggcucuuauagacagaaauacagccucagcguuagggguuaaaaucccccucuuaaacgguccgagggcagagaggugaccaccgauagguaauuggaucuccugcuggaaagagcaaaucugagcggugugcgcgucuguuuauguuccccuucgagauggugccaggacacgaacugauuaaaacaaucuauuguguuaagugggucacuaggguuuuaagcugucccagggaccccagaguaguggcuuccuucuggcuguacacacaaguuaaauaaauagcguagaagagguuaagauaaccccauucuagggugaggaguccucuuucaucccuagggcuucccccuccccuuuucucuuuuuuuggaaggagggggagcaugagagucuugagggggggauguacuuuucaaagcaaggagggaaagaucuuaagaaaacuauauauucucacugccccccaagccaagucuauaacaguaggugauuugauuacuaucucuggauaaauggcacugucaaauuguuaauauuaacuauuucagggauuuuuagcaggguaguggcaguaugugugcgugugugugugugugucuguguguguguguuuaaccuccaggucauuguaggaauuagagucuuuuguaaacuuuguaauuucacagguuuccuauuuucuuaaaaguucauuuuuagugaaauguuuugguaacccacgcucuguaggaaauccagguuggcuaaugcggucuuuaugugaguaguuacacagggaaggauaaaaaccuuuuauguccuacaucucugaaugagggcugccuacccugucuuugaaacuaagccgaagaugccuucagucugaauggucaaguauuaaaagugauaaaaugcaaagaaauuucaugccgcagacaccucccccaagaacugcuuguugacagcaaagcuguggaacauguuccacaacagagaguaaaggacagccaggaaauauaaaccuuuuauguaaaggaaaggcaggugggggacagugguuaggggaggugacugcagccucuaaccaaaaggcaaccaucaggcaagugcuaccagcccgugucuucgaucugcaaggaauuuucuuuaguuuuaacauaugcucuuagaaauucaaaguacaacaggaauuccugggacaagagaaaucuuuuuauucacaugugaacaugaagauacaaaauagauaauuauuuuauuuauagcacucuucaaauuguauugcauuagaaaacauauccauugacccacuguuaaggacagcacugggugucaauaggacagugguuaaggaccuguguuuggggcuagauagaauuggguuuaaacugcuggcugggcuaggcacaguggcucacaccgguaaucccagcacuuugggaggccaaggaggacggaucaccugaggucgggaguucgacaccagccugaccaacauggaaaaaucccgucucuacuaaaaacacaaaauuagccaggcaugguggugcaugccugcaaucccagcuacuugggaggcugaggcaggagaauugcuugaaaccgggaggcggagguuguggugagcccagauagcgccauugcauuccagccugggcaacacgagugaaaacuccgucaaaaaaacaaaacaaaacaaacaaacaaaaaaaugcuggcuuucccacuuaugagcugugugaccuuggacaaauuuccaacuuuucugaguguagauucccugauugguaaaaggaagaugauauuaucuaccucauauuuuguuaugaaaaauaaaugauaaaauugggucagaaaucagcauaaugccuggcacaguaagggcuucaaaauaaaagguagcucuuauuauuaguaaugguguuaggaaaaguagcaauguuauacagaaccaggauauaucacagggcaguucugaaauuaaauccugaauccuggccgggugagguggcucacgcuuguaauccuaagcacuuucggagacugaggcaggcggaucacgaggucaggaguuugagaccagccuggccaagacacugaaaucccgucucuacuaaaaauacaaaaauuagcugggugugguggcaggcgccuauaaucucagcuacuugggaggcugaggcaggagaaucacuugagcccaggaggcggagguugcagugagcugauaucgugccagugcacuccagccugggugacaucucuuaaaaaaaaaaauccugaauaccacacuacgcagugacuaacacaucuuucacuacagaacagaaccuguaacuuggccgucucucagcagugcugcucagugaacauuuaauaauuuauuacuuucuaacucguuucuuguugaccucaagaauuguacauagucauuaacuuuccuaagaaaaucuuugacaaacauagagcuccugagauauuucacaaccagguggucuccucccuguccuaugcaauguugggccccagccugauuuagccgaccuggucuucagacuugagaggcuguuuaggguucuuacaacacaaaggggaugagacuuuauccucuaccugucugccaacaagggauucuucuuaucuccuuggugcaacuugucugaaaaagaaagucaacacaauuaucuucuuaaaaguuaaagaucaaauuaaaaauaagcuauaguuuucccaaagauuuagaccugagaaaaaggaauagaucuuucuaaaaccuggccugcacuuagagcauuuguagucacuuccacuauuucuuaugcugagagaauaauuugaugucaugccuauugaaugucuuucuaaagcuugauucaucaggaggaacugaccagaaguccaugcacagacauuuggcuuucacuguaauuccuacucaaaacucccuuucacugauuaugagcagguugcuuagcuaaaaugagaaauacagcaagaagagggauggaaagagcuggcuuaaacuuucccaaagacaucaugaacacugggaacaggucauacauauaccauuuuuauuucucaguccucaguauuagaauauuguguuccuagaggcuuugugaaaauuggaauacauugccaugaccugcacaggauagaggugguuaauauggcuuaccuugcuuguagauguuuacucuugaucccuaagggaaacuggaaggaaagcaugcuguagagaggaccugcuuugagaguauguguccucugggacaaguggaaugaaagagaggauagaggcaaagagaaaaaaagguggagauggggugagacuugcugguggacaguugcaaagaaaacucaugaugagaauaacaucacauuucuugaagaagcugaacugcauugaugggaaguugaggcagaguuugaaaagaagauauacugucugcaaaaaagaaucaacggagaugucagguaucuugaugcacccugagucuaugagaugcagcuuaauuuaauuuagugauaugaguaggccauuucauaagugguggaaauuaccauaaaguguuugcagcuaaugacggcgcaugaaugaugucauaggaaccuaagucuggaugagcuauggauugaauuuuuacuaugggacacccuucuacauguugcuguggaaaagaauuguccucaagaaauguacaucuucugcauuuccucuacaucucugauauuuacaaagugcacauuauuuggugauacuacaacugggauuucaagugcacaucacuacuauuuccuucacugaagaaucaagagcagucuggggguggggagagcuugagugauugacaaggauguggcagagcccugguuccacuaugaauuauaguucuuacccugcuuacugucacucauguagagcagcuagugugccucagagcacugcuguucucugagaagcugaggucucgauugacauucuugaaguugguguuuacuucucucugaauaaacaaagguuggcaacucagacaucuuacaauaaguacuaaagauuuuugaagaauagguuuuuaaaaaaugaaaaaacauuucacuuuccauagcuaauaaaucuuauuuugaggaaaauguacuuuucuuuaaaaaaaaaaaaaaagccugucugucacucuagacccuuuggcuuagaagguaggcacacucacauagaaacagaaagucuguccaaauuaaaacugaaaaccacaguugacuaauuuugaauuuauagcucugcuguuggcuucugcgauaguauuaauuucaauggcuucaauuagaaaaugaaacccauagcauuccauaugagaacagguaaaaagucagggacauuuggaguuuuccaagaaaaagaaagacaagucuuaggaagcucucuaggauggaaggaauuugccacacugagaguuagacauccaaaggauagcaauuggcucuucugcucaugggcacuggugaaggcauuuuaaaaugcgaagaaugguaccucuguaaaucaaugagguucauaauaaucaugcauuuaccaaauuuuuauaagcaccugccuugugccaggcacugaggguaaggugaugaauaagcccucaucaacugucagacuagauauuuacucaauaacagaugugaaaaugccaagaaggaaaaguugaguauaaagaaagccuuaaguugguucagagaaauaaaauugcauuuuucggauagauguuuauggaaucggccuuaugagguaaacuuguccuaugcagugaacauacauucccaguuagucucagauuggccucugugaugacaaacucagaggguccuggucuaggaggggugaauuugucuggaggccauuuucaggagguauggaggaagacuggggcauaggccuggggccaucccauguacuccuccucugaaauggggagcaacugaauuguguuuuauuuuagaucuucguccaacuugaauaccagaaauucgugaaaccuucucaaauucacacuauauuuugagaccaggagaaggcuccuugagaaauugccacacugucuuauccuagucucuggaaaaauucaguccuguauuauaacugggcguuucucauaagugcuuuuuuuuuuucuuuuucuuuuuauaauacuuuaaguucugggauacaugugcagaaugugcagguuuguuacauagguauacacgugccauggugguuugcugcacccaucaacccaucaucuacauuagguauuucuccuaaugcuaccccuucccuagccccccaccccucgacaggccccaguguuugauguuccccucccuguguccauguguucucauuguucaacucccacuuaugagugagagcaugcgguguuugguuuucuguuccuguguuaguuugcugagaaugaugguuuuuggcuucauccacgucccugcaaaggacaugaacucauccuuuuuauggcugcauaguauuccaugguguauaugugccacauuugcuuuauccagucuaucauugaugagcacuuggguuggcuccaagucuuugcuauuaugacuaguacugcgauaaacauguguauaugugucuuuauauuagaaugauuuauaauccuuuaggucuauacccaguaauaggauuccugggucaaaugguauuucugguucuagauccuugaggaauugccacacugucuuccacaacgguugaacuaauuuacacucccaccaacaguguaaaagcauuccuauuucuccacauccucuccaacaucuguuguuuccugacucuuuaaugacggccauucuaacuggcgugaaaugguaucucauugugguuuugauuugcauuucucuaaugaccaccgaugaugagcuuuuucucauauguuugcuggccccauaaaugucuucuuuugagaaaugucuguucauauccuuugcccacuuuuugaugggguuguuugcuuuuuucuuguaaauuuguuugaguuccugguagauucuggauauuagcccuuugucagauggauagacugcaaaaauuuucucccauucuguagguugccuguucacucugaugguaguuucuuuugccaugcagaagcuguuuaguuuaauuagauccaauuugucaguuuuggcuuuuguugccauugcuuuugguguuuuagucaugaagucuuugcccaugccuauguccugaauuguauugcccugguuuucuucuaggauuuuuaugguuuuaggucuuacauuuaagucuuuaauccaucuugaauuaauuuuuguauaagguguagggaaaggguccaguuucaguuuucugcguauggcuagccgguuuucccaacguuauuuauuaaauagggaauccuuuccccauugcuuguuuuugucagguuugucaaagaucagacgguuguagaugugugguguuauuucugaggccucuguucuguuccauuggucuguauaucugcuuugauaccaguaccgugcuguuuugguuacuguagccuuguaguacaguuugaagucagguagcgugaugcuuuguucuuuuugcuuaggauugucuuggcuauaugggcucuuuuuugguucuauaugaaauuuaaaguaguuuuuucauagacaucuauagaacucuccaccccaaaucaacagaauauacauucuucucaguaucgcaucgcacuuauucuaaaaugaccacauaauuagaaguaaaacacuccucagcaaaugcaaaaaacagaaauccuaacagucugucagaccccagugcaaucaaauuagaacucaggauuaagaaacuuacugaaaaccacacaacugcauggaaacugaacaaccugcuccugaaugacuacuggguaaauaacaaaauuaaggcagaaauaaauagguucuuugaaagaaaugagaacaaagacacaauauaccagaaucucugggacacagcuaaagcaguguuuagagggaaauugauagcacuaaaugcccacaggagaaagcgggacagaucuaaaaucgacacccuaauaucacaauuaaaagaacuagagaaacaagagcaaacaaauucaaaagcuagcagaagacaagaaauaacuaagaucagagcagaacugaaggagauagagacacaaaaaacccuucaaaaaaucaaugaacccaggagcuguuuuuuuuuuuuuuuugaaaagauuaaugaaauagacugcuagccaaacuaauaaaggagaaaagagagaagaaucaaauagacaauagacacaauaaaaagugauaaaggggauaucaccacugaucccacagaaauacaaacuaccaucagagaauacuauaaacaccucuacgcaaauaaacuagaaaauugggaagaaauggauacauuccugaacgcauacacccucccaagacuaaaccaggaagaaguugaaucccugaauagaccaauagcaaguucugaaauugaggcaguaauuaguagccuaccaaccaaaaaaagcccaggaccagacagauucacagccgaagucuaccagagguacaaagaggagcuaguaccauuccuucugaaacuauuccaaacaauagaaaaagaaggacuccucccuaacucauuuuaugaggccagcaucauccugauaccaaaaccuggcagagacacaacauaaaaaaggaaauucaggccaauaucccugaugaacauugaugugaaaauccucaauaaaauacuggcagcacaucaaaaagcuuaccugccaugaucaaguuggcuucaucccugggaugcaaggcugguucaacauacgcaaaucaauaaacguaaucaaucacauacacagaaccaaugacaaaaaccacaugauuaucucaauagaugcagaaaaggccuucgauaaaauucaacaccccuucaaugcuaagaacucucaauaaacuagguauugaugaaacauaucucaaaauaauaagaguuauuuaugacaaacccacagccaguaucauacugaaugggcaaaagcuggaagcauucccuuugaaaaccgccacaaggaugacuucucucaccacuccuauucaacauacuauuggaaguucuggccagggcaagcaggcaagacaaauaaauaaaggguauucaaauaggaagagaggaagucaaauugucucuguuugcagaugacaugauuguauauuuagaaaaccccaucaucucagcccaaaaucuccuuaagcugauaagcaacuucagcaaagucucaggauacaaaaucaaugugcaaaaaucacaagcauuccuauacaccaauaauagacaaacagccaaaucaugagugaacucccauucacaagugcuacaaagaauaaaauaccuaggaauccaacuuacaagggaugugaaggaccucuucaaggagaacuacagaccacugcucaagguaauaagagaggacacaaacaaauggaaaaacauuccaugcucauggauaggaagaaucaauauuaugaaaauggccauacugcccaaaacaauuuauagauucaaugccauccccaucaagcuaccacugacuuccuucacagaauuagaaaaaaacuacuuuaaauuucauauggaacugaaaaaagagccgguauagccaagacgauccuaagcaaaaagaaaaaagcuggaagcaucaugcuaccugacuucaaacuauacuacaaggcuacaguaacaaaaacagcaugguauaguauaagugcuuuuuuuuaaaagacaaaguaaaguaauuuuuuuguuguugggguaaaacaaaagcucugcauaaagagcagggauguuguaacauacacugaccaaaggugggaaaccuacaguuggagcagaagcugaaugucacauuaucagcuccgaacuuauaauggucuaaaaguacuagguuaauguuggaaagauggugccauuuaaagauaucuuaaauucaauauuuaauuauuuuaauuugacauuauccuagaguugaaugguguuuacuuaccaugugcuguucauuagaaaaucuagauccuacacugccuuugcgcaagguaguugcucuaauaauaccaaccuguccaguuuuggugggagaaauaauguuacuguuaaguugcacuuagugguuauuauguguaauacugguauuccaaagagagaaggaaaauguuugcuacacagcuguguucuuagguucagaaaaccacaggagugggacaggagaaccuucaggauucagguccgauuguugugauggccgcaggagggagacugugaauuugaaacugcauccauugaaaagaaaaucccuccacacuuuaauaauucucuccgugccccauggcagcaagugcuuauaggccuugcuacucaaagcuuaauaaaaaggcagaccugcugaaucauaaucugcaucuuaacaauauccccagauauugucugcacuuucuuuuuuuuuuucuuucuuucuuucuucuuuuuuuugagacagagucucgcucagucacccaggcuggagugcaguggcgcgaucucggcucacugcaagcucugacucccggguucacgccauucuccugccuuagacucccgaguagcuggcacuacaggcgcccgccacuacgcccggcuaauuuuuuuguauuuuuaguagagaugggguuucaccguguuagccaggauggucucgaucuccugaccucgugauccgccgcccaucugggccucccaaagugcugggauuacaggcgugagccacugcgcccggccaauugucugcacuuucaagucuaagaagcacugucccaggaggaaaaucuuuuuagucugucugaggcuucucucuugcacucuccuuuuuaaaaauaugcugcuccuucuccaccuuucccucuucuuccgccuuuucugucugccuuuacuaccuccccugaacauucaacuuguagaagaguuccccuuucucugaauugcauucuucacuucauucauucuuuucucucucugucuaugguuuccuauuuuuugucgguuuucccucaccucaccuccuuguuauuuuuugccauuguucacauaucacugcccuuucagacccauaucuagcuucugacccauccacuaauccauugccacuaauuuauucagcaugcccaugccauuuauuaauguaaauauuugcacauacuuguucuaucaugcccauuuuucuaccuuuuaaauuguauauacacagacacaugugaaugacauauuucacuauuuaaaagguagaaaaauguauaucgugguacaaagugauacauugaguaucugugcccaguuucaagaugagaauaagugagaggugaagccucaugagucacgucaccuacacgcuacugucuuucauuccaucugcaguacugccacacauuugguuaguucuccaauugcugucacauugacaucgaguuggaucugaacagcguaccuggggagacgaaguauugguaucuuugcuuaaauggagugauuuacugagagacaaagugacaucuuuaagaucagauagcaaguuacugcaccaggagcgcgaccuuuccuguuuuguuguuuucccucugucaaaugccuucuggucuccaugaaucucuccuuccacauaugauaaaaaugcaaagucucauaagcauucacagcucaggaagccucaggcuaguuggggagaaaagacugggagguuuccggaggaaugaaguccucugagcagagagguuaauucaucuugcuguaaaacaaaauagaaaauaaguuccccucaauaagugaacguaauacaaagacaaaugugguuggugccagaggccaggaagaaguucuugugagaauaggugcagagaagagcuaggcccuggcugaguuuaaaccuugacuuagucacugugggacucugggugaguuacuccauggauugauggcugggucauggagauaauaguaccuaauucauacagguacugugagaaguaaauggaauauuucacguuaaguguuuaacggugcguuuaaaugcuaggugcuauuauuauuaauuuuuaaauuaacuuugccauguuuugugucuuccccucucugugcuuccuuucuuuaguaugagccgcacagccuacacggugggagcccugcuucuccucuuggggacccugcugccggcugcugaagggaaaaagaaagggucccaaggugccauccccccgccagacaaggcccagcacaaugacucagagcagacucagucgccccagcagccuggcuccaggaaccgggggcggggccaagggcggggcacugccaugcccggggaggaggugcuggaguccagccaagaggcccugcaugugacggagcgcaaauaccugaagcgagacuggugcaaaacccagccgcuuaagcagaccauccacgaggaaggcugcaacagucgcaccaucaucaaccgcuucuguuacggccagugcaacucuuucuacauccccaggcacauccggaaggaggaagguuccuuucaguccugcuccuucugcaagcccaagaaauucacuaccaugauggucacacucaacugcccugaacuacagccaccuaccaagaagaagagagucacacgugugaagcagugucguugcauauccaucgauuuggauuaagccaaauccaggugcacccagcauguccuaggaaugcagccccaggaagucccagaccuaaaacaaccagauucuuacuuggcuuaaaccuagaggccagaagaacccccagcugccuccuggcaggagccugcuugugcguaguucgugugcaugaguguggaugggugccuguggguguuuuuagacaccagagaaaacacagucucugcuagagagcacucccuauuuuguaaacauaucugcuuuaauggggauguaccagaaacccaccucaccccggcucacaucuaaaggggcggggccguggucugguucugacuuuguguuuuugugcccuccuggggaccagaaucuccuuucggaaugaauguucauggaagaggcuccucugagggcaagagaccuguuuuagugcugcauucgacauggaaaaguccuuuuaaccugugcuugcauccuccuuuccuccuccuccucacaauccaucucuucuuaaguugauagugacuaugucagucuaaucucuuguuugccaagguuccuaaauuaauucacuuaaccaugaugcaaauguuuuucauuuugugaagacccuccagacucugggagaggcuggugugggcaaggacaagcaggauaguggagugagaaagggaggguggagggugaggccaaaucagguccagcaaaagucaguagggacauugcagaagcuugaaaggccaauaccagaacacaggcugaugcuucugagaaagucuuuuccuaguauuuaacagaacccaagugaacagaggagaaaugagauugccagaaagugauuaacuuuggccguugcaaucugcucaaaccuaacaccaaacugaaaacauaaauacugaccacuccuauguucggacccaagcaaguuagcuaaaccaaaccaacuccucugcuuugucccucagguggaaaagagagguaguuuagaacucucugcauaggggugggaauuaaucaaaaaccucagaggcugaaauuccuaauaccuuuccuuuaucgugguuauagucagcucauuuccauuccacuauuucccauaaugcuucugagagccacuaacuugauugauaaagauccugccucugcugaguguaccugacaguagucuaagaugagagaguuuagggacuacucuguuuuagcaagagauauuuugggggucuuuuuguuuuaacuauugucaggagauugggcuaaagagaagacgacgagaguaaggaaauaaagggaauugccucuggcuagagaguaguuagguguuaauaccugguagagauguaagggauaugaccucccuuucuuuaugugcucacugaggaucugaggggacccuguuaggagagcauagcaucaugauguauuagcuguucaucugcuacugguuggauggacauaacuauuguaacuauucaguauuuacugguaggcacuguccucugauuaaacuuggccuacuggcaauggcuacuuaggauugaucuaagggccaaagugcagggugggugaacuuuauuguacuuuggauuugguuaaccuguuuucuucaagccugagguuuuauauacaaacucccugaauacucuuuuugccuuguaucuucucagccuccuagccaaguccuauguaauauggaaaacaaacacugcagacuugagauucaguugccgaucaaggcucuggcauucagagaacccuugcaacucgagaagcuguuuuuauuucguuuuuguuuugauccagugcucucccaucuaacaacuaaacaggagccauuucaaggcgggagauauuuuaaacacccaaaauguugggucugauuuucaaacuuuuaaacucacuacugaugauucucacgcuaggcgaauuuguccaaacacauaguguguguguuuuguauacacuguaugaccccaccccaaaucuuuguauuguccacauucuccaacaauaaagcacagaguggauuuaauuaagcacacaaaugcuaaggcagaauuuugagggugggagagaagaaaagggaaagaagcugaaaauguaaaaccacaccagggaggaaaaaugacauucagaaccagcaaacacugaauuucucuuguuguuuuaacucugccacaagaaugcaauuucguuaacggagaugacuuaaguuggcagcaguaaucuucuuuuaggagcuuguaccacagucuugcacauaagugcagauuuggcucaaguaaagagaauuuccucaacacuaacuucacugggauaaucagcagcguaacuacccuaaaagcauaucacuagccaaagagggaaauaucuguucuucuuacugugccuauauuaagacuaguacaaauguggugugucuuccaacuuucauugaaaaugccauaucuauaccauauuuuauucgagucacugaugauguaaugauauauuuuuucauuauuauaguagaauauuuuuauggcaagauauuuguggucuugaucauaccuauuaaaauaaugccaaacaccaaauaugaauuuuaugauguacacuuugugcuuggcauuaaaagaaaaaaacacacauccuggaagucuguaaguuguuuuuuguuacuguaggucuucaaaguuaagaguguaagugaaaaaucuggaggagaggauaauuuccacuguguggaaugugaauaguuaaaugaaaaguuaugguuauuuaauguaauuauuacuucaaauccuuuggucacugugauuucaagcauguuuucuuuuucuccuuuauaugacuuucucugaguugggcaaagaagaagcugacacaccguauguuguuagagucuuuuaucuggucaggggaaacaaaaucuugacccagcugaacaugucuuccugagucagugccugaaucuuuauuuuuuaaauugaauguuccuuaaagguuaacauuucuaaagcaauauuaagaaagacuuuaaauguuauuuuggaagacuuacgaugcauguauacaaacgaauagcagauaaugaugacuaguucacacauaaaguccuuuuaaggagaaaaucuaaaaugaaaaguggauaaacagaacauuuauaagugaucaguuaaugccuaagagugaaaguaguucuauugacauuccucaagauauuuaauaucaacugcauuauguauuaugucugcuuaaaucauuuaaaaacggcaaagaauuauauagacuaugagguaccuugcuguguaggaggaugaaaggggaguugauagucucauaaaacuaauuuggcuucaaguuucaugaaucuguaacuagaauuuaauuuucaccccaauaauguucuauauagccuuugcuaaagagcaacuaauaaauuaaaccuauucuuucugugu

SEQ ID NO: 13333 - RNA, 117558 nt, Homo sapiens
gcuaccucagacucuccauauaaaggaaucauuuuuccuuuuaaaaccuacucuacccucuaucuucucuauugugcuuuaugguuccacuauucuugcaacuacuaaagauuauuucucuuuuucugucuuuccagugucuuccacauuuauuccuuccuuuucauuuugacugucagaacccacauuuaguccuuuuuauuuuagcuuuagauuugcgguagucuccuagcugauauucccauccccauaguaccugcaccaacccauuugacauacuacucagaagucaucuuccaaaaauagauuuacaaucagugguuucccauugucuuccacaauuguuauuguggaagagagcuuccucucccuagcuuucaaggcuuucaacacaucaagccuuauuguugacuccugacauagcccugcaugaccugcuucgguggcuuuaucugugcuguaacuauagcauaguauagaaauacagucccugugguuuuugcuagucaaaauguuauaugucaagauucaucauaaaagccaucagaaucuuauuuuuccuguuuuauaguguguuuguaaguaaaaugucaauagauauuauacaugcaaaaucuguuacauuuaaaauugugaugaugcaaauuuuaaucacuagcacucuaaacuuuacacaauaacauagggggaaaaaggacuucacauuuaaucuccauuccuacaggcuuuugcuuucacguucacacugucuauuuuuguuuuuauuuuuguuguuguuguuguuguuguuguuguuuugagauggaguuucacucuuguugcccaggcuggagugcaauggugcaaucucugcucacugcaaccuccgccuucuggguucaagugauucuccugccucagccucccgaguagcugggauuacaggugcacaccaccaugcccagcaaguuuuuguauuuuuaguagagaugggguuucaccauguuggccaggcuggucuugaacuccugaccucaagaugauccaccugccucggccucccaaagugcugggauuacaggcgugagccacugcgccuggcccacacuguuuauuuuuuuacuguuuuuuuaaauuuuuauuuuuuugagauggagucuugcucuguugcccaggcuggagugcaguggccugaucucagcucaccgcaaccuccgccuccccaguucgagugauucucccgccucagacuuccgagcagcugggacuacaggcgcccgccaccacacccgccuaauuuuuuguauuuuuaguagagacaggauuguuagccaggauggucucagucuccugaccuugugaucugcccgccuuggccucccaaagugcugggauuacaggcgugagccacugcacccggccuacacuguuuauuuuugaacaugucauacauauuacaaaauucuaaaguuacaaaaagguauaaaauaugaaauaacuuuucuccccuuccuguuguccccuccccacaguuccuucuucuuggaaacaauaguguuaucaguuucuugcauguguucauccagggagaguuuaacuagagacacauguuuaauuuacguauggauuugggaaugguaggggugugcauugaaacucaguaguaagaaaccaaguuauucaauuuaaaaaagggcaaaaaauaugaauagaggcuuccccaaagaagauauaugaauagcaaauaagcacaugaagagaugcucaauuagucauuagggaaauguaaaugaaagucacaacgaaauauaucacacaccuauuaaaaugacuaaaauuaggggcugggcgcccccgguggcucacgccuguaaucccagcacuuugggaggccgaggcagguggaucacuugaggucaggaguucgagaccagccuggccaacauugcgaaaccccgucucuacuaaaaauacaaaaauuagcugggugugguggcgugugccuguaaucccagcuacucggguggcugagacaggagaauugcuugaacucgggagguggagguugcagugugcugggaucgggccacugcacuccaaccugggcgacagagugagacuccaucucaaaaugaauauauaaauaaauaaauaaagacuaaaauuaaaagauuguccauauucacauagaggggaacaaugcacacuggggccuuccagaggguuggguggguggagggagaggaucagaaaaaauaacuaauguauacugggcuuaauaccugagugaugaaauaauuuguacaaugaaccccuaugacacaccuuuaccuauguaacaaaccugcccauccugcacaugugcccuugaacuuaaaaauuuaaaaaaaauuguccauauuaaguguugacgagguggagaacaaacuagaauuauaugcuccugaugugaauguaaaauaguacuacuuuagaaagauggcaguuucuaaaaacuuaaacauauacuugccgggugcaguggcuuaugccuguaaucccagcacuuugggaggucaaagugggcagaucacgagcuuaggaguucaagaccagccugaccaacauggugaaaccccgucucuacuaaaaauacaaaaacuagucaggugugauggcgcguugccuguaaucccagcuacucaggagccugaggcaggagaaucucuugaucccaggaggcagagguugcagugauccgagaucacgccauugcacuccagcccgggcgacagagcaagacuccaucucaaacaaacaacaaacaaacaaacacaccuaucguauaacccaaauauuucacuccuaaguauuuaagagcaaaggaaguauauguccacaugaagacuuauacacaaaugcucauaguggcuuuauuuguaauaacugagaacuuggaacaacucaaaugucuaucagcagaugaauaguuuaucaaacugugguauaucaguaaaauggaacgaauguuaagcaauaaaaaaggaaugaacuacugauacaugcaacaacaugaauccaucucaaaaucauuucguugagugaaagaaggcaugcacuguauuauuucauuuauauaaaauuccaugaaaagcaaacuauagugacagaaagcagaucagugguugccugaaaagugggugggaacagugaaaggcacagauagcaaaaguucacgaggaaacuuuuagaggcuuugauaugcucauuaugauuuuggcaauaguuucacaaauguauguucaugucaaaacgcaucaaauuuuacaaccuaaauauguguggguuauuguaugugaauuauuuuuauuauuauuuuauuuuuauuuuuugaggcuagucucgcucugucaccaagcuggagugcaauggcgcaaucucggcucacugcaaccuccgccucccagcuucaagugauuauucuccugaauccgaguagcuggaacuacaggcgcgcgccaccacgcccggcuaaauuuuguuuuuuaguagagauggguuuucaccauguuagccaggcuggucucaaacuccugaccucaggcaaucggccagcuucagccucccaaaacgcugggauuacaggcgugacuaccgcgccuggcuggguuauuguaugucaauuuuuaccuccauaaaacuguuaaggccuguaaucccugcacuuugggacccugaggcaggcggauuaccuaaaguuggugaguucgagaccagccugaccaauacggagaaacccugugucuacuaaaaauacaaaaauuagcugugcaugguggcgcaugccuguaaucccaacaacacgggaggcugaggcaggagaaucgcuugaacccgggaggcagagguugcugugagccgagauugcaccauugcauugcagccugggcaacaagagcgaaacuccgucucaaaaaaaacaaaacuaaacuaaaacacuguuaagggcaguuaaaacccagcccauauucccaggcuguuuuuuuuguuuuguuuuguuuuuucuuuaggguugaaaaaaaacuaaauccccauucaccgcacacggcacucuucacuaaccacgagaaaccccacccaacaccauccaccgggucccucccuugcccuccuaaucccgccagcgaggugucuucucucugccgcccgcuagagggcguguacagaggaggucaaagcucuuggcucgcuagcucagccccaacgccugcaugaacuuccggcuacacgccauuccgcuucccgaggaacgcuugggcuguuguacggguucccuacgggacucugaaggcugaggauauccggcccggagcguuugugcggcgcggaguuaagcgccccggcaguaacuuaagggaaguggaccaggguugccgcugcccagagcgguccuuuaguuuccacuggaguggagggaagagugcugccauggcagccccugcgcagcccaagaagaucguggccccuacggugucccaaaucaaugcggaguucgugacccaggugagcucgggcgagucuggugugugugaguggguauggacgucguggccccgaggccugguggugggguuuuuuuucaggauuuaggaguccggaggaggcauucguuuguuaauugauucacacacgucuuuuuacugaguaucagcuccgugccggccacuaugcuaggugcugggcauaccguggugaaagaagcugcccugcccuggggaguucauggcccaaggaagacagacgcaugaaaauaaaacuacuguaugaguuuugcuguguuggaguuugucucaggagcaauggauucagagaggagggaacaccccagucuaucugagacuggcaaguaggcuucgcagcagagugaugcuggacugccucuucaaguaggaguaggcuuuuuccugguccuuagaguguccugaguuuuugagcagcgaugagaaacugacaagacaccuccaaauagaccuaucuaaaaacagaguaauucuguaguuugagagcguucauuuagaaucuguuuacuaucuugcauugugagccacaguuggcuuuggauagggaaccacaguccugugguugucagcaucauuccucauucuuauuauuuauuugugaauugcauaagaguguaaguaguucaauguagaaguuaucaugcccaccugcuucuuuauucuuuauuccuugucucaacagauuugccagggcagaagccuagggagugauuuugaauccucccuuucccuuagucccuacauuucuacauucuaaauaucuuuugaaucuaucugguguucuacaucucugucacccuaagcuugguugccauuguuuucugccuggaccaagguaucguaaucuguuauauuguccuuccucuugcucugcucuagcccauucuucauguugcuuuccgagugauuucauacaagugcaaaucucaucauaucacuugccuucuuaaaauuucugccuuccggccgggcgcaggggcucacgccuguaaucccagcacuuugggaggccgaggcgggcggaucacgaggucaggagaucgagaccauccuggcuaacacggugaaaccccgucucuacuaaaaauaaaaagaaaaaaaauuagccgggcaugguggcaggugccuuuggucccagcuacucgggaggcugaggcaggagaauggcgugaacccgggaggcggagcuugcagugagccgagaucgcgccacugcacuccagccugggcaacagugcgagacuccgucucaaaaaaaaaaaaaaaucucuuccuuccuuuccuuccuuuucuucuuucaagauagggucucacuauguuggcugggcuccagugagccuuccaccucagccucccuuguagcuaggacuacagggacuacacuaaggcuggcuguccuuaaaaucuucagccgggcgcgauggcucaugccuguaaucccagcacuuugggaggccguggcaggucgaucaccugaggucgggaguucgagaccagccugaccaacauggagaaacccugucucuacuaaaaauacaaaaguaggcaggcuugguggugcaugccuguaaucccagcuacucgggaggcugaggcaggagaauugcuugaacccgggaggcggagguugcaaugagccaagaucgcaccauugcacuccagccugggcaacaagagcaaaacuccgucuaaaaacgaagcaaaaaaaaagaaaucuuuaaagaauucuaauuacccuuagguuaacggcugaaauccuucauaguguugugugauuugaccugugcuuauaucuucaguuuccucuuuuuccucuuccuuucuaacucugugccuuagcuguacagaacuucguuuauuugaaugugccaugcuaucuuucaucuccuggcuuuucaacauuguuccucugcuaggaauccucauuuuuuuucuccccaccuuccuuuauucauucucagccuucuacacuacuuuagagaggcuuuuccugacaacuuaaacgagauuagaggucucuuuccccauauaccugcauuuuugcaguagaagucauuuauuaguuuacuucugucauggaacucacauuuuagagggaagaaccagacagaugaacgguauaguuucauacacugauaaaugcuaugaggaaaaugaaacagggcugugacagacugguuugagguguaugaaagacagucaggaaaguucucuccgaggugacauuugagcuaacaccugaaugcaaagaaggagccaguuuugagaagagcaaggaaauagcaaguacacacaccuuaaggugugaauguaaagaaggccagggugggccgggugcgguggcuuguggcucgcagugggauuacaccuguaaucccagcacuuugggaggcugagguggacggaucaccugaggucgggaguucgagaccagccuggccaauauggagaaacccugucucuacuaaaaauacaaaauuagccggacgugguggugcaugccuguaaucccagcuacucaggaggcugaggcaggagaaucacuugaacccaggaggcagagguugcagugagcugagaucacgccauuguacuucagccugggcaacaagagcgaacuccaucucaaaaaaaaaaaaaaaaaaaaaaaaaggccaggguggccuugaaggcaaagauuaccuuucuuugcacucuagaagagccuaaacaguaucuggcaaauauuagacauuaauguuuguucccauggcccaagauugcugagaaccuuccuuucucacacuacaucuuaaugaucuggcauauuuguucauuaauucacuuauguauccauuugacaaauagucaucacacagugugugccuaguacaauaccaggugcugggaguacauggggaauaaaacagacauguucucacaaucuaacacacagucuguggaaggagacuuuaagagacuuaaagaacucacuguaguuuaaugugagaaaugccagauugggguauaagggaagugcuuugagaaaagagcaugaaauuauuacuuuguugaaggaaagaauuuccaagaagaauuuucucauugagaaaguaucauuugaguuggacuuugaaaugcagagaggaaagugggggaauugguuuucuagguagaggggacaucuugggcuuagguguuuucuucuucuuucuuuuuaauuuaauuucugagcaucuggcauaccuagccagaaaagguacuuuuaaaauuauuuauugaaugaaugagaucaagagguuaaaauuuaguuuuaaggagauuggagaucugaacuuugugaccucacuuuuuuauaccauuauauuuuuauuuccuuuuuugucuuucaguaagguuuacuuuaaacaguuuauacugucauagcuguacuaaguagagaauggaaaguuuuuauuuuacaugagacuagagaguuugagggagggcaauguguauauacugugagaucgugauauuugagacauuacacguuagaccccaagggaaaggagaaacucagagaagagacaugauagaugcuuaauaaauguuugcuaaucuuuaaucaaguacagauguacaguaagcaguuuagaucagagauaggauauacauuuuuauuuguaauuuccugaguccaucauaacagguuagacucaauucucuuaaugguaugauguaagaagaagaugacugaauuuaugaugcccauagggagcagaaugaggaaaugaggacaccacagaauaacugggggugaggugaagauuuucuauugaguuggagagugauugguaauuugggaagguguuauuuauuuauuuauuuuagagacggagucuugcucugucgcccaggcuggagugcaguggcuugguguuggcucacugcaaucuccaccucccagguucaagcaauucuccugccucagccucccaaguagcuggaauuauaggugcacaccaccaagccuggcuaauuuuuguguuuuugguagagaugggguuucacgauguuggccaggcuggucuugaacuccugaccucaggugauccgccugccucggccucccaaaguucugagauuacaggcaugagccaccaugccuggccggaaggugucauuuaaguaggaaguuacuguaauauuuuuagaggcuauuccucagggccaguguccuaacugccugggaggcucuuuaaguguguuguauguguucaucacugagcuauaaaagcaaagaaaacaagucccaucucuuaaguauuccaauuaaaugagaaggaaagauggauaagcaaucaaauauuuauaauauagaaagguaagauuauaaagaguuauauacaaaaugaagagaaggagaaagcaauugucaccaucagguaguguugaggacagccucacagaaguaacauuucagauuuugcuucauuuguccauccauucauccaucagacuuuauuagugccucugauaugccagacacugcagaguagucaccuuuuuauaaauauauugagucuuugugcuugccaguuuucuauuuuuaaagagauuauaauuggguuuuaaaacaaaacccuaugaauaagacuaugcuguuucuuuaaauauguagagagaguuauauauuuguuuaaauuucacaauuuacaggucaagccuaaucugcugaaauaugccagcucuuauauucucuguaauaagcagccgauagacuacaauuuuuuuuuuuuuuagguuuuguuaugggugugaacuaaucauuuaaaggcucauuauuuuaggaaagcauucaugaagauuuugaguaucauuuguaauacuugcucaacuauuaacuaacuguaaucuugggcagaucacuuauuuuuucuagaccaggguuuccuuauugccaugcugaagauguuuggcucugugguuauuaacugagcuguauuguuucucuagggugguuggagaggauuuuguuuguuuguuuauaucacaauggcauguuguagugcaaagcacuacuggcauuuagugguuuggggucaaggaugccaacuggccugcaugccuguguagugccuucagauauacucugucccccagugccgaguagggccuuguuaagaaaccgcuuaucacuaaaugaucugucuuccagcucuacaauggcaagaaucugggacuuacuguuuauacuguuuacuuugcaguuagcauguaaauacugggcuccccacaucaagaagaaaucaccuuuugauauaaagguaaguauuuuugguuucaacauaauucuugagaaguuacacuccuuuuaaaggguuauuucaacaaaagcuuuccauaauuuuuuuaaaauuaaaaacaaccuaacgaucuacaaaaaauacaauuuuuugcuuaucaaacuuagcaaugauuuauguuaggaaauuuggaagacauagaaacuacacauaagaaaauaaucacuacacagagauaaccucucuuaccauuuuguuguauuuucuuuaagccuuaacaaaaauguguauguggcugggcacggugucucacgccuguaaucccagcacuuugggaggccaaggccaguggaucacaaggucaggagaucgagaccaucugaccaacacggugaaaccccaucucuacuaaaaauacaaaaaauuagccgggcaugguggugggcgccuguagucccagcuacucgggaggcugaggcaggagaauggcgugaaccugggaggcggagcgugcagugagucgagaucgcaccacugcacuccagccuggaugacagagcgagacuccaucucaaaaaaaagaaaaaaaaaaaguguacguguauaauuuacuuaacuguuuuucuguuuauagauucuuagguuauuuuuaauuuaucauuauuauaaaugaucauguaauaaauaucuuuguaaauauacagaaauuuuuguacaaguuuuugauaguucauuuaggauuaaaucuguuggguuaucuuguuuuuagaguggugaaugagguaaaggucuauaauaaagauggaaggagcagcaguuguauaguguaauaacuuaaguccaguaauauucaauaagggaauugaacuuauucaauugaauaaguccaacugaagcaauuuagaacaaauaauaugacaaauucccaaauauaggguuaauucucauuggauuagguucuuaaagagaggucuaaggccaggugugguggcucaugcguauaauccuagugcuuugggagaucaaagagggaagaucaccugaagccaggaguuugagacuagacuggacaguagugagaucucgccuuuacaaaaaaauuaaaaaaauuggcuugugcaguggcucacacauguaguaucaauugcucuggaagcugaagcgggaggaugacugacugagcccaggagcuugaggcugcagugagcuguaaucaggccacugcacuccagccugggcaacagaaugagacccugucccuuaaagagagugaggucuuuaaaugaaauagauguugacacugcauaccauucaacaaguaaugaagacucuuaagcuuugccauuauaaauuuaauggugaugcuuuaggcacuguugguaaaacugaacuuuuuacccaaaauuucuuacuuuauuugaacuuaaauucuuacgaauauauauuuguuuuugccaguaaucuuuuauuuauuuuuuuuuuuuggagguggagucucgcucuugucacccaguuuggaguguaauggcacgauucuggcucacugcagccuccaccuccuggguucaagcgauucuucugccucagccuccugaguagcugggauuacagaugcacgccaccacgcccugcuaauuuuuguauuuuuaguagagacgggguuuuaccauguuggccaggcuggucucaaacuccuaacuucaggugaucugcccaccuuggccucccaaaguggugggauuacaggcuugagccaccacacccggccaaccaguaaucuuuauuuuauuauuuaauuugaaauuugaugaaaacaauaacagagcauuucaucuagauugaacaagacuuguuuuccuuaucgccucccucccuuuaccacucacaaauacuuauuucacaaauguacuuggagcaauuaaaagauauuauaggcuagguaccauggcucaugacuguaaucccagcacuuugggaggcugaggcgguaggucacuugacuucaggaguucaagaccaaccugggcaacauggugaaaccccaucucuaccaaaaauacaaaaaauuagguggguauggugguguaugccuguggucccagcuauuugggaggcugcggcuggaggauaguugagacuggaaggcagacguugcaaugagcugugauugcacugcuacacuccacccuaggugacagagugagaccccaucucaaaaaaaaaaaaaaaagacauuauaguuaccauacaauaauauuauagcauguuaaagcacuucauaauuuuacaguaguauuuuuuuuuacuauuauuaaugcuagcacuacuacugcugcuauugauaacuguuagugaaggcucacuguaugccaguauuuguacuaauuguuuauaugcccugucuuauuuuauuuucaguaacccugugugguaguuuguguuauuagaucuguuuuguggguaaggaaacugaggcuuggagaggucaggcacuugccuaagaguuccagccaucaguagugaaggcagauguuuugaaccagucuuccaauucgagagucugaguucuuuuuuucuuuuuuuuuuuuuuuugagauguacaguuccagagucagaauucuuuuuuuuuuuuuuuuuuuuuugagauggagucucgcucuaucaccaggcuggauggagugcaguggcgcgaucuugacucacugcaaccuccgccucccggguucaagugauucuccugccucagccuccgaaguaguugggacugcaggugugcgccaccacgcccagcuaauauuuguauuuuuaguagagacaggguuucaccauguuggccaggauggucuugaucucuugaccucaugauccacccucuucggccucccaaagugcucggauuacagucgugagccaccgugccuggccagagucugaauucuuaaguaguacaccauucugcccacccucacucaaaugaauggaaauucugaagcucuaucauauucauuuggauaaagagauguaacaauuagaauuugugucuguuaugucuucacacuuuuaaauuauuuucucucuggguuuugcaggcacacaguuaugacucucaaauggagucucauaacauuuauacacuuuaaguuuaaaaaaaauccugaucuugugaauuuuuauuuucccuaaaaaucuuuauaagcacaucauuuuaaugaaucuagggcucuguuuuauuauuuguuuuuucuacuuugcuuucuguuaauuucauauuucgaggaauauaaugggauuauuuuaaauaucucauuauuucaauagcaguaauauuugauggcuuuccuaaaccaacuuauuuuauauaaucucacucauuaaaaacugucaauuuaggguugaaaaaaguuguugagauauuaaacauuuuuauauuuuuauaacagguuauugaagauauauaugaaaaagagauugucaaaucaagguaggaaugaauuuaaauuuuauacaaugugauugggguggaccaaguuggaucuuggcugaacuucuaaaugugaucauaacuugaacccuuuuucuguuucaaacuggucgucagggcaauggugacuagaaaaacuuuaggugcugaagagucauaaauuauuuuuugccuucuaacuuuuggcucagauuagagguaucaaaucccauaggguuuauuuggauuuagauggaauuugagaaaaaguaaacaugaagauuuuauuacuaguauuauuucugauucaccuuuuaaaaauauucuuaaaaaguuaugaaaguaagacauuauuaaauuuacaauaauauaguauacauauguaauguauaaaauguauaauaauaaacacagaagugauaaaaauuauuuuugagcaauaugcuguaaggggugaguuucaauaaaucaucuuuucugcccccaaucccugguucauguauaugguucauauacaucuguucuauuccccacgccuucacauguuuuuucaaacacaaaaggguuuguacucuacaugcuauuuuucaucaugcuucuuuuaaaaaauuuaacagcgugucuuaggcaucuuuuuguauauacaccugcagacauguauguccagugaguauuuuaaaaggauauuugacuaaaugggucaaaggccaucuucaggauuuuguucuuuauuuggaaaacaguaggaaguaagaagaguuguaagcacagugguauuugaaaaagagaauuuggguuuguuuguuuuuuuucuuuuuuugagacaggguuucaccauguuggccaggcuagucucaaacugcuggccccaagugauccaccugccuuggccuuccaaagugcugggauuacaggcauuagccacugcacccagcaagaauuuggauuuggagggagcaagaggcagggaauuaauuaggugagcauuguaguagucagcuucaagaugucauagauuuggcuuguguggaaaguugggagcggaauuguccauuugagaaagauagagguggagagacuugauguuuggauguggcagauguaggaaaaggaagaaucaaagaugauccuaaaauuuuuugcuuaaguugcugagugauuagugaugccauuacugacuuuugccacguuguuggggguaggauuggguguagaucuuuauuucacuuuuggauauauugaauucuagcuacuuaagagcuaugaagauggagauauggaauaggcaguuggauauccagguguauagcucaaaagagauuggguuggcugggcaugguggcucaugccuguaaucccagcaccuugggaggccgagguggguggauuguucaagcccaguaaguaguucaggaccagccugagcaacauggcaaaacccuguguccagaaaaaacacaaaaaauuagcuggacaugguggcguauggcuguagucccaguuacucaagaggaugaagugggaggaucaccugagcccaggagguuaaggguucagugagccacaguugugccacugcacucuagccugggcaacagagugagacccugucucaaaacaaacaacaaaaagagacugaguugagccuacuuuguauuagccaccuuuucgaugcuaacaguacaacagaaaagaggggagauacgaucccugcucuccuggagcuuacauucuaguaggucagacagacggacagacagauaucuauauaucuauaucuauaucuauaucuauaucuauaucuauaucuauaucuauauaucuauauguaauguaaugucaggagacaguaaaugcugugaauuaaagugugguuagaggauagagacaagggcugguauuucagaauaauuaggcaaauucucucugaaaguaggacauuugagcagauuuguaacauauggucugaaggugaguaugaaugaaauuucuugagaaaacuaaagaugaguggguggauuaauucugguaucauuuuuucuucuauauuaagguuauacuaguuugaaaauuauuuugaaucuucagaauagauuuucacuccaguggaaagugauuguuuauuuuuucauuuaaacccuugcuauuaauauuucuucuucagaggugauuuuuuauaacaaccaaaagcugcuaaugauuuuuaagccauauacauuuggcugcuuuuuauauguagcucucuucuguguagccgagauugcgccauugcacaaugugugacaggguugcucucuuucacccagguuugagugcaguggugugaucucagcucauugcaaccucugccuccugggcucaagugaucccccaaccuuagccucccgaguagcuggcaccacaggcacaaaccaccaugcccagcuaauucuuuuuguauuuuugguagaaacaggguuucuccauguugcccaggcugcucucacuccugagcucaagcagucugcccacuuugaccgcccaaagugcugggauuauaggaauuagccaccacacccagccccuaccguuauucuuuuuuauuuuuugagacggagucuugcucugucgccaggcuggagugcaguggcaugaucucggcucacugcaagcucugccucccggguccacgccauuccccugccucagccucccuaguagcugggauuacaggcgcccgccaccacgcccggcuaauuuuuuguauuuuuaguagagacaggguuucaccauguuagccaggauggucucgaucucccgaccuugugaucgcccgccucagccucccaaagugcugggauuacaggcgugagccacugcgcccggccaccgcuauguuauucuuaguucugaaagaaguagcugucuuuggcauggcuaagauuuaucuuggcacuuuuaacagucguuuucuuaucuuggacacguuuuuuauuauuauuuuuuaauuuuuuuguuuuuuauguuuuuuuauguuuuauguuuuuucauguuuauguuuuuuguuuuauuauuauuauuauuauuauuuuuauguuuuuuuuauguuuuuuugagacggaguuucgaucuuguugcccaggcuggagugcaauggugcagucucggcucaccgcaaccuccaccucccagguucaagugauucuccugccucagccucccgaguagcagggauuacaggcaugcuccaccacgccuggcuaauuuuauauuuuuaguagagacgggguuucuccacguuugucaggcugucacucccgaacucaggugauccgcuugccucggccucccaaagugcugggauuacaggugugagccaccacgccuggccuacauuuuuuauuuccaaguacacuucuguaacacauaaacuauaguauguauuuaaaaauuuaacauggugaaaccccgucucuacuaaaaauacaaaaaucagcugggugugguggcacgcaucuguaaucccagcuacucgagagacugaggcaggagaaucgcuugaacccgggagguggagguugcagugagcugaaauugugccacucuacuccagccugggcgacagagcaagacuccgucugaaaaaagaaaaaaaaaauuuaaaugaccaguuuuuuaggcuagguccugaggaaauuauuuugcugagcuaugugcucacggcauuuucaguauugggggaauggcuugauguaacagccauguuacuguaugguacauuacacaauugauucauauuugcuguucuugccauuaucagauuuggcaggcuuaucuuaaugaauucuucauccaaguuugauuuuaaaaauauuugaaaaauaauaguuaagugcuuacuaugugccagauucugcuguaagcaccuugcauucugcucuaagcaucuagcucauuuauucccacaacaacccuguaacacuauuauuguccucauuuuauggaugaggaaacugaaguggauagguuaaauaacuugcccaagauguuucccaguauuuagaggcacaccagguauugaauccugguucccugguucuuuuuuuuuuuuuuuuuuuucugacuucuuacugaauauucuguucuguucuuuuauuuuuuugagauggaguuucacccuuauugccccaggcuggagugcaguggcgcaaucucagcucacugccaccuccgccuccuggguuccagcgauucuccugccucagccuccugaguagcugggauuacaagcaugugccaccaugccuugcuaauuuuuuguaguuuuaguagagaaaguguuucaccauguuggccaggcuagucucgaacuccugaccucaggugauccgcccaccucggccucccaaagugcugggauuacaggugugagccaccacacccggccuugaauacucuguucuuaaauaagaguccuuugccuucuagaaaccucuuaacuaguacacuccgguaugauguuuaauccuguuaugaaccaacuaagugguuuuuaugcuuucaaaaagggugauuuacagaguaauuuacuuuucccaaagugcuuauuuuuauuugaaauguauggacucuuuuauuaugaaauguaacacagaaaacagcaugaaacaaauguauagccuuacgaauuauaguaauaauucauaaccaccaccuaggcugaaaaacuccacgaacauugucgguguuccagaagcucucugcuuguuucuuuuuuuuaucauuauaauauguaaguaugcaaacaagaacacuauaauuuugguucuuuuucaacuuuaaauaaauaaauagaaucacacacuauguacucuuuuguggcuggcuucauuuuuuuuuuuuuuuuugagauggaguuucgcuguugucaccaggcuggagugcaguggcaugaucucggcucacugcaaccuccgccucccagcuucgaaugauucuccugccucagccucccuagaaguugggauuacaggugcccgccaccacgccuagcuaauuuuuuguauuuuuaguagagacgggguuucgccauguuggccaggcuggucucuaacuccugaccucagguaaucuguaugccucggccucccaaagugcugggauuacagacgugagccacugugccuggcguagcuggcuucuuuuguucacuguuauuacuuguuguuuuaaucaucugcuuaacagaucuggaaguagguagcucagaaguuaauaaugucaaggcccuugucaaucuugucaaaagguuuuauugauuuuuuccguaugguugugguggggcugccacagcuccagaccucguauuucacauagucgucugaaaagaggagguuguugggauaggggggaauguaauagaaaagaacucucauuuguguggccccuucucuuuuucuuaucauauuuaaugauacaguaauagauccaguuuaucauacauaaauuauucaacuuuggaaggauuuaaugaaaugcacguuaaguccuuggcacagugucaggcauaaugcaugcucucaguaaauauugguaacuuaaaaaaauaaccauccaaauauccuucaaauuauuuauauuugugauuauuguuuguaacuuuucauacuuauuauuuauuuauuuauuauuuugagacggagacucacucugucaccugggcuggagugcaguggcgcaaucucagcccacugcaaccuccgccuccuggguucaagcaauucuccugucucagccuccugaguaccuggaacuacaggcacacaccaccacaccuggcuaauuuuuuguauuuuaguagagacgggauuccaccguguuguccaugcuggucucgaaccccugagcucaggcaguccacccuccuuggccucccaaaguuuaggauuacaggcgugagccaccaugcccggccuuccauacuuaucuuuaaaauucuucugacauggugucuaguucauagaccuguuuuuuuuaaucuuacaaguacacuuucaguuaagcuguucacuuuaucugucucagagaguucauuggcaaaaguauaaaacuccaaauuuaauaaauaccacugagauugcuagaagaggaauugaauguuuuucagacugcuuuugcuuuauuuugacuuaccaagaguuauuuuucaaggccaggcaugguggcucaugccuguaaucccagcacuuugggaggcugaggugggaggauuacuugagcccaggaguuugaaaccagucugggcaacauagugagacuucaucucuacuaaaaaucaaaaaaauuagcuggacgugguagcacaugccuguagucucagcuacuugagaggcugaagugggaggauugcuugagccugggagauugagacuacagugagcuauguuugugccacuguacucuagccugggcaauagagcaagcucugccucagaaaaaaaaaaagacuuauuuuucacuugucuaguuaucauaaaggaaaguuggcugcucuaccauuuuuauacaugaggaaacugaauugcagaauguuuaaaagacgucaggugugguagcucacgccuguaauccuagcauuuuuggaggcugagguggguggaucaccugagcucaggaguucgagaccaaccuggacaacauggggaaaccccuaucucuacuaaaaauacaaaacauuugccaggugugguggcacgugacuguaaucccagcuacucaagagucugaggcacaagaauugcuugagccugggaggcggagguugcaguguaccgagaucgugccacugcacucuagugugggcgauggagcaagacucugucucaguaaaaaagaaaaaaauaaacaaaauguuuaaaagacauugucaaaguaacacugagucauuacuagaacacugguauucuaucuuaugagccaggauuuucugucuuuuaucaugagguccuauuugugacugaagaaauuuaauguagaguuuuguguauagugggcagugagugaauucuguugucuaacauacaguuaauucaagugaaaugucugcaguuggagauuuagagugugucacucaagauggccuauccacuuagcaucuuggcugccuguagaagccaguacuuuggcaauauucugucuuuugcauaguaaaaaccuucauuucauucucacuaaaguuuugugacauugcaugcucagugaaacuauguaagagaucagaaaucaguggaauaggauuuuugacaggauagugguuuccuggggcauuauaaauucauaauacauguauuuuuaauuuucaaagcuggaaacaauuaucuagugacaguguucugaucuauuuccaauauuauaaaacgauaaagcuaaauuaguggccauuugugucugcuucgggacagcguaaguauguuugggacaaacaugacuauaucauuguuuauucauauaaaacaaaguaauucuauuuaaaaaagacaguauauuaaagacaaauaucugauauuuccuccacaauauuuuaguauuuuaagcucacugucaacacuaagaagcaagugaaacgucugauuuucacauuugcaauauagauauguguccugcgugcuuuuaggaaggcaugacucuagcaaaguguuuccauuugaguauuaaaugaaaacauguuggucagugcuuaagaaguugaacugacauuagaaguugugaucugauauuaugaauuuugauagauggguuaauauggaaacaaaacaucccuaaaugcauuuguguuaauaacucugaaacguuuguauucucuauuuuaaacauuuuauuuauuuuuauguuuucagguuugcuauuagaaagauaaugcucuuggaauuuagguaaguuauaaggcauuccauugaugaaagagauaaugugauuucaguuuuagcuaaauuuucuguguuauuucugugagucacuaagaaaaucuaaauuugugaagauuuauauuucugugauuggcuuauuuuggaauauguauaugauagccuuuguuuucaaagaugauggcccauugccagaauagcuuguguuuugauuuguuucuuacuuguuaagcuagcauguggugaauaauuucugaacucaaacuugguuucuguagugaucaguggaaauaaauuagaguguguucuauagccacuuuuucucccugccaagcuaaaauguuaucaucaagguaacauuguuccagucuagcuacuaguaauauaaauauuucagacaaaagauaauguaugauuuuuagauugcaaagguagauuagauuauguugcaaccagauguagccaguaugcugaaaauaagagccaggauuguuguugaugauaguuacauuuaccauuucucaaacagaacaccaguuuugugcucaccacaguguuaagcauuuuacauacagaguacucacaacaauccugugaaguaaguacuauccucuguauuuacuggaaacagaagcugagaucagagagguuaaauucuuugcucuaaguaauuggcagagcugggauaccaaugucugaugccaaagcucaugguuuuccacuucucuacacuuccuugacaucugguuuacaucagaggucagggccucuguguuaauaauuguuacuccuacauacacauuugauccuuacaaaaaaaaugacaugaaguagauggucuuaucguuuuucuagagggaaauugaaauuuauuauuaugaauuaacuaguaaguugagugccuccuguauccuaaggacuguauuauuauuaaaugaucuuauuuaauccugacaacaacaccaguaagaucuuccuuauuuuguaggggagaaaacugaggcuagaaacuggacccaucucgcccugagauaaauaugcucuuuccaucauaucgugccuccuuucaagaagacagauuaaaaucaagaggcuaccaauaugcaguuagaauuaaccagaauucuagaguccagaaaccaagagaauggcaggaacugaaggagaaagcaacaaaacagauugaaagcaucaaugacagugaauuuuuuuuuuuuuuuuuuuuugagacagucucgcucuguugccaggcuggagugcaguggcacgaucucggcucacugcaaccuccacuucccggguagaagcgauucuccugccucagccuccugaguagcugggauuacaggugugcgccaucacgccuggcuaauuuuuguauuuuuaguagagacgagguuucaccauguuggccaggauggucucgauuucuugaacuugugauugccugccucggcuuccuaaagugcugggauuacaggcaugagccaccgcacccagcugacagugaaaaauuuuuaauagcugaaaaagucaguuguuaccuuucaggaacucuuauuuaauuuuaugugacaauaucauuuucccugggccaacuuccaaacauaaccagucuaaaguuuguuguagagaguaauugaugguuucuugcuaaacuggaaaguaagauggcauggagaagguagcuggauauagggaagugaacugagaaaaggguuuccauggaugaaaaucauuagaggaaggcauuauuuuauaucaguauuguauagaauuugcugcaauugcugaaauaggaucaggaaguuauugaacaaauccuuaagucugaagaaaagagauguaguuuggagucaggaccauaccuguguaaucaggcaaaucauugacucucauuaccucaguuuucucaucuaagagauuuuaagauagguuuggaauuugcuguguagucagauaacacccaagauaagacuuuacucuuaaaaacuguggcaagccagugacaucugugggacaucuggcagaaacaguuauaaagauacucuggaagcauauguauuccaacuauacugcagaaaacucuauaaauaaaaccuugguaaaggugaguuuauacucccaaauuacagagcacauuaggguaauauucucuacuauaagcaagagugaacagcagagaacaaauauuuccccccugcccccaccaccaagaacuucagauaauuaaauaauugauacacacugucaagucauuauguuuaaaauuauuauuggcauaagagaagaaauauaauaugugagaaagaaacaagauacuaaaaauggauagacgugggggagggaaauggagauaaaaaaucacugaaauuuaaaaacucaauuagcaaaauaaauaacauguuagacgcagguaaagaaggaauuaaugaacuagaaaauagaucugagggaaugaacuagaaaauagaucugagagaauuaacuagaaaauagcaaagagggccgggagugguggcuuacaccuguaaucccagcacuuugggaggccaaggcggguggaucacaaggucaagagaucgagaccauacuggccaacauggugaaacccugucucuacuaaaaauacaaaaauuagcugggugugguggcacaugccuguaaucucagcuacucaggaggcugaggcaggagaauugcuugaacccaggaggcagagguugcagugagccgggauuaugccauugcacuccagccuggcaacagagugagacuccaucucaaaaaaaaaaaaaaaaaaaaaaaaggaaaauagcaaagagaaguaaaaaugaaaaauacgaaaggaaaauaagguauguggaggcuagaaugagaaggcuuaguaggaguuucagaagauuuuuuuuuuuuuuuuuaguuuuggagauggggucucacucuguugcccacauuggaguacaguggcacagucauggcucacugcaaccucaacccccuaggcccaagugauccuccuaccucagccuccugaguaguugggaccacaggugugcaccauuacaccuggcuagugguuuuuuuuuuuuuuuuuuuaauagagauaaggucucacuauguugcccaggcuggucucaaacuccugggcucaagcaguccacccacuuuggccucccaaaguacugggauuacaggugucagccaccacaccuggccucauuuuguuuuagaacugauguuugucagguauuuuuggguuuuccuuuuuuuuuuuuuuuuuuuuuugugacggagucucacuguugccaggcuggagugcaguggcgcgauguuggcucacugcaaucuccgccucccggguucaagugauucuccugccucagccuccugaguagcugggacuauaggcacacgccaccaugcccagcuaauuuuuguauuuuuaguagagaugggguuucaccauguuggccaggauggucucgaucucuugaccucaugaucugccugccucggccucccaaagugcugggauugcaggcgugagccacugugccuggccaacuuuuacuuuaagaagagccuuaaaguuaaaggcccaguguaguggcucaugccuguaaucccagcacuuugggaggcugagguggguggaucgauccugagguugggaguucaagaccagccugaccaacauggagaaaccccgucucuacuaaaaauacaaaaaauuagccgggcgugguggcacauucuuguaaucccagcuacucaggaggcagaggcaggagaauugcuugaauccgggagguggagguugcugugagccaagauuacgccauuguacuccagucugggccacaagagcaaaacuccgucucaaaaaaacaaaaaaaaagccuuaaguaagggaauauccggugguuugguggugauaauuauguauguuggcaacguuugauaccuuuuuauuugaauuuauaggacugucauucuccaaagcuguauuuucuauauauaaauuuguagcugguagcagugaccuagacugcagguaaauuuguggaggauuccaaguuuuuuuuuuuuuuuuugagauggagucuagcucuguuggccaggcuggaguguaguggcgcaaucucagcucacugcaucuucuucccggguucaagugauucuccugccucagcccccugaguagcugggauuacaggcgugugccaccauacccagcuaauuuuuguauuuuuaguagagaugggguuucaccauaucacaacuccugaccucaagucaggaguugaccuccacccgucucggccucccaaagugcugggauuacaggcaugagcuaccacacccagccaaggauuccaaguuauaaauagagauuuccaaaauauuuucagaaaguuguaaauaauuaugcuuuucugggugaguuauguauuacagugaguggugguaacuaaugaaguauucuaugcuuuuuacucuuuacagccaguaucuugaaaauuaucucuggaugaauuauucuccugagguaucuagcaaggccuauuuaaugucaaucugcuguauggugaaugagaaguuuagagaaaacgugccugcaugggagguaacugauuuaaaguacuucauagcuuucauacugacccacauaagccauuacaaaguggcagaacuuuuacugauaguggugcuuuuagagcagaacuuuacccaguaauaaagcaaauauugagaaaaagaauggguaugugaaagauauguuuucuuuugguuucaauacuuucuucaaacgauuuaauaauuuacuaugaauugaaaauuuaugaaugugaguuauuuuucugcuuuguguuugaaacaaagaaugguauauguuauaacaacuuacaucaggagcuggcaaaauggaaauuauauuaauaaguacaaauaggcugagugcugucacucaugccuauaauccugcacuuggaaagcugaggugggaggauugcucgaagccaggaguucaagaccagccugggcaacaaagcaaaaacuuguuucuuuaaaaaaagaaaaaauuagccaggcaugguggcaugagucuguagucccagcuacuugggagauugaugcaagaggaccacuugagcccaggaguucgaggcugcaaugaacuaugauugcaccacaacacuccagccuggguaacagagcgaggccugucucuaagaagaagaaaaaaaagcacaaguauauaauguucaaaugagauauuuuucagugucuuuuuucacaagagggaguuuauuuuuauuuuuuuugucuuauuuuuauuuuuauuuauuuuauuauuauuauuauuauuauuauuuuuuuuauugaucauucuuggguguuucucgcagagggggauuuggcagggucacaggacaauaguggagggaaggucagcagauaaacaagugaacaaaggucucugguuuuccuaggcagaggacccuguggccuuccgcaguguuugugucccuggguacuugagauuagggaguggugaugacucuuaacgagcaugcugccuucaagcaucuguuuaacaaagcacaucuugcaccgcccuuaauccauucaacccugaguggauacagcacauguuucacagagcacaggguuggggguaaggucaccgaucaacaggaucccaaggcagaagaauuuuucuuaguacagaacaaaaugaaaagucucccaugucuaccucuuucuacacagacacggcaaccauccgauuucucaaucuuuuccccaccuuuccccucuuucuauucuacaaaaccgccauugucaucauggcccguucucaaugagcuguugggcacaccucccagacggggugguggccgggcagaggggcuccucacuucccaguaggcgcggccgggcagaggcgccccucaccucccggauggggcggcuggccggacggggggcugaccccccccaccucccucccggacggggcggcuggcugggcagaggggcuccucacuucccaguaggggcggccgggcagagacgccccucacuucccggacggggcagcuggccgggcggggggcugacccccccaccucccucccucccggacggggcggcuggccggguggggggcugacccccccaccucccucccggacgggcggcuggccgggcagaggggcuccucacuuuccaguaggggcggccaggcagaggcgccccucaccucccggauggggcggcuggccgggcugggggcugaccccccccaccucccucccggacggggcggcuggccaggcggggggcugacccccucaccucccucccggacggggcggcuggccgggcggggggcugacccccccaccucccuccuggacggggcggcuggccgggcggggggcugaccccccccaccucccucccggacggggcggcuggccgggcggggggcugacccccccgaccucaagagggaguuuauauuuguaguuuuacaugaauaaaaaaaguuaccaaagucaagacagaugcuuacauuauaauuucaauguucuuuugguuuuuuguuuugagacugaauuuagcucuuguuauccaggcuggagugcaaauggcgugaucucagcucacugcaacaucugccucccagguuccagcaauucuccugccucugccucccaagaagcugggauuacaggugcccgccaccaugcccagcuaauuguuguauuuuuaguagagaugggguuucaccauauuggccaggcuggucucaaacuccugaccuuagaugauccacccgccucggccucccaaagugcugggauuacaggcaugagucacugugccuggccuguucuuuuuguccuugauuugggaucuauuuuuccuuuuagaaauuucuaaugcacugauguuuccuuuuugugcuggugcaacagaagcuugaucaguagggauccaaaaucuuuguuuucuuugcccgccauauaauggucacuucaucaagaguuucuucucuuccagucagacuuuuuuaaaugaaaaaaaggaauggaugccugucaucuguuuugaguaaauggucaccaaagugaaaaggugauagagucuuuaagauaaaaccauggacacuuaucucaaauauucauuaaaugacuaccaucucagggcacauuagagcucagaauaaacuauggguuuuaugucacuaucaagagagccuagggguuucuucaaguugcuucaagcuauuauagaaauacagaaaggaagaaggaaaauuuuuugagccagggaauaaccuggucaguuuaccuguuauaaagaucacuuuggugauuaggccuugaaauagagaaaugauaauacagauuuagaggauauacagagauguagaagguagaauugauugaauuugauaaucaguugaaguagcauuaggaaaggguguuauuuucaauaaccuuccaggcuugggcaaaugaauauaauauaugauggugccauuuaccaagauagguaauagagagugaggaauaauuuggaggauacaaaacuguugaauugaauuuggacauauucaguuuaaauugccuuuggaauaucuagauuaagucaucuaguagaggaaucuaagguuugagagcucagaagagaaaucuggacugcagauguauauuuggaaucauugguauuuagugguugaaguaauagagggagaagaaugaggcuagaacccuacgaauauugcgguuuagauaacaggcaaaagaagaagagccuucaauauggugaaaaggaguugagaguuaauaaggguccauaggacuugacagccauacagcuucaggagagcuugucuuagagaagugaaugaaaacaacuaguauagaccacacgcuuggagcauuugucuguggcaguaacuagaaacagagguaggucaaagaggcuugaauauauuuacauuauuuacaaguuaagaguaaagagcuaauauaaagcaggaggggcuguucuugagauuaauuacagugugaaaacuacaauuuuugcuaaagauguaguuucuuuuguuuaaaucagagaaauuaaaacacuucagauccuuaauaagaaaacaaagccuaagcuaaauacaggcauaauccacagaggaaaaacuaaagaaaugaaagccauuauuuuauuagcuaaaggguucugcagcucucucauaguccugucagaaaccuguauuugacuugccauuaauuauaaguaagcacgugaugcuucuuuuauacauauacaaauaacccuuuuguaauuauuugguuuuuuuaauagacugcuaaaaagccuacuagggcuucuuuaaagcuuaagugagcaagccaauacaaaaugaauuuuauucuguuucuuuucagauuuuuaagaagaagccagaccacuucccauucuuuuuuaaacacaucuugaaggcggcauuagcugaaacugauggugaauuuucacuucaugaacagacagucuuacuacuuuuucuugaucauugcuucaauaguuugguacuuuuacuuuauauuuugggguaauuuucaaguuuucuuguucuuuuagguugaguuuagaugaaauuaccucuguagccaacuccauucauccauaauagcaggcaauaaggauaaugcuaaaagcuugauuucagccacuuaucaguaaaaccauuuuauaagucuuuaagauauguuuuuauaagauauguucacuuuuuaauagauuugaaauugauacuuaauuuuuucuaucuagacucuuaagaaaaaugauuauaagaacugaaacucuaaagggagagcacaaaaaugagaagcagcaaggagacugguuauauggaauuggaguaaugagaucugugccacaaacugcauauacauacaggaauguaguuucauugcuuuucaucaugccuuaugcauaggcugguuagucaacaggagaguuguauuuugaguugacugauaaaggccaaguguaaaugaucuuugaaaaugucuugugugugauacauuuucauccuucauaagauuaucuucuaaaaaauuaaauauuuucaguaauauuuuauuugagcuuuccugugugguuagcugauaaauacacauauuuauuuagugccucugaauugauaauucacuuacacccaugcaggaggaaugcauggaguucuuucuuauucugaagacugaguguuaauagauggaugauuauuaccuguuuccauguacuaucucacauggaucuuuuaaaggcauaaaaaaagauuuaugaugccugcacuggauaccacuguuaucucuuuaacauuuauuuuuauuuauuuauuuauuuauuuauuuauuuauuuauuuugaacauaaacucaagauuuuauugucuucauaauaaaagaugacacuuagaacugaaucacuuggcccuuucucuucuuaucuccucccaguucaaaaugcuugcaucuuuuaauagccagcauucucuuagaucugcaguugggcucaaugcacucaagccuuagcacaaucuuuguaguuuuagccuuuuuccagaaaauuggcuuaguuugcccaccauagccacucugcuuccugucauaacgccgcuuucccugggcauacagagaauccuugcccuucuuguacugugucacuuuaugggguuggugcuugccacacuucuuacagaaaguccggcggguuuuagggacguuaaccaugcuugcgugagcguuaucggcacagaaagccucuuuaacauuuauuaaacuaaacagaacaaauagaaauauaaauagaugugauuuuuuuaucagaaacuaaacagaaacaagauuuuauuaguauuaguaauuuggugauaguuuuagccaacuuaccaaacuaguuuauuauugaaaugcuuuaucuuuuaaaauaugcagucaguucuuauuugagguaguuauguucauuuuauaaaguagcuaugaacauugaaugagcuaaugcugaaccauuacuccuuggggaaauacaggguuagguuccugcaagccuuggucaugacauuuuacaaacuaucaauacauagccuuauuuuauguguguuucuauuuaaagacagcuuauuuauuguauauuauugauucauuaaccaugaacucacugccaacagcacuguaauuaugccugaacgaagcuuaucuaacauacguauuuacucuguaagacauaucacagccuucuugcacccaugaacaucagacagcacuucagccuugggcuuguugccauuuuaaacagcgaaaucaucaaaaagcacaagcgugccaaaaaaaauaguacucaauagaccacaaaaaggauacuuguuucuuacaguaugagagcugagaaugaagcagagcaucagcucagucucaccugagaaugugcacgucggacaacucagauuuuuguuugggccaucuggaugacugugaaagcacauggaguguugauuuugggguuacaaauacauuuuuauuaguauaugaauuugcaaguacaaaaucuguagauaauaaggauggagucuuuuuuaaagcauugaacuucuuaauaucaaaauauuaacuugaaaauauuuguggcauguuuucccuccaggacuuaaaaaggcaguauacuucuuauguaaagacuuagguagaaaugcugguauguuuauaaacuuauuuucuucaugcccuaaacaggaaguagacuugauacgaagucaaguacagcagcuuaucucccucccaauguggaugggcuuacagcugguaagucucuaauuucagagucuuaugaauguauguguuauaaguagaacgugugguuuuagucuauagccuuaaucuggauauacaagugguagcuaaauaccccuuuucuuagaaaagccacuuugcuuaacuuuucauagauauaguuuuuauuuuaaaguuuuuauaugcauucgauguuuaacuuaauuuuaguaauauaaaaugaauaagguaguaucuauugagcuuauagagaaaggggguuaauuuagcaaaguauagaugagacuaaauguggacuugaauuuuuuuuuccuugauuagaguauauauauagcuguaggagaagaucuggaucauaccuaauauuaaugacuuccauuuuuccauaaagucuuuauuggguaauaugugcagguaccaaagccaaauuaauacaucuuagguaguuuaguuaaaacuaucagauuucauuguaaugcuuuauucagaauuucccuuccugcacauggguguuucugcauauacucagauaugcagacucauuuauaagcaccaguugauggggaugaaaacauaaggcacguauaaauaauuaauacuaaguuaaaaaguggcaagugcuauaagagagaauaugcugauguggacauuuccuuauuuacuugugaucgcuguuuuuugugcauuguuucagacucauauuuuucaaaccuuagugauuaugcuaaguguugaugcauauauuuuucagacuuagcucuuuaaguuuugaaauaaaaaauuaauugauuauugagcuuacaaucuugauuuguauuuuuauuaacaagagcuagaguugaauaauuuuuuaaaauaucguuauucauuucuuaauuuucaggguuugucauguuauuuucagguuuuaucagauugcucuauuuuguacucauauauuagaaaacuagcaaauaguugaucuaauccuuauccuuguaaacuuugaggcuacugguaauuuaauaacacaucucuucuucaggcacgauuggaauuagaauuaaaaaagacaccuaagcuaagaaaauucuggaacuugauuaaaaagaaugaugaaaagauggauccagaagcaagagaacaguauguuggcagagcuucauuucauguuggcuuauuaugcuggauuguggaccuuagaugauguugacugguuuguuguuucccuuuauauagugcugagugcaaauaaauuauuauaauaagugcuuuuaccuagacugucauuaagaauauuuuccacaaagaucuaaagcagaagccagagcaucaugcuuuucuucuuuuccuucuuucugugcugcuaaguauauauaguugacccacuguuuuucucccugccuauuguccgucucccucauggaugguucucaauuuucuccacuaucuucaggcuauuaauauaacuucucuuucuuuuucuuacuccuucacucuuuuuuuauuuuuuugagacggaguuucgcucuuguugcccaggcuggagugcaauagugcgacuguggcucacugcaaccucugccucccagauucaagcgauuucucuugccccagccucugaguagaggggauuacaggcaugcgccaccacgccuggcuaauuuuguauuuuuaauagagacaggguuucuccauguuggucaggcuggucucaaacucccgaccuuaggugauccgccugccucggccuccuaaagugcuggggauuacaggcgugagccacugcacccagccuaacucuaaacuucuuacaagguuuucagaagcuugcagcuguuucuugugacucuugcaaaucacuggacuacucuagucauugcuucuuuagcauuucuuuccuaagucccuuuccucuucacuccacuuaauugaauauuaaccauauaaacacucuuccagaccaacuacuuuagaucauagugcuuucaucugaacuccuagaacacaugcucugugauuuuuuuuugaaacaccagcuguuuauguaaugauugggauauguauaguaguugaggauguagguucuacaaucagacuuagcuagauuccacacucaauugcuguaugacuuugggcaaguuacuucaccucuaagccucauugugaaaucuggacaguaguacccauuuccgaggacuguuaucaauauuaaauaagaugugaaguguuuagcauagcucagauccuggcaaaaugcgugcuuaauuaaugucaggcaguuuuauuaaucacauacuggcauguauuacuaauuguguuuauaauauaugacuuguuauugcaaguagauuuuagccguuccccuucuuuguauuuccagcaggacuguuacaagcauuuacagcuguacgauacuugauacaugucuguucauuaauggauauaucuuaaaguaguaaugaauagaaaauuauuuuuuaaacauuugaucuuuagcuauuguaauacucuauuauacuuaaacguuaaaauauaauauuguucaucucauuuuaacuacauuaaaugugagauuuuuaaugguaagggcagacuauaaauggaauuuugaaacuucuuucucggucugacuuguaaaucacaaaugaaaauguuuggcugggagcugugucucaggcugggcgccauggcucaugccuguaaucccagcacuuugggaggccgaggcggguggaccacaaggucaggaguucaagaacacccuggccaagaugguggaaccgcaucucuacugaaaauacaaaaauuagccaggcaugguggcaggcgccugucaucccagcuacucgagaggcugaggcaagagaguugcuucaaccugggaggcagagguugcagugagcugaaaucgcgccacugcacuccagccugggcaacagagcgagauuccaccucaaaaacaaaaaaagcagaaaaaagaaaacguucacggugagagaaggaggugcuugcuuagguggcuuauuaggucaguaaugugacucuccuuuucuucauauagcacuguauuuacauagaaagaagaagcuguauauugaaguuauagucccagcuucacaaagaaaugaacaguugaacaauauuggaaagccguggucaacauuuaaaguuuacuuuugaaaugacuauucuucaaaaauaauuggucaauguucuuucugauuuuagggcauaucaagagaggagauuucuuucacaacucauccagaaguuuaucucugugcugaaaucagucccacuuucugguaucuucuuuuuuacucagugcauuugugaaauuaucauauagcugccccuaugguauuuacucaucucuaaucuaaaaacuguucuuggaaugauuuuaaauuguauuggcaaaguguauguccucuccuuuuuaaauacauuaccagugugaguauugggacugccuuuaaggguuauuuuauuuuauuuauuuauuuuuugagacagaguguugcucugucacccaggcuagagugcaguggcaugaucucggcucacugcaaccucccccagcaggguuccagugauucuccugccucagccucccgaguagcugggauuacagggaugcaccaccaugcccaguuaguuuuguauuuuugguagagacgggguuucuccauguuggccaggcuggucucaaacuccugaccucaagugauccauccaccucagccucucaaagugcugggauuacaggcgugagccacugcaccuggccuaaggguuauuuuaaaggcaccagugugguuauugaaauauuccuuuauguagcaaauuuuuuaucaccuaauuacuagauccagguccugucuaaggugcugggauacaguugugaagaggaaaauuacagaccauauuugcauguuauuuauaauauggugcugaauaguguuuuuaaguccuauugauaccguuggaggaaaaaaggagaaauauuacugagauaugagcuaaaagacuaaauagaaggauuuuccuccaucauagcuccauuuacugauuuaaaaaguaaguauauauauauacuauauuaaaauuauaaaauauaauuaaaauauaauuguuuaauuauuauuauuuuuuuuugagacagagugucacucugucagccaggauggagugcaguggcacaaucuuggcucacugcaaccuccgucuccugggaucaagcaauucuccugccucagccuccugaguagcuggaguuacaggcgugugccaccacgcccggcuaauuuuuguauuuuuaguagagacgagguuuuaccauguuggccaggcuggucucgaacuccugaccucaggcagucugccugccucggccucccaaagcgcugggaucacaggcgugagccaccacgcuuggccaauuguuuaauauuuuuaaguggaauauaaucuaagaacagcucuauagguauaccauauuuauauagguauaccauauuuauauuuuugcaucagaaaguacagcuuuuaaaaaaacacaauggaaugaguuauaaaugcugacccuccaaguaauauuuuacaauugaaaaucuuagcuacgauucagugaggaauugauaccaaugcaguaaaucaguuguaucugacuuagggcacaguacuacuacuagcauuaguauaaagaaaauguuuuggccgggcgcaguggcucaugccuguaaucccagcacuuugggaggcugagguggguggaucacgaggucaggagaucgagaccacagugaaaccccguuucuacuaaaaagacaaaaaauuagccaggcgcaguggcaggcaccuguagucccagcuacucaggaggcugaggcaggagaauggugugaacccaggagguggagcuugcagugagccgagauugugccacugcacuccagccugggugacagaacaaaacucagucucaaaaaagaaaagaaagaaaacguuuuaugcuuauaaucuuaagucucuuaauguuaguauaucuaaaucuuuccacuaagugccuucaaaccuggaaagaggacuaagauuggguuuucuuggcacaaagaauaacauugagcgcuuugagcuacuaacgucuauagaacuaaugucuguaauaaaaauugauaucucuaacuauggaauguuuaucuagggucgucuagguuucaaaagcaagaacauagggccugcaguaauuuaacagccuauaaaccacuugcuguugccgcuauuguuuauauacugucagaaaacaacuuuuuuuuuuuuuuuaaagauggagucucauucugucucccaggcuggagugcaguggcacaaucucagcucacugcaacuucugccuccuggguccaagugauucuccugccucagccucccaaguagcugguacuacaggugcacaccaccaugcccggcuaauuuuuguauucuuaguagagaugggguuucaccauguuggccaggcuggucuugaacuccugaccucaagugauccacccuccucggccucccaaagugcugggauuucaggugugagccacugcgccuggccagaaaacaucauuucuuaaucuugaguuuuuaucaaaauuugucagcuugcuggcaaaggaacuaacaggaugaugacaguaauuugccaguucagaauggguaugaagauagaugguuguguaguuaggaaacagaaggcuaauuuuuuaaauauuuugagaaggauuguaguuuccuuuuuaaaauagggucauuaaaaacagaaugcccagaugaguuguuggaaaucugugcaggauagucugagauguuaagauugcuguuagaagggaaaaaaaguuacaguauagcugagacaaaugauaaggauauauuugugucugaaauugggauagcaagguuucuaccuuaggcaacaugcccaguaggaccagcucucauaaaaaaacaugcaacuuuagucaccagagcaccaugcauuguuuucuaauuuuaaauaggccauuuccaguaauuugucaagacguaaauaaagauacagaauucagaauuugcucacucuuuuaguuugggaaaaaauguuuuccuuugacaguuacaagaacaaaagauagcaacaaaagguugguucgaauggauuuaauuuaaaaauugcuccuuuaaauuguuauuuuaaaugacuguauauguaugucucagaaaaccaggguuccaguucuaaccaaccauucuagcuuuacaccuuuaucaggucauuuucucugaucauguuuuucuaccuagaaaaugaagaucuagaauagaugcucucaaaggucuuuuccagcuaauaauuucuauacuucuguuauuucaggguuuggauuaugggcauaugcuagcugaaaaaguuccaguuaacauuucuguauauauuaaucacaaaaguauucacauuucuugcuuuacauuaagcuuuccguuuuccuguacacuacaaauaaauaaauggauuuuuauguaagcauuuguaggaugccuucuauagaucuggcacuggguguuagucacugcuguaaguuuuuaaacuaaguagcaacaggaaaccuaaaauuaucuuuguuuuaauugaaaccaacuugacaggaugguuuuaguuggcaaaaugguagaccauuuccuggcauuagaaaaaaagcuuuuacucugaaaauauuucaugccccaagguuguaauuauuuaaaaacaaaaauaaauguuuguaaaaauaguauacuaugcucauaaauaguauauaauaagcuagugauuuaaaagguauuuuuauuguucuuugugucauuggcauucuaauguuaaaguaauacauguacaguggaaaaaaauaauaaaaauuaccucucuaauuuucagugcacuuuaaagguguguguguguacauauacguauguguguguuuauacauacgagaaaacucucagaaguuuagaauguaaagacaauaaggaaagugaagcaaaaccugauauaaaacugccuucuaguuuuuauaucucuaaguuuuuucaaaaucuaauuuaauacagauuuuuaaagguuaauacuuuuaaaauaucuuugcaaaccugauuuuuaaaaugugcuuuugacccaagcuagaucuuuuauuuucucauauuuguagagcuaaguaucaggguaaggccuuccuuaaaaaaauauauaugugagauccucauucuaaaucauaguccaauucugaugaauaaaagacaauugacuuuauuuaaguuauuaaauaacugccaguuuucagaaacagcaugcaaaauggccuaguaaggaaauucuaucaugcguucucucuuaugucuagaaccugucacuauggacaaaguucauuacugugaaagauucauugaacuuaugauugaucuagagguaagaaaucuaccgugacuuuuuuguuauauaaucauuagggggucuaagauuaagcauaugaccauauaugaaguauuuuuuucuuuccuuuucuuuucaauacauauguauauauuuauuauauauuucaauuucucacauuaaugagagaaaggaaagguauauauuuccuuucucucauuaauuaaaauauauuaaagguaaauauguauauauuuauuauauacauauguauuauauaauaauacaauacauauugggugcccauggauuguauaauaauauaguauuguauacaauauuuauuaauauagauuauacauuaauaaaaaauuaauacaauacaauaaaauacaauaaaaauacauuaagaaaaaaauucuuuuucuuuucccuuuucuuuucuuuucuuuccuuuucuucuuuucuuuucuuuucuuugagauggggucuuucucugucaccaaggcuagaaugcaguggcgcugucucggcucacugcagccuccgccucccaggccucaagugauccuccugauccaccucagaccccugaucagcugagacuacaguugggcaccaccacgcccagcuaauuuuuguguuuuuuguagagacgggguuucaccauauuucccaggcuggucuugaacuccugggcucaagcaauccuuccaccuuggccucccaaguaggaggauugcuugggauuauaggcgugagccaccgugccuggucuauaugaaguauuuauucaucaccucaaacugguuuuacuuuguacauguuucaaggugucacuuagagaaggaagucacaaguaauuggcccuucagguuuucaaaugacugacucaucuaucaugggcuguuguuuguagaaaaaacauuacauaguauaguuauuaaacaugaguccagcagugacaauuuauuuugugucauacuuuaauaccccucauacagaguuuucuguagugggugaagucauggguuuauaauugucucuuuaaauaaucucacuuuucuaaaugugcccaauguuugugaagaaaaauauagcuguuguguucaauuuuuuaaaauaaagauucuuaaaaaaaaaaaaagauuucauacucuuaggugcaggauuugcugacaaguucagacacagaauugauguaguucagauugaauugauuuccuuuccuuucucucauuaaugagagaaauugaaagaaaaucuguuccuugucuggagaaguaaggugguuuuuugauaugaguauuagcauauuggacuagcagucauucaugagaucuuucaaauucuagcucugccaguaacuaacuucuaacuucugaggaucucaauaacuucaucuauaaaaugaggauauuugauuagauuaguaauuuucaagcuauaguguaggggaacaugaggagaggaaacaaagacaggaaucuccacauagggauuuguacuuccuuuuuucucagagcaacuccacuuuuaaacauacacacgguauauauugggauuuuauguaggauuuuguuggaaaacuacuggccaagaugaucugugagauuccuuagugcuagauuuucuuucuuucuuuuuuuuucugagacagucuugcucuguaauccaggcuugagugcaguggcacgaucuugguucaagacaaccucugccuccuggguucaagcaauucucccugccucagcuucccgaguagcugggauuacaggcgcccaucaccacaccuagcuaguuuuuguauucuuaguagagauaggguuuugcccuguugcccaggcuaaucuugaacuccugaccucaggugauccacccgccacgccaaagcacugggauuauaggcaugagccaccgcgcccggccuuuauuuucaauuuuaucuuaaaaguucuuuuaucaucauuauuguuuuuaaaaccaaaaacauugccacuggguuuauuuacagcaugaacgggaccucuugcauuguauacagugugucuauuggaagguuggaggguaccuuguaugugauuaauacuugagaguuaaauaucacuagauuucacuucuagcuguggagaauagaugcaaacuuacuguuaugauguuuguuuuucccaggcccugcuacccacaaggcgcugguuuaauaccauccuggaugauucccaccuucugguucacuguuaccuuuccaaucuuguucguagagaagaggauggccaucuuuuuucccaggugaauauugauguaucugaacguauuuauuguuuuacuuucuaaauugaucuuuucuuugccacacaacugggaguaucagggcauaacacaaacuccuaguuauuuuaaagucaugucuuaauauauaaaaugaauguauucuuauauagguugccucuaguaauuauauaacuuuuuguuaauuauguaugauuuuuauuauuggacuaaauuaugauuuggggaauacagucacacauguucacaaguuuugauuuuaugugaaauauaguagcugaugagcauuaauuuuaaaugaacugugccccaauaguaugacucuuucuauaagaugauggugacagauaguugaucauguagaaguauacaugcugccuugaauaaggaagcugcaaaugcacuuaacuuuguugucuuggcuaggaagacacaguauuuuacauuuccuguuaugucaugcagaagaaagcauuucuuuugguuuuguuuuguuuuguuuauggagacacaguucgcucugucacccgggcuggagugcaguggcaguggcaugaucucggcucacugcaaccuccgccuccuggguucaagugauucuccugccucagucuccccaguagccggaauuacaggcaugcaccgccacgcccggguaauguuuuguauuuuuaguagagacagggucucaccauguugcccagguggccucacacuccugaacuaaggcaauuuggccaccucggccucccaaaaugcuaggauuacaggcgugaaccacugcacccagcaggagaaaucauuuuuaacaaacuucuaaugcuaucuuucaaugagaucauaguuagagauacaauuuugguauguguuuacauauccccuuuguucuuuuauaucugggagcauuccucuuauucucuuuuuaaauuucugucuagugauuugccacauauauuaaaauauauuaaaaucuuaauaucugaucugccauagauuagaucuaaaaauaauaaagauuuggggugagugcagccaguaggcucuguugaugcugcugcuacaggggagacaucagagccucguuagcaagagaaacuaagccaaaggacuuugauggccauggagaaaaaagaauaacuuagcuuucccuaucuuaguguuuuucccuaaaagaagcagcacagccgggcgcgguggcucacuccuguaaucccagcacuuugggaggccgaggccggcggaucaugaggucaggagauugagaccauccuggcuaacacggugaaaccccgucucuacuaaaagugcaaaaaauuagccaggcaugguggugggcgccuguagucccagcuacuccggaggcugaggcaggagaauggcgugaaccugggaggcggagcuugcagugagccgagaucgcaccacugcacuccagccugggugacagagcgagacuccgucucagaccaaaaaaaaaaaaaaaaaaaaaaaaaaaaaaagaaguggcguauaaaaaaguaucuccaauuaugaauugcaaaaccuauagcgagagaccucaggaguucccucuggugcuauagcuuuguaaguuuucagugauguagauagauaagauagauguuguuuguuucauuaaaaugcugggcuucuuuagauuaucuccuuaacgugucuuagguauugggauugcaguauaaguuuuucuuugcagaaguagaccauguauaugaaauagauuuaacaauuuauucacauacuuuauuuucauguaacuaaaacguuuuuaguuggauauguucuaaaaucuuuuuuguaauguuuacauuccugaguuuuuucagcaccucugagaaacuguaugaaccuguuuauuauuuuaaacaguauugugcuuucuugcccuuauguucauaugauuuauacauguaaauguguuucuucagcuuuuggacaugcuuaaauucuauacugguuuugaaauuaaugaccaaacuggaaaugcucugacagagaaugagaugaccacaauucacuaugauagaauuacuucucuacagguaauuaaaauacauuauagacuguguaugcuccauaagguuuuaucauacugcaauuuagguuuuguauagguacagauugaaaaccauguuaauuuaauaguguuuuuauauucaacauuuuuaacguuucuuuuuccaaugaauucuugaaaaauaagacuuucuuuuauaaccugucuacauucugugaaucaauauacugauauuugcuacucagaaauguuaguuacugggccaguuugguggauuuaaauauuagcucugcugucaguuuuauuuuauuaaagaguauuucaacauauggcagggggugcguaaccauuuugcacauuuuuaagaugaacacauaugaugggacugaaauuuaccaauguaauucagauacgcccaaaaaaguaucuucacuuguuuucuuuugcugaucuuaucuuguucuugagcuccaguuucucugauggcagaaggaaguuuuauuugucaguuuaagguaauccagcuauuucuguuuaaaguaauccagcuauuucuguuuuaaagagucuuuuguuggggguaaagauucaguucaaacucuuuuguaaucaaguuagcuaucucuuaagagaucucucuucuccaaagcuggaggcaucaugcuacuugacuucaaacuauacuacaaggcuacaguaaccaaaacagcuugguacugguaccaaaacagacauauagaccaauggagcagaacagagacgucagaaauaacaccacacaucugcaaccaucugaucuuugacaaaccugacaaaaacaagcaauggggaaaggaucuccuauucaguaaauggugcugggaaaacaggcuagccacaugcagaaaaugaaacuggaccccuuccuuacagcuuauacaaaaauuaacucaagguggauuaaagacuuaaaaguaaaacccaaaacauaaaaacccuagaagaaaaccuaggcgauaccauucaggacauaggcaugggcaaaagcuuuaugacaaaaaagccaaaagcaauugcaacaaaagcaaaaauugacaaaugggaucuaauuaaacuaaagagcuucugcacagcagaagaaacuaucaucagaguaaacaggcaaccuacagaaugggagaaaauuuuuucaaucuacccaucuaacaaaggucuaauauccagaauuuauaaggaacuuaaacauauuuacaagaaaaaaacaaccccaucaaaaagugggcaacggauaugaacagacacuucucaaaggaagacauuuauguggccaacgaacauaugaagaaaaacucaacaucacucaucaucagagaaaugcaagucaaaaccacagugagauaccauaccaucucucaccagucagaauggcaauuauuaaaaacucuggaaacaauagaugcuggcaaggcugcagagaaauaggaacgcuuuuacauuguuggugggaguguaaauuaguucaaccauuguggaagacaguauggcaaucccucaaggaucuagaacgagaaauaccauuugacccagcaaucccauuacuggguauauacccuaaagaauauaaaucauucugcuauacaggcacaugcacauguauguuuauugcagcacuauuuauaguauuaaagacauggaaccaacccaucaacgauagacuggauaaagaaaauguggcacauauacaccauggaauacuaugcagccaucaaaaggaaugagaucauguccuuugcggggacacggaugaagcuggaaguuaucauccucagcaaacuaacacaggaacaaaaaaccaaacaccgcauguucucacucauaagcaggaguugaacauugagaacacauggacacagagaaggaaacaacacacaccaguaccugucggggaugggaguugaggggagggaauuuagaggacaggucaauaggugcagcaaaccaccauggcacauguauaccuauguaacaaaccugcacauuuccacauguaucccauuuuuuuuagaagaaaaaauaaauaaauaaugguguaaaaagugaaaaaaaaaaaucucuguuuuucuucuuuccuacuagguauguggagacaccaaaauagccuuauuguuuuggaagaaggauuaacgcagaugucuuuuccugcuuuuuucagagcauuaguguuuuuguccugucucugcccuugaaauaaccacagcugguguggcauguggucuauuguauugacacaggcaaggcaucauuauugcuuccaaggaacuuggcuauuugcccuguugaggaggcccuaacuuugcuugaugcugcuagcauucuccugaggacugacuuguuuauuuccuuguuuacacaguucauucucaugcuuggguugcagagucauuuugccauuguguguaguaaucucauaaucccauggcaagcucacucauggcaaccuuggcaaccuucugugucauccaccauggaacacaugaaaacuuccggaucuuuucugugccaugugggcaucaaggaagacagggauauuauuucaaucacucuguuguuaaaucccaaggaagacuagggauauuaucucagucacucugugcaauacuacuauuucuguuuucuuacagcuuacccuauguugguugagagugcuacccugugaggucuuuucccagaguuccaaacaaaagcaaggcacaagcauaaguuuuuuggucucuccuuccaaguucucugcagccagaguuucccuugggacuuucuuuuagucuuguucgaccaguucuugauaaucaaguguguauuuguuuuuugcuccucuucugucaauaaagcuagccuuuguggcuauuuuguauauauugaaaauccuuuuagaugucaaaagcugaacgccaacuuuauguuuuuuacauuucuguuaugacaguuguaguuuuuucucuuuuuauuauaugcuucugucugauuaagguagaggucacauaaaagaagcauauaagagacagaaaugcguuaauauuuuuauaaaauauuuucauucuuaaauaguagauguuuauauuaauauguagacauuaauuauuaauauuuuuugccauuauuuucuagagagcugcuuuugcacauuuuccugaacucuaugauuuugcccucucaaauguggcagaaguagauacucgggaguccuuggucaaguuuuuuggaccucuuagguaagacaacaugaaaaacuauauauucuuuuuuuguaucaugcucccucaauuuuacuuuucuuuauugcuuuuaaucauuuugcaguacuuuagauaauauuacuuguuauuucacucuucguugacgucuacaacuagugcuucucuccagcaguuuggugucuuugucacuuacccacguuugguaaaguuucuguuuuuuaugacguauacaauuuucuucgaucugaaauuuuucucagaguagaauauaaagcuggucaaucucaucagucauaaacgacauaugacaaaaaccaauaaagauucauuaugugugauauuagaggugugacuuagggaaauuuuugcauguuuaaaauuuauaaaauuaguaauauccucuggcaguuagcuaucugcuaauauauccuuuugaaaauaguaauaauaauggcauacauuuauuuacuaugugauagacguucuguuaaguguguaaacaacucugaaaacauucaugcuagaaguagguaccauuuuacguauaagguaucuggggcauagaauaguuaaguaauuugccuagguuacacagcaaguaaguggcagagauacaauuuaaacccggauagugugauuuccaagcccuaacuuuuaacuacuauacuguaucaucucccagcucuugggauaaauuauguuuaguuccuugacuauuuaaaauguaauaaacugagguugguuugguuguucauucucauaugaggauuuaauauaauuaauaacacauagauucauuucauuauuuuaaauaacuacauagaguuccauuaaacaggaccagcauacuauuuuuuuauuuuuuuauuuauuuuuauuuuauuuuauuuuuuugagacggagucucgcucuuucgcccaggccagacugcaguggcucacugcaaguuccgccucccggguucacgccauucuccugccucagccuccugaguagcugggacuacaggcgcccgccaccacgcccgucuaauuuuuuguauuuuuaguagagacgggguuucaccguguuagccaagauggucucgaucucugaccucgugaucugcccgccucagccucucaaagugccgggauuacaggcaugagccaccgcgcccggccuuauuuuuuuaaaaguuaaucuccuauuggugagucuuuuuuuuuguuuuuuuugagacggagucuugcucuauugcccaggcuggagugcaguggugcgaucucggcucacugcaaccucugccuccuggguucaagugauucuccugcgucagccucccgaauagcugggacuacaggcacacgccaccaugcccagcuaauuuuuaguagcaaagaugggguuucaccauguuggccaggcuggucucaaacuccugaccucaggugauccugccucggccucccaaagagcugggauuagaggcaugagccaccgcuccuggccuccuuuuggugaaucuuuaauuuuuaaguuuuggcuuuuacaaacaguucugcaaugagcauccuuuucguacugauuccuagaagcagaauggcugauucaaacggggcaugcguuuaaaacuuguuacauauugcuaaauuuccuucagaaaagacuaucaauuuacacuuaaacuaacagcguaugaggauuuauuuuucucccuacuaaugcuggguaaauuggauuuuaauuuuuucuauuuuuaucucauuuuacuuugcauuucccugaucuuauuugggaaauuaagcauuuuucuguuuuuuucuuggccauuuacauuucuucuguaaccuucuuauuuuccuuugcuauuuugcauuucauugcuugucaucuuacugauuuuaaagaacuuuuaauauuuuugguccuaaucccuuugucuaguuuguguugcauuuauuuucuuucaguuuaacuuuguuuguaacaucuuuugucauuacagauauuuuaaauuuuuuaaugacaacugucauucuuuuuaauaacuauauuagaugcuuuauguagaaguccuucucacccuaagguuauaaaauguuuuccuauauuuuaaaaauacuuuuauugccuuuuuuuuuuuuuuuuacauuuagcuuagcugcauaguucaucugggguauuuauuuuuguccauagacauccuuuacacucuuaaaaauuauugaggaucccaaagaacauuuauguguauuauauucauuauauucacuauaguagaaauaaaaacuggaaagauuuuaaacauuuauuaauucauuuaaaaauaucaauugaggccgggugugguagcucacgccuauaaccccagcacuuugggaggcugaggugggcggaucaccugaggucaggaguucgagaccagccuggcgaacauggugaaaccccaucuuacuaaaaauacaaaaauuagccacgugugguggugcacgccuguaaucccagcuacuugggaggcuggggcaagagaauggcuugaacuugggagguggagguugcagugagccaagaucgugccacugcacuccagccugggcaacagagugagacucugucucaaaaaaaaaaaaaaguauauugauugaaaucuauuauauguuagccauauguauugcuaaugaaaaacauauucuccaaaaugaaaaaaaugcaccauuaaaagagugucauuguuuuacauuuuugugacugauuuaauugaagacagauuugcagaucuccuucuggauucaguuuguugugagauauuguuuugguugaaguaaauuaagaaaauuuggccuuacacagagggaaguguauuuugauaagcuuuaucaaauaauugggaauguucuucuuuaauacucuaugaaaacuugacaagugguaguuucuuuaaaaauuaguuucagaguagaaucugaaaccauguaaggaagucuguacaauuaaaaugaauuaaucugaaaaauuagaagcuaggucuugcuuauggauaagaggacccaaggugugaauccuucccaaauuaaucuauagauauauuuuaauuccaaucauaauucuagcaggauauuuuauagaaauugacaaacuuauuuuaaaaauaacauggaaaggcaaaggaacuauaauaacccaaaccauuuuguaacagaacaaaguuggaagauuucuacuaauuucaaaacuugcaguaaagcuauaguaaucaagacauuaugguauugauacauggauagauguauagaucaauggaauagauuagaguccagaaauagaccauaccuauaugguuaguugaguuuugacuaaugugucaaggcaacucaguagagaaaggauuucaucaauggugcugaaacaauuagauaucuauaugcaaaguaugaacauugacccauaccuugcaucauauacauaaauuaacucaaaucggauuauagaccuaaaugucaaaauuaaaacuucuaggaaguaugggagaaaauuuuugugaucguggguuugugcaaagauuucuauagacaccaaagcacaauccauaauggaaaaaaaaaugaugaauuggacuugaucaaaacuaagagacuucugcucuuugaaagacauugauaagagaauuaaaaaacacgcuacagccuaggagaaaauauuggcuaaauggguauuugaugaaggaauagaauccagaaaucucagaacucaauacagcagcccccuacuuuccgcaggggauguguuccagaaccccaguggaugccugaaacuguagauuguacugaacccuauauauacuguguuuuuacauguaauguaaaaaccuaugauaaagcuaugaaguaggcacaguaagagauuaacaacaauaauaauaagagaacaguuauaacaauauacuauaauaaaaguuaugcgaauguggucucucucucaagauaucuuauucuacuauacuuaacuauuuccagacucuggucaaccaugaguaacugauauuagggaaagugaaaccacagauaaggggggacuccuauaauaauaaaacaauuuacaggugacaaaagauuugaacagacacuugaccaaaguagguagauagaugucaauaagcccauggaaagaugcuuaacauguuuagucauuggggaaaugcaaauuuaaaccauaagaagauacuacauaccuauuagaauuuguuuuuuuuuuaauggauaaggccaggcacaaugguucacgucugugauuccagcacuuugggaggcugagguggaaggaugacuugucuacuaaaaaucaaaacaauuagccaggcgugguggcacaugcuuguaaucccagcuacucaggaggcugagauaggaggauugcuugagcccaggagaucgaggccgcagugagcuauaucuugccacuguacuucagccuggaugacagaguaagacccugucucaacaaaaccaaaaaaacaaaaaacaaccccaaaacggauaauauugacucuuggcaaggauguggagcaauuggaauucucauaauugcuggugggaauucaaagugggauagccacuuuggaaaaauuugaguuucuuauaaagguaaacaugaacuuaacauuaugauccaguauuuuccacuuacagauauauucaagaaaagugaaaacuuauguucacacaaaaauauguacaaaaaugaauauaguugcuuuauucaaaaucgucaaaaacuggacuacacaaauaucccacaacuguugaaugaauaaacauacugugauacagccguaucaugaaauacugcucagcaacguaaaggaaccaacuacagauaaauauacagugugggugaaucucaaaugcucaaaugcauuaugcuaaguaaaagcagccauucaaaaggcuaccuaccuaagaccaggcaugguggcucacaccuguaaucccagcacuuugggaggccaaggcaggcagaucacuugagcuuaggaguuugagaccagccugggcaacauggugaaaccucgucucuaccaaaaauacaaaaauuuagccgagugugguggugggcaccugugguuccaccuauucgggaggcugaggugggaggauugcuuaagcccgggagguggagguaacagugagcugagaucaugccacugcacuccagucugggcaacagagugagacucgucucaaaaaacaagcaagaaaaaagacuaccuaaugugugauuccauuuauuugaccuccuggaaaagauaaaauuacaaauagaaaacugauuaugguugcugggcugggauggagaggaggauuugcuauaaauuagcauaagggauuuuggggaggugaugaaaccaguuaaauaguggaaagcuaugaagcucaugguggcaaauaccaguuuuccaaaauucuaauuuuucacguucacauggaaguucaaauuuuaucauugacagcaaauacugauaguuguuuuccuugaaauuauagucuuauuucauucaaaauuugaaauuugaaaaaaaauuggccauuuguccaaggcugguauaaacaguuugucauuuuuuuuuuuuuuuuuuuugagauggagucucgcucuuuugcccaggcuggagugcaguggugcaaucucggcucacugcaaccucugccuccuggguuuaagcgauucuccugccucagccuccugaguagcugggacuacaggcgcucaccaccacgccuggcuaauuuucguauuuuuaguagagacgggguuucaccauauuguccaggcugaucucaaacuccugaccuugugauccgcccaccucggccucaaaguacugggauuacaggugugagacacugcacccgguccaacaguuuguuguuuuuuaaaguaaaaguugugugcaaaauauguacuucccauuuugucacagaauuuaaaauaaaacagguacucgaguccaaauuuaauaguauuaauuuuuuuuuacugcuucaucaaggacauucuuaaauaaaacugugaaacaaugucuuaguauuguuauuauuauuguuauuauuuuugagacggagucucgcuuugucgcccaggcuggaguacaguggcgcgaucucggcucacugcaagcuccgccucccggguucacgccauuuuccugccucagccucccgaguagcugggacuacaggcgcccgccaccacgcccggcuaauuuuuuguauuuuuaguagagacggaauuucaccauguuagccagcauagucucgaucuccugaccccgggaucugccugccucggccucccaaagugcugagauuacaggccugagccaccuugcccugccgguauuaauauuuaaaaguguucuuggggacugcccagaaggaucuuggguacaaugagagguuugcagaaaauauuuugagaacccugcacuaaagccuuaauuuucauugcugguuuuugauauuugcugcccaugucauaguauuauauuugcuuuuuuaagcuauuuguaaaaauacauguuucaaaagugaagugaaguaaguuacuaugaauaaaauauuguucucuauucugcaguucaaacacacuccaccagguggcaucauaccucugcuuguugccaacucuuccuaaaaaugaagacacaacuuuugauaaagaauuucuucuagaauugcugguaaauauuaauguucucugaauuuugcaugugguuuuccuugccuuuuaaagucauucuuaaagauguagguucauauagauuuuuuugugggccaaagauuaggcagauaauucccauuuuguuuuuggaauuguauuaucauuugauuuuuuguuuucucaucuuucgaauuucuuuacucaaguauuuuaucucuucgaacuacuuucuggaugaaucauucuauuagcaacuauuuauaugcaaaucacuuucauugucucuuucaguuccuaaaaauuccugugcuauuuucugacaauguaaaaccucucaugaguaagguuuuuggaauuaauaauaacucuuugcaauagaaagaaaugaggauuuuuuucaggaauucuucuucuuuuuuuguuuuuuuguuuguuuguuuguuuuguuuuuuugauaccgagucucucucugucgcccaggcuggagugcaguggcgugaucucagcucacugcaaccucugccucccagguucaagugauucucgugccucaucuucccgaguagcugguauuacagaugugugccaccacucccagcuaauuuuuguauuuugaguagaagauagaguuucgccacguuggccaggcuggucuugaacuccuggccucaagugauugacccaccucagccucccaaaguguuggguuacaggcaugaaucaccgugcccaaccuguuuucaggaauucuucuaauggaaaauaaguuugaggauaacguugauccugugccuauuaaggucuuguggcuagaauuuuauuccuaaaauuuaaauaguuccaacaaaagaaaauaauuuuuaaaauguauagugcuacaacauuauguuuuguuuccucccuucccuaaaggauuuccccaggcuuuggauucuucuacuauucaauuuaugaucaaaaaguuaaaacauacauauuguuuagauaucaugauuuuuucuauaauuauacuaucuucacugaagagaaugugauacauuuuaagaauaugucauuuuagcauuauuagauaaacacuuauuuuucuuuuucuuucuuuuuuuuuuuuuuuugagauggagucucacucugucccccaggcuggagugcaauggugcaaucucgguucacugcaacuuccgccucccggguucaagcaauucucuugccucagccuccugaguagcugggauuacaggugugcaccaccacgcccagcuaauuuuuguauuuuuaguagagaugggguuucaccauguuggucaggcuagucuugaacuccucaccucaggugauccaccugcuucagccucccaaagugcugggauuaaaggcaugagccacugcacccgguguaacacuuauuuucauauuugagauagauuauuaauauuaaggguacacagaggucaucauggaaaggaacauagagugagaagacuagggugauagauuaauaaacuuucccagaugguauagcuaguuaguauaagaaugaaaacuauaguccaaaaccuagagcuccuauuuuuuccuacauugauuaaugcuaagugucaugguuuuuaaacccuuggcaugugccagggacuuugacacuauuucauauuucauuggaaacuugagauguguggcacuuuaucuguuuuagugaaaaggaaacuaagguuaggaagguuaaaguaacgugcccagcuuuuacaguacucauaaguagaggagcugggauuugaacucaggucugucugauuccaaagaccauuaccauugguuuguuucucaucuuugaucuauggagaaaauaggaaaagaaaaaaaaaucgcuuguugaacugcuacaauaacugauaggcaugaaacuucuuccauaaauuauuuugauugaaaaaagaugcuucuaaccuucugcaugaacuuguuuccuuuauuuuagguaucucgucaugaacgucgaauuucucagauucagcaguugaaccagaugccuuuguauccaacugagaaaauuauaugggaugaaaauauugucccaacugaguacuauucuggagaagguaugguaaagaaguauggauucagcuguacaaugaaacaauuucagauuuaucauauauaauuggcaauuauaggcaguguacuugagucuacucuguacauuaggauaauuuccuggugcccagaaguuaacuuuagaagcuagaaaagauuuaguauuuugaaugcuuuagcacuaaggguuuuuauuaaauuuaacuauacacauaucacccuguaaaaaauacgaccauaaagcccuaagacuguuuugguuuuuuuuguuuguuagugugagacagggucuugcucugucacccaggcuggagcgcaguggugcagucucagcucacugcagccucagucucugggcucaagugauccucccacuucagccucccgaguaccugggaccacaggcgugcaccaccacacccagcuuuuuuuuuuuuuuuuuaguagagacaaggucucgccauguugcucaggcugaucucgaacuccugagcucaagcgaucugcccaccucagccucccaaagugcugggauuauaggugugaaccacugcagcugaccauaagacuguuuucaaggagaccuuauaaugcaugaaguauagcuuucauuuugucacuaugauaggcuguguuugauagagcuuuuguuuuucaaaggcuuuucuuaggggcucuuuugaauucuauguaaagcagguaaugaucaccaaaaaaaagacauuaucauuuauugauaguaaacccuuaguguugauccaaaaugguauugccuaguuuguucacuuauuuccccagauuuggaucuaaacacuuuucacgcauccucugaggaugagaauuugccacaacugaguauaugcaaaagugcauucagauauacuuugaagguauauuucaaaagaaauuucaggacuuuuuugaacaauggcaucauuaguagaagaaaugugacuguuuuaaagacaucacaaguauaaguauugguauauuuacuuaaaaugguuaaucuaagacauauccuagagccauaacuccgauagacccagugcacuaauauugugcuagauuucagaacauaggcagucuucauaucuuuuuauguucuuacagugguuaauauguugcuuucucaugucuagggaugcacaccuggaugauaaaacuauaaagaaauucaagauagcgauugcuauaaaagucagaaaauaguuacuuucggguaaagggaagaagcuguaaccaggaaagggcacauaggaguauucugggauagcugacaaggugguuacaagguuucauuaaaaaaaugucuuuuacuuuacugguaccuucuauacaucccuuuuuuucuuucuuucuuuuuuuuuuuuuuuuuuuguucugcugaagaacuugaguuguuugaucauagaguucccguagucuauagauuuuucugauugaauacucaugguauauugcagcauguuccucuguucuuuauuuuucuugcaaauuaguaccaccuugugcagaggcuugaucaggcuaagguuauccuuggcaagauucuugguggugguguguucuuucaucaggaggcacauacuaucuacuugucucuuuuuuugugcuauuaguagcuauagauauuuaacaccuagauuuguuaauucagugaguguugcaaaguggugacauuuuaguugucauuuuuuuaaauaaaaaugugcuauugaaagaaauugaguuagauuacaagucagaguuuacuaauauaaauaauguuaaauuuuuguacaucaauguuuguuguauuuaaguuuauuuuuuuuuuugguaguauggacaacaaugaugagacuaugacuuaucaguaaaauguguucugggauuuuuuaaaaccuuuuugauauugcagcucaguggucacuuauugucuaagagaaauaguguuaagugagaauaaugaaaagggggagucuggaauaacauacaaacaaugucugguccuuaaaguuuagccagaaggcaaguucagagcacaauaauaaucauuggagauugauuuaugcaauguaacauaauaauucaguguucaugcuaaauuuugucaugggcuaaauuuaugguaacauuauucacuucaguauuuugccaaauauaaauuaggugauaagggaagaaguuuuaaacuacuugagacuguuaguacaaguaucuuuaaauacuuugaaggaguacuguuuacauacagaucacucauaugcagauuacauguauuaauaaaacucauccuucaccccaauucucucucuuuuuuuuuuuuuauuugagacggaguuuugcucuuguugcccaggcuggagugcaaggacaugaucuuggcuuccugcaaccucugccucccggguucaagugauucuccugccucagccuccugaguagcugggauuacaggcgcccgccaugacacccagcuaauauuuuguauuuuuaguagagaugggguuucacuauguuggcuaggcugucucaaacuccugaccucaggugauccaccggccucggcuucccaaagugcugggauuacaggcgugagccaccgugcccggccucaccccuaauucuuaauagccaacauuuauuaaucugguuuuaacaucugugugaaaacaaaaauaaguuguuaucagauaugcugcauuucaggcauucauuagauucuuauaguuuugaggugccaguuuuuuaauacagagaacaaauaucugauuaaaagaauaauucaggccgggugcgguggcucacgccuguaaucucagcacuuugggaggccaaggugggcagaucacaaggucaggaguucgagaccagccuggccaacauagugaaacccugucucuacuaaaaacacaaaaaauuagccaggcaugguggcaggugccuguaaucccagcuacucaggaggcugaggcaggagaauggcuugaaucugggaggcggagguugcagugagacgagauugugcaggugacagagugagacuccgucucaaaaaaaaaaaaaaauugaaauauggauguuuuuuuccuuuucagguugucuugcucuucccaaauugaauuugcaguuuuugacucuucaugacuaccugcuaaggaacuuuaaccucuuccgcuuagaaucaacuuaugaaauucgucaggacauugaagauagugucagcagaaugaagccaugguuaguaaauugguuccaccuguaaugaagagaugcaaacagugacugauaaacuucugucagaaaccuuauaaguauauuuagaaauaauauacugagacaaaagugcccucuaaaauaggagauauuuacucuuugagacauuuuuaaaugugaauuaacauacaucaaaagugcuaaaauauaaaccacauaucuggguacuugggaaugggagugggagacuggggauaagggagaagaagucgucaugcucaagaagggaagggggaaauguagagggaguaggucagaccuuacuuaaaggccgauuggaaggcuagggguuggccaagcaggcccguacuaggucagaacaguuuaaguccuggaggaagcuuaugauaaagggguguaccauuaauccaccuacucuugucacuguugccacaguauucucaggcagccucucuaggggaauggacagaggauuagggcuguugcugcacauugcccggggugguacauuagaaaaucucugucucucuacccauagauucuguggaagaaaguaaaucaccaggauuuacuuuuagggccaguugaguuggucuuguuauuugaggaauucuucugcauaaacuccacuccccaccugcuagcucaugucugaaauuccuuuagcuaagaaaagucuuucauucugguaauuguagcagcucugcauuacaagaauuuguaagguuaauuugguuuuauagauauggcugacuugaggcaaaugcucuuuauucacuauuucauucacaauuucaucaaguaugaaauugauggauguaaguuauacaucacaagugauuauaaaugaguaaaauacuaugagauggauuuuuauuacauuauauaauaggacaccauguauacauacacgauuauacugcauuuuaugugaaaagcugaacagcuuuggaaugugaacugauucagguaucuuccaggcuucugcuuacuaauuauggagagcuaccacagacacugugauuaugaucuauuuuuucacuuccauguuuuauuucauagagaguucuauuuuuuaauuaauuguuaugugaaaaguuauucugggugagacuauaaaauacaacacaaagcauuuuugacuuaauaaucaguugagucaguaggcaggcaaacacugugaaauuuguauacccacuggcugaucauuccugcccacagcuuugcugaaauuguugcccauuguuugcacccuaggggagugcuugaucagaaaacuucuuuacaauuuaugguuaccuugaguuuauaugcucagauucugggccuaauuuuggccauuuugcagacuagcgauuuauuaacuggcaguucaacaaauagaauucauuuauauuuuacuuaaaugccaagugcaacaaaaauacuuugaguucuuuuggucuguuaauaaaaaaaauuuuuuuuaauuauaccauuuucuggcuggggaagaaaaugucacuucuuggaguuaauucauucacacugguaauaauagauuuuucuaaauuuacauuuuuaaugcccaucauugaaaauuauuaaaaaugucgaaaccuaaaagggggccaggcuucuuucuguuucauguaucuugaagaugaaaaccagcagaggcauuuuuacucauuacaugguuccaaugauuauguuuucagggugcugaagcccacuaaccagcaguaagagaggaugugcuuaagggccagaaaucuauacuuuuuaaugcuucaaguagauuuuauaagaagagaaagggguaagaggaguagauuagcgguugcuuggguuugguaacagggauugacugcaacuggacaagagggaucuuuuuaaagaugauggaaauguuccacaacuggauuuuguggugauggaugcacaacucuguaaauuuacugagaacuauggacuuguauauuuauaguggauaaauguuaugguauguaaacuauacugcauuaaagcuguaaaaaauggaggaggugauaggaaguuguuucacaaggguuuagccacuaaguaauuccuuuuagacauugucccaauacuaaccaagccauugauugcagaauuuuguuuuuaauuaguuucucuuuuuaauguuaugaagugcuacaauuuuuuguugugacauaaagucuuuacauaggaggcaguuuaucuuuguagguauguuguauucugcaguacuucauaacuuuggaguguugcuucaguuuuuauguuacguauuucccaaauacaacuuuuuaauauaaaaacuaaagacucguuagacugacauaagaagaaagaaugggcauugggauguuagugguucuguuuauuacaacuagcuuguuuuuuuuuuuccuuccaauccauagcaacaucuuuuaaaugauuuaaauaugcucuaaaggagguuuuuacauagauauucuuuguuugcuuguuuuuaauuuuuuuugaaauuauagcuuguccuaaaauguauuugaaacagcuuauagaaauacuuaaaauauagaaaauaaaauauuaacaauugaaauggucuuuaugaagaggauaaaaggauaacaauauaaaauaaaacuaaguaaagagguccuucagaaaugaaagagaaauaaagacagaaaaacagaagagaacaaaaacugagagaguuuaugaccacuagacugccuuacaauaaaugcuaagggaaguucuccaagcugaaauaaaaagcugccaauuuguaacaugaagagacccugaauagcuaaagcaaucuugaucaagaagaacaaagcuggagacaucauacuuccugauuucaaauuauauuacaaagcuacaguggucaaaacaguauguuacuggcauaaaaacacauagaccaacaaaagagaacagaaagcccagaaguaaacccacacuuguacaaucauuuaaucuucgaugcaugugccaagaguauacaauggggaaaugaaaauggucuugggaaagcuagauaucuacuuguaaaaaaaugaaauaggaucccuauauuacaugauacacaaaaguuaacugaagauagauugaagauuuuaacguaagaccugaacccaugaaacuccgagaagaaaacauaggggaaaagcuccauaacauuugucuuggcaaugauuuuugggugauaccaaaagcauggagaacaaaagcaaaaauaaguaaauggggaccacaucaaacugaaaaguuucuauacagcaaaggaaacagucaacaaaaugaaaaggcagccuuacagaauggaagaaaauauuugcaaaccaugugucugauuagaaguuaauauccaaaauauguaaggaacucauaauacucaauagcagaagaccaaauaacccaauaaaaaaugggugaaggacuucaauacuauuuuuuguaggaagacauacaaaugacagauagaugaaaagguguuccacaucacaaaucaucaagggaaugcauaccaaaaccacaaugagauauucaaaccucacaccuguuagaauggcuguuaucaaaagucaaaagauaacaaguguuugcaaggauguggagaaaagggaacucuuauacacuauuggugggaaugucaauuagugcagccauuauggaaagcaguauggagguuccucaaaaaauuaaaaaacagagcuaucauaugauccagcaaacccacuucugaauguuuauccaaaggaaauaaaaucacugucccaaagagaugucugcacucuuguguucauugcagcauuauucacaauaaccaagauguggaaacaacuuaagggcugaauggauaaagaaaaugugaaaaugugguguguguguacauauauaaaaacacacaaugggauaugauucaccuuuuaaaaagaaggaaauccuuuuuuugacaacauggauaaaccaggaguacauuaugcuaaauguauuaagccagauacagauagacaaaaacugauuaucucacuuuacauauggaaucuaaaaaaggcaaauucauagaagcaguagaagggcaguuaucagguuguagguggggaaaauggggucauguuggucaaagggucuaaacuuucaguuacaagauacauaaguuuggagaucuaauguaaaguauagugacuauaauuaauguuuuauguacuugaaacuugacaggauagaucuuaaguauucuuaccacacacacaaaaaaugcuaacuguguugguaaugauaucacaguguauacauaguuuaaaacaucacauuguauuccuuaacuauauacaauuuuuauuugucaaguauacgucaauaaagcugaaauaaaacuaagugugcuggauuauuuauuucuuugauaaaauggcucagccccagaaugcucuuauguacauaggguuagcuuuuuucuuagguuggagaggagauauuccucuacuucucuuucuuuucuggaccauguuugccuguuucaugcuaucauaucccuguuucaugcuaucuuauauacuuugcauacuuugagaguuaaagguuuucuuuuuuuuaaguuaagaaauaagaguuacuaauauuaggacuuaaauacuagcugaacaguauuccuacuuacuaguuuuaacuugucuaaaaguuggggauaaauuauuuuuuguuugaguaaucauccauuucuuugguuucaggcaaucugaauauggcgguguaguguuuggugguugggcgcgaauggcccagcccauuguggcuuucacugucguugaaguggccaaacccaacauaggugaaaacuggccaacccgaguucgugcagauguuaccauaaaucucaaugucagagaucacaucaaagaugaaugggaagguaaguuuguauuucaaaaagugacauuaccuuuugccuuguuaugaacuuucacuuagagcauuaacaaaguacuuuuacuaaauguuauccuuuaaagcuuuuauuaagcguuauccuugaaauuugauuuaaagaauagcaacuuuuuuucuaauuauuaguuuuaaaaauaccagggaucauacaagaauauuuagguaucuuaauacuuuaauaaaaaguauaaaauugcauacauaucaacguuuugaaaacugaaguuugcaaagccuagaggagagcauuuuaagucuuaaauuuagcaaaauaauauuuauggauuucuggcaucaauauaaaagaauaaaaauauuaguguucaccaaagagcagggagaaagcccacauauaacauacaaacaugcagagcaguaaggaaaauugguauuuuucaaaagauaaaaguagccaaggugaaaaaaauagaaauacauacacuuuguggaaaauaaaaauuaggcaagcuuaaaaagaauaugugggggugggcagggcuauagugaaacaauucagaaauaaauaauaguuuauuugcgccuaaggcagaaaggauaaagagucagugaagucaaauguagucaaggauauauaauaauugcaaagaaauuaaaggaguuauuccuccuauuuuugcuaggcaagauuuuaaggauuagaguuccaugucaaaauuaauuuguuuuggaggcagauauguucaaaauuacuaaguccaauagaguuaaaacaucaauaagaccucugccagaagugacauaugaacugauuucuaauaggcaguuuuauauuuuucucccagcuguccugugagaggucuuacuuaaagcccuguuuugagaaacaguagucaguagguuuuaccuccuuuuaccuucuuggcaugccagaaggaaaggaugucccuuaauggaucuguuuucagaaauuauuacuaccaguguagcuguuuauaaucaugggaacuauaucaaagaauucugaaggaauccagcaacaaagcuagccaaauguuuaacaaaugccuacuguagcggguauaguuuaugacagauuguuuuauaacccuuguauccuucaaaagaguuccauccugguauauuacucaucuagacuaaugugcaccuuuauuauugcugagccucgagaaagccauuaaguugcuggagaaggucucauauuuauuauuccuugaagcuuaaggagauauuaaacacuguggguaauaaacugagauaacuuacuggguacccccagaaguaguagauaguuggaauuuuguuuauuuuaaaggacucuauaggaauuuauagaugagaggucugcauuuugguguuaaggaaaacaaaaggauguuuaaaaacaggccacuucccccauuacugacugcuuucagaaggacaugagacagucuuuuuuucuuuuaaacaucagccucugguagaaugagaacuggacaggguacauuuugaugggcaagauagggcacaauaggguauugugggaugagugauaaucugggguaugauggagagaaaaguguuuuaugggaggccugggccaaaaaccagccccuauauugaucacagauaggguagccaaauagaaaauggaguaaaaaggagagauucuguaaacaauaauacauuuuuuuuuuuuuuagacggagucucacucugucgcccagucuggagggcaguggcacaaucucggcucacugcaaccuccaccuccuggguucaaacaauucucugccucagccucccgaguagcugggauuacaggcacccgccaccacgcccagcuaauuuuuuguauuuuuaguagagacgggguuucaccaucuuggccaggcuggucuugugauccaccugccucagcuuccuaaagugcugggauuacaggcgugagccaccgugcccagcugaauauuguuuuauaaaaguaaauuuuaaagauuauuaaacuaaauaccauaaaacauuccuuuugucccuuugaaaaggugugaaccucaagcccuuaucuucuucaauauucucauuuaaaguuaaggaaacagaauucaugaaauggaaaugccagauuugcuccagaaagcacagcuaggauaggguggauacaaaugguugcaaggagagagacauauaggauuuuaaaaaauguggaucuaagaugucccagaguaaagugguuuguuuuaggaaggaacaagaggucaucccucagugaugccaaaaaguaacuccuaucuugggagaggauaaaugacuucucaggaccacuucuuuggcuguaagacuuagaaguuuuaaugagcugugcagaucagacaucacacagguaguacaacucagagaguaggaugauucccauucauucucauuacuucucuugcugcuuugcauagaauuuauugggaaauaauuaagucaguauuaugaauagaguuauuauuucuaccuuuacccauacucuaaccagucccccaauuaaaacaaaccaaaauauuuucaguacuauuagccauaugcccacauuguugauuugauuucauuguguuuguuguuaacaagguugugagcaagcagacuguuuacauuuacauuuaugucauguaauggcuaacaaaaacaucagaaauggaaugaagauuaagugguguagcauuacaugcugugaggucuaauuuuauaauccuugucuuccaguuucucuacuuuuaauagagcugggaagccauuugaguucuuuauugggucuagugaccaagaagcuguggacucuggcacaagucuccuuuuucuugacauucacuuauaaaaauguucacgauuugccaacugaaacuguauauauucagccaucuuucucaagaucauaccuguaaacaauacuuuuuugccuugauuaauuauucuugaguugaccuguuuuagugaaauacaauuaggcugucuuuggaaugacacugauagauaguuuaaacugauauuaaaaaccugcuaaauaugcuauagauggauuauaugccagccauauuuuugguuacuuauuaagauuguuaaaaauaagaaugaugacgaacauccaauuuuggagcuguagcaugacuuggagggcuuauucaguaauauauucauggcaugaauguuucuaauuuuaauauaaagaaguuuucauuucaauuaaugcuaugaaauauugaguauuaaagauuauagaaaagcccauaauuguguuacaaugcgauaauaaucauuggucacucaacgguaucucucuaccaaagauaagagguagagaggcaaauaagaauuugccuacaaaagacugaaaacaaugaaauucuaauaaaugaaaaugucuuuauaucuuaccaggucuucguaagcaugauguaugcuuuuuaauuaccguacgucccacaaaaccuuauggcacuaaguuugaccggaggagaccuuuuauugagcagguuggccugguuuaugucagaggcugugaaauucagggcaugcuggaugauaaaggacgugucauugaagaugguauggugaccuauauuuuugaaagaguauguguauagaaugauaaauuucuuugccuuuuucccuuuuugcuucuuagguaauauuuuuuaguucuuuuaccuacuaaauugacacaaaggauuuuguaucaaauauguguaggguaccuaccgugcaguuuuagauauagguaacaugguuucucacugugucacacaggcuggaguucaguggcacaaucucggcucacugcaaccucugccuccuggguucaugcgauucuccagccucagcccugcuaguagcugggaccauaggcacgugcgaccaugcccgguuaauuuuuguagagaugggguuuccccauguugcccaggcuggucucaaacuccugagaucaagcacuccacuugccucggccucccaaagugcugggauuacagacaugagccgccaccacacccagacaguuucagaacuucuauguuagauauuggaaaggacaggaucuuuuucuuuuuuuccccccaagacggaguuuugcucugucaaccaggcuggagugcaguggcgcgaucuuggcccacugcaaccucugccucccaaguucaagcaauucugccucagccaccccaguagcugggauuacaggugccugccaccgcgccuggcuaauuuuuguauuuuuaguagagacagaguuucaccauguuggccaggcuggucucgaacucugggacaggaucuuuugaaaucaucuuuauucaaagcuuuuuaaaauauguaauacuuuaccauauuuuuuuuaagaaacacucuaaauaucucuuacaguuguccaagcuuuuuuguguucaaugauauauuuuuucuucuuaaauuugacuauuuuaauucauuguaguggugguucuuaauugggaacaauacuguccugcguuugaaaaugcauagugauauuuagguuuucaaaugaccgggauagaggugaggaauggcaggcucuuggcauuagguaacugugagccaaggaugcuaaacaucugaacagaaauaaaagaaggaauuauccugcauaagaugccaacuuuaccgcauuuaaaaacacugcuuuacaaaauuagucaguuauuugauuucuuauguguaucacuuauuaucccuuugaaauucuuucuucuguuguccugacuuccuuuauaauacuuauuauuaaauuacaacugcauacaugucuagugcuuauuuuacaauuugguuguuguacuucuuuugaaacuuuagucaguuuaugcuaucugugguuuagagauuauaucauugcuaaacugcugaugauuaaguuauuuaucucuagaaugagaggaaauaggagaagggaauggaaaauggauggaauaagcauaaggccacauaauggaaccaaaguucgaggucuaagacccccccuuccccccaccccccccaaaaaagaggagauaugucagagaggaaagaaaaggcucugggcuuucaaccauuaguauccuacauuucuguguaugugaaauuucuuuucaugcugguuauacuagguauggaauguggaaggaugagaaaagugaugaaccucugucaaauuaaggaauuaaugaauagaaaacuaugccuuaaauucuaaaauacauauauuuaauuagaaaauauuuauugaauacuuacuauauguaaggcaguagugggagcuaugagugacaaaaguaaagauaaguucuuugacuucuaaguacuccuauuuuaguugaguguguguacaaauuauugcaagucaugguguugcaucguaaacauuacaugacugcuauggaaggaaauaguaagaauuuagagaaagaagaaaauacuuucagcaucuuagaauuugaagugggugaguggagggcauucuacuuugggaagaaugguuggaguuaagccugaaccauuuacucaccauuucuagaaaagaaauacuguuaacuuauuuugauauuugaaaaauacauauuuuauuuaacaaacuuuuucaaauuguccaggaccugaacccagacccaaucuuagaggagaaucaaggacauuuagaguguuuuuggauccaaaccaguaucaacaagauaugaccaauacuauacaaaauggagcagaggauguguaugaaacuuuuaauauaauaaugaggagaaaaccaaaggaaaauaacuuuaagguaauuuggggguauguaacuaaaaguacuaugucauaauuuaaguaacuuuuaugacauaaauacagagauauuugguuagaggaagauuuguuaagaaaaaaauaaugacugcuuuuauuuuuacuauaagcaauccucuuaaacuuuuaacaaaaugaugaaauauaaaaauuuaaagaaauugauuucuuaaaucuauuuugucuuuugaggaguuuaaaaacuuaaaauauagaugaauccaaguguuauucuaaagguccaccuccuuuuuugcuuuuuguauauuagguauucaguuaaugcccuauuaugaagugaagaaaacuugcuuacuuguuuacuggggcuucuuuuuugaaucaaaaguagguauacuuccaggucacuuuaagaauacagauauggaaucucaaggcucugaauuacuauacguuauaauauauuuuuacucauuaguaggaaagggagguuugguggcucaaaguucuacuuuuagaauaacuuuguggggagaagaguuuuaguaaaggauaguuuuaaaaaccauuauuugaaacuauauuauaaaacuuaaacauugaacaguucuagcauuugauacauguagcuuuugcagaaagagugccuuucuuuucucuuucucccaaagugcaguacuucuuagacauuccuaucauuuuauuacuuuuauguaacccuguuguugugauuuuuuaagaaaaucuuuugaacagcagaacuuguucuucaucucucccuguuguugaacacaaauggagauauccuuaauuucucuuuaucucauacucuaccucuaaucuaucaguaagucugauuagcucaucaccucugcugaugccauguccaggacaccuuuaucucucauaucccugccuccuuucuugucuauuccuccccuuacacauguccacauaauggcugaauaauccuuuuaaaaugugaaguauaccuugauuugauacccccacuuaacauucuuuaaugguuucccaucacauuagaaaguuccuaccauaauccaaaaggcccucucauuaucugucuucugguguccucuccaacaucauuuucuaacacuuuuuccuauucacuccaugucagucacacuguccuuuuugcuguuuuuuaaaauaauccaagacuuuucacaugguguuccuuuuacuuagguaauuauccccagguauuuacauaguucuuuuccucaccugacaugggcaacuguuuuucaaugucaccuccuaagagaagccuucccuggcaaccuuaccuaaaguagcaucuucccuucucaucauuuucuacccuauuaccuuuauuuuuccucagagccuguaucauaacugaugauuauacauuuguuauguaucugaauucuucauuagaaagcaaugaagcaagcaagucuaugagggcagggucuuuguuuugucugccaguguauccuuagcaccuagaacugugccuguuauauaguauguucuuaauaaacauuuauugagugaucgaaggauggagaaaucuaagaguuuccaaguuuuauaguaccuuugacugucacaguuggucaguuuucaguaaauaaaucucaguuacuucacugaaaacuaaaacauuguuuucuuauauucauuuguuugacuauuuagugccuacuguaagucagauauugugcuaagaugaagcuuaugaagaugaaucagacacaacuuacaccuuuagagaagcuagaaauauagacagaugccuaccaugaacaguuagaagguaccaaaagccauaaaaagccuguggauaaaaguguccugaaaguucaaaggaggcauuuaguuucugauccaagaaagagggggaaugauuaacuugccuauguuuaggaaaaaaagaaugcucuuuugguuucuuugguguuucauuauguaucuguguagcaucucucauuuauugccuuuucucuuuuccaguuuguacaaccuguccuaaucuggauacuuuauuuuuugccuagacaguuauaguagccuccucuuugucuacccuugagucuccucauagccagucaccuguuuuucauguuuccuccuacugugugacacugaucauuuuacucucccucucagaacauuucuuugacuuucuauucaugaugaaauaaaucaaagcuccuucacaaaucuuuuacuugaguucaauaaaaaugccacuuuccuccaugaaaccuuuccuaauguuaaguguccccugcauccaucucucugauuuacugugaacuuuguucccacuguauuuuguaacauucuuuacuauuuaccauucugcugcuuuguguuacaguuaaggacauauuuuaucuugcuacuaaaacuguaauuuccuuagagggcagagcccugaucuuauucaucauuguuaggugaauauacucauuuggguauucauucauucacccauuccauauuuaaacuguucuagaucccuacucuugugggaauuauauuuuaguagggauuaaacaaaugauaguagggauaguagggauaaaacaaauaaccaaguaccugaacaagagaaugucagguacugguaaguguaagaacauaaagcaaggcaacaugauuaagggugugauuaacauauacuaucuuaucguuuucaaaaguuguauaacaguuaugauuuaaaaauggucgguuugguuauuuuauucuuugaaauuaauagccuagccuccaaauuucuauaugugagauagcucacuuuguugaaaugauuuuuggaaagucuaagaauuucccuuggcuuuuuguaauuauuuuugacagcauauaugcuaacuacuauaaugaccuuuuguuguaguccugauucuuuccuucugaaauuuuauuugauauuuccuuuauuuuuaucauuuuguucgcuuuuuuauuucuucucacagucuuaauuuuaauauuucuaaguugugacguuucaucacaauugaagcauacauuaaugugcuucugguugugggugacuuuagcauuaaagaacuauggaauauaaagagggaaaaauuccaggaguuacugagaggaaguauuuucuuuaaggguuuguucuauauuguuuuuuuuacugcuguguccaccugagucugguuuucauccuacucaauaggagucaaaugguaaauuuauuuaugucauucugucuaagcgaacucuuaacggauaaacuguucuugcuaaguuuggucuuuuguuuaacucagugugugguaucagcugaaaauauagcuguugauucagucuagccaagcaccugucagccagcggaaaauagcuucuugcucugaaacacucgggaauucuggauuagugcagccagcucugcauuccaguaagugcaaauguuggagaugucauacugacacaaucuuuuucuguccuuuuacugacaggcugugcuggagacuauucggaaccugaugaauacugauugugugguaccugacuggcugcacgauaucauuuuagguuauggggacccaaguagugcacauuauucgaaaaugcccaaucagauugccacccuugauuucaaugauacauuucucuccauugagcauuuaaaagccagcuucccuggucauaauguuaaaguaacuguagaagacccugcucuacaaauacccccuuucagguaaagucagaacuggguacgcuccucuccagcauucuguagucaauguacguuaugccaucaggauuguuagcuaaagugaguuuugaguacuauauuuggauuuuguuuuagcagucccuaccuucaccauacaaucacugggauaacuuuauuauauuugaaucuauuucuuacugcagaaguuguuuuaagaccacaguaaaaguagucuaauaccuaauaagggaucaauaaauacuuauugucugaagagaacuauauaaauauauuuauagcauuugacuaaaauaugucuuggcaguuaugcauagucugguauguuucucaacuaaugcagcugugugauguugaacuuuguuuuuaggaaaaaaaucuuuuuuucuuuuaacuuugcgugcuuucacaaauuugaaauguucauaauauagcuggguaugauggcucaugcauauaaucccagugacuucagaggcuaaggcgggaggacugcuugaggccacgaauucaaaaccagccugggcaacauagcgagaccccaucucuaaaaaaauucaaaaaaguagcugggcaugguggcgcacaccuguaauuucaggaacucaggaggcugaggcaggaggauugugugaacccaggcguuuaagucuguaguaagcuaugguugugccacuguacuccagccugggugacagaggaagaccucaucucuaaauaaauaaaauaaauacaauagucauauuuaaucuuaaauuaggucuggucuuaaaauuuaagugaaaacagaacaaaguaccugaaauaauugguuguuauucccugaauuccuucauauggauuagugguaaggcacugaguauaccuaugggugguagcccacagauuacuuucuugccuagaaauuagaaaacacacagcuuucaacuguauauauauauauauauaauaauaggccaggugugguggcucauaccuguaaucccaacacuuugggaggugaaguugggaggauugcuugaggccaggaauuccagaccacccugggcaacugagaccucaucucuauuaaaaaaaaaaaaauuagcaagauuggugugugccuacagucccagcuauucgggaagcugaggugggaggaucacgugaacccaggagugugaggcugcagugagcuaugaucacaccacugcacucuagccugggugagacagagcgagacucuaucccaaaauaauaauuaauucuacauuuuaaauauacguauccuuuauacacccaaaccuagucucccuccauacuuuccuaauccuauuuauggcaaagacauuuuucuacuccugcaucuugaaaucucagcauuauuuuugaaucuuuuuacucccauaaaacuccugcuauaucucagagauucugccuugaggauaguuuuuuggauuuuuuuuuuguuuuugagauggagucuugcucugucgcccaggcuggagugcaguggcgcgccgucucugcucacugcaagcuccgacucccggguucacgucagucuccugccucagccuccggaguagcugggacugcaggcgcccgccaccacgccuggcaauuuuuuuuuuguauuuuugguagagacaggguuucaccguguuagccaggauggucucgaucugcugaccucgugauccacccaccuuggccucccaaagugcugggauuacaggcgugagccaccgcgcccggccaaggauaguuuuuucgcucugucacccgggcuggagugcaguggcuccaucuuggcucacugcaagcucugccucccggguucacgccauucuccugccucagccuccugaguagcugggacuacaggcgcccgccaccacgcccggcuaauuuuuuguauuuuuaguagagaugggguuucgccguguuagccaggauggucucgaucuccugaccucgugauucacccgccucggccucccaaagugcuggaucacaggugugagccaacgcgccuggccgaggauaguuuuuucaugugccauuuguacugcucccucuuuaggcccucagcagucuuuaugauagcaaaaucuuuccucccugucucaccucacuagaauccauuacaugguuuacugcuagagcuauucacugccuagcuaaaaagcugauaugcuccuauuucuuaccaaaauaagugcugaccacuuagccucauuggcucuuagcauucuuugguguuaucuauuuuuuuagaaugugaaagacaacuggaaaaaguacacauagagaaugaauuuuuuaguucaauuuuagggaguucauugacuucccugagguaucuguggggaguuaccuccuaaccccagguuaugacccucugccuuaaaagcuucauauucuagacaugucauuauaagguuccugucauaacaaggcuucugucucuucagccuuauuuuucucuacccuaugcccaggcgaaauacgcugcuuguacuuggccucugcuguugcuucuuucuuccaggaaugucuucucuucccgucuuugaaugucuaaauucuuugagacucaucuuagaugccaucugucccaugaaauuuuuuucugauuaaaugaaggacagacaaugaauaaaacacuuuacaaugcacaugagauaauauuuaauguuucuuuaaauucucccguaauucuccguuaacugggugacuuuuuuaaauuugaaaacucccaacacacguuagggcuuguaacucgaccauuuucagaguuuacauacagauaucguuccuuuaagccagaaauguuucuuacuccucugauuaucgugcauacaaugucaugcaccagauagguacucaguaaauccuuguuaauugcaaaaaugaacagaaguuuuggucuuguaggauaacuuuuccaguaagaaguggaaaagggaagaaaaggaaagaugcggauguggaagaugaagacaccgaggaagcaaaaaccuuaauuguugagccccauguuauuccuaauagggguccuuauccuuauaaucaacccaaacgguaauuuuacuaccuauuauaauuguaaugaugaacaauaguuugccauuucaacuggauuaggaauguuuuuaaauuuucuguuucuuuuaaaacuccacaaaacuccuguuucugaacccucuuucuuucuauucugucagucagcugaauaacugacauuuuaggccauucuguagucauaauauuucaaaaagaaacauuuucagguacuaugagaaauaaauguuagaggucuaccuuaauuugagcaaaggguucuuacuucaugagccuguguuacauauagcaguagcccuaaugcaugugugccauaacuaguaaauuggcauuauauuuaguauuagaauggaaacuagaacuuuggcacuccaaaugaggucugggaugggcuaagucccgaaaaauaacuauaauuccauuuuaauugucuguguugagggguagaggugaagggagucauucagaagagauugagagaacugggguaaauacagagcagauauuuagaccacuggucauuguugucuaaauuuguauuauacaaagcaucauuuaucuguaccaacuuuuuauuuacucuuauuugcaguaauacgauucaguucacucauacacagauagaagccauccgugcuggaaugcagccugggcugacuaugguaagagaauuguuacaccuguuuguuuguuuguuuguuuguuuucugagauggaguuucacuuuuguugcccaugccggagugcaguggcgcgaucucagcucacugcagccucugccucccagguucaagugauucuucugccuaagccucccaaguagcugagauuacagguacccgccaccaugccuggcuaauuuuuuguauuuuuaguagaggcaggguuuugccauguuggccagucuggucucgaacucuugaccucaggugauccaccugccucggccucccaauguguugggauuacaggcgugagccaccgcacucagccacaccuuuuuuuuuuuuuuuuuaacauagauuaagacuagaaguaaguaacagauuuuagaaugcguucuauuucaaguacagcaaccccgcugaauuuaagcguuuacaaguaaguguagguucuuaugcauuuagagaucuugcugcucgcuucaguguucauaaaguuuuauuagaacaugacugcccauuuuuuaaaaguuuuguuuuauuuuuaauugacaugauuguacuuauuuaugggguaugaugugauguuuugaugacuguauacauuguguaaugaucaaaucaggguaauuagcaaauauaucauccacuuguuuucugcauugcuuauggccacuuuugugcugcaauggcagagaucaguacuugcaacagagauugcuuagccugcaaagccgaaaaugcuuccucucuggcucuuuacagaaagagucugcugacaacugauuuagaaguguguuuaauuuuuaaguauuuggagguuucccuguaaucuuccaguuauugauuucuggucaaagucuauuuuggucagagaauguauuguaugauuuuaauuuuuugguuuuugcuuuuuaaauuuguuaaaauuuguuuuauggcccagcauaugaucucucuuggugacuauuucauguguacuugaaaagaauguguauucuguuguucuggaguagguugugcuauaaauguugauuagauccauuuuguugauguuauuauuuaauuuuucucuauuauugcugauuuucugucuguuguuuuguugauuacugaaagcagacuauugaagucucucacuguaauuaugaauuugucuauuucuccuuuaguucugucaauuuuugcuuaauguauuuugaagcuucauggauaagugcuucacaccuuuaggguuguuauguugucuuggugaauuggccccauuuauuauuauguaaugucugucuucauugauggaaguuuucuuugcucugaagucuacuuugucugauauuaauaucguuacugcagcuuucuuuuaagugguguuugcacgauauuucuuuuucugucauuuuacuucuacuugucguuauauuugaggugaguuucuuauaaacagcauauacuuuagguauguugcuuuauccauucugagacucucugucuuucaacuugcguguuuagacuauucacauuuaaugcaaauuaaaggacacauuuggauuuaggccuaucauuuuuauuuauuuucuauuuguucccuuuauuuuguauucuucuguuucccuuuucaugccuuccguuguguuauuugaauaguuuugaguauuauguuuuuauuuguuucauauauauauauauauauauauauauauauauauuuuuuuuuuuuuuuuuuuuuuuuuuuuugagacagucuuacuuuuuagcccaggcugaaguguaguggcaccaucuuagcucacugcaaccucugcuuuccaagugauucuugugccucagccaccugaguagcugggauuacaggugugcaccaccacggccagcugauauuuuuguauuuuuaguagagaauuggguuucacuguguuggccaggcuggucuugaacuccuggccucaagugaucugccugccucagccucccaaagugcugagauuacaggugugagccacugugccuggccuaucauauucuuucauuauauuuuuggguguaguguuuucuuaguggcugcuuuagggauuugcaauauauuuaacuuuucauagccuacuuacaaucaguauuaugucacuucagguugauuggcaaauacuuacucccauaaaguuuccuuuaccuuccuuccccuuuuguauuguaguuguuuuaugugcuacaucuaaauacuuuaagauaccaucagauaguaguagaauuuuugcuuucaacuguacacauauuuuaaagaacucuagaggaaaaaaauagccucuuauuauauuugccauuuauucuacauuccagauauuccaaguuuccucugguagcauuuucugucugaagaacuuuuuaaaaaaacaaaaacaaaaaccacuuuuuauaacaugucuacuagauaugaguuaguuuuguuuuucuucaugcaagaaugucucuaauucaucuucuuaaaagauauuuuaccuggagauagaauuguggguugauaguucuuccuuuuagcacuuuaaauguuauuacacuuccuucugacuuccauguuuucugaugacaaauccaaagucauuuuaaacaucuuuuuguaauauguaaugcaucauuuuucugugguugcuaucaggacuuuuuuuuuucuuugcuuuuuguuuuuaaccauuuaauugugguauaucugggcuuggauuucuuugggguuauucuguugggguucacugagcugcuugaaucuguagauuuaugucuuuugccauauuuaggaaauuuucagccaugauuuuucuaaaauuuugucuaugccauacucuuuuuccuuucugucuuagaauuuguugacaugaguguuagacuuguuaauguucuauagauucaugagucucuauuuuuuuaaucuuuuuuucuguuauucagguuguguagcuuacugaucuaucucaaaguucaccaacucuucuucuauccuguucauucuguuauugggcccaucuacugaauuuguuaauuuuaucuuucaggucuguacuucacguuuucuaacaaugugugauaacugugaugacuuaguaguuugcuauguguucaucuucuuuuuagguugugggcccaccugguacaggcaaaacagauguggcaguucagaucauauccaacaucuaccacaacuucccagaacagaggacucuaauuguuacucauuccaaucagguaaaugacugugugugugugugugugugugugugugugugugugugugugugugcacgcaugcgcaugcacauggguaugcagguuagggguugagggggagguaagugugggacacaauaaguuccucuucaagaaaucuaguuucauuauucuuuguucuccauuuuucugagccuggccuaccuguucccuaauauauucuggcaugccuaagucucagcugguuuguggcucacauuccuucccuuauuugggaaugcauuagcuccugguuucccgugaggacccccuccucucccuugcuuccccaucacgcagugaccauauuuagaaaagcuuaaguuuuagccaaucgggguaguuuauauugugcggucuuacuccagccaauggggaaaggacacagauacaggggcugcauuagggauagaaacccuucucuccuuuguucggugugcucuuggcaaacgugacugacgcagguagcacccaccugcagaaguaaauugccuugcugagaaaacuuuuugucugagugcugguucuuccuugcagcauugagcacuuguuccuaacauaaggaaggagcagaggauucaugaaaugaauguauuaauagaugauuuauccuuguaugaaaaucugaucauagguaccacaaaauaccaggaaaggcuaauuaguauagauggucccugacuuuugguuugacuuuuauucugaccuguaauauuuugacuuuaugauggugugaaagcaauaugaauucagcagaaauuguacuucaaguacccauacaaccauucuguuuaucacucuuauuucgcuauucaauaaauuauaugagauagucaacauuucaguauaaaauaggcacauuguguuagaugauuuuucccagguauaagcuaauauauguguucugagcauguuuuacauaggcuaggcuaagcuaugguguucaguagguuagguguguuaaauguguuuucaacuuaggauauuuucaacuuaugauagauuuauuggaauguaaccccauuguaaguugaggaguaucugcuauugagcuacucuuggauuaucacugcuuauaaugagaugacauugagagauauauaaaagcaaucuuuuauuucuacuggagagggucaaugugaaaaagcuaagacuauuuggauauaugguuagauauuuggauuaaauuaaauugcuauuuuuuccuucuacacuaaacuagaacuuuuacuuggagauuauaagcauuaacccuuacugggagcauuuuucuucauuuaguagaaugaauauuccugaaagacuaaggucuaaagugcauugauacuggauuaaauuucaaauccaugugaaauguacaccuguauuacaugaagggacuguauucuacuuuagucauucugaagcugucagaaaugagggaagaacaaguaacauuuauuagaucugguauaaaaugagacaggcaacucugagaacauccugaagcauauuaugaaauuugcaugguagucaaaaccucugaaaguuuuuucucggaguuuauguuaacaguggugacuucaguugaccagucuuugaguugguauauacagaagcacuguguuuuuggaaugccaaauaucaguuacucuggugaucauuaacuuuuaauuuguaaaguuuuaaaaauaauacucuucaguucauuugccugacauauuuuuauauauuuugaaguuuauaaauaguaaacuuauccaauauacugaauauauguuauacauaauuauauaauaacauauuacauaacauauuggacauaaugcaucuaauauacugaauuugugggaguugaagggggaucaauuuggacuuugucuugauaaaagaaacaaauuaugaaaagaaguuuuuuucuucuguuuauaaaauuuguucuguaaaaaccuauuguaaauucuuaaaaugaacagaauaauucauguguuguuuuaacauauuuuuuacuguuuugucauaccuugauauggcuuucuacaguuauccucuacuuuaugauugauuuguauagcacaaucauugaaaagauuaauuugcaaaaauagacacauaauucacugcuugcuaaacaccugccuugguuuuuugaaauucaaaucauuucccuugaugcccaucgaauugauuguuuuccuucaguuaacuguuuuguuugccagaucuucauuugcauguauaauucaaguaguucuucaaaaucacuguaauucacaaugaaaucauguaguuuuuucugggauuauagugugcaaguuuguggggguuuuguuuuuuguuuuuacuuuuauucaaucuaugugguucuugaguuugaauagugaagguuuggauagugaguaacaccauguaaucugcucuguuggguacugaguuuuggaugaugaguaucaagaguuuggauagugggggauuuuucugaaaauuuauguuaaaucucuucaguuucagagcucagauugcuagaauuuugaugguaaaggauaucuguaucuacauuauauaaccuagguguuuauaagacuggaugcugacuucacaggcaggguuggacuagugaaagugagauguuugaauggcggcuuauuuuuaaauaguaccuuaauuagugagucuuuccauacuaugaaacuuuugccuuucuguaaaaccuuguaacugcggaaguucagauaaugaauacuaggauucgagggaacccuaauuaugaacauuucacagauagaaaguagugacuuuuaaaugacuuucaucagaauaguuugcaauaaaugagugcucugcucuuuauuauauugagaacauuagacuuucagacuaagauuugaaagaugcaauuuauguuuccaccuucugguccucuuaauguauucuaccaacacacucacugccuucuuauugucuuucuccaacugcaaaaacuuuuucaguucucuguaacccaaggaaaugcuguugaaugaaaugaaacucagugugguuguuuauuuuaggaguuguuacaacucggaagaaauagcaucugagccaaugccuuucucguuucauaaauuaaaagcagauguuuaauaggugggugguuuuaugguuucuaguuauccauacagccaaauagacauagauggcaauaucagaaaucaauauaaauacuauuugauuaaauuauaaauggccuaauauaaggcugauuuccuucuguguuucaacuuugauucuuucuaaauguuaguuuuugcuacguuuaaaggugccgucacccuucuugcuuuauugucuaggcccuaaaccaguuguuugagaaaaucauggcauuagacauugaugagcgccaccuacugcgucuuggucauggagaagaagagcuggagacagagaaagauuucagcaggugagcaaaugggagugaguaacaguguaaaaaaggauuuuuuauuuucuuuucauuucuuuuauuaaagaagaagaaagcaaugaauacugaaacuuaauucugaaagguucuaacuuaacuuacuaagacuauauguugagcuagaaauauggucaugaugucccucaguuccaguuguguaugguuaugccauuuugucuucaaauauacaauuauguuaaugaagagaaugaucuuguuaaucuuuuuaacagauugccuuuugcuuucuauuuauugagguaauuuuucaugcugccaguucaaaacuguacaacuuuaaaugauuccuuuuucacaucuuauucaggaauuuaauuugcauauauuuuaggugccaauuaggagguugauuuauuuauugaaauagaaauuacgggaggcugacgcaggagaaucgcuguaacccgggaggcagagguugcagugagccaagauugcgccauugcauuccagccuggcgacagagcaagacucugucucaaaaaaaaaagaaugcaaauuagugauuaaugauaauauaagcuuugggguuauaaguauaacuucagaugcuucuugccaguuuggcuggacuuuguuugauaucacauacuguaaauugacuaaaacuuuacaagucggauuucuucugccauuaguauuuuaauuuuuuucauucaaaguugcuuuauaaugucucauuuuauuuauauuuaaauccauuuuuaaagcccaauuuuagauaauaagcacaauuaacagcuggacauauuuaauguagccuuuggcuauuaaacaugauauuugaugaauugaucauagacauuaaaagaguuuuaaauuauuaugugcaucuauuuugaguucuuguauuauagagcuuaccaaacacuuagcuucuaaaaagucacuauguugcagaggggcaaagaacaacaugccauaaguuauuuagggcucuauauucuuaauuucagauuagccaguaauacuuuugaauucaucccauagguauuuccucauuuuaaagccaacuuacaaagguagguuagacucuaaaaucuaauaauucagaauucagugaacaugaaggugcuaauagaauauuugacuauaauuacaauuauauugaagucgaauuuaugguuuuuaaagaauauuagaauagggguagaauuuuuacaaugauuucagguaccaccaaauuuguuagaaaaaauguacuuuuaaauucugacacauaaccuagauauuguuaguuugcauauuugauuggacauauucuuuuucucuuacaauuaaaaagaaaaauuaugacuauuguuucacaauaaaaguagcaucacuuucucugaagaaaaaaauuguaaaaucuggugaaguuguagagaaggagugguuauccauaauuacacuauccuaaaacaacuuuuugcuagucuuuuucuguaaugcuguuauuuguaauuuuuauguugcuuuuuuuguuuuuuugagacagaguuucacuuuguugcccaggcuggagugcaguggcaccgucucagcucacugcaaccuccgcuuccuggguucaagcaauucuccugccucagucucgugaguagcugggauuacagguacccaccaccaagccuggcugauuuuuuuuguauuuuaguagagacgggguuucaccauguugcccaggcuggucuugaacuccugagcucaggcaauccaucuuggccucccaaagugcuaggauuacaggcgugugccaccgcgcccagccuuauguugcuuuuuaaaaauaauucuuuaucuuuuaaguguaauaauguacuaauugagcagauaguagaguuuaauuguacuguauauugcuuuuauuuauuuauuuauuuauuuauugggacagagucucacucugucacccaggcuggaguguagugguaugaucucgguucacuguaaacucugucuccuggguucaagggauucucaugccucagccuccugaguagcugggauuacaggcgcccaccaccacaccuggcuaauguuuguauuuuuaguagagacgggguuuugccauguuggccaggcuagucuugaacuccugaccucaagugaucugccugccucggccucccaaagugcugggauuacaggcgugagccaccgugcccggccuguugcuuuuuaaguuuaacauuacuucacaaaaauuuuggcauuuuauuaacagagucuguaagcauuccugauuuuuuucucauuaacgaaguguucauuguagauaaaaguuuauagauaagcaagcagaaaaaaguuaucugccauauguuuauauccuuccaaguugaaaaauucuucaagcauagaucauguuuuagaucucuuuuuuguucuuaaucaucccuugcuaccucaaaugugaaucucugaacuacagacagcuaggaacaugacuucuucuuuuguugagucuuuaaacaugggaacaacagugauugauuaaauuauuuuagucuuauuuuaagcauuaaaggguuaugggagacccuuuguuguugugguguugugaaaagaaugugcauagaauuugggaucuaauucugguuccacuacuuucuucccuaacuguguguuuucggacaagguacucuccaaacuucaguuuucuuacugauucagcaaacauuaagaaccugcuagguuugggugccaaguuauguauugggauauguagaugacagagauaaucaaaaacauuuaaaaauuacuuuucaaagccuuuagaucuaaucuacuuuuauguaguguaaaacagugcuguuugaagcagccaguuugugaacuuacauguucuuggucugugaugaaaugaacuagcaccagaaugcacuguccugcuuucuucuuugugaaagugucuugcugugaaaagaaagauugagagcugaacuaaaugguguauuuggugauguaguugacuuucccuccuccuagaccaguaacacccuugcagaucaauacuguuccauggaguauacucuaaguagcuuuuucuuuuuuuuuuuugagacggagucuugcuuugucgcccaggcuggagugcaguggcgccaucucugcucacugcaagcuccgccucccagguucacgccauucucuugccucggccucccaaguagcugggacuacaggugcccgccaccaugcccggcuaauuuuuuuguauuuuuaguagagacaggguuucaccauguuagccaugauggucucgaucuccuaaccucaugaucuguccgccucagccuccccgaaguguugggauuacaggcgugaaccaccgugacccaccuacuuuaaguagcuuuuguguaaaguaacccaagaacuaccaccaauaguuaaauagaagccauaucuucuaguuuuuuuuccucuucuuugcuauuaugauuuucuugaauuuugcugauuguuuccuucaaagucucuuuauuacaguuuugucauuuugccuaauugaaaugucuagguauggaagaguuaauuauguucuggcucgaagaauagaacuuuuagaagaagucaaacgauugcaaaagagucuagggguuccaggagaugccucauauaccugugaaacugcaggcuauuucuucuuauaccagguaagauauuaaggguuuuugaaucauacuucaucauaauaugaaccccaguuggaagcuggaaugaguucuugugauccuucaugaaagcuuauuuuuuugaguagauuagaauguaugguauugcaagugcuauauuuaugaauguuaaguguauuuuguauuaucuucaguuuucuuuucuaaauaacuuugcuugaugacucauucugugaaagaccaauguugcuacuuuuuacauuuuuuucuuucuauuggcaaaguucuagucacucuuuuuucuuuuuuuacuguagaaauacaacuaaauaaauauucuagcuagccaguggcaacaaaguacaguuaacuuuuauuguauacauuaaucaacuaaugaaggaaaacauucuuccuucaaauuuccagaaauaaauuaugucuuacaacuaauugcacagugggucuugaaguuaaaggcuucugacuucaacauaaagauguacuuuuacuuuuguuaggguaaauuuuggaagugugaaaaccaaugagaaauagccaaauaaagugaauaaaacuaaacuuuaauagucaguuggauuauuaauaauuuuaaauggacuaggacauaauuggcuaaugaagauuuuuguauaacuucauuuguucucuuuguucuaaugccaauuguauauuuuagauauaaauuauaauauuguaagcucauuguaaguggauaucacaaaccaauuaaguccauucaaaaugagcagcuuucaugguuucuugugaagcagggaaaauacauaauauagucuacauuagauucaagacuguuuaggacuugcauaaaggaguaaagaucagcuuaaaugcuuuuuugacacaaaauuacuuggcuuucagugaaaauaauguuuaaaagugggaaaaauaaccuauaaauuaagaagguuuauguaauaaauuugggaagaaugaacuugaggcuucacaguguaaauuggcaguuuucaacauuuaagaaucauaucaggaaaguuguuuacgaguuaaauucccuagcccuuguuccuauagcuucucauucaauagagguggaauccaggaauccacauuuuuauuuagcuccucagauauuuugcauaaggacuacacuuuugagaaacacugagauaguaacagaaaaagaccugggagaguuacagaaauugagguuacauaguaacuggcugguagacgcauagcuaacauuauacaaaguaauugaacuauaaucacaaaagucauaagauaagcuuucaaauacacacucagcuuaaccagacguucuuuauaaauguucuaaaaaacugacagaggguugacaagugccaaauugauuaaaaagcugcuaaagcugaacuuaccauauauggagagaaacagagaugaaaaaaaugagcaauuucuuuguccagagagcuuucuuuccuuuacauuucuuuuaagcguuaauaauaaacucucuugaguuacguggagaaucugaacugucggaguuagaguucuaugagaugauguuaaggcucuuuccaguuuguagaaauuuguuauuaaagagccuuuuuuucuccaaagacaagguuacuuuuauaacagaagagcaaucugucaguuacaggaaugaagaauaguuauauuggaucaaagauugaauuucuuuuuuuuucuuuuucaccuagcagaucuuguuuuuauaagauuuauucauuuuaugcuuuaaaacaucauaauuagcuggcaguuaacuucaaguccuuuuuucuacagguaaugucucgcugggaagaguauaucagcaaagugaaaaauaaagguaguacauugccagauguuacggaagucuccacuuucuucccuuuccaugaauacuuugcaaaugcuccucaacccauuuuuaaaggaagaucuuaugaagaagacauggaaauugcugaaggauguuucaggcauauuaagaaaaucuuuacgcagcuugagguaaggauucucaaguucuuugaacuucccuuuagugguuuuuaauuuaguuuaguuuuuuuuugaaguaaaugugaaauauucaaaucuuuuguuuuuuuguuuuuuuguuuuuuuuugagacggagucuugcccuguugcccaggcuggagugcaguggcaugaucuuggcucacugcaaccuccaccucccagguucaggcgauucuccugccucagcuuccgagcagcugggauuacaggugcacaccaccaugcccagcuaauuuuuguauuuuuaguagagacaggguuucaccauguuggccaggcuggucucgaacuccugaccucaaguuaucugcucgccucugccucccaaagugcugagauuacaggugugagccaccacacccggcccaaaauauucaaaucuuagaaauuagauuaauuuuaaguaagauauaaauuggauccuuauucuggcuuuccugauguaaaggucuuaguauuuuugagaaaggaaugcuuccgucaagaaauucaauaaugguucuuugaacuggaauuugagacugccauguggccauucuaaguccuguaugccucuugaucaguaaaauagugggguugcuguaguagccaggaugauugauucugauuauuaaagugaaaugagucauagcuacacaaugggaacagagaauaugucuggaacccagugcccccuggauaugucuccuaguuuuugccacaucauugcagaaucaucauugcaaaaauagauagcaaacaucauugaaaaauuacagcgguccuauaaagggaucauauucaggcucagacuccucaguaagaaaauuuaggauuacacuuucagguagaaaggucagggacauuguuucuugucuuuguaucuuuuagaugugauuacauaccuacuuccuagaacaguaucagauauguaguauauguucaguaaauauugaaauguauaugguugaguggauggaugguagguacagaauaauaaauguauuauguuuaugguuacauaaacacaaaguaaaaggauaaaaacauacucaauucauaauaauagcugccuugggagggaguaggcagaagguuauacaggguaccucaccuauauguguaauauuuuaauuauuuaaaaaacaaauguuuuuuguuuuuccauacucuuuucugcucuguuggggauccucugccaugguugauguucuggcuuauccuugcagguuuaauuucccagcuuccuaugucagcugacuucuugcuuaguauagccgaugagagagugccaagguauuucuucaucaguucccucugccuuggguuucaucucuuucaugauuccaguuucugcuggaaaaacuugugguuccagcuuuuuugugugacuacagucccugggcucugauaauaccacuuccuaccuuuauucuuucuagucuagggaugauagugacugcugcugucucuaauuucuauguuacauuaccuuuauaguuccucuaucacuuauauaaccaguuucuugcuaaaauuuccuuugauaugaauaccugaaaucauuucuauuuuccuggagggacguugaguaauacagguacaaugaucacugaauuuuauucaguauucuuguuuauauaguacauauuuuacguuacauacaaaaaaguuugaauuauaacuuuuauaucagcuauuauuuaaacucaauuaguaccgaaaucauaaugaacagaauuauaauucauuaggcuuaguuuauaauauauuuauguuaauuucucaggaauuaagucugacuggauuguaugguuaugugcaaaacuccguuuuccuaaaauuaucuuucauugcuccucguuuccauaggaauucagagccucugaauugcuucgaaguggacuggacagaucuaaauaccuuuuagugaaagaagccaaaauuauugcuaugaccuguacucaugcugccuuaaaacgacaugacuuggucaagcuagguuucaagguaaagacuuaugguaguuuuuuuuuuuuuuuuuuuaagauuaucagagauuggcucacuucuuaugaaguucguauuuauaauuaccuuaaaauguuucuuuuauaaguggaugauaauaucccuuguuuacaugauuagugaacucugaaucuaauuuuucuaaaucuaguuguuaguaauauguccauuagguaauguuauaaccauaugguugucugaccaaauucucauacuuguuaaaguuuuauuuuuacugaguaucacuuauuuaaaaaucuccaaauaaagcuuaugaaaaaagccuaaaauucaccuaauuaaaaaaauaguaauaauaaaaauaucuccaaacagaaguaaaagcuauaaaaagaacauuucaaaaugguuuucagccaggugugguggcucaugccuguaaucccagcacuuuaggaggccaaggugggcagaucacuugaggucaggaguuugagaccagccuggccagcauggugaaaccccgucucuauuaaaaauacaaaaacuagcugagcauggugguauacgccuguaaucccagcuccuugggaggcugaggcaggagaaucacuugaacucaggaggcagagguugcagugagccgagauugugccccugcccuccagccugggcaacagagugagacucuaucucaaaacaaaaucaaacaaaaaaaaacaaagugguuuucaucuauuagacaucuguaugcuuagauuauucacauauuaaacauacaaccauuccaguuauuuguguacuuagcaaaugaaaagccuuucauaugaggauauggaauacucuuagacugcaaaaugagauauuaaaaugguuucaucauaugauaaaaacaggaguacaaaauaaccuguuaaucugugacucacuugaaguggaaaguaaugauugagcaguaaauuugaauuugcaaauuuuuugugacuuugcuagugauacugaucugaacuuagauuuuaauacagucauuuaacuuuccugcaacugguuugucuguuguuuaaaacagaguucuguauauggguuugaauuaaaaauuaguaauucacuuguugauuaaaguaacugacaauuuuaaaauguugugagcucacugaaagauaggcgcuaaauaaauucaaggugaugaaauuguuaucuuggaugcaagguuccucagcugcaagguaggacaaauacgacaauuuauuaaaagguagugugaauguaccccaguggugugaacuuacccuuuugcaaauuauuagugagaauuuuucaccuaaauguuuuguucuuggggcugacauauaaaauauacuuugauauuaaaucauagcuuaauaacaagggaaaauaaugcaaccauaauuaacauuuuuugcuuucauggagcuuuugccuguguucuaaagaauacuacuuaucaaacuuucaguagucauuuucuacauuuaaaucaugcuacacgucaacggguaguuagcaugagugcuaauagguuuucuauauuuuugauuuugaaguuuuauuuuuaucacacuuaagaguuuuaaaaaccuuguagguccacuuaacaaaaaaaggcagucccccacucugcucauccgucccauuuauccaguccuucgacucuuuuagauuuuguccuuuucaucuauaucagucaagaaugguaaauuuccauuuuaggcauugucuuuugauucugugcucacccaaaggacaaauagacacacauucaugcaugugugcgugcaccuuuccuuccuuaaugcucccaauauaguuaugucguaacuuugguuugcucacuuugggguguuuacaucauuauuaacacaugaacacuuucacauccaagcagggggaauauaccaugauuaguuguccuuucaugcacaauuuuuuuuucuuucuggaauuaaugauuuucgccuuuuuuguuuguuuaguuuucuguuuuuaccaccaauucaacccaaaacuguguuuaguuuuuaaauauuuucuuaguacauuuagacacaucccauacauguuuuuggagaucucucuccuagauacuccugaccuauuucaguucacauugcauccauuguaaaggccuuugccuuucucauaugucagauucuguguuuugggcauucugugucuuucucuucuguauuuuaguagaauacauccucccguaucuuucaugugaaaggaugcauaggagguaauauuuuuaagacuuuccauguccaaaaacuguuuuuaaucuacucucacauuuaguuauuauggcuagguauagauuucuagauuggaaauaauuuuucuucagaauuuugaagaauuguuccguuuucucugucuuccaguguagcuguucagaagcccaaagccgugauuuuaaauguauuuuguuuuacauuuuuguucugucaggaagcccuauaaucuuuucuuugucccuagaguucugaaauuucagugauaagucuuagggauacgaagggauaaagaggacucuuacuuuccugggucccuggguugugggagauggauggagaaagagagccagacuucuccacauucaguuuuguacacagacuuuugacauaauucccacuuucuguguggugcucauuucugaucccacccucuuaacucugccugcuuucuccaaguuccaagauccucuccagacacuaaaccuguugucuauugggggugagagagaagggacauuucguuugguuccuugaaguggggaagucuaauugccucuuuaaaccauuccuauuguuaccaagcaaaaggggcucgcugcucagugcacuagaagccaauacucuaacaccagguuuuugagggaaaaaaaagcuccuauuacaaguugacucaugagaagaacauagucaagcucaaaucuauguccccaugcuggcuuuaaggcaguaauuuuauuagaaaauauacaggggguggauucugggauuaguaagcgauugguggaaggaaaggggucuggaaaaucuucaagcaugcgcaguucucucuucaugcuaccucuuggauggcauguguagauucuagaggagauaacaugaaacaugguagaaauuuggguugugacguaagcaagcucauucugcgcucacucuaguuggcuauauugguuccagccaguuucagccaguuuuauuaucuuagaagcaaaggaaguuucagcuuugcagcaaguuguuucuuuucuuaucuaucauccuguaaacucaaggauuucuguuaguugcugguuucuuuaacucuuugggauacaauuucacuauauaaugucaaguguuauuuuaggggguuuccagagauaguggugaucauuauguguucaguucaucaccuuuuaacagaagucuaccacuuguuucaauuuguauuuuguugaagccuauuuuuuuuuuuuuugagacagagccuugcucuguugcccaggcuagagugcaguggcgcaaucucagcucacuucaaccuccaccuccuggguucaagugauucuccugccucagccucccaaguagcugggauuacaggcacccgccaccaggcccagcuaauuuuuguauuuuuaguagagacaguguuuuaccauguuggccagguuggucuuaaacuccugaccucaagugauccagccucgggcucccaaagugcugggauuacaggcaugagcaacugcacccagccccaauuuuuuacaaacacgaaguuaaauauuaauucuaauuugcuugucuguuuucagggauuauuaauucaauguugaucaucuuaaacccauuuugaguuguagaaauuguaaaaggaaauaugaauucaauguugaucaucuuaaacccauuuugaguuguagaaauuguagaaggaaauguaucagaaugauaacaaaaaugaacaaugauaauaaucaucauuuguugagcgucagcuauguaccaaguucuguguuuacaauguacaaaauucuauguuuacaaugauuuauuucucuucuucacaacuagaucuuuuuaugagcuaucuccuuuuuuuuuuuuuuuuuuuuuuuuugagacagagucucauucuuuuucccaggcuggagugcaauggcgugaucucggcucacugcaaccucugccucuuggguucaaacacuucuagugccucagccucccgaguagcugggauuacaggcacgugccaccacacccaaccaacuuacuguauuuuuaguaaagacgggguuucaccauguugaccaggcuggucuugaacuccugagcucaagggauccaccugccuuggccucccagaguucugggauuacagcugugagccacugcaccacaagauaccuccauuuuauaguugagaaagggugacucaagagagauauuaccuuagagucgcagguaaucaguuacagagcuaguauuaaaacaugguuuucuaagaauuuaaagucuguugugcccuuacuccuacaccacccugacccuauccuagcagcuauaauccauuaaagaaccguggaacugguaacgguggcuguagaauuuaggaauccuuugaaaguucacaaagacuagcuccuagccuggucccuggccugcagcaucaagugccaacccaacauguaauauguugguagagauuaguaaggguugaaugaaugaucugacuaauaaauacauggagcaaguagcuaaaguagugauaauuuugcuuuggaauuaaaaucuguauuuuaaaaaacaaaaucuguaaauauguuuuuauaaguaaaauugcauuauauuuucagaauugauuuucagaaagcggucuuuuuaagcuaucuccuuuugaguugcccccacucuguuuugcauauuauaccuguuaucuugagagucuacacagggacuucuuagaaaaugugagaguuugaauuccuccuucuguucagcucccacaaaaaugaccuaaucauuauaauagggaaaugccuacaccuucaaguaguuucaauaacaguccaggauugaaccauaacuuuaaaagaggagaguuaaucaaacauucagaguaaauaugcucuccccaucucccaccucccuggaaaauaaaauaaugggagaaaucuuuaaaaacagaaagcaacagaacucuaauguguacuuagauucaagaagaagguauuguaccaaaacaagaugucauacuaaguagcgaucagaauuagaugugaauaggaaagauaaaacauauugauaauagaucuaaaugagaauuggacagauagaacaguaguaauuaucgaagaaggaaugaaauuuucucauguuuuagaaagacuugauuuuucauucuuuuacaaauguguaauaccuaacauuacugggaacugggcuacggaaaagauacauuaaacaaguaaauauacagauauaauuacaaauuguguaggucuggaagacaaaagaacaguacuucaguacuuugagaucaguuuuagauugggaagucacagaaggccuagauaaaguggcuuuuaagcugauauuuuaaggaugagaaagaaccaacuagacuaaaagugaagagaauagcaugugcaaagggccugaggcagggaagguuuugccauuuccaacaaacugaaaugggucauugugguugaagcuuagugaguaaggagaaagauaaaguacaagaggaagucagggacuagauugaauauagguucuugguaaauacauccuugcuggcaauauugagggauuuuuuucacuuaaacaguggugugaaggauuugaaauaaggaguuguauaagugccuuagaggagucaagacaggaagaggaggaacuaguaaggaguuugcuauccguagucauagugguggcuuggauuuuuagagugguagugcugguagaaauaaagaaaaaugaauagacucaagaguuuugaagguaaaauugacaugcucuggugauggauugaaugcccaggggugagacugaagugaauuguugugauggguaggauucauauaggaaaaaaaauuaucccaaaaugcuaccagaguaagaguaccaaagggaaagacuucauauauaauuauaaauugaugcuuucugauguagaaauaaagaacuaaauugaaaagaaccaaacuggcauugcaauucaagaaaugauauacaagaucuuuucaauguaaaguuguauauuuaggcggcuuuccugaagucaaauacuugaauuggaaaugcagaggcauaaugauaaguaagaccaugaaguuucuguuugaauaauguguauguuguuauuuuuaucugucugaauaauuuguaugucguuuuuaucagaaauuauuugggguuuuuuugaugauuauguuuaugaugguaguuguuugacuuuuaagcugucuuuaugacaagauuuccucuuucuuaguaugacaacauuuugauggaagaggcugcucagauucuggagauagaaacuuuuaucccucuucuucuacagguaagaaauauaagaucugaggcaaagaaaauagaguucuaagaaugcugaggacagcaucagaaaguuguacaguuugggugugcugauugccauaguuauguauuuuccuuaacuucauuauguuugguauucuauuuuaagccuguaaacuuucuugaaucuauucacuggcuauuuaguaguuguuuugcuucgagaaguacuauuuaaaauuucauagucuauuucuguaguuuugaaaagauuuaguaauuuuaaucaagaaaauuacauuguugugcaguuuggugggaagaugagcuguuucuucauuucuuuuguuauaauuguuuguagaauuauuuuuuucauuuucacugagugcauugcuuuucuuuaugccuaaguuuuugagcuaaauugugcuauuuaagaauuuuuuuacuguaaaauauucuuuacuauugaagcauuaaaaacaaaauguggaauucccaacuuaaggauagagaccacucuaauaugcagauaaauugaguuccagaaguuguuuuuauaagugaagcuacuuggaacuuggaauguauucuaucaggauauguuucaaggaacuaggagacauauagaguaggaaauugaaguaguaguguagauaauuaaagaagguaguuuuuacugcuuugguggguucagaauugguccucagcuaauugugaaacauguuuauuucgcaucuuuccauuucucuucuugggcuucuguuucuuucugugugcucguuaccuaaugccugaccuaauccuuccagccuucuuuggauuacccugccuauuaaaguaggguaauuccaugcuugccuucuaaauaccuccauucucccucacccacugucacccaggagcaauaacguccauaauugguucacaaauuguucuguaaauuugcuagacuccuguuuguggagcugguaaaguuugguaauuuguaagauaaggaagcuguuugaugaagacugagucucucggguaauaaauuggagacaagaggauaauagaguauuuugccauuuccuuacuuuucauuucuagaauccucaggauggauuuagccgacuaaaacgauggauuaugauuggcgaucaucaccaguuaccuccaguuauuaagaacauggccuuucaaaaguacucaaacauggagcagucucucuucacucgcuuuguucgcguuggaguuccgacuguugaccuugaugcucaagggagagccagagcaagguaaaagagacaggaaaaaaaaucauucccauuuaaggacauuuguuccaugauccaaguauuugugaauagcuuuuguguagacuauuagcauucuuggcuauccaggaacuuggcuauccauaaauccaaaagcacuuuugucgacuucugcaagagaugugaauggaccaaauaauuuauuuccuucauuucauucauuaauauuaauuuaaguaacuuauaaucuaaaggcuucuuuucauugucccuucuccuuucuucauguccccaaaagauauacaguuaauauaauuuuaaaaucuaaaaauaaagugaacaagaggagaacacaccaauucuuacuucauaaaggaugcaggccccaucucauaguuacccccaaauguccucaauuuuuagucuuccuugauuuuuuaauuuaagggauaaagauagcauugaccucagagagcguaauagaacucucauuuuuguaguaccuucagucuucugacccuugguuacuugaaguagggaagcuaagguugaaagagcauuauugcuuaaaagaugagccaaaauggcuaacaugaaaauuuaaaagaagcacagaaacagaaaccuccuuauguauauuaaaagagauuuuacacugcuaauauuuucuguuugugggggaauuugucuuuggaaagcuugugcaaccucuacaacuggcgauacaagaaucuaggaaacuuaccccaugugcagcucuugccagaguuuaguacagcaaaugcuggcuuacuguaugacuuccagcucauuaauguugaagauuuucaaggagugggagaaucugaaccuaauccuuacuucuaucagguaagaaaaaauaggaagcuuauaaguuuauuuugcauuugcuggcugacauaugccuaaaucagugauacuuaaccauuuggccguugagaaaaggaaaguuggaaccccaccuuacacauagcauaugaaaaaucgauuucagauugauuaaaaauacaugcacuaaagaaacuaaacaaacuagaaacuacuagaagaaaauauuaaugaauauacaguguuggagugagaaaggucuuccuaagcuuguuacaaaagcagaaaucauaaagaaaaauagcgauuggagaaaagauuuauuuucaguauuuaaaauuuauuucaauauuuaacaaacaaguugaauucugaauauauuuauagaacucauaaauuguuuuaaaaaaucaagacuaacaggaaaauaugaauaugcaauucauauuuuauaacaaguauaaaucacugaauuacauuuucacuucuauaacaaugcucaguguugggauagguuuggggaaacuuuauucucauacaaugcuaguaggaaaauaauuugguggacaaauugucagcauguaugaaaagcaauguucucacaucuaggaauuuauccuaaaaaaauaauugggcaaguuuggaaagacuuguaugcuucauguucaucacugcaaauuauucuggaaaugagaaacaacccaaauaucugucaguagggauuaauugcauuauuacauauuccauauaaaagaaauacuagauagccacuaagaaugauaacauuguauuuacuaacaggaagaauguuuaugcuauauuaaguggaaaaaaguugcaaaguauaucuacaguaucucauuuuaaaaaggagcugcaauacauacauauagaaauacauacagauaaucuauacaaaaugaccuggcagcauauacaucaaaauauagucuuugguugguagcauuugggguuauuuuaauuuuuuucuuuuuuucucucucucuuuacagcaaaauauccaauauagguuguuauacaaauuagagaucuugaguuauucaugaaaaagcaucauuuaucaucagcuuaaauguguaugcauagauguaacucaugcagaucuuauugucccuccaaauauuugguuauauuaaaucaaguuacucuauuuguguacuuaaugccugagaacagaugugaccuuuaaaugauaacuuuaaaaauauuagaaccuaguucaaaucagugauguuuccuaauagccaccuuagaaauuaauuauucuaucaguaaucaacugauguuuucauuacauauugguuuuuuggaauuucuucuuugagucaguuucauugccugagucauacuguaguauugauugaaacauuuuuauccagauugguuaccuguuuuucuuauucauuaagccuaacucuagaugaguuuuuagcgauucaagaaauaaauauauuuucagaugaugauuugccacuauuaaauauauuucuggagaguugaaaacacugucccccaaaauaagaauacuaugcauuuaagugauaacauuugaagaauuagugucgagagggaaagacuagguggauaaaugaauaaaagucacuaauuugaaggggacuugacucauuuggagcgaguucuaaaauguuuggucacaauacaguucauguuguuuuauuguuaaugcuucaugucuaaccuuugggcaaaguaccaaauugggcaguguuaaagaacuagaaaacuuaaaugaacuuguaacucaagcugugcgucacaaagaaccagaauauaaaugauauuuuuagaagucuuccaguaaucuuucgguugccuuugcaugaaauccagcuuccuuuuuuuuuuuuuuuaaauauuguguuuauauucuuauuuuacuuucuucuuucaucuaguacuuuggauuuagucucuacugaacuggaccaaagagcuuugugugugguuccucaccuuuaaguugaauaagccuuaguuuuaagcuccuuucuagucuguaauuuaacaguaaaccagacugaccaauuugcggucacauccucaucccaccuaaagugaucuaguagaagugacaaccauuacgcagagaacagaaacaaagcauacaaaaaacauuaagaaacaugaggaaggaggaaaagcacugugcaaaaauugagucaauuauaauacugcuagguguauuugcuauuaaacuggguauuguauuggcuucuuaguuacuuuguuccuuuauaguuuugugucuguguaacuacaguuguggcacauuguauagaauuuuuuuuuuuuuuuuuuuuggagaugagaucucacuuugucaccaggcuggagugcagaggcacgauugaagcucgccacaaccucugccucccaagcuuaagcgauccccccaccucagucuccagaguagcugagacuauaggcaugcaccaccaugcccagcuaauuuuuguauuuuuaguagagacaggguuucaccauguuguccaggcuggucucaaacuccuggacucaagugaucugucugccuuggccuccccaagugcugggauuacagaugugagcuaccaugccuggccagaauaguauuaaucuauauugugauuguuauggucuuaggaauauuaagccuuuaaguugguaaguuuuauuuuaggauuguuccauguauugcaaauuaaaaguuuguauuuaucacuguuaauguagcauaaaauuaucccucaguuuuaugaaagguacucacuuauccaaguuacuaagucuucacuucuugcagugugcaaagugaacaaguuuugcuuaucuagaugagauauuuucucuauaaaauugaaacaaaagcaaaugaaugcacagucugauuauguuugcauuacagaaucuuggagaggcagaauauguaguagcacuuuuuauguacauguguuuacuugguuacccugcugacaaaaucaguauucuaacaacauauaauggccaaaagcaucuuauucgcgacaucaucaauagacgauguggaaacaauccauugauuggaagaccaaacaagguacuuuuauaauuauaauauguucucuuauucaucauuuuggcaagauggaaagguuuauauuguucugcuuugccucuuugcuaucucuuuuuaagauauuugagaaaaugaaauaaugggaacuauaaauaacucucugacagucuugcugguuugaugugacuuucuaucucagcuaccacauaaaagauauuuauugaugguaaaagaaauguuucugaaacuuuuuguucauaaaaugauauauaacaaaauuacauuauaauauguguacuguuacaaggaguauguuuugcuuugcagggguauaauuuagacugcuuuuuauuguguauagggggagguugucuugggaauaagggaagauuguaaaauguauucagaccuugggauuuuaaaaauauauauauuuuuuauguaaucaaaaaugcauaauaucaaauaaaaugaugauucuuucauuaaugaaggguagaauacauuagaaaaaacauaaagauaauacuaaugauaaaauuaggacuuuggcuaugaacauggcuauguaaaagcucaccuuuuuuggaaauuaugcaaauguaacaggaaaaugagaaaaagaggggacaaacuauuuuuauagacuaucugugcaguagcagaagaaaagagggccuuuuguuaugaaaaccguccagccuucagaaaacagccuugcucaccccaucuucaugucucccacauagcuaaucuaagaaacuuacuuauucagugaugaauaguauaaagggaacuagcacaagcucaauuuauaggaaaaaaugaagaacagcaaaacauagauaggauacaugcuccagaaaccauguuggccuggaaaagaugaaauuuucaaauauacauuuugcuguaaauugggaaauacuuaaugaaguaaccauaucuuugaggaaaagcuacaaagcagagaaauguaagaacucagaaagagaugaaauguaagcuggaagaaaauaaaaucagaggaaugaaaacaaaaucaaaaggaauacagggaagaauagacacugcacagaauacuucauaaggaauagagugaaacugagaaacuaauaauuuugcaaguuuagaaauagaaggaccucaauauuugaguccuuuuacagaaaaucuuacucaaauaauaaggaaaguuacuuucucucauaacaagauggaaauagggugguuccaagguuggguuacaggguagcucaacgauguuauucugcccugcuaaugucagcaugugagcccaguucuccacauggucagaguggcaacagaauucccagguauaauauccacacauaacaacaaaggacguauauccagaauauaugaacuccuauaaaaguuauuacuaaauaaggcagaccaauacaaaaugggcaaaugacuugaacagacacuucacauaaggaagaccuacagguagccaauacgucaugaaaaagugcuuaccaucauuaguugucaaggaaauagaaauuaaagcuacaaugauauaccacuaccuacccaaaagaauggguaaaaugaugaagauugacauuaugacaaauguuggcaaggauguacaacaacugaaacucuagaacugggguucuagaguuuacacauugcuggggaauguguaaagugggauaacaauuuuggaaaaguuugacaguuucuuauaaaguaugcacuuacuguacagcucagcaauuucacuccugcauauuuauucaagagcaaugaaaacauguccacaaaaauauuuguacaugaauauuuauugcagcuuuaugcaagauagcuucaaacuagaaacaggccaacuuuucaugaaaaggugaguggacaaaacugugguauauuuguucagugaaagaauacucaaaaagguaugaauuucucauguacacauacaugaauauaucucagaaacaugcugauugaaagaaacaggacacaaaagaauauauccuuuugaugcuauuuuuauguaauucuagaacuggcaaaaaauaaucuguagugacagaaaguaaaucagugguugccuggggcugggggaugcagauuugaccaaaauggggccugagaugauggacauuuuuauuguggugguggucacaugggaaaauguauugucaaaauucaucaaauuguacacuugaacacauuuuauuguguauaaacuauaccuccauguaguugacuuaaaaaguguuuuguaaacuuccuaaagauagagagacuauaaauuacaguaucugcaggguaagcaauaaacuuuuugucaaauugaugaaaagauaaaugucugaguugccaguauuagugacugaaaccuuucugaacuucccuauuuguacauacacuuuuuuucuuucuuucuucuucuuuuuuuuuuaaacagggccuuacucuguuacccaggccggaguguagugucaugaucucaacucacugcaaccuccaccuccugggcucaagcaauccucccaacauagccuucugaguagcuggaacuacaggcacgcgccaccaugcccagcuaauuuuuguauaauuuguagagaugggauuucaccgcauugcccaggcuggucuuuaacuccugggcucaagcgaucugcccauguuggccucccauguacauauauuuucaaacugaacagaaagugcaaugaagauuauuuguuuuuuucuuugauggaggaaugcuguagacauuuacuagugauacguuaaguaauaaauaagcauacuaaguuauauugcugagcaucaaacugggauaccaguuaauaagcuagacauagucucugcuuucaugaaguuuugcaaucuaaugggggaagacuguuaauuccaaaaauaguuauuuaguuaucagcaaagguaaagacaagugcuguaaguguuaauaacauaaggauguaguuugaucugauuaguaugguuucuuuaauaauguucauuaacuuguucuuggaauuccaagccuaugauuauguuucuuuugggauugauuaaggauaagauguuuguuccuagcacauuauuuaaaugaucucuagugucuuuuggcuuuugcaaaugcaccauauuuuccauuuuuuauuucuaggugacaacuguugauagauuucaaggucaacagaaugacuauauucuucuuucucugguacgaaccagggcagugggccaucugagguacguaggaaaaaacuuucauaauauuuauugaacuuuacuaucuacuucaauuuugaaauucuguggcuaaguguucuaaauauuuuuuaaguuuaaacuauaauuacuaggcaacuuuugcugcuuuuuguuggaauguaacaucaaauuccuuguaacuauucucauugcugcuggauuuuuuuacucuuaaauguuuuaguaauuuuaaguuuuacccuuuaguaacccucagagauagcguuuuaucauaaaaucuuaaucucuccuguaucuguuagaaacuuaauaucagaaauuaaaggagauuaacuaaaaagucuucagaauaaauuuucauuguauaauauguuuucucauuuuuucucauacacaaucuuucagccucaguguuagaggauaaaggagccauuuguucucccuggauuaagaauugucaaaacaaacaaucuacuuuuaucguuuauuaugauguauuuaugugcuagagauuuacggaaauaauaucuucuuauuauaaagcauccauuuaguuuuauauaaaccuucaucucauaugacauacuaacaaaacuaaggagaguuuauuuuauuacuuuauugauuagaaauaaaaagaaaauucuccaagcucucauaauguugucauuaagaucuguuuggagcuuaacccagugaucagguuucaugagauuaauaacuuuuauguaaagguaaguaaagauguaauguuuuaaaaaauuguuuugcauacuagaaguuuguuuuugcauauuaagugucaagccaauauuuacagacuuaacuuuuuacaaaagcaauuccuucuucucauugagauuuauaacugccaucugaauggacugucacuaugguuuauauaauuaacaucucaaaaacuuacaguaugaauauaugaauacuccuuccgccccccuccucucccuaccuuuuuucuuaacucugugguacuuggucuucaaauuccagugacuuuaguucugugcugcccuuugccuaauuuuucuguaaacuuagaaaacaagaaagauuuugaugauacaaugcuuauaaaugaaggguuaaaagaaaaccugauuucaguauugucuugaacaucaaaauuuuuuagcaaaaauaccuuuaucccaauaacuuaaauuuauuuguauuugccaaaauuuuccuuugaaacuccaacuucuucaugggggauaguguugguggugguugugcauagaagggauaugucaguucauuauuuaugauuccaguuacccagguagcuuagccuagguaucuuagcuagaauuuuaucaaacuuuuaauaagaauuucugauuuuuagaaagcuaaucuuucauauccuuccuuuuauauauaggcaaggaacuauuucuguuucaggauaccaaggaaaccuacuuccugccauauuucauuuuuuugauaacauuauugaguuguaauuugcguauacaauuuaucuauuuaaaguguacaauucaaugauuuuuuuguauauuaacagcuaugcaguuaucuccacaaucaauuuuagaacauuuucaucacuguagcaggaaacccuguacuuagcaaucacuucccuccccacucccccaaacccuuggcaaccacuaauuuacuuuuuaucucuguagauuugccuauuuuggacacuuaauauaaauggaaucauauaauauguggucuuuuguuacuggcuucucucacuuaacauauguucaagguucauuguugucgaauguaucaguacuucauuccuuuucauugcugaauaguauuccauuguguggcuaugucacauuuuauuuauccauucaucaauuggacauuggguuguuuccacuuuguggcuauuagaaugaauaaugcugcuaugaauaugcauauacaauuuuuaugugaacacuuguuuuucuuucacuuggauguagaccuaagaguagaauuucugggucauaugguaacucuguauuuagcauuuuagggaacuguuagacuguuuuccaagugccugccuuauuucuuuugcucacaccuuuuuuucagccaggguggacuaauugggugauuggguuggagccagcuucaguuccagaggccuguuuuaggacaauguggagcuguuuaguagccagaguagugggacaguucuggucccuuuuccagcauucauuguucuuguaccgaacugauuuggacagccuagcuaccaauagaaaugcacguaaccuguucugagccaaguaaugaggcugcagcuuuccucuguuguuuccucauagggguucuaucagaguguuggcguuguuguuuaacagugcuuuuccucuccagccaucuucuggggacuaagaaagaauguuguagcccauauugcccugcuuucaagacauaacuccaaggaacucugccuacucauguuaccauccuuuguuuuuuuugccugguaguuuguuauguucguaguauuuggucauucauuuaacaaacauuuucagauccauccauuguuugucagugugcuagauucuuaauauuuaguaauagaucuaacauucaugaucucugcccuuguggacuuuagggucuaguggcagauucauuaauauauccuuggaagauaccuacauuugaaucugcagaaaauuuguaguucaaaucuccucauguacaacggagaucauacugacaaaagccacuuuacugcacuauagcacugaaggcuggggagaaguuuucuccgagaccauacaguggucauugcaauaaugcuguaucugugcugcucugucuagagauagggccuucuggauguaagagaucaccaugaaaacaacaguuuaucaccugcuuccaccacuaacccuuuuuccuccuaacaacauuaaauuccacuauaauuuuauuuauaauauuugugugaggacuuacgcuagguauuucuagcaguguaccuucaguuaccaguguuggaaccacccaacuguagcauaaccccuugggguuuuaaggaaauguggcgaaaauaauaauuuggcugacaguaacuuagaaaauaauauuuccuucaugaauccaguaugucacaaauguagagauuccucaagguuucuguaaaggaguauguccuuuccuucuaccuaaaugagcaugucuuaauuuuguuuguugcuggggaaaggguaccuaucccugcucugucccuucacacacauacacguagcacaagaauauaagugauagcauaugcuggugucacacuguaccuccuuaaggaaacuagaugauuuuaagaccauagacuagaccauaaaaaaaaccauaaaaaaugaggccgaauuagagauacuccccaaauaccuugcauuacacaaagaaaagcuauuagauaaauauuccaauuccugguucucucugucucucugaauguuacagagaacaaucucuguaacauuagaucucuguaacacucuucacacuuucuuucagagauuggaggugauucucccaggcuuuauuauucuucaugaaagucuucucuuuugcagaguacucaaaaauuuaaauagccaucuaaaaacaucucagguaaaaaaucuguccucugcauuugaaaccaaaauuauuuuuucucacuaaaacacauuuuauuuaauagugaggugaaauuacauuagcccucuucacauuuauuugauucaaaccuuuuuuaaaaaacuuagauucuuuuaaaaaaauaaauuaaagaaaaaugacaucauucaucagauagccagcuacauguguaguuugaucauucaguuuaaccguuuuaucacuguugauaugaacauugaguaccuauuauaggccaggcauugaaucuaaauacuagaauaaauacauggauaaaacauguuauaggcugacugucccuuaucugaaguuucagauuuugaacuuucacauuagggaugcucaacuuguguuguuuuauaacaucauacuguauuuccauauguacuuauuauuguaaauaaguauaaaacagugugguaagaguuaucuaggaaguaaaauuuuaccuuaauggagccugggauuuugguaggugaaguggaagaagagcuaguucgaauugacucaaugacagugauacaguaaguuaguaacugacaauugaacucuacuguaauacuaauauauuacuuagaccuuuuuaauaagugcauugguuauuuugugauccuccccuucaaaaaaccaacaagagguuaguaauaaagccuuaacuuuuacuugguuuauuagucacguaacauugauuaacuucuauuaaguuuuuaagaagcuuaacuuuuuauugccagggcuuaacaggacuaucuaaugaaaucugugaaaaaaaaaaaagcugcuuaaauguuaauaaucuugaagugugcuaauuauuuuguuuauuucccaaagggauguccgucgcuugguaguggccaugucuagagccagacuuggacuuuauaucuucgccagaguaucccucuuccaaaacuguuuugaacugacuccagcuuucagucagcucacagcucgcccccuucauuugcauauaauuccaacagaaccuuucccaacuacuagaaagguaggacuucuuucuucauuuuauaaaacagcauuccucagaguggaaauugggauuuucuuauaggugaccacauuagcuuggaacauuauuauagauaauuuagucccuguuuuagagugugcugcacugaggaacugagguagauuuucuauauaaaaaugauaucgguagggcgcaguggcuuaugccuguaaucccagcacuuugggaggcugagguaggaggauugcuugagcccaggaguuugagaccagccugggcaacauagugagaccuugucucuauaaaaaauaaauaaauaaaaauuaaaaauaauaaugucagccaacauuuaguggcuaccauguauuaggcaggcaguucuuuacauacauuaucucauuuucaucucaguaaaaacagccuauuagguuauuagauuauuuuauuaaccccguuuuacaaauggagaaacuuagggucagagaagcuaaguaguuuggccaugcaucuagcagauagaggauccaagaucugaaaagccaggaggucuuuucgaauaacaucccagaguucauguuauuuaucauuauacuguacuguuugucuucagcuuuguaaggagaacuuaacuacuuacuuggaaauagagcaauaaauaguugaguucuuaagaagcuuacauucuggggaaaugagggaggagagagcacauauauuuaaagaaaagauagagaaauacuacucccucuuaucuccccuucuuucuccccuuuuccuagcaccuucccuccauagguaaccaguuucuuuaguuucacguuuauccuuauauuccuuuuguauaaaggagaagagauauguuacuuuuauauuauuuuccuucagguuauuauacuauagacuuuugggcuuugcuuuuucauuuaaugaauuguccuagggggguccauuggauuuuaaauaacauuauuuuagauguucacaguauacgucuucccuccaccccuacuaaaaaaaaacuuaaaucuuguguguuuaauaauaauaaguacuuuauaaaaagugccuuuuuauuuacuuauuuuugaagaaaugcugcuguggagaaauaggaaaaugguggagagagaucauggggugguagggucacauaaagccucaagugucaggcucaagucuagacacaauccuauuauauccgaguuucuugaucuuuugugggcuaguaaacaggcacauuccugacaagaggucugggacagagccuaggugucaucauguguaacaagcuccccacgugcuuucuauguaagggcuacaugucacaccugaagaaaucuggagugcaggucagacaauaucacugaacagaaggcuuggaaacccaugcuuuagauaacacucaugaguucaaggcccuggggagguuagggcugagaacaucuccccaucuucuccucaagagauagugaggggcggagagugcugugucucaaggaaaggcagcucuuggcaagacuccagaaaauaagcuaacaagcaaaaacucuuccauguuccuagucauaauagcauggccguauuuguacauacgaguucugaccauugcagaaaaugaccauuaaucaaaagaauaccugcuuagauggaaugcugccauccugcuuacuucugagaaauguuguuuaauuuacuaaauuauuucuaacuucaugcucuuuaaauaacuuuucacuuugagauugaauccuccuuuuuugggguauguuuuuuaccuuaaugauuuucuaaauuguuccuaucauaagaaaggauaagacuuuauaagcauuuuauuaauaacuauaaauaggaaaguuguuaaucucuauuuuagggugguuuaaaaagaagugcaaauucuguauuuucuugauuugcuuuacuaccuuaccuacacuuauagagcaguguuucuuagauuguugucagaagcuacagaagaaucagcucauuccacccagaccuucugaaucugaaucuauagggcuggagccuagguaccugcaauuuaacagucuaccccagaugauucugauagacaccaaaaucuuaaaaagagcauuugaauauucacccucuugacucauaguauauguguuaaauaaaaguaaauguuagccucuuacuuuuuagaaaaauauaaguaggacaaagaguguuaauauuuucuuucugaauuaucuuaagaacugucuuuggagcauacacagucuuagaaacugcuguuucagacuguguugacuuuucucucuagucaaauaauuacuuaucuuguacuaauucuuuuauauuagauaguaaacuaaaacccauacuuaacuuaccagcccaaaauuauauuaaaagcuggcaacucuuagcucuucuagucucuaaccuuucuaaauuucaauggaaucacuauucuucaugaagucuuuuuuuuuuuuuaaugggagucacguggccagcaggcagagcgugcugaccugggcccccuuuuuauuaauucuauuuaagucuuuuuuuaacauucaugaagucuucauuggacucuucacacuugcauuuuauguccucuuacuguuaggucuuccagacccuaauugugcuuauucauaagauuaagaaauggguuuauguugaaguguuaccuucuaggguuguuuuacuagauacuuaacguucuuuuuuccuucuucuagaauggagagagaccaucucaugaaguacaaauaauaaaaaauaugccccagauggcaaacuuuguauacaacauguacaugcauuugauacagacuacacaucauuaucaucaggugaguuucucaaaaucgacuuuuauuuuucuugcuguagaaauaauuuucuuuuuuucagaauaaaucuuuaaaguaccuaauuccuugugggaaaucagcuaaacuaaagcaggcuauuauuauuuauguaacauucguauuuuuaaaacuucuuuauauaguuagaauuccacauacaauaaaguccacaaacuuaaaguguaaaauuuuauauguucuggcauagguauuuaccugugaagccaucagcacagucaagauaaagagcauauccauuaucccaagaguuuucccuugugcccauuuguaaucccuccuugcccuucaccaguccccuuuuuaccuucccaggcagccaaggaucugcuuucugucaugauagguuugcuucuauuuucuagauuuuuauauaaauggaagcauacaguauguauucuuauuuuuucuggcuacuauugcuuauacaagucuuuguacuuuaucuuggguagauaccuaagaguggaauggcugaauuuauguuaaggauguguuuaacuuuuuaagaagcuaccaaccuguuuuucaaagugguugaaccacuuuacacucucagcagcagugugagaguucuaguugcuacacauccucacccucacuugauaugguacgucuuuuuaaaauuuuggcaguucuaauagauauacaguggucucaguaugguuuugguuuucauuucccuaaggacugaugaugagcaucuuuucauguggucauuugccaucuguauaucuuuggggaugugucugcucagguuuccugcucauuuuuuuauuaggcuguauauuuuauuaaguuuugagagguuuuuauuuauucuggcuacaaguccuuuaucugauauguauuuuacaaauauuuucucccauucuggcuuguuuauuuauuuuguaagugucuuucaaagagcaaaaguuuuaaauuuugaugaaguucaauguaucaaaguguucuuuuaugauucaugcuuuuuauguccuaaaaauacauagccuaacucagagguauaaagguuuuuucuagaaguugcagaguuuuagguuggauacuuagguaugaugcauuuugaguuaauuuuuauaugauacagguaggacugaguuuuauucauuugucuguggauaugcaguuguuugagcaccacuucccuaauaggcgauuuuuuucuuuguugacuugcuugucaucuuagucaaaauaucaauugacuauauaugugagagucugggcuuucuauucuguuccauuauucuguauauccgucccuuugccaugacuguacuaccuugauuauaguagcuuuacagucagucuggaaauuagauaacauaaguccuuuagcuuuguucuucauuuuagaaauugucuuagcuaucccaguuccuuugcuuuucuguauacauuuuacaaucagcaggucaguuucuacccccaaaagcaugcugcaguuuuuaaaaggauauuuugaagaggaggauuguuuaggaucuauuuggggagauuaacaucuucacauauuaagucuuccuauccaugaauaagaucucucguuuauuuagaucuucuuuaaauucucaucaggauuuuguaguuuucaacauacaaaccuuacacauauuuuguuaacauuuugcuaaguauuuuucuuuuucguuuucuuuuuuuuuuuuuuuuuuuuugcugcugucgugcacgguacuuuuuaaaaaucuuaaaggccaggcgcgguggcuuaugccuguaauccuagcacuuugggaggcugagguagguggaucaccugcggucaggaguucgagaccagccuggccaacauggugaaaccccgucucuacuaaaaauacaaaaauuagccaggcauggugguacaugucuguaaucccagcuacuugggaggcugaggcaggagaaucgcuugaaccugggagacggagguugcagugagccaagauggcaccacugcacuccagcuugggcgacagagugggacucugucucagucaaucaaucaaucgaucaaucaauucauucauucaauuuccagcauuguaagcagagucccugaugagaaagucacuagacugccauggggcaaagggcaagcuaagcauauagaguugcuccaguuuucugguugaacggaacagaaaccuuguuccuugcugcucccuucucccauggcuuugccuuaaggccaggcuccucucugccucucacagggcucuuuuucuuuucuuuuucuuuuucuugagacagaaucucucucugucacccaggcuggagugcagugacacaaucucaacucacugcaaccuccaacucacagggucaagugauucuccugccucagcauccugaguagaugggauuacaggcuccugccaccacgcucagcuaauuuuuguguuuuuuaguagagaugggguuucaccauguuggccaggcuagucucgaacuccuggccucaagugauccgccugccuuggccucccaaagugccgggaaugccaccaugagccaccgcacccagcucacagggcucuuugauuaaaguugacccuuucuugaguuaguuuuauaaucaguccugaucagucacuguuuuuugcagaaauguugacagcaaaguauguugcuuaaaaaucuaauagcuuuucaugguuguuuuccucucugaagauuuuauauguauuuugauuaucaguauaugacaucuguguaggcauauuccuugguguuagcagaaccuagaccauugucaucagagguguuacaucuggaguauaaaauggucagcacuguuuuggagaacucuagaaugguaaugugagagcuuagcuuuauaagcuguuuuucauauugguauugucuuuguuuuuuuuuuuuuaauuagacuuuauuacaacuaccaccugcuaugguagaagagggugaggaaguucaaaaucaagaaacagaauuggaaacagaagaagaggccaugacuguucaagcugacaucauacccaguccaacagacaccagcugccgucaagaaacuccagccuuucaaacugacaccacccccagugagacaggagccacuuccacuccagaagccaucccugcuuuaucugagaccaccccuacugugguaggagcuguaucugcaccggcagaagcuaacacaccucaggaugccacaucugccccggaagagaccaaguagccaaacuguaguccuucuaaaggaggacauggcagucaaaaagucugaguaaagcuguuuuuuguauuuuauauuugcuucugccauuuuacugucacuaauuaauguuuaguucuuauauuuguuaacugauuucggugucuugaauauauuuuuuuaaauuauguguaugaacaauucuaguuucauuuguucaaucagaagagcaaauaaccauuccuuucauguuuugaucacugagugugucuguaaucauaccuacauuaaaaucauuuucuaugaauauauaa

SEQ ID NO: 13334 - RNA, 9771 nt, Homo sapiens
cccugggcgcgccagagcgccgcgccugcgcgcucagcccguugccgcgccggcccugcggacgugcgcgcgcugccuucgcggcaccugggccugaggugcgugccucccgggcccucgccagcuccagaugcgugaggaggacuucagaaacccgacugagaaguggagcgacccccagggagggucggaccugccucaauaccgccaaggugccuggggacccaagaacgggggcuccacaaccucaguuccugagcuccuuuugcuuucucacuuccccaccuauugagugcgucucacgcggagcagaaauuugagaggaaggcguagagggauuuuuuuuuguuguugcuguggguuguaucacauguggcguuuucauccuggcugcagccaaagcaguuuuuacccuuacccuuccuuuccuggcgugggauuuugugguuucuggacucggcucgaccauuacgugcuuauuauugguugugggccuuuagaacgaggacugugugucaguguccuuuguccaguguaguccacugggagggagaggugaggguucaaggccaagagaaugggcccggggcgaguggggcagaagcagccgccggagauuauuccccaacugaaaguuguguguguuucucuuaggucuuucauuucuuguucgcuuacuuucgugaaauccucacaucguuuuaaugguacuagucaagacaagaaaaucaacaggcuuucagccuugaggcaacauuggauauuauugaggucaguuuuuacaguuuuuacagucuucacguagaguaucuuguucuugucaggauaaauucuggauugaaccacugagcagaucuacuauucuuuuauuucaguuuaagauaagaaaaauuacagucuuuuuuauuuuuauguuaucaacaaaaaucgguugaaaugggauuuggagcuccaugagugcgugaggugaggaucccuaaccugacucucauaaacaggagauaggaucaccacuugccacuaaugguucuaacaaucuagggcucccaguaagugcuuuuccacguggugggaggcaagugacaacaguuauccaaucuuagugcuaacaauggaugauuaaccguagcuccuuuuugguacaggagcuguagguagccaaucccuguuuuaaucagagguaguuguggugugugauuuuuuucuuuuaggcguguuccacgaaagcauuuauuaaagggaagaagaaacauacaaaaggaauugaaucuggcuuuauaccaaaauccugugugaucauucaguccugacauuggacaauuaccaggcuuugccugacuggccucaagggccaagcuguccucccacaccauacucgauaugggccggugcauugcaguuuucuggaggggguugcagucaaggacuugcccugccccuccugcuagauaugcaaaucccauaacuucuuuccuagccuggguaccuccauuuggaggcccuccuaggaaggaccguggcuaagacacuuuucuccauuuuugacccagcuucuuucacuccuagaccuuccccucccuuuccuauucugaaguuccauaagaggcaggagauuuuuguuaggggcuccuuucagugagaggauuaccucauaugcacugcaucaacugacccucacccaguguccuuguauuuaguagaccacuggggagccagugccucuuuuuaccacuugcuugcacugucacaguaagugaauaaaggcuugauuacuuuugguuugacucauuguccugauugacuaccuuggcaccuaauugcugccaaguucuuugcaguucacuggauucaugacuuaauuuuaauuaucaugacuguugcucuguaucggcauguuuagagacuuuggagcuuguucaccucuaauuucucuaauucaagcuacugaaaaugcauauucauagcaccaagaguugauuguugguuaacauugauaucuggguuauaugauauauuuuacuacuauacuggcuuacagucagauuguuuuauuuugcguggauuuauguggcauuuuccauuuggccuguaauuagaugauuuuuauuuaaaauaaauauuuuggaauaauaugggucaagugaagaaaaccagacacuugcuuucuuuaguaaucuugucucauacuaugggccccuaucuuucucaccuuaauagaucacuuggccacuuugaauaaaguggucgauuuguuguagguuccuuugucuaguaugaagaggcauguuaagaacagcuuucauaaacuuuuuuacuucuuccuacagaaguuucacaaaacaauauuuauccuugcuauauaguaugcagucugauacuuucuacuauuauuuauccccuauuuuuauuuauguauuuauuuuuaaauuuuuuuugagagucuugcucugucucccaggcuggagugugguggugcaaucuuggcggcucacugcaaccuccgucuccuggguucaagcaauucuccugacucagccucccaaguagcugaaauuacaggcauguaccaccacacucagcuaauuuuuguauuuuuaguagagacaggguuucaccauguuggccaggcuagccucgaacuccugaccucaggugauccccugccucggccucacaaagugcugggauuacaggcaugagccacuaugccagccuccgcucuuauuuuaaauaacaaagugcugaucaugaucugcuaaguugaauucacaauccauuaaugaguaauauccugcaguuugaaaaacacugugauaaaguaacuaaagauauuuguucaguaauuuuuuuuuucuguuucugauucacauugcuaaagaaccacaguggguauguuugugauuugggguugaagguaucuucuaggagaaaauaguaacaccguguuuguuggauguuugccagaucagcugacaaaagaacuccagacuuagaacucucugaucuagaagauacauuauauugaaagagcuagcacagcuuuuaauuuuuuuuugaaaaaaucucugacuccuuuauuuaagggcagugccauaguaaaguaauaaugaaaagaaaauuggcuucucugauagaagauagaguauaagauaguuaugaaagugcuugcuaaacuuuuuuuuuuuuuuuuuuuugagacagucucucgcucuguugcccaagcuggagugcaguggugcaaucuuggcucagugcaaccuccgccuccccaguucaagcaauuaucgugcugcagccucccaaguagcuggaauuaacauaugugcacuaccacgccuggcuaauuuuuguauuuuuagucgagacgggguuuugccacguuguucaggcaggucuuaaacuccuggccucaugugaucucccugccuuggccucccaaagugcugggauuacaggugugagccacugcacugggccaguuuuuuaaaucuuuauauuaacgcuuaagaccaaaaugacccuuuuacuauauugccugaugggcaaagcacacucaaguuucaauuacuuagucauagauagcuauauaaguaaccaauuugucgaucuuauuaccucuaugcuugucuuuugggaauuucacaacaaagugaaaaggagaauuuuuuuuuuuuuuuugagauggauucucacccaggcuggauugcaauggcacgaucucggcucacuguaaccuuugccuccuggguucaagugauucuccugccucagccuccugaguagcugggauuacaggugugcacuaccacacccggcuaauuuuuguauuauuacuagaggcgggguuucaccauguuggccaggcuggucucaaaauuccugaccucaggugauccaccagccucagccucccaaagugcgggauuacaggcgugagccacggcgccaggugagaaauuuuuaaaaccuguaaauuuagucaguggguuuaucucuuauugagaaacgcuuaaaaauguuacuaagacgauaaggauaacauuuuaaaauuugauuaguguugagcuaaauaguuccuuagauuuauguauugcuucacuguuuuuuagcacauucauauacauuaucuccauugauuuuugacaacagcuuguggugguagacaauccaggagaccuuuuccccauuuuacagaugagaacucuguauuuccuucuuccuaccaccaagaucguauaguggcaaauccaggacuagaacccaggucuucugugaauuuucuccuaguccacacuguccuuguuggucuaaagaaguaauugagaauaacucauguuaaauuuguggcuaagaaauccaccuaugauaagugaaauguucuauucuaagagcauauuuacaaugugcuauaauugaaugcaaguauaucuuauuuuuaguauuauguuuugauuuguuaccuuucuagcccauuuuuuaaaaugauggcaacuaaauacuggcaaaucuaccuaauaaugaaauaggaaaauuggaauuaaaauaucuauuucauguuaagaaauucagccuaguccucauuuaauguagcaucucaauuagaaaaauagcuuaaaauuguauugauuuuuagauauuucuuuuaaagacucauaucucuguauguauaaaauuaguauuauuauucuaaaguauuacuuaaaaugauuauuaacuuguaaacacuaaguccagauucuccuuugccuuuaauaucuucagccaaagaacaacuuaaguuacuuuucauaugaauaaauaauuuuaaaauuaauacuuuuuuuccuuuaauuuuuagacaucuguggaauuuaagaacaguauggagcucaucagaguauaucauugaagaauaugauggcugaaaacaauuuaaaaaugcuaaagauucaacagugugugguagccaacaaacuaccuagaaacaggccauauguuugcaauauuuguuuuaagcacuuugaaacaccaucaaaauuagcuaggcacuaucucauucauacuggucaaaagccauuugaaugugaugugugucauaaaaccuuuagacaacuaguucaucuggagaggcaucaacuaacucauagucugccuuuuaaauguaguauuugucagcgucacuuuaaaaaucugaagacauuugugaagcaccaacaacuucacaaugaaaccuaucagaauaauguuaaacaggucagaagauugcuggaggccaagcaagaaaagucaauguauggaguguauaauacuuuuaccacagaggaaagaugggcauuacacccgugcucuaagucugaucccauguauagcaugaaaagaagaaagaauauucaugcauguacaaucuguggcaagauguuuccaucacagucaaaacuugauaggcauguacuuauucauacuggucagaggccuuuuaaaugugucuuguguacuaaaucuuuucgacagucaacucacuuaaaaauccaccaacuuacacauucagaagaaagaccuuuucaauguuguuuuugucaaaaaggauuuaagauucaaagcaaacuucugaagcauaaacaaauccauacuaggaauaaggcuuuucgggcucuuuuauuaaagaagaggcguacagaaucucgcccccugccuaauaaguuaaaugcaaaucagggugguuuugaaaauggugagauuggugaaucugaggagaauaauccacuugauguccacucaauuuauauugucccuuuucaauguccaaagugugaaaaguguuuugaaucagagcagauucucaaugaacacagcuguuuugcugcuagaaguggcaaaauuccaagcagguucaaaagaagcuacaacuauaaaaccauuguuaaaaaaaucuuggccaagcuuaagcgugcuaggaguaaaaaauuagauaacuuucaaucugagaaaaaaguauuuaaaaagaguuucuugagaaauugugaucuuauuucuggugagcagagcucugaacaaacccagagaacauuuguggguucucuuggcaaacauggaacauauaaaacaauuggcaauagaaagaagaaaacauugacuuugccauuuucuuggcaaaauaugggaaaaaauuugaaaggcauccuuacgacagaaaacauauuaagcauugauaauucagugaauaagaaagacuugucaaucugugguucaucaggugaggaauucuuuaauaacugugagguacuucagugugguuuuucaguuccaagggaaaacauacguacuagacauaagauauguccuugugacaaaugugagaagguauuuccuucuauauccaaacuaaaaagacacuauuuaauucauacuggacagaggcccuuuggcuguaauauuugugggaaaucuuuuagacagucagcucacuuaaaaagacaugaacagacucauaaugaaaagaguccuuaugcaucucuuugccaaguagaauuuggaaacuucaacaaucuuucuaaucauucagguaauaauguuaacuauaaugcuucccaacaaugucaggcuccugguguucaaaaauacgaggucucagagucagaucaaaugucaggaguuaaggcagagucacaggauuuuauuccugguagcaccgggcaacccugucuuccuaauguacuuuuggaaucagagcaaagcaauccuuuuugcaguuauucagagcaucaggagaaaaaugaugucuuccuguaccgaugcaguguuugugcuaaaaguuuccgaucuccaucuaaacuggaaagacacuaccuaauucaugcagggcagaaaccauuugaaugcucaguuuguggcaaaacauucagacaggcuccucacuggaagagacaucagcuuacucacuuuaaagaacgaccacaagggaaagugguugccuuagauucgguuauguaaauugucgcaaccacuaacaauuguggucucuggugaucuuauuuuuaaagccuguauuauuuaaaaugcauuuuuauugaaaggccugcauuaaacugaaugguuucacaggcauuugcuuguccugcauaguaaggagguagaauacauagaaaauuaauacaauguuuuagaaacagccaaguuaauuuuagaggcaagaacaugauuugaugcuauaaaguaggcauuuuaauauuguaaacauauacuuuggcuguauugaaaaauauaaauccaugauggcuguacaaauaauuuagccucauucauuuuuuaaaggaauuauuccuuaagacaugccaucucuuuuuagauauacucaaaagacugagaggcaaaacuuggcuuuuagcugcagcacauagcccuguuauauuugauuuauuuuacauuucauaugaaagcauaauuuuguccacaugugacucaaauugcauugguaauuuuuuuuuuuuuuuuguaaguuaaaaaaacuacagagacacuaaaggugaaaauggaugagacaauuauaguauuauuuucauuggucuuuuuuuuugagauggagucucacucuuucgccaggcuagagugcaguggcgccaucuaggcucacugcaaccuccgcaucccagauuccagcgauucuccugccucagccuccugaguagcugggauuacaggugccugccaucacgccuggcuaauuuuuguauuuuuaguagagacggggguucaccaaguuggccaggauggucucgaucucuugaccuugugacucacccgcaucggccucccaaagugcugggauuacaggcaugagccaccgcacccgacggucuuuucaaagcuauuuauuuuuaggacuaugugguaauuucaccuucaggugauaaggauuuuuuuuuucucccagcuagugcuaucuuucucaaaauaauuuaaaaguaggcgagaggcuaggauguaccuauauuuaccauguuuacuuaccaggaauauuuucuaagugccauagucuuuuucauaauacguaugaguuuuaccuuuucagaggaauaauuucaagucauuuauuugcucauuaaugauagcaguagucauagacuuaagacuauucuagagaucuucaucuccauaagacuuuuacauuuauuuuaguaaacuuuucuuucuaugccucuuuaauggagugguucuguuauuuaagccuguucuaaguuugaucaaauggcaaugacuaggucuaguuuuaguuuuuauuuuugcaggagucuauugcuaaagaauuuuauuuugaugcuuguuaaauuuuuauuuuaauuaauaagguagucauuccuguagagggauaagaugcuuguagaguuguggguaucauuccaaauagaacuguuaugauuugggaaauauucuuuacuacaaaggacuuauuucauaauuacaaauuuuccuucauauuugccuuuguuuauaaaaucuucaggaaugacauucucuagcaauaaaaggaaugaaccguuauguuucuaagcugaaaagaggaacagguggguaauuauccugccauacuuaaauauaguggaaaauccucuauugagaauguggauaaaugaacaauuguaaguuuugcaucauaaacugagaacuuucuuuugacaggggggaggcgggagggauaguaggugggggugaucugcuugcuucuuuuaccacaggugauuuuuaaguaacuuggguuuaauuuacagagaugaaacaugacagucugaguaaaauacccagugauguagaagugugccuguuuauuauguagauacagacauccagcaaaaacaggagaaucacaugcuuuaaagaacacuuucucuuagguuuccuugagauauguuccuccagugcaagcaagauaaugguuuacagaauuugcuuuacacaaaacuugucaagaacucaucuguuaaaagcaaggaauaacuaguuuauauuuuccaauaauguucaagguuuucuccuuaauauguuugaaauuauugauuuuggcauuuuucuaagcaauuuauguaauuuuauuugaagaaaauguuuuguauaauguuuuucccagccuaaacagggagaguccuaacaguguugugcuuguaugauucugagacuuuauuugcguaagugauacuacuauacuuuauuuuugacccaugccuuuuuaagcuguuucauauugaaagguggaauauuguaaaaauuuugucaaagauguacuguagugcuauuugaaguaccuguaacaaaacaguuggcccucuguauccauguacucugcaucuguggauuaaaccaauugcagaucaaaaauauuagaaaaaauaaaaauaauacaaauaaaaauacaguauaacaguuauuuaaauagcauuuacauugcauuagguauuagucuagggauaaaguauacaggcggaugugcguugguuauauacaaauaugucauuuuauguaagggacuugaguauacuuggauuuuugguaucuguggguuggggggacgguccaggaaccaauaccccauggauaccaagggacaacuguacuuauuuaccuuuauugucauugcaagcuucuuauggaaacuuuauaggaaugaaaauauacauguuaagaagauuaaacauuagauaguagaugguuuguugcaugcuagaacuguuaguauuguugaaucaauuacuuugguuucaugaaaaaauaaacgauaaauaucuuuaaagagaacuagaa

SEQ ID NO: 13335 - RNA, 1183 nt, Homo sapiens
uucauuuaaaaaaaaaaaaaaacuuacuucuaguucauuuucccaucacucccggcuccugccuaacugggucuugccggggacguuuggcauggcgcucuagcuuuuguuccuuuuaauuccgcggccucccucuccucugcccgccgauuacagcaccccgaaggcuuccugcuaacguccaagggcagcaagcucugcagacgguaccacugccgggcuaaauuuuuuauuaaguggcacuuucuuuucugcgcagauccagcaaccuugucaauacucauuuuuuuccaggaccagaagagaccagcuuaacucagagcacacucccuccaagcggugcggacaaggggccaccccgagagucuuugggggccgcggcggaaucgggagggaggaagugaggaggcagucaucuggguccgauguagccaaaggcgugugugugugugugugugugugugugugugugugugugugcgcgcgcgcgcccgcgcgcccgugcgcgcgcgcgacuagugugcgucuccaaaguggaucucacucagagcugggaagcacaggaggaaaagacggagagagugggggagaaagaaguugccgggcgaggaggaguggccggcgcucacagcccagcuuuguuguggucgcccgaggcgcagcggcgggccgcgguaacgccugcuaauggcuguguuaauuacacaggggcgauuucgcggggucagggagauggggccagcuccgaaagaacuuuuccaaaaaggaaaaggaaacgaagggaacuaccccacaccguuuggguggaaacuaguuguggccggugcccuguccucccuggcccgagcugcaccaggcuucaccucugcgcggcugguuucccggcggccgcgcgucaaucacuacgagcccggaguugggggcggagccacggucaccccgcgcaagccuugccgcccagcagcccccaugccccucggccccuuguggcgcggccgggcggacaggcgcuggaagcgcguccucuccccaacuucucgcucucgcccucccagucccuggcccagagaguggaaagcggacuguuguucuccaacagccgcaucccuccccaacuuugaacccauucugagaaguggagaguagugucuuccgcgagccgcgucuaaccgacuuucccgcg

SEQ ID NO: 13336 - RNA, 1183 nt, Homo sapiens
cgcgggaaagucgguuagacgcggcucgcggaagacacuacucuccacuucucagaauggguucaaaguuggggagggaugcggcuguuggagaacaacaguccgcuuuccacucucugggccagggacugggagggcgagagcgagaaguuggggagaggacgcgcuuccagcgccuguccgcccggccgcgccacaaggggccgaggggcaugggggcugcugggcggcaaggcuugcgcggggugaccguggcuccgcccccaacuccgggcucguagugauugacgcgcggccgccgggaaaccagccgcgcagaggugaagccuggugcagcucgggccagggaggacagggcaccggccacaacuaguuuccacccaaacggugugggguaguucccuucguuuccuuuuccuuuuuggaaaaguucuuucggagcuggccccaucucccugaccccgcgaaaucgccccuguguaauuaacacagccauuagcaggcguuaccgcggcccgccgcugcgccucgggcgaccacaacaaagcugggcugugagcgccggccacuccuccucgcccggcaacuucuuucucccccacucucuccgucuuuuccuccugugcuucccagcucugagugagauccacuuuggagacgcacacuagucgcgcgcgcgcacgggcgcgcgggcgcgcgcgcgcacacacacacacacacacacacacacacacacacacacacgccuuuggcuacaucggacccagaugacugccuccucacuuccucccucccgauuccgccgcggcccccaaagacucucgggguggccccuuguccgcaccgcuuggagggagugugcucugaguuaagcuggucucuucugguccuggaaaaaaaugaguauugacaagguugcuggaucugcgcagaaaagaaagugccacuuaauaaaaaauuuagcccggcagugguaccgucugcagagcuugcugcccuuggacguuagcaggaagccuucggggugcuguaaucggcgggcagaggagagggaggccgcggaauuaaaaggaacaaaagcuagagcgccaugccaaacguccccggcaagacccaguuaggcaggagccgggagugaugggaaaaugaacuagaaguaaguuuuuuuuuuuuuuuaaaugaa

SEQ ID NO: 13337 - RNA, 1072 nt, Homo sapiens
gagaaaauucugcuaguuguuuuaggaauauuguauucaggaauauugaaagauguaauauuucauuuaucugguaugaagggguauucuacuuaagcaaauuuucuagacaauuggagcugaccuuuaaccaccaauaauuuuauguuaaacauuuugauggaacucucucuaaaucauauuucauaccauuuugaauauauguuucuuuaugccuucuuaaacagauuauauugaauauaauuugaccuuuucuugaaaauguaggagcuucgugaauaccaauuuuacuuugcuaucacagugauucccucaggaugaauaucuacucagguauuugaaucuuaaauuuuuauucaauuuaacaaguauuuucaagcaaccauuauguguuggauacuguuagaugcucuuucucauaaugcuugucucucuucuaucucuuauuagacagugguauacuagcaugugacagucuucauucuaaucuaccaaugguacuaggaaaccagauacaucaagcuaauccaaauuguuaaagggaaaaggcaguaaauaagagaucugccacaucucuuuuacauaaucaaauuucuauuucuuaauaccacaaggcuguugauuuuuaauaauggaaaguugagauuauuaauuaccuuuaaacaaguaagucauaacauuagaauugagaaauacagucaaagacauuaguuugcugacuuguguguguguguguaugugugcacacgcauauacaaggcucuccuugucuagacuuuucccucugcccgaauagcuaaauagggcucccaauuuuauaggaaguuuaccugaagauauuuuacuuacuuuuuacugaauaaucuugcugucuuuuggguaggaguacccuggaagaagaaaggauauugauaaauaagcaauuucuggaggcuauuaucaucauccaauaauauuuagugagccauuaguuauauguuauuuagauaacuuuaacaaauucuuuuuauaugcauaagcacauauaauuuucaggccaaaauuuuaaaauauguuuauuauuauuguuauu

SEQ ID NO: 13338 - RNA, 4099 nt, Homo sapiens
uuuuucccaggagugaggagggggaggaaaaaacuggucuuuguugugaagccacggucccaaacuugaaccuagaggaauguuaaagcucugaaaaaaaguuagggagcagccuugcaauuaugcacucagucacaacaagaggguaagaacuuucaaggcacuggauugaagagacacaaaagucaggaaaugacccuuucgucgggauuucagaggccgcagaggagaaacaaaguccucucacaacucgggaaacuucggaccguaccaucccgagggggcaagggugggggaggccgggagagggcaguggaaauugacaucuucguucucaacaagccgugaguaaacugaggauuucccggcugaaaggacucagugucugccuguccccggcccagaaaugaaagcgaguuucagccgauccucauuguggggccugcugaaaaagcagcccgggucgccccggccagccccggcguccugaaucggagcccugugcgcgccaggccgggccgcgcgcccggguugcaggauggcgugcccaggccagcccaucugcggccgcgggccggcggggaggaagcgucccuggggaugaauggggcuuuguucguaggcagccgcggcuacccucugcaggcccggcccgcacaacagaggcuguaugcgagaggaauggaaaugagccucaggcccugccgaaggagccccauccccuuccccgcgcggggcugaggaaugcuggccagccggaaaggaacccucgcugggaacgccgcucucgcgccucugaaaccccauugagaagaacccuuugaugcaauuaaagcgcauuucauugcaggccugggaggagggaacgaccggcaagcuuuuuucugucucggacguguguaugcaccuuugugggccggguuacuuagagaccaggcgggaacuugagcucccucucucgcagacguucuguaacaucagaaaagcguacccauaaacagauugguuuucaccagggguggaacucaauuuggacacgauccaggcugaccugcaggccgggguuccuacuuugaaaggcucuuuggugcgccuuacacccaccuucccugcuguaaagguuuaggcggaaaagaaauugcguuugcaggaggaaguuguuucugagguuacugcucagcauuuuccauuuucucagugguggggugggccgugucgcauauccagaagugaugucacagccagaccugcaaaaugauguaaccugcaaguguugaaggacgacgaugggacagcuauuuugauacucguauuauuuuauaacauuucccugcuuuuuccauugagacaacugugugaccucagaaaauccacauagccucucugaacuuaguauuuuuguguguguguuaaaaugaguaucacaaagccggagaacgaaugugaugaaguucugggugcuuguggaauucuuucuaaguuggagguggacacuuuaucuaccugcacagguggaagauaugugggucuggaacuccgguaaacaaaaagauccuauugggaccucuauuugguugacuuugugucacuuuuuacuagggcuaauugucuaaugucucuuuccacuaguguaugccuccuugagaacaugaaccuuuaaacaacaacaacaacaauaacaacacgaagacaaaguccugucugcucucccaggcuagagugcagcgugcaaucgugcaaucgcagccuacaguaagguagaauuccuggccucaagcuauccuccugccccaccguggccuccugaagggcuccgauuacaggagggagccacugcacccagccaaaccugucuuuuauucuguaucuccugugcccagagcagucccuggcccugauaaggguucaacaaauauguugagugaaugaacaaauacauucaggaguguagggauugauacuaacuuguuggcuguuuucuguuccuuauaaaucuaaauaagaaauagggagagcaugguagguauuugggguccucggcgaggcguaaguucaggagaaguuugaaggaaaggguaggaaaacauuuuugagagcacaaacaugcuacaaguguuuccugaaaugccccaaagaagagugcagcacucagguggaggagucauuuuuuccaacugaguggaugguuaauacuggcaaacaugaaucauguuuuauauucauaaggagugugccuagucaaucacugauucuuuaaacaccccagagaagcagggcgggaagaguaauggccaugcaugauggacaucauuguuucuuauacguugcucuaaauguguccccaugguucuuguuauuuugggccugguuuagacuucuauuugguuguuuuccucugaggucuggaauacacgaauauguuuuccacucagaaaauccaauacacuuuugcaucccaaucaggaaguugauaaacaugagauaguagaguacuugcuaccuuaaauauaccuccacaugucugcaggaaauaccauucaaguaaugccuagguaagcaaaugccugcuccugucuuuuucccucacucuuacaccacacacacacacacacacacacacacacugaucagauggugaguaauauaaagucuguuuaaagaugggaccuccauaauuccuuguuugugucaggggcaauaugcgaaacacacggcugcccacaacauuguuucuuguccuguggguccguuuggcuuuuugucuugaugugggcaucaacccugagaguggagacuguuuuucagacugucccauucgugucuauuuaaccaggugaguacaacccacuuaaaaaucucacaugugaggugauuccaggauagaacaaaaguuguacaacaguaacaguugugguuucccucccuuuacagaacuagugaguuuucaucaaaucauuggguauuucuguuucuuucugauuuacaauaugcuuuuguagagcaccuuuauccucauuucagauuggucauuacuaggcagugacuugagucgaucuaccugacacuagcaaauaaucaaugauucagaagggauuagugaaagcaaggaucaaagguucuugucugauuaccuccauaaagucaaaaaucucaagugaucauguuuuauaaauuuugauuaacuuguuuuuuuaaaaagacuauaccuauuuaucuggaaauacaauucauuagcaccuuuuaucuuaaaaaccuagaacuccacaugcuugagaauuguggaugaggaugaaguuugcagagacaggucccagaagagaaaaaaacaaggauggucauuccguacugccaauuaagaaauaaccucagagagguaaaguggcuugucuguugucacaaacgguggaauuagaguuggaucucuauucuccugauuuccaagacuguccucaaggccucuagugcuuuaaugccaaggaagccugcuauuuagauagagaccagacucugcaucccaagggacauaagaaagcugccucgucugauuugauaagauugagauagccauauugcauacugcuuuuccauuuuuggaagguauacauuauuagcucaacuucccuuuucuucugccuuauuuguccagaagccagaaacgugaagagaagaccucgccuugauuugccagaugaccccuggccuuuuuagucaaguuccuggagaaguuaggguggagacuuauuuguccuguguuuggggcaauaaaaggggaggggccgccuccuccagccuguucuaaaaagccaaaaagcaaggcuauuuacucagaccugggcuacuaagugcugggguggcccauguugacuuaaaugagcccuugcaguuagguggggcucucuggagcuguuagucaugugagguugccagggcaacuuaaugucuuaugaguuggaaugcuucaagaaguacaaagaggagacugcaagagugcauuacaacuuacagucauauguucaauaacaugucaucuuuccuaauggggcuuuuauuuuuauuuuauuuugugggauugaaagaucagaagccggaaauuaucugg

SEQ ID NO: 13339 - RNA, 104317 nt, Homo sapiens
accccgcucggcagccccaccccgcgcccgcucuggccuccggggaaagcgggcggccgggagaagucgcgagggacuacuucgccuccuucucucgcgggcgcccccgguucgggcagcggcugcggcggcggaaggagcgggcggcgugagcgcuuccgccgccccccucgcggcuccccucucucgggcgugaggagcuggcccgcugagcugcuggugggcacuggcuggcggggaaccugcagccgcucuuguccucucccgccgcuucucgggauccugccccccggacccgggcccgcccgcucuucuccggccgggugggaacgaucgguuugccugccccucgccucacacgcuccccgccgcccccuccaccccccugaggaggagucccggcuggagcgugucuggaggaauccgccgccgcggggccccuagcccugcucugccggcgccugaggaccgacccagacgccgccggggguugaggggcagccggcggcgaggcgggagaugguggggugggcuccggcaggaccgcgccgccgcugcccggagccugggcucggcacccccccgccggcccccaccgagcggagcucugcuuccuccucgccgcaucccugagggaagcgccgccucugcucccggguucuccgcccgccgacuccuuccuggccggaccccgcugcgcuccaccccaguggcuggaggagcagcucuccagucagccuuugcagccccucucuuuuucccuuuccaccgggccuccucggaucccuuggcugggcacugaggcgggggaagaggcuggggucgccacggcggagguugcugccgccaccccccugcggggguggccgggguucccggcuggggggguaccguucugggugaggcauccaccauggugaggccccugugccgcugcccccgcgcccccccggccgccgcugccuccugccccucggugcugcuguugcucccccgccugcuguugcuccuccaucuccagaucggaucacggugagggaaagaugagcgaggagacggcgacuucugacaacgaguaagcgccucauugaucucgauugcuaaucccccucccccuauccgcccucggcucucccccagacccauccgaaacuugggugccggaaagcuugcgacccuggagaguucggugcaucuucuggagauagcugauuucuuuagccauuuuuaguggcagcaccccuccccauccucccacauuuagcugcuuucuuuugggguaggggauuaaguguugggagaggauggcaauuguacgucuaugagagggaauaauguggauggauggaaguggaguagaaacuaccccuuugccugugagaccccugucccguccuuuuucacucacauaccagucaccauaccuucaguauccauccuacuuccuuuauagcuguuucacuuggaaacuaaugugugggagcaccuccugcagcaaacugcucuugaaucuuaauucgaugagucagugacucuuaaauaccgauuaagccuucacccucuccccccucccccuuuuaaacuuaugaccuguaagauucuuguaaaaaauaggguuagggaaacauuuuuagaauuuaauaggauuaaggacaccuggagugugggcgauguugagcuagaguuuaccuuugugaauauuggacgugucuucaggaacggagaagaauuuugaaugcuaauuuuuaccuuucagcuaugugaaaacacaugauuuacguugauguaaccgaauuuacauugcugaauauguuggugauuucauuaacuuuuagagcauuccgguuuaaguuuuagcuuauuugggcuuucuccuugcuuuccaaacgaaauacuucgucuuuuaaauguuuugcuuuaacgugacagcugcguggagaaauaaugguuggcaacacuuuucuauugagaagggauuuaauuccaagcagaauauuagcauccguuuucuuguaauuaaguucaacuuuuguuuaucuucggaggguuggaaagaguuaagugaguuaggacuuagucauuuggaugcauuccuuuaaauacagugcauuacuaaagucagaccuuuuugaaauaacuuuuuaaagucuguaccgaguccuguuuaacguaaaauagcuagagaaaggccaaacaacauuuccuccucccuuacucccuccccaccccaaaacacacgcuucugcugagcggguguagaaggagguacauugcugcagugucagugcaguguagaagcagaaguggcagccauguucugucucuuuuugugaaucgcccucauuugcauagcacacucuucauucauaaaaaaaauaauuaaacauccaucaccuuggacaucuugaaaggauuucccaagaaaaaaaauucgcggcuuauuugucuguguguagauuuuugaguucagaagguaagaagaaugugaaauuuuagguuaaauuuaaaaacauacgcacacacaaacaacuaccccuguucugagaauguugacacaguuaugugggaaauaucaguucggggaggugcugggaucacgugaucgccuccauucauaaaauaccuggcuguccauucagagugcaguacagucucucccugccuucugcagauuagaccuacuuugagggagaucaagaagucuaucucagauaaugguuauuuaggagaagaacugcuaaaaaugcugaaccgaaugacgguaacuuuuauugguaucuuucaaaaaguuuggauuaaaaauguuaaguuuucuuuuagagaugggaaaagacuucuuaccaguuuaauuuuuuucuuaaagcagugaauaucuccuuguuuccuucugguugcagcuaauaaaaaaagcagaugauggaaugugaauuaacacaaguaaaauauauuuuuucuaaauggccauuuuuuuaaauacuugccauaaauaaauugagacaacagguuuuuuuguauagugauagugcguuccacugcuauuacaguaaauugagaaaauacucccagugauuuaauccccaagauguugauauuugaaacaccgauggcaaucuucagugagaggauugcuuuaaauauuuuuuuuucaucuaaauguacuuaguaugggacaacuuggaaauuaucucacucacccagacuuuuaaaaucguuuuuucacaaauuuauccugcuuuauuaauaaauuauucccuaggagcuuuguaauacuuuuuaaguuugggcagggcgauaauaauauuuagcauaauauuuugguaaacucuucaugggaacaaaaucuuggggguuuuacuuuaaaaaacucuauuauauuagaaaauaauguguucaucugauaaucaguuuuacuagagccagcauuguuugcuugugcauuagauaaaccacagagugaacuuauuuggaauguagcuuuuaauauaguaauuuaugucucaucuuuaauaggugaaccguuuugaaauggaaauuuauuauuuauagucauuaugaagaaagauacguaucauggcagaagccauuaaggccuuagcacaguuuaaaacugcccuguaacauggauuuuauuugggccuuacauuuuuuucccuuuucucuuuuuuaaagccauugcucauagggauuuaauuacaguagggacuauuuuuaacauucuuuaguuucuuuuucaccugauuucaaccuucaagaaaagugaaaaucaccaguuuccugggaaaccauuaacccuuucuagauagccauugugguaaaauccaguagggccucauucugaaauccucgaguacaugcuuauuauuugaaauuaaaguuuuauguagagaaauggauaacuccuaggcugacugugagaauauauuuaaucaagaauuagugggggaucuguuauguguagggcuuugcuuuaaugccaaaccaaguaaggaagaaauaaauuagaauaaagcauuucuuagauuguuucacauuuauguuuaaaaaucuuacuuuucaaaaauaguaaacauacucuagagcaaaagaauuuguguuauaaauaguagaggaaauagccacauacauguuuguuuuguagguaauuugcacagagacuguuuaauacuccagucaaauguuuccgauagauauaacuguaccauauuuuacauuauugaauuagccuucuaaauagaguuuuaaacauuuaaaggcauauuauauaauacuuaagagucuuuguccuuugguauugaguguauauagcacugcauguccuuuugucaauuuggccaaaacauuuggagaagugaaguagcugaaauaauaagcauuuggcuuauuagguucacguuagccagaaacacuuccugugucaguauuaggcuuucuaauagcaaguugggauuauauuagauuuuggaauuagguuaacuagaauuagaccauguaugauaaacguacuauguuguaaucugaguuugaacuguuuuuccguaaauagaaagcaaauuuuuaugguuauaucauuuagugccucauaaaaaauauacccaguggugaguuauuuuugauaaguguaaauaaacauauguucaccccauacauuuuacguauguauauguauguacacacacacacauauauauauauauaaaauuggaaaacauucuagaaauaaauggaagcacuggaaagcuguguaauauuaagccaucuaauguuuguuuauauagaugugguguauacauaauauaaaaauuugcuuauuauucaguuggccuguguaaaaaucagcuaaaugacugcauacuugcuucaacuuaauuucccucugcuuucucacuuaaaacuuuaugauccugaauuauauauuuuaaacacauuaugauaccauaccuagaauuccucuccuuacaaacuuuuguaaauuugucauuuuuccccaaaagaccuucucucuuccccucuuucaacacucugucccucuauguugccucuguacuucguacauauguauauuaguuuuaaaaucauauaauauugugauuauuuacuuauuucuaugaccgcuauucuguaauucccuacuuuuguuuguaugccuagcacagugcuugauggcaaaugcucuacaaaugugguugaauuaauggagccucauuaccucauuuuuuuguuuucucugaauuuaugcauuugagaucauuagcuguauuagaaaaaaaggccgaaaaagaguaugggaaaaguaaauuauuacccguuuaagaaggcuuaccuuuuuuuuuaagaaaagacaaaaauuggccucauuuuugacauguuuuguuucugcaaguuugagaaauaacuuagaucaggcuuaaaaacuguccuaaagugcuguugggauguuuggaugugcuuggccucugaguuaugugguguaucugaagacccguguuauauccacaagaagguagacauuugugugucugucuuuuuuggcauaggaagcucaaaauuuaggaauauguaucuccagcuguuuaucaguuuuaagucuuuaaauugcucucccuuucccccaugguuccacauuagugccaagggugaggaacugacuagggauaaagaagugaaauugaucaggaaaggguaaacagcagcagauuccgugauuuuauacugcagcuguuggugacugagaacugccuaaggggaaaguguaacaauuuagccuuuucucugguguuguauaacuugaacuugacuagucuuacccaguuuggggaaaugauugguaaagacaagccugcuuuucuucuccaucuuucaguaggaacaggaacgacauuaaaaaugccaauuuaaaaaaugcuucaccccauguaagaguaguaguuuauuucagauaauguacaaaaugaucucuaaagugaguaauaauuuauuugcaauucugccauuaaauaacagcugcuaaaauuuuggucuacauggaaaccuuucuuaugauguuggugaugaaacauauucauuuauuagauuuuuacuguaugccaagcacuguuauaaaugcuuuaugaaagcauuauguaguuuauauauauacauguguuucuucucaguggaauggaauugcacaguggguacaauuguagcuuaaugugaauauuuucuuaagucguuaaauauucuagaauauaauuuuuaguggcuacauuauguucaguguaugauauacauuaguuguaaucagucuccuauuguuggauauuuuaguuauuuuuaaacaauguugcauaccauccugaguucugucuccauccagaucucuuacuuuucccuugagauagucuaagaauggaguuaaaagagaggaaaauauuuaauuuuauucuuucuguuaaauugcccucuagaaaagaaguauuuaguauaugagagugcuuaaacuuugaaaugucuguacaguugucugaauuuuucuuugccaauuuugaagguagaaaaugaagucuuauuuuuuaaaugcuuuaugguaaaauaaaauugauuuaaaaacuuauuagguuguuuugcgguaacuagaauguuuuuaaaugcuauauuauaaauagaauuuaagugcucauguaaaagccauuuguacaucauuuauuuaacucuuaccaucuucugugcaguaugguauagucuaaagaacacuggacuugaaauugggagauggauuucuuuuguagcuauuuuuaauuuauucucuaauccugggcucuguaggccucaguuugcugauuuauaaauuaaagaauuuggacuaagcaucauaugugcccuuccuuuguugaugguguaugauuuagacuuuguuaauuuuauuauauuguuauuuuugacauacuuaaacaaaagacuuaagaguagaagugguaggaagauuagguaaaagcaugcauuuugaacaauuaagauacaaaauuuggaaacaauugguauauuaauagucuuuuaagacuuacuuugggcuuaauagccauguaucuuugaugacacaaaauuuuguacuacucaauuuuguuuuuuauguauuuauuuauuuuaaagaggcagggucuugcaguguuguccaggcuggagggcaguacagugguaugaucauagcucacugcagccuugaacuccuggguucaagugaucucccaccugugccucuuaaguagcuaggacgacaggugugccaccacaccuggcuaauuuuaaaauuuuuuguggugaucggguccugcccaggcuggucucaaauuccuuggcucaagugauccucuugccuuggccucccaaagggcugggauuacuggcaugagccaccaugcacagcccucauuuuaaaaaagagaaaaaaaguauggccuccaucuguggaugaauaaguaaacaaaggcuauugggcuuaaacaccaacuugauuaguucuacaaggaauaugcuaacaagauaccagucuuuaugcuuuacuuacagaaguaaguuuuuuacuaggucacuuauacaaaucaguaauguaacacuaggggauaacuguauauuaguuuaagaaguuaacucagguaaugaauuuuguuauucuuuaauguuuagauuuaugauaaguauuaugucauagcugcaucucagaauccagaaccaaaauuauuacauaucugugagauuguguuuuugcgauacucagaaugaaaaacaguucauuaauaauggauuucacgcuaagguauuauguugcuguagacaaagcauucuuaaaauucagaguguuugcgggcuugaaggaaaaugugacguucuuacuaaucucaaccugaacauucauaauuaaaggaaguguuaacaagcuaugacaguauuagagguacuugugacagcaaauguguuaguuuuuauugcugcuuuaacaacguacuacaaauuggguggcuuaaaaagcaacaacaaguuuauugucucacaauuacuaaagguccaaaaucaaaaaguuggcagggccauguucccucuaaaaccaguaggggaauccuuucuuuugucuuccuugcuucuggugguuguugggaaccuuucacauuccugagcuuggagcugcauaauuccaugucuucaucaucacauggcgguguucucccuguguguuucuaucuucauuugagugauaccagucauuggauuaggagccuacccuacugcaguaugaccucaucuuaacuaauaaggucauggggcuaggacuucuacauguauuuugggggagacacaguucaacccauaacaccaauagaaacuacggauuuuuuuuuucuuauagcacaauugcuguuagcuguuacagcuaucuugaaauaccauuuauagucaucacuaauuugaaauuauuauaguuauuaaagcuauugcuagagcauauauuuuaaaguguuaauaaagaaccgcauuauuaccauaucaaaaugaaaaauauuucaauaacuaugucaauauaauuaauuucuuuuguaauacuguguauguuguuuuaggccccuaauauuguucugagaaaggggucauaagcuuuaccaggcugccaaaaacauccaugacacaaaaggcuaaaaucuucugcaauggacagaagcccagaagccugaacccaaagauagagauauaaaauaggaagaguaagaaacaugaggauaagaugaguaacuccaacauacagcuaacaguuccaaaagaagagaauagaggagacgaaauauuacaaauaguggcugcaaauuuuuaagaacuagcaaaucaaaccucacucagcgaacuagaacaaaacaaagccucacagucaaaugggguuuaucuugaggauguaagaauggaucaacaugagaaaagcagugcauuuuaucacauuugaagauuaauggagagaaaugauacgaucuuaauaaaugccagaaaugucauuuaaucucugcccauaauaaaguaaauguucauaaauauagagacaaauuauuuuucugcucucuagaauuucagauuuuuaauuuuucugauuuaaaacgagggugugggauuuacuuaacuuugggauuuuaguccaagaguucuagaaucauaacugauuuuuuuguacuucugaauuaauauaucauuucuguuacucagauguaggauugacugguggaaauugccuugugucugaaauuucugaauuaccuugcaaggcauuucuuucuguguuuggagagcaaagaauaaccuuuaguaaauucaagaguaauuggaauuaaauuucagccuaauaucaguuuaauaauuuuaugucuaaauuuaaucuguaugacaggaguuauaauuuguuuuuguuuuuguuuuuguuuuuuuaauuuauuuuuuagacggagucuugcucugucucccaggcuggagugcaguggcgccaucucggcucacugcaagcuccgccuccuggguucacgccuuucuaacaggaguuauaauuuggauaaaggccauuaugaacuuggaauguggaauguaauucuuuuuccugguaguauuuagugauacuauugcaugugauuaaacacauuuugcuugagcuguucauguaguuaggaauuacauucacaaauacaguguuuuuuaaugacuucuauauauuagcaucccguggcaggauugccaaaaauuuagauaaaauuuagugaguugugucuuuucugaugccacuuuuucaaaguuacuguaacuuuuaccacuucagaguguuuuuauucacuucagcacagucaccaaacucuuuuuuuuuuuuuuuuacuguuuuauuguguuauuuuuauacugugagauuggggaguucugggguuuccccccuuaauauguaaaagcaguauuaaacauuucagaauuuuaguugcuggauuauauauauugacuuuuuacacuuucaggauagauuugaacagggaccauuaauaacuuuuuccuaaagaaauucaguucaguggcauuugaaugagugcuuacuaggcacuugacuuuugccuuagcuuuggagauacaaagauaauuaaaacuuuaaaaucgcuaucacaguccacaagggaaauagauacuucugaaaugugauggguguucugguuauaaaguucuucaaggcucaaggagaaagugauucuaccugggaguugguggcaggauggugacugugugaaggaaggcuucaggaaagaaguggcauuuuaagagucagccaugaaugagagcauggaaugggggaaggguauuccaaccaggaagagagggggcagaagacaagcacagaaagaagaaaaaguuggaggaaaggcaauaccuuuuuggauacaguuguuuggaggaguuguuaaggaaaguguugagggaccagauugugaguaguguagauuugugcuuaccuguauaucaccaacuguggggcaagggaugguggcuaggccuaaaauaugagacacaauaugagcauggcagaagccccuggaaaucaguuuuucuugaaaaguugaauauuuaucugacugguuaguaauaagaugaauuuugaacagaguucccauuaauuuuauagaugaaacaccgaagaguugaaagaaaauuuguucuuugagcuaccuucccuccucaccacaacuaucuuuagucaguaaggauacuuaaugagagacaccaggugaaguuuucaucauguagacaguggcgacucaguauuuuaagugagggaaugauaauccaauuuguguaaagcagggcuucuuaggacaguugacuggagggagaagaaaaugaacuucaguugaugaggaagaauguaguaagacaacaaaacagagcugggaauagagcauuuggaacuauuggggacucauaugagaagaaauucaaauguccaacgauuauuugacugaaugugaaggaaggaguaggaagguugugggaugacuugaacauuuuaaauuuaggccgcuguaaugcuuuuaaaugaaggugggaauagagaugaacccgguuuuuuaaaugggaaaauaacccaguuuugaucuuuuuuagucugggugcuuacuggaugucaagguagaaaguguccaacaaggugcuuuaacuauagguugaguucucaaaaagguuaagaggguagaguuauagugacaucuucagcauauauaguaguugaggccaguggaaaauuucccauugagaauauuaaguaauaauggaaagaugacaagugagaaacagcaguguuuuuaagggagaguagaagaaagaagagacgccaaaagacggaaguggcuuaagugguaggagagcucugagaggaaaguauuuuagaagccaagggaaaaaggaguauugagaaagcguuagauaucacagaaaaauuagauuggugauuucuaagacaaggauauaaccguuaggaugucauugaccuuugugggaguaauaauggggacagaagucagguuuugcuauagguugaggguguccaaucuuuuggcuucccuggucuacuuuggaagaauugucuugggccaccuauaaaauacacuaacacuaaagguagcggaugcgcuaaaaaaaacgaaucacaaaaaaaaucucauaauguuauaagaaaguguacaaauuuggguugggcugcauucaaagccguccugccacaugcagcccaugggccgcggguuggaugagcuugcuguagauuaaagagaaaauaagaagugcugaagcagagaagucauagaguagaugcuagucauuuagggcgaaguuaguaguugaaguuuauuuguuggcucaugucaguaguggagaagaagagaaagaaagacuuaaggaauggcauaauggauggagcaaggccuaggacagucuaucaaauuguuuuacugguugucacacacuguuagauuuaauccuucuaaagaucaugugagcuaaguauccauaguuuacagaugagauaacugagacucaugaaagguuuaguaacuugccauggccacgcaagagaguaaagugguagaacugagauucaaacugcacaguauuuauaccacacuguacgucauauacuuuauugacagacuagauuuuaaagaaaaaauuagcuugaagugguagauugacacauagaacugauagcuguuuugaagaacugcaaguuuugguaaaguuaaagagcuuguagaguguaagugggaaaaauggaaagacaaagagauuuugaucauagaacaauggcuccagagugaugacaugugagggaagauuaaaguagaaacagggaugaagguuauuggagaagccaggaucugcuaaaauguuuuuuuuaaaaaagagugaacaguauggauguuuggauagcuagggugguaucaggaguugagguggagagaaauccuaagccagugccaguguauuuaaugugaguguggguugagugacuuagagugcugguaucacuguugccaccucccucugcaaucaagagagacagggguaaggauuuuggaauuggagguugaagaaaaggguauuggggaagaggauaagaaaagggaaggguuuagcugggaagauuugagaguauuugcaaugauaggaugucauguaauaaugguccuaucaggaacgagugauucugagaauuagcaaguagaggggaagagagacauguaaauaaacuauccaaauuaaggucuuauuaagaacuuuacguuuuuaugagaggcaaaccaagauguugacugauauugcaggguuuuauccaauacauuauauugucauuuaugggauuuuguagccuuuggguucuccauucuuaaugugguuagagaagcccuuucaaauaaaaauuuacuaauuuaaauuuuacaguuaaccugguguucacaacuaacauaauccugggguuacugcugacuguagcauuaagacauuggcaaauaacauaaccugucuuuguccuugccuuuuaucuauaaaaccaggauaauaugucccuacuucagagggauacaaccucugaauguaaccucucucccuacaauaacauuuuuugauuagagauaaaagaauauuaaacagaacuuuuaguucuucagaaggaagguacuauguuuauaaaauaaucagugcucauuuucauuuagccugaagguggggucgcuuuuuaaaaaggauuauuaaccuacuaagaaaaauuguguuucauuuuaaauguuagaaagcaacuuuucagaaaaacuuaaaaucuaaaaauuccaacauuagaaaaaaauuuauauugugaaaauuuucuuccauguucugggcagacugaagagguagauguaacuagucuugaguagguuaauaagacaaacaacuagcucuaaguaguuuuuuuuuuaauuuuuaauacaacuauuuaguuauaaaaggaguauauuucuagaacuuauuaaaauaauuuuaauaccugagcacaguuuggaagucuaaguagauucggugucuugccaucauuuuuaauggaaaaaaacaucuuacaguucaauccaggaacuuucaaauauuguuguauggcaagcagaaaucuauuuucgugggagagaaugggagaggaagauuuuucagcuuaggggaauuauuaaguuauuaaagguuuagaauuuaauuuuuuugcagcuguaauuaaacuaagauuccuauuagauggacgcacuauuucugccagcuagaaauucauuguucuugauuuagucuguuaacuguaauuuggacagcugauggucuguaugcucauguuuaguuaaguuuuauggucauuaaaagcuaaagcaaaaauacguuuacauuuugcuuuagccugauguuuaguccuagcauucugaaaaaacuguauaauuuguuaauucaaaaauaauugccuuggacacauaaucagaaacuugguuuaggaaugaguuauguaugaaucaaaaucuuaaaugagcauaaaucagggacuuaaaaauaugaugaagaaugcacauacuuuuucucuugaugaagguuauuggauccaaaaaucaaacuuaauuaacuuaguaacaguuaagaacauauaacagccuuaaaugauguaucaaauuagggccaggcacgguggcucaugccuguaauccuagcacuuuaggaggccgaggugggcagguugccugugcucaggaguuggagaccagccugggcaacauggcaaaacccuuucucuacuaaaaauacaaaaaaauuauccaggcaugguggugcaugccuguagucccagcuacucgggagucugaggcaugagaaaugccugaacccgggaagcugagguugcaguaagccaagaucgugcacugugcuccagccugggcaacagagugagacucugucucaaaaaacaaacaaacaaacaaacaaacaaacaaacaggauauucuucaacuuuguauuaucauuuuuaaagagaaggagaguggcgagagauggaugagacagacuggcuucuagccaccuuaguuuuccuuagcaauguuuccuagucuugauacuugaagagcaagcaaacugagcuucuaagugagccaaaaagaaaaaaaaaaaauuauuggauguuguauauagacucuacugcuuuugaguccgaacuguguuuuguguacuaggcccuagcauauaacacauaagaagcauaauuugacuuacaauuacuggcuaauagcagaucauccaauuuuugcauuuacccuaucucagauuuagucaggugguauaaggaaaaaaaugaaaguaagcuaaaauccuuuaggaaaacaaugagcaauaauuacaucaaaagaaaucaacuaaaaacccagcacagcuuucaacugcaucuaguuccauacacauuuuugcuuguguacauacacauauuauuuaccugauuaaguauaucaccugauauacuuaauauaaagacuuaggcguauaucuaguuuuuaaauaaucauuuuaguacuguaauauuucacauuguuuuaccaaaaguuuaccuacuuguuaucucuuuaaagaacacuuuagguuuccagcucuuugcuauuacaaauaacauuuuuaaggagcaucuuuuugcauauaaauauuuucuucucuuuaguaaaauuucuuaagauaaauuuacaggagugggauaagugugucaaagaguacaagugguuuuuuaaaauucuuaauaugaacugccacuucugaaaauucacauuuuuuucuaucguggauuauuuguaaugaaauuuguucuuaaauuucuuagauuccuuuuuuguucuuugguaccuugugguuuuauguagcucucaguacauaauuaaaugacagcucauauaugaguaaguaacagcauuggccuaaaaucauuucaugcauuuagucuuuauaauaaccauguaaguguuuguuauaauguuacuacucccauuuacaaagccaaggaaacugaggugcaggaaaguuaaaugacuuggcaaagauuacauacuugguaaagucuuaugauuccaaagccuaugcccuaaaacaauggcuuucagacuuuuugacugcaucacaguaacaaacacauucugcauuuugacacuuugacaucagcaguguacauacacgcacguaugcccauaggauauacauaugaaaagauuuaguguuuaaaaagcuuuccaucuuuuccuaauacacauaauuaaaaacauuucauauugggaaaacaacuguccuagugauuagaauucaguguucacauaacucugaguuaguuuacuggauuuacaaauaauuauauacuuauaaaagauuaauuugcaauacauugcuauaucauuuggagcacuucagugaagacaucugaaaaagcaaugauguaauaacauuugcugucucuacucuagcuacagcaauucaauucugaauucuucugcagucccucacagcucagccuugaaacccacucuugugaguauccuaugccuuuuaguauuaucucuuauuuucaugaaauaagcugaacauaaaugugaaucuucacuaccaacacggagguacauccuuagaggagaacaacaucccaaauacuucacaguaguuuagaacagggaauuuuucaauggcaaugggucuccaucagcauuauguuuccauguagaauggaauagaauaccaaagucagccuguguguugucacaguaagucuaaguuguuuugugaaaaguuaugugugugcgugauacacuuacccuugugacuaccagucauucccaaacaaauucacaaggauguugagaccauguagggggugggggaauagccuaaacauuuaaaagugaccaggguauaguaaaugauaaaucaucauacaggacccaucauuuaaaaagauauuguuaauacuguguuauuugagcauacuuuccuuauugcuuuauguuaaugaaaguaagguaauuaaaagauuuuucacagguuguguuaaaaguguauggcuucagucucuuaaccuuguuuucuaaguuuuuacuguucauuccuuaauaguaaccauaucaucuuaguuggagagggauuccuaucuaccucaguacauuuucagucuuugaaaucaucagauuauaaaggaguuguagaaacagaaaucauauuuauaguacuaacuuuuuucuuuuuuuuuuuuuuuuuugagacagagucccgcuccgucgccuaggcuggagugcaguggcgcgaucucggcuacugcaagccccgcuucccggguucacgcuauuccccugccucagccuccugaguagcugggacuaaggugcccaccaccaugucuggcuaauuuuuuugguauuuuuaguagagacgggguuucaccguguguuagccaggguggucuggaucuccuaaccuugugaucugcccgccucagccucccaaagugcugggauuccaggcgugagccaccgcacccagccaguacuaacuuuuuuuuaagagacagugucucucacuuuguuacacaggcuggagugcaguggcacaaucacagcacgcuaaccucgaacugucaggcucaagugauuaaucugucucagccuccugaguagcuuggacuacaggugccugccgccaugcccaguaauuuuuaaauuuuuuuguagagacagggucuugauuuuguuggccagccgggcuggucucaacuccugagcucaagugguccucccacuucagccucccagagugcugagaucacaggugugagccaccaugccuggcccuuacuacuagcauuuaauucauugucucucacuguuuuuuccaaauguuuguuacuuuacugaaagauacuaccuuuguuaucugcuaaaauuuuuacuuccauuugcugccaguugggcuuuauuagaauucuuugagaaucuaaagcagugaguacaauagaacauucugugaugauggaaacauucuguuugugguauccacuaugguagcuacuauauaguuauuuggcuguacuugaagugguuugagugacugaggaguuaaauuuuaaauuuuauuuaauuuauauagccacaaguggccaguguugacugcuguauuggauggcacaaaucuggagcauuucuuucuuucuuuuuuuuuuuuuuuuuuuugagacagagucuugcucugucucccaggcuggagugcaguggcacgaucuuagaccacugcaaccccugccucccagguucaagugauucuccugccucagccucccgaguagcugggauuaaagacgugugccaccaugcccggcuaauuuuguauuuuuaauagagacgggguuucaaccauguuggccacgcugucaugaacucccgaccucaggugaucugccugccucggccucccaaaguacugggauuacaggcaugagccaccaugcccagcccaaaucuggaacauuucuauuccuucaagcccaacaccuuuuuugaaaacuaugacauguucuccauucacucugcugaagaaaguuucuaauuguuuuuucauggagagguaacuugagguagcauagcuuuuuccaaaauguggaauuugccacugguauguaagauaauuuuaguuguuucacagacauggcauuuauauuagucuguucucacugcuauaaagaaccaucugagauggguaauuauuaagaaaagagguuuaauuaacucacaguucuguaggcuauacaggaagcuuggcagggaggccucaggaaacuuacaaucaugguggcaggcaaaggggaagcaaguauuagcaaggcagagcaggagagagccaagugggaagugcuacacacuucaaacaacuagaugaucugagaacucuaucacaagaacagcgaggggguagucugccccucuuucaacacauggggauuacauacucgaccugagauuucaguggggacacagagccaaaccaaaucagcauuaaauuaaauugagaaguuauuccuuucuuaauacuuguugaauuuuaaauuaaaaaaauguauguauguauguauauauacuaauuaguauacuaaucuucauauaucagcuuuuguacauaugucucuugaacugagugaaauguuuucuuuaaacauuucuuguugauaccuuugagguagugcuuuguaaagcuaaucaucuuuaugaucugcuagaugaaccauagauuguuguucauuuguuuguuuugcuuuauuuuaccuuuuagacacuggguuuuuaaagauaaauauuauauaaaaaugauucuucuggugauaugagaauuuacuuaauaauuauugagcgacaaagucauuagacccaauaauaaauaccuaauuauccguguaucaugccaaagugugauauuaucuaaaugucagauguuaaaguguuuagauucuaugaaaauaguguuuagaccuguuucaguaaggaaaugucuuuuaauucaaagucauguguaugcugcauauuuuagugguaauuaaauguuucagugcagcagacccuaaaggaucaaucacacaugugcauuggaaugcugggcuaauagaaacagccaaacagauggagaucaggauguugcagcauuucuuaguagucacauuuaguccaucuccuggauuuuacauugcucuuagguuugacagucauuaauguugauacuuaaugaaauagagacagcuaacauuuauugagcacuuauuauauguuagagaaaggauagaaacuaacauuuuugaagcuuacucuguuccagguguuaggacaguaggcuuuagagaugaauaaaaucuagaucuuuccaucgugcaguucucaaccuaauguuagaaguaaaugauugauugguucuuugguaaaaaaggacuuagagauauugauucccugcuagaggaaauacauuuuucccaggagagugagaaaaacugcugaaaauaaaaauuauuucauuaaaaaaauuuccauucuuauuuuagauuuggggaguacaugugcagguuuguuacaaaggcauauuucaugaugcagagguuugggguaugacugaaccugucacccagguaguaagcauaguacccaauaguuuuucaacccuuacuucccucccuccuuccugccauauaguaguccccagugucuauuguucccaucuuuauguccaggaguacccaauauuuggcucccccuuguaagaacagugguauuugguuuucuguuccugccugaauucacuuaggauaauggccuccagcugcauacguguugcugcaaaggacaugauuuuguucuucuuuguggcugcauaguauuccaugguauauauguaccacauuucuuuaacccacuguuaaugggcaucuggguugauuccaugucuuugcuucagugaucaugagugcacgugucuuuuugguagaacaauuuauuuucuuuaggauauauacccaauaaugagauuguaggggucgaaugcuagguuuuuuuuuugagaugaagucuugcucuguugcugaggcuggagugcaguggugcaaucuuggcucacugcaacuucugccucccagguucaagccauuuuccugccucagccucccaaguaguugggauuacaggcaccaaccaccacgcccagcuaauuuuuguauuuucacuagagacagggguuucaccauguuggcuaggcuggucucgaacuccugaccucaggugaucugccugcuucagccuuccaaagugcugggauuacaggugugagccacugugcccgaccucgaaugguaguuugguuuuaaguuauuugagaaaucuccaaacugcucuccacaguggcugaacuaauuuacauucccagcauuguguaaguguuccuuuuucucugcaaccuugccagagucuguuauuuuuuaacuuuauaauaauagccauucugacuagugugagauggcauaucucauugugauuuuguuuuguauuucucugauuauuagugauauggagcauuuuuccuuagguuuguuggcaacuuguaugucuucuuuugagcagugucuguuuaugucuuuugcccuuuuuaaaaugagguuauuuguuuuuugcuuguucaguuauuuaaauugcuuauagauucuggauauuaugucuuuguuggaugcauaguuuaugaauauuuucucccguucuguagguuuacucuguugauaguuuccuuugcugugcagaagcuguuaguuuaauuaggucccacuugucaauuuuuuuguuacaauugcuuuggaggacuuagucguaaauucuucuccaaggcccauguccugaauggugauuucuagguuuucuucuacgauucuuauaguuugugguguuacauuuaaaucuuuaauccaucuugaguuaauuuuuguauauggcugggauagcuggcuagccauaugcagaagaaugaaacuggaccccuaccuuucaccauguguaaauuaccucauuuugaagaaacaucuuuauguguuauacuuaacuuuauaguucaguaguagucuugugaucuaaguagcuacaaucuuaacuguuuuugauucacuuugaaguuuguauggcaugauagauuguguaagaaggguuaaagauuuauugucuguuaacaacauagagcucaggaucaaaugaauaucaugaacuaaguuuuuuuaaccuuagccuuaauuuuuauuuuuauguauuauuaauauauauauauauauauauauauauauauauauauaugaauaauaguuuuuuuccuauaggauguguaggacuuuaguguuuuuaaaaaaauuauucccuucacuagcaagagcuugaaaauggauaauuuguagcuaaaugauaauuuaaauuuaaaugauaauuuguagcuaaaugauaauuagcccaguugggucuggcaugagauguaugagaugugucauucuaaaucauguaaauggcccaaacugcccggauuucugauuggaagacgaagggaggauuuuaggugaagaacacgguggugguucccgacuccuuaaauaaguugucaugaaccuacugaacuauguuuauuucucccuuucccuucaguuauuuauacuaaagacuugcuaagacaagaaaugacagacaagcauguuuaaauaaucccgucacuacuucuauuuugacaaccuagauaaucuugagaacuuuuucacuaucacauauuaaagaguuauucaaagauauguggccauuauugguaauuaugagcgaguccuccucauauugcuguguuuauucagaaaauucuuaugcuuagagucuacuuuaagaucacagugacagggagacaggauucauuuuuaaauggucagacuacauuuuuagaaaaaguuuuucccuuuagaguagaaguuuaagcacccuuggauacccuugguuuagaaccaaaauucuacauguaggaccaguuaacaauuuuguuucuucccacagacuggaagguguacuggggggaacugccaacaggaagugucagguaucuugcagcaccagagucggaaaugauaaugaaagcugcuaacauuuguguauuacuuuagaaucuacagagcaccuuuaugugcauuaucucaugugauucucaaagcaguugugagauuuaugaaacuacauauauauuuauucucacuuugaaauaauuuuagaccuacaggaguaagaaaaaauauacaaagaaugcacauauccuucaggcagcuuccuaaaauguuuuacauagccaaaucaggaaacuaggaucuauacaauauuauuaucaacuggcaauauucguaucuauugauauuauugaaauuucaccgguuguuccacuaauguccuuuuuccaguucaggauaugauaaaugauguugcauuaaguugucaugucucuuuagucuccuuuaaggugaaacagcuguucagccugucuuuuauaaccuugacacuuuugaagaguacuggccaggaauuuuguagaauguuccuaaauucaacuuacauguuuuuggcaacaauacuauagagugaugguauccuugugcaucaguucaacagguggaugguguugauauaucccauuacugguaaauuuucaucauuugguuaagaagauguuuguuuugccagguuuuguaacuguucacuuuguaauaagcaucuuuugaaaagauaguuugagacuaauaaauauccuauuuucugucauucacuuguuacuauuuuuagcaucugcugaugauucuugccugcaacaauuacugugauguuugccaaaugauuuuuuuucuacuuccgucauuccuucugcuuuuauuaauuggaauuuuauagaagagccuuauuuucucacauuuauuuaaguauuaguaucaauuauaauccaucacugucaucauuuuuaugcucuguugucccagacuuggccauugggaaccccgugaagucuguuucuauguccuuuugacauaucccuucauuuuuucagcacguccuuucugguaucauaagaugcuccaggcucaucucaugcuuuucuugcccagcuuuggaaccaucccauuacuuaaagaagcucuaguuccuuuuauuggagaauuguauuuagaaacuacucuaugggugcuagaugugcuaauuggcuuugggaugaggcuggugguauuauuauuacuauuauuuugagacagaaucuugcucugucucccaggcuggagugcaauggcgugaucuuggcuugcugcaaccuuugccucccagguucaaucaauucccguaccucagccucccaaguagcugggacuacaggugcgcaccaucaugcccagcuaauuuuuguauuuucaguagcgacgggguuucaccauguucgucaggcuggucuugaacuccugaccucgugauccacccaccccggccucccaaagugcugggauuacaggcgugagccagugcaccccgccgcuggugguguuauuaacccucuuuacaguuggagaaaacuaagcugaaguuaaaagucuuauucacaauacccagguaaggugauccaguugggauguaaacuuggaccuucuuauuguggagucuggguucuuuccacuuacucuccugugguacuguaguauuccuuucuuaacauuugcuuuuccauuaauuuugucauuugucuugccggacaaggacaggacacaaucuaauuaaaauagauucaagaaaauuauuuauuaauaauagauacaguuauuucaaugcaaaaaauagucauugcagugccagaaauauuuaucauaugcuugcuauguguaaggcagugugccaaacauugcugguaugugaguauuugcauauguacuaggagacauugugcugugaauguuuuuuuuuuuuuuuuuuacuguggcucuuuuucccuagauacauauuuaagggguagagguagguguauaacaauuguaaauuaugucauuauccauuaauucaaaugacuuaggauuuuuauauuauauaaauaugcggaaguguuauauauauagcauuuguuuacauguaccuccuuuuagugcacuaucauuucauaauuagaguaauacuauacacccguuaaaugauauuguuucauaauuguaacauuauacacucauuaaaugauacauauuugcuaaccacaguuaagcacuuuauguuguugcguuuaauucucacaguagcuucaugaguuggucuuauuuuucccauguuucaggugagcaaacagacuuaaauugacucacccaaggcguaauaaauauuauaagguggauuuaaaucuaauuuuuaugcuaccuacaaugugaaauacucuuccuauuguggauguauuuuguucaggcuuucaaguaucauuuuaauucucauguucaggauuuggugaguaagucuauucuguuuaaacauuuuuugacuuacacauuuugagccuguccuuuuaaaguuuuugccugauuuaugaaacacuguaguuuauccuaaagaagucuuauggcaguaucauuuuacuaacuuauggaacauucuucuggucuauaaaguuguguuagguuagugaucaguauccacaaguaaaaagagguggauauauuuuugugcuaguuuauaauagcaggcuaaugcuuggugugcauuucuuuucugggucaucaugauaguuuggggucuaucuuuauaaaaaaugauaguaauauucauaaagcuuaucuuugcuucuacauuaagagaaguaaauuuauuaaaauuucuugugucaguauaaggacuuuuuaaaacuuuuagguucaagguuacacgugcagguuuguuauauagguaaauuuuaugacacgggguuugauguacagauuauuucgucacugagguaauaagcauaauacucaauaggugguuuuuuugaucuguucccuccucccacccucaaguaggcccuggugucuguucccuucuuuguguccauguguacucaauguuuagcucccacuuauaagugagaacaugagauauuugguuuucuauucauucauuaguuaacuuaggauacccauggcuuccagguccauccauguugcugcagaggacaugaucucauuccuuuuuauggcuguguaguauuccaugguguacauguaccauguuuucuuuauccagucugccauugaugggcauuuaggcugauuccaugucuuuucuauugugaauaaugcugugaugaacauacaugugcaugugucuuuaugguagaaugauuuauauuccguuggguacuuacccaguaaugaaguugcuggcuugaauaauaauucuaacuucuuucagaaaucgccaaacugcuuucugcagaagcuaaacuaauuuacauucccaugagcaguguauaagcauucccuuuucuucauauccuugccagcaucuguuauuuuuugacuuuuuaagaauagcuauucugcuggugugaaaugguaucuuuugguuuugauuuggauucuucuaaugauuagugauguugagcauuuuuucauguguuuaugcuuguucauguaugucuuuuuuuuuuuaagugucuucauacccuuugccuacuuuuuaauggggauauuuguuuuuugcuuguuaauuuguuuaaauuaauguaaggauguauuaauggcaaguaauauaggauuaauuauaucuuagauauuuaacaucaaauuuuauaaaugaaaacagguaagaaauaagagaagguagaacuauuuguguguguguuuauucacuagcaguaaugaaaacagaaaacucucaagacagaaauucauguuuguuacuagagagcucuuagaaauuauuacuccuggcugggagugguggccuauaccuguaaucccagcacuuugggagguccaggugggcagauugcuugagcccaggaguuugagaccagccugggaaauaagaugaaacccugucucuaccaaagauuuaaaaaauuagccuggugugguggugcgagccuauagucucagcuacucugaaagcauaggugggaggauugcuugauccugggagcuggagguugcagugagccaugguugugccacugcacuccagcguggaugacacagagagacccugucuccuccuccaaaaaagaaagaaauuaucacuccuuuuuguauacuuuuuguguacauuacagauuaacacuuacuguuauuugugggagauugguuuuaggaugaccccugaccaaauaccagaaucuauggaugcucaaguccauuauauaaaaugauauaguauuugcguauaaucuacacacauccucccauauacuuuaaaucaucucuggguuuuuuaugauaccuaauacaaugcaaaugcuguguaaauaguuauacggcauuucuaaaggaagaaugacaaagaaaaaaaagucuguacauguucaguacaaacacaaccauuauaaccuaacuacacuguuuuuuuuuuuuuuugugaaaugaagucucacucugucgccuaggcuggagugcaguggcggaaucuuagcucacugcaaccucugccuccuggguucaagugauucuccugccucagccuccugaguagcugggauuacaggcguacaccaccaugccuggcuaauuuuuguauuuuuacuagagacaggguuucaccauguuggucaggcuggucucgaacuccugaccucaugaccuacccuccuaggccucccaaaguguugggauuacaggcgugagccaccaugcccagccuccuaacuacauuuuugauccaagguugguugcauccaagguugauugaaucuguggaugugguacccacaaauacuacaacuaugguacacccacgauaugaucguaccauauuugaauguuagucagugaccaagaagaauucuaccacauuuucuuauuguuguacuuuaaauaugguugaauuuucucuguagagcaauuaccaguaugagucaaaggccaugauuuauguaggcuauagcucugcaauuuagauuguuuacuaaaauuuagucuuaagaguggaugcagaauauuauuucuuguuuucuuaaucuuaucagguugcaaauuagcaucucaaucaaaagaggauguguguaugugguuuugugccaaacagugcuauccuauucuaaucacaaccucugaaguaaacuuccauugguacuuuugaguugcuucugcccagaucaagguccagcucuuuuacuuaccaguuaugugguucuggacuucuguaagccauaguuuccucaucuguaaaaugaggauaaucaucaggauuaaauauaauccuuguaaagcauugaaccauaucugcacauagcaaauacugaaguguugagugcguguuaauauuagugguaguaguaguaguaauucauugcaaggagacauuaaaaguuccuaauguagaauaagaacuagguaauacaugacaaacacuuaugggggacuaucuaggauaauuuuaggagucuucaguguuucauggaaucaaagaaguuuggauuaggagagggcuuugauuagcaucuuuucuuccuuaauuuuauagaugagggugcuacaucuuggaaugauaaaauaacuugcuggaacuauuacaguugcaugugucagucucaguggaaacuuggucuucaugacuguaaguucaguguuguuuccacugaauguugccuuggucaauuuuuuccuauaauuuugccccugguaaccccagugucuuuaaagggaaaugauuuguuugggaagucaucuuuuucuuuauuuuuagggaucauugauaucaguaaucaacacugauucuuaaaguguagguaauauaaguuggaagagaaauaccucauuugccuccuuaaaggaacacaauaguauaauaauguuuuuugucagaaucucuucaugaaucccuccagcaaguuaaugaaaaucuccaaaaacacuauucagauucucaugauagccagaaggguauuggcaguagauugauuauuuagcuuauagaugaguugcuuguuuacucuuacacauuugaaaaauacagaaagguacagaaaagauaaccuuaucuauauccuuauccagaauugacauggauaucaucuuugcguuagauuuuuaaaaauccauuguuuuuuguggagauaauuauaauugaguuagaccauuaaaucuaucuuaucuaaagauaagagauuuuaaaaaugugauuuuuagcuuggggcuacuuaggacauuugguuaggcaguguacuaauagagauaguaagcguauauguggaucagcaaacuguuuucuuugauaaucaaaagcccuuguuugccaaaccacaauuuagaaugaaugaguagaaauuuaacaucucuuauaacuuaaaaauaacuacuugugaacucuauagaucuucauucagaauauguaauuguaaaguagauaauaccuuaaaagagaaaacagugaaucacuuugcuagugggugagccuagcucaucaccuaaacauccauaucucaaagguuauuauuuauucuuuuccaguacauauguaaccauugugauaaauucauaacccaccagugugaugauauauuuagaaacuacauuaaaugaggacaaguuguaggaacuggucagguugaacuuggagaagaguugaucacugaaauauuaguuaucuucaaauaauugaaaaccucauauaauaaugggaguaaacuuagacucuuuugucccugaaaguaaaacuagaaucaguggaugaaaguaaaaaaaggugggggaguaaguuuuguuucuauacaaaagagaacuuccuacugaugugauuuguuugaugauggaauggacuaucuugugaaauugggagcuuccuauaguuauuuucaaauggagagugaaaagauugaucauccaugcaucuuugcaaaaggaguaaguauuguguagugugucagauuagucuagaucuuuuagguuccuuacaacugccuaaguucuguuuuuuugauuuuuugagacgggagucucugucugucacccagcauggagugcaguggugugaucauagcucacugcaaccucaaacuccugggcucaagcgauucuccccacucagacuuucuaguagcuaagacuauaggugugugccaccaugcccaucuaauuuuuuuuuuuuuuuuuuuuuuuuguagagacagggucuugcuaugcuucucaggcuggucucaaacuccuggcugcaagugauccuccucagccucccaagguguuaggauuaggcauaagcuaccgugccuggccuuuugauuuuuaugcaugucauacacugcucuguuucuuacauuuccacccuuugagaaauguacauuuuuguauaaaaauauauaaaauacauagcuuuagagacaugcuguaaaguuugggauuuauggaugaagaagaaauuuuugaccccaauuaauccuuuggaauuuacucaguucauguucacuuacagaaguuccugaaauuucuagauguaaagucgauaccuaguucaguaugagcucuuacaggguaaagccgauuuuauugcuaaagaagguauguuuuugugguuauuuaucuauggagugaaaaagcuuuacuuguuuuaagggauuaauuugaagcuuucugaaguugucauaguccaguggacaccagcaucacugaguucauauacuguccauaauacuccaugcauguuccauaaauacaucuuucugggaaugaguguugguugguuuacauucauuaaguuaacauuucuuauucuggccagaaucgguggcucaugccuguaaucccagcacuuugggaggcugaggccgguggaucacuugaggucaggaguuugagaccagccuggccaacauccugaaaccccaucucuacuaaaaauacacacacacacacacacacacacaugcacacacacaaguuaaccuggcgugguggcaggcaccuguaauucccaccacuugggaggcugaggcaugagaauugcuugagccggggaggcagagguugcagugaccagagauugugccacugcacucuggccugggcaacagagcgagaccccgucucaaaaaaaaaaaaaaauucuuauuucauuccucaugcuacucaagaagccaugggugguauguuugauuuacuccaccuuugucugauguaaaagccacugaugucgauggauaagcagugguaggaugguuugaguuuggggaucuuggaaacacuugaaaauucuuaucuaugcccauuuccuaauagcgaugggaaaugucuccuguacaucuuugcuguuuuuauucaguuuaacuuugcagaugaaaaguuuauagauuaaaauuucucugcugauagcuguuuuuauuucuucauugucuguuuuuucuuuaaggaccaugguuuguagcuuuguaagucccucgcugucaugcguuguuuuaaaccacgguuuucuugcuacuuugaggacugugacacugauuugaaucuaguauugcuuauaguuaaaaagcuucuuguaaguucuaguguauuuccauuagauacuggauugccgaacauuuugggguguaaugagguauguuaguccguucucacacugcuauaaagaauacuacuugagacuggguaauuauaaaagaaagggauuuagugacucacgguuccacaggcuuaacagaaagcauggcuaggaggccacgggaaacuuacagucaugacagaaggcgaaggggaaguaggcgccuuccucacaaggcgacaggagggagacaagagcguguuaagggggaacugucaaacacauauauaaccaucagaucucgugagaacucacuaucacaagaacagcuugggggaaaccacccccaucauccagucaccucccaccugguuccucccuugacauguggggauuacaauucaagaugagauuuggguggggacacagagccagaccaugucuugagagguauagggaauaaugugaagggauauguagacaaggucagcauguuuauuuugugaaauauauuacagauuuugugauuuguuuccuuguaggugucaggggcaugaugauggaaucugcuuuuuucaguaagugcuaugagcuuauauuuagacauagaaaauuguagaaaaugaaaaauauaauugauggagaauauuuacuucaaauauucuuauuuuuauauaagugaagcugagagugugauaugaguggcuguuuuccuuuccagucacagcagaacuagaacagcagggguuuaaauccuuacucagugaugugaucuugugcgaaucacuuacccucuugaagcuuuaguuucccuaucuguaauuuggggauaauaacccuuucuaggguuaugucagaauuaaagauaaugucuuuaaccaaauauucaaaauagauuagguagauagagcugccuuacuauaguguaacugccuuacuaauaguaaaaacuaaugguaaaaauuagguauuuacuauuaaauguuuauuauuagagcucagaucacuuuauuuuagauaguuuucuuuguccaugugauuauaaaagaagaaaauaaagauaaucucuacuucugcuacuaagagauagccauuaugacauuauguuguaaauuuuuccagauuaucuuuuaaggcauauuugauacauuuuaaaauguuuuuauuucuauaaaacugaaguuguacuauuuuauacuauuuggaagucuuuuuauuuacuguaucagccugugaaaauacacaucauaguaguggcugaaaauuuacuuuuagucaguuucuuagugguggguccuuaggcaguuucaaagguuuuuauuuuaccauaauaaacaauguugauacacaguuuuguucauacgcucaugagugcaugucucaguuucuuuagaauaaauauuuagauguuacauuucugggucuaaagguauaauauuuuuaacuugccagauugcuguauaagauguaauuuuauauuaugauacuaaucuuugccauauaugauaacauguuuuuuccuaguuugucauuugucuucuaauaucuugguguuuuuagcaauacagagauuuuacauuuuuaugcaguugaauauagcagucuucuguuauaauuucugacuuuaguggaaguuuuaagugguauuaccacacaacuauaaacauauuucuuuuaauaauuacagucuuaauuuuaguguaauguagagauucaaguuuuaauuuuuuuuuccgauggauagacuuuuacuucacuauuccuugaguaaaccuucuguuuucuacagauuugauguuccuuguuguuaucaccuacuaaauguuuguaugcauuuggaugcuuucugggcuccacuccugugguuuuuaaacugugcauaagggguuacuucaucugggauuuuuuuuuuuuuuuaaaccuauuugugggccuugccuccagaaauuuugauucaaaguuuuggugggaucuaggaaucaguuuuauaauaaacacauuugguuauuaagaugcauguguuuuaugagccacacauugagaagccuuccucuguuucaccuguaccacaccauuuuaaauacuagaucuauuuuuuuuaaauauauuuuuuugcucccagcuccuccugcugccugacugcccccuccugcucccucucccuccauucaaguaauguauuuuuacauuacacuugaauaacuacuaggaaaagcaccaccuccaaauuaaaauguuuauuuauucagcagauauuuucagugcguauuuugugccaagcacucuucuaguuuaaggauguauucaagaacaaaacaaagaucuuugaguuuuuauguaggugugagagagaucacagaagauaacaaugaaauuauaguaauuaaauuauagugcugugguagcacagacuacaugguauggauggcaaauagaguggagaugauggcaguaggagcaccccauugagaaagugauauuucaguaaagcagcgagucuuuugugauggaaucuggcauacagaauaucugggaagggguuuagguggugagcacaauaagaguaaauguccugaagcagguguaugcuuggcauguuugagaaggagaaagaacaguuuggcuggaacagggaaugggagggagaauggcuggagaugaagucacacagauuacaagagccaauuuuuguagggucuuuagaguuuggacucuuuccgugcgugaaauauguggcucuuggagguuucugagcaagacucacaugaccugauucauguuuaaaagaucacucaaauguuccuggcuuuaauguauacuuaaagcucauguuuuucaaguuaccuuuuccccagaauagcccaucgguauuuuaaacucaauuuccaauaaacgaacagacacguuagaauugucauccuugaaauacuaagcuuugcuuccagaaaacauacaauaucuucuuacucauucaugcccuuuauacccuuauuaauguuuucagaucaggcagguguggaggcucaugccuauaaucccagcacuuugggaggccaaggagggagguuugcuugaggccaggaguucaaggcuagucugggaaacauagugaggcccugucucuacagaaagugaaaaaauuuagccagguaugguggcaggugccuauggucacgccuacugagcugaaaagcugaaauggggagaaucacuugagcucaggaguuugaagcuguagugagcuaugaucaugccaaccgcacuccagccucaaaaaaaaaaaaaaaaaaaaaaguuuugcagauugcuucagauuagcucuguacaucauuauccuaucaauuuuauauuauuuuuauugugaauuggcucuuuuuguaugugugacaauuucuaaaucauugguaaauaggacaguuuuuaaaauuuccucuaucuaaccacuauauugcauucuuuuguuuuucuaaugggaaaucugcuuguaucuucuaaguaagcagucacauaaucugcaaacaagaauaauuuuuaaaugaagauuuauauuuaucuuuuucaccaucuccucuaaucauuacuuauggcuuuuuuuuuuuaagucugugguaauguccuauuucugacuuuaauagaaugcccagauauuucauuuuuaggcaugguaccaauuauugaaauacauuuuuauuguuguacauuacauauuauuaauugagccuuuacaguauugaugaaguaucucauacugcuuuaccaugaauauuuuuaagaauaaauguugaauuuuucauuucuuuuaaaccaucauccaaguaagugaaguuuuucugaagcagugucuuuugauugccaguuuaguccccuuuccaguauuugaaucauggagugcagacuuuguaaaaauaauguugucccacuuuaucaaauuuauguuugagauuuugcuccucuuuucucuuuuuauguauuuuuauucauacugcacauuauuauauugcuacuuguauuauaucuacaauccuauuuagauggugaacuucuugagggaagguauagaaucuuuuuuguauuuguuucccaucacacaugucuuauguaauaaugcagcuguuaccauguuaaguugaauugcauuaccuccuuaauucuuuauuuaaaauguguaauaaggccuuuauucuagagacuagaaacaauugaaaaaacagaaaaaugcaacagaggucagaguuuuagaagcacauuggcuagcacaguuuuaccuccagaagacaucuucugucuauguaguuuucucauuuauuugucuaguuaucucauuauucuagucuguauuucucaccuggauuucuagcaugccaccuucaucuauugcugacucccuuucccccacuaucuuuucauucaaucugcaaaacugugauuuuucuuuaaacauacaucucuuucauuguuucuuugaucaaaauguguuuuuucuuaaaauaaagaacaaaauccuuaauauggcccuguaugagcugguccauauaucccauuacugcucccuccccacuuaaaaaaauguccaucugaaucuuguagacuaucauuuucucuaaugcucuuucuugucugguggccuuugcauucauauguauguguuucacaucugugaauugagccagcuacagauugaaaauauuugaaaaaaauugcaucuuuacugaacauguacacacuucaaaaucuuauuauucccucaacaauacagcauaccacuguuuacagaugauuuaaaguauacaggaggauguccauaggcuguaugcaaguauuuugccauuuuauaucagggacuugagcgucaaggauuuugauacucaagcgagguccuggaaccaauuucacacagauaccgaggaacaacuguagccuacuaucaggaaaaccuuucuucuccuuccuuuauuuuuucuuguuuuuugauuuccccuugcuuauccuucugaucucuuaggauccagaguacuccugguuccuggaaagacuugaaucaugaaucacucugagauaugagguggucuucucugaaugauacacaacugagaaaaguucuguaucuuacaguuuuugcuuggauuguaacaauauaccuguuuucaccucucuaucauuaagaguugcuucuggagucauguuuaccuaccuucagucaaaauuaccugaucacaagggucagggauaaaugaauauugguggaagacgggagcucagaagaggaagguagaggaagguacuggaaauuuucuacuucaggcuuguuuacaacuaaacuuucauaacauauguuauugucuucauagagguucaugaauaugacauguuaauaaauugagaggaagguucggaguuuguagugagcaaggaaaacaagguuccuacucauggagcguaaauccuauuaauggaggacagacaauaaauaaauaaauaauuucagauagucauaggcauuaugaggaagauaaaaccagaaaaagaaauaguggagagaagguggauggaugcuggugcuacuccgaggaggauucuuguuagcugauggcuuagaaaggagcaaccgauagaauaucucaggggaauacccaacuaaaggaaacagcgucuagagccccacgguagaagagaacuauuauacuuaaggaguacaaaaauacuaucauugcaauauagugaguaagcaguaagagagguggucagagagguauagccuucuaaguuauagccauuauaagauuucauauugccaggcuaugcuaacucaguauuuuuuugcuuugaauauugugucuuuuuuuuauugcuuuucuuuaguacucaauauuuaggauuauucaaagcccuaaacuagaguaacuguuugguuaggcuacauuaucugcagugauaugagauaaauuauucuggauagaauuuuacagcaacaaauuuucaguuaguuuauucaaaauuaagauuaguuuucuaguuuaccaauauuccaaauacaacaucauaacuuccuucggaauuuaaacuacagguuuccugugccuuaaaccuuaggaaucagggaguagacuugggaaucuguguuuuuaguuaccucuaaaccaauggaauuuuucgcuaaaacaaguuuugccaugauuccugauuauuaguguggucauuauuaaaugaauuuguugggguuuuacaaguuuuguauuccacguuuaagaaaaacugcaaucagugcuuugaaauggaaaaaaaaaagguaaucucuuuaauuugcauuccucuuauucugaauaaaauuacuuuuucuguauuucauggcauuuauguuuuucuucuguggauuuuauucaugaacuuagccuguuuuuccuuugugguguuugucuuuucuuacugauuuuuggaguuacuuuuaaggaaguaccuuuuuuuuuuuuccuguuauaugccauuugugguagacagaauauguccugccccuccccaaagauggccuugcccuaaucuccagaaccugugaguauguuaggauuuugcaacugugauuaaguuugugagcuuugauauagggagauuauccuggauuaucuggaugaaccugggcuaaucacaugagcacuucaguggauaaccuuuccugacuguauaggacuguagucagagaaagauauaacuacagaagaagguucagagagaagcaauauucaugacuuugaggguagaaggagggagccaugagccaaggaauguggaugggcucuaggaacuggaaaaggcaagggaaaacuguuuucucuuuuagagcuucuugaaaggaacgcagcacugccaguaccuugauuuuagcccagugugaaacucuuuggacuuccaacucacagaaguguauaaauuuguguuguuguaagccgcuaaguuugugguaguuguuaggacagcaauaaaaagcuaauacauguguguuacauauuuuuuucccaauuuguuaucuuugucuuuauuguucaugguguuuuuaccaugcaggaauguguuuaauauaguugaauuuauccuuuuauauuuuaauggccucuggaucuuaggcuuucccaacuauaggaugauuuuaaaguuuuucauauuuuacucuaaugcuuuuaucucaucaugaacucucauauuaauguugacugccugucuucuauguuuugaucuuuuguugagaaugaauacuuuuuauaguucucuucuucugacguagaccaagagaauuucagaaugaaaucauaguaucaaugcuaguaauuaaggagucauggggaauggacacuaguaguaccagaaggcaggggacauucgaaguaguuauaguuugaacuguuuucauagguugaugauacugucuagcagaaccuaaaaugauugauucuaaagguguaguuugugaaaaccucuauucaucucucauauuuuaauuuuauuucuucuucuggaagaauucccagaugucugcauuauauaaacaguuuguggaagacuuagaugacugauauuugauacuguguuaguuuguuuucaugcugcugauaaagacauacccaagacugggaacaaaaagagguuuaauuggacuuauaguuccgcauggcuggagaggccucagagucauggcgggaggcgaaaggcauuucuuacaugguggcagcaaaagaaaaaugaggaagaagcaaaaguggaaaccccucauaaacccaucagaucuccugagacuuauucccuaucacaagaauaguaugagaaagaccagcccuaaugauuccauuaccucccccugggucccuccuacaacaugugggaauucugagagauacaauuuaaguugagauuuggguggggacacagcuaccccauaucauucugcccuuggccccugcaguucucauguccucacuuuucaaaaccaaucaugccuucccaacagucccccagagucuuaacgcguuuuaccauuaacccaaaaguccagaguccaaagucucauucgagacaaggcaagucccucugcuugugagccuguaaaaucaaaagcaagcuaguuacuuccuagauacaauggagauacagguauuggguaaauacagccauuccaaguggaauaaauuguccaaaauaaaggggauacagggcccaugcaagucuuaaauccaguggggcagucaaauuuuaaagcuccaaaaugaucuccuuugaccccaugucucacauccaggucuugcugaugcaagagguagguucccauggucuugggcaucucugcccaugugguuuuguaggguacagccuccuccuggcugcuuucacaggcugauguugagugucuguggcuuuuccagacacaugguggaagcugucagugaaucuaccauucuggggucugguaaaugguggcccucuucucaaagcuucacuaggcagugccccaguagggacucugugucggggcucugaccccacauuucccuuccacacugcccuagcagagguucuccaugagggcccugccccugaagcacuuuugccugggcauccagguguuuccauauaucuucugaaauguaggcagaauuucccaaacuucaauucuugacuucugugcacccacagguucaacaccauguagaagcugccaaggcuugggacuuccacccucugaagcaacagcuugagcucuauguuggccccuuucagccauggcuggaguggcugguacacaggacaugaaguccuuaggcuacacacagcacagggacaguggguccauccugugagaccaguuuuuccuccugggccucugggccugugaugggaggggcugcucugaaggucuuugacguggccuggagauguuuucuccauggucuuggggauuaacauuaggcuccuuucuacuuaagcaaauuucugcagcuggcuggaauuucuccucacaaaauaguuuuuccuuuuccacugcauugucaggcugcaaauuuucugaacuuuaauacuguuucccuuugaaaacagcauaaaacaacacccaagucaccuuuugaaugcuuugcugcuuagaaauuucuucccccagauacccuaaaucaucucuuucaagcucaaaguuccacaaaucucuagggcagaggcaaaaugccaccaguuucuuugcuaaaacauaacaagauucagcuuugcuccaguucccaacaaguuccucaucuccaucugagaccaccucauccuggaccuuauuguucauuucacuaucagcauuuuugucaaagccauucucccacauuuuccugucuucugagucuuccaaauuguuccaaacucugccuguuacccaguuccaaagucacuuccacauuuuuggguaucuuuucagcaauaccccacucuacugguaccaauuuacuguauugguccguuuucacacugcugauaaagacauacucgagacugggaagaaaaagagguuuaauuggacuuaacaauuccacagggcuggggaggccucagaaucauggugggaggcgaaaggcauuuauaugauggcaacaagagaaaaaugaagaagcaaaagcagaagucccugauaaacccaucagaucucaugagacuuauucacuaucaugagaauagcacaggaaagaccggcccccaugauucaauuaagaccccuugggucccucccacaacacaugggaauucugggagauacaauucaaguucagauuuggaugggggacacagccaaaccauaucacauacuuagcuaugauuaauaauucuuagcguuaaaaguucugagagggagcugucaccuugguuuuuuauacaagaucaucauaaauaaugagacaaauuuagacaauuugauaaugcgguuguaguaacauaaaguugauuuaauauauuaagucauuguaauaacauuuauugggcacauaacaaugagccaggcaaaaugcuaagaaaucuacaugcauaaccucauuuauuucuuauagcacugugauaaauauuauuauuuccauuuuauagaccaggaauagggauauagagagcuuaaguaauuuacccaagauuacaacuuuuuuuuuuuuuuuuuuugagacggagucucgcucucucaccaagcuggagugcaguggugugaucucgucucacugcaaccuuugccucccaggcucaaguaauuuuccugccucagccuccugaguaguugggacuacaggcacacgccacuacgcccaucuaauuuuuguaucuuuaguagagacaagguuucaccaucuuugcuaggaugguuucgaucucuugaccucgugauccaccugccucggccucccaaagugcugggauugcaggagugagccaccacacccggcuccaagauuacaacuuuuaagaggugacacugccuuuggaaccuagaucugacuuguuauuaaacagugccauguuuaauauuugcucuaguuuuuagaguugccagugcuaaaggaguaauacagaucuucgucuuucuaaucaaacucagcucuucucuguaagaugaagaaauaucuccuucauuaggguuaaugcaguaguggucuccuacugcucuuagagcuuuuaaaauacaaaucagaacauucugcuuucuugcuuauuaucauccuguggucucuuuaucgugauaaaauagaguacuaaccuugagcauaguaugcauggcuuaauacaguaagucaacuacuauuuucuuucuuucucucuaucgcuuaugucuacugucaucuuuugaacuucguauugguucuuaaauaugauauacuugugucaugcucucucuauugaguguccuuagccuuuuaucuaccugauauacugcuauuaaaaaccuacaucaaauaugaauacuaguaaucuccuauauucccauuaugugguaauguaucuuugcccacuagauuaugagcuucuacagggagaggaucauaacuuuucaauuuuguuuauguaguauaugaaucucauggguuaagugaauagauuauugaguaguaaugugguuaucuucugaaugucugcauucuacauaguuuagaaagcacguacuuacacugugaaguacuacaucaucccaaccuacuucuauuaaaugcuucccuuuucucuucuaccuagucucuguaauaauguuuaauauuuggaugguuaauauuuacuuaaaauauauagagagcaaaggguguucugucacuauaaauaugccucaauggauaaauaaguuccuguuauacuguacaaaucuuaaggcauuguaagaacuuccucaauuuggugguugguggggcggaggucaggauuuuguuuuaauacuauuguaauuaaaaauggaaaaaguuaucuuuuucuccuguauauauauuacuguaucuucgagaacguguuuccuccuuuguaguaguuuccuguugcugauguaggcaaauuaccauaaacuuagugacuuaaaacaacagaaauuuauuauauuuuagccuggaggucagaaauacaaauaggucucacugggcuaauaucaagguauuucuuggguauguauuauaauagaaaagaaagguauagagagaagagaaagacagauaauuuauuuuagaaaaguuaagcuuaagaacagucgaccaaaacaauauaaauggccagcaggcuguuagaaauguauccaaauuuaggaaacugaucugagcaagagccagagcuguacugcuagucauuuuguuuguauagcagugguuccuaaauuggugggccaggguaaucauagaugcuauugugauuaaagcuauguacuaucuccccugaagaaaauauauauguggcaaaaaaacucacauuugauuacaauuuuggggauucauaauccuuuccaggagguucacaaaauuaaucuuugguguaaaggguaaaguugcuuugcuacagauuuauuggcucuaugaauuuuggauucaucgagguaacauuuccuugcacauuagauauuugagugccaguugaguggaguuacagcaucuucugucaaguaaaucgugaaauuauuuuacuuucaagagaauaaaaguaugcuaaguaaagcagucacguguuuugcaauacguauuugcucugagaaauacauuguuggguuauuucaucauugugcacacaaacaucauagaguguaccuacacaaaccuagaugggaaaauacacuaacacgauagcugauaaacuuuaaaaaaaaucacacaaaaauuucauaauguuuuaagaaauuuaugaauuuguguugggccgcauucaaagccauccugggccacagguuggacaggcuugcuguacagcauguuguuguacugaaaaguguagccaguuuuagcacaaugguaaguauuuguguaucuaaacgucagaaagguacaauaaagauacgguauuguaaucuuaugggacuguuguacguggagucuguuguugacggaaacguuauuaugcaacacaggauuguauuuagaaaaugaaaccgauguaaaauuaaugagaauuccauaggagucaauauugugcuacaaugcuuguuaauuuuguuuuccuguuauuaaguugaauacauauuauguuuaacauauuaacuaauaacaguaagagggauaggggauagauagaauuuuaauuuaugaacaucaugcacaauuauuuuaccucauaauugaacaucugguuaauguaaguauuauaagcuuauaaauauuacaaaaacuugcauaauacuguacucuagacucauacaugugucagccaaugagcuaaaaaaaucacaaguuucauacaugcauuagcauguaugcaucuauaguacaauauuauggucacuaucugccuucuugguggagagaaaaggaagagucgggaacuuuugguugugaccaggaaaugggaagaaugggaaucaguauuaaaacugugcaguguaugguuagagucuuuauguucucuaaggagcuugacuaucaaacacuuuaaguguuuuaagccugguuuuuccuuauaauggacacguaaaacaaggagaaaacauaaaaucucagaucuccagacuaugucuuccuugagccuucuacuugucuagcaguugggugggguauauaauaggcuugguaaucacaaagcaagauaguucuguaagggagaaaagaaacuaaaaaagcaggucacuuuaggugaaggacacuuugcguuucagacaguuaaaacuacuagggcuuguaaaaauuucugcaacuauuaauuugauuguuaaucaaauuacaaauuuugccaauauguaaauuugaaauugcugccauacauuuauccacaaagugcaauaaaguauagcuuuagaguuauucugguucauguguaauauaguacugucauuucaaacaaaacuacaugguccaauacaacugagacaaaauuugucuucguguguuuggucaucuucuuuugccuuugacuuuauugaaauacuagcugaaaauuuuaggaaaugaagcucauggauucuacuaagaauuuuagaugauuuggaacacuuuacuuguuuuguaguuauaaucucaucagcaaguuuccucuuggcucuaccuccaaaauauaaccaaaucucucuauucaucuucguguccauuguuaucguccuaguucaauucaguauuaccucucaccuggauuucuacauuaguaguugcuguggauuuaauguuuuugcccccacaaauuuauguugaaauuuaaacuccagugcaacaguguuaggaggugcggccuuuugggagguguuuagcaccuaccaucaugaaaguaagaguucuaccuucaugaauggauucguauccuaauaaaagaacugagggugcccaucgcuuuuuggcuguccaccuucugccauguaaggacacagcauuccuccccuccagaggucacagcauucaaggugcaccaccuuggaaguggagauuggccucuuuccagacaaugaaccuacuggugccuugaucuugguuuucccagccucuggacuuucaagccucuagaacugugagaaauaaauuucucuuuaucaucuacccagucugguauucuguuaaagcagcacaaaauguacagagacaguaguuuaguucuccugcuguguaugaaaggauauauuugaaauuacuauucaaauaugaucagagauuagaaauugaguuacaguuuagguuuuuaauaaagaaggaacaucuuacaagauucucuuaauuugcuuuagaauagaagcuagcccacaaaugugguuauuauguagucugcucccacugccucuuaagaugcauauuguguuuauagugguggagcuugcuccagcccaucucaggagaauuuaauaucuacaucaacccaaccuucaugcacccgcacuuccucugacuguuucucugaguugaagauuggcaagaauuggguccagauaagaaucagagccucugaauaacuaaauaauaaaaagcuuccacaaaagaguaaauuaugaagccaaacccuuucagaguuucuauauaaagaauuauuuugaccccaauaauagauaauuaugguugaacaugaaaauucaauuauuucccagauccugauuuugaauuaccaggaugguagugucuucgguuuucaaugcuuuguugucauaaugauaauaaaaaguaauacucauauagugcuuguuaugugucaggcaugguuuacauuuauuauaagugagugcuguuauuucacacguaaguuugaggcacagagguuuaguaacuuucucaaagccauacagauaguaaguuucuaagccaagauccaacuuguggaaauuugacucuagaauucucacucuuaaccacaacccagugcaacuuuaaaaguauauucucuaaaaaauacuuauguccagaauauauuuuaaaaaacacuucuaaaaaucauaauaaagacaauauaauaaaaaauggucacagacuuaaaaacaagauaaacaaauggccaaaaagcacaugaaaagaugcucaacaucaugagucauuauggaaauagaaauuuaaaacgcugugggauaccacuauauacucaauacaaugaguaaaguuaagacugaaaacaccaaguauuggcaaggauguggugcaucugaaacugucauacauuauugaugggaauguguaacaguacaaccacuuuggaagauaaugucuuguauaguuaaacauguaccuauccugugacccguuaauuccacuccuagguaauuauuugagaaaugaaaaaaugucuacaaaaaagacauguacaagaauguuuauaacagcuuuauucauaauugccaacaacuagaaaaauccaaaugccuguccauguaagaaagaauaaauuaugauagauuuauucaauuagaggacuacuuaguuaaaaaaaauuaacuucugguacacaaaacaacaugagagaaagaagucagacaaaaagaguacaaaugguaauucuguuugauuccauuuauuugaaggccccaaacaggcaaaaucucuguguucggcauaaggauuuuugaagugaugaaaauggccuguauuuugauuaucauguugauuauacaugugucuuauucucuuuggacuacuauagaaaaauauaaacugguuagcuaauaacagaaauuuauuucuuacaguuucuacagaccaauuugcuuguuaaguaaucuaagcauaacacuuuucuuuauaugauuuguguaagugauucagauucccaguugguagaauaaauuaaaaauguagcuaaacuaagcauguuuguuucagcauuugauuuauaauauucuggaacuguuagggacuucuagaugcugcaguuuaaugugcugaaauacagcaguuuguccugguuauaauauuguagcaaauggacauauauagacaaguuuuaugguacccuguguaguuugacaguauuugccucugggauccuucacaacuuguuccguggcaaucagaugugcuggaacuacugaaaugaugaauugagguaguaguuuuguagucuuuuauuacaagaguagucuuuaaaauaaaggacaaccuuaaagucuguuuuugguuuuugaccucuuucaaguaggcuacuuucuguagauuuucauggaaguaguaaacaccuuagucaccacauguuaacuaauguguucuuugguuucucaaacaagacugauggcuuggcuguuuuuuguuuauggaaaagcuaauuccugaucuuugcaucuauuuuaguaauaguuaugcacgagugcgagcuguggugaugacccgagaugacucaagugguggaugguuaccacuuggagggaguggacuaagcagcgucacugucuucaaagucccucaucaggaagagaauggcugugcugacuuuuuuauccguggagagcgacucagggacaaaaugguaaugaauaauguaucuaauacuauaauuuuagauaaugaauuaucuguuuaaaguuaugauuaguauacuguugugaguuuuuuucaccugugaaucaguaauuauguuucuggagcuguuucuguguuaaaggcagugaaauacaacauuuuuuuuucaaacugagacugacauugauacacauuuguugggggaugggguugcugcuuuuccauuuacgcuuaaugcaggaguuaauaaauagucccccuaguuauucaaccgguaacauccugccuucccuucucucagcuauucccuagaccagagauuggcaaacuaauccacaggccaaaugcaagcccaccaauuguuuuuauauugucugugagcuaauaaugguuuuuauaguuuuacaugguuggaaaaaauuaaaaauaauaauuuuguguaacauaagaauuauaugaaauucccauuucaguauccacaaauuaaguuuuauucgaacauagccaaggugauucccuuauuaauucccuuauuuucuagucucauaagacuaucugguggccagccuaauuuuuaacacuauugucuuccaugcagaugugugguuucuuaccuguauacauuuuaaaauuucaguuuaaccuuugauaauguuauuugcucuuuuuuaauuaguauggaaagcuccuucacuuucuuuguuucauuugugggccaaaaacaacugauuacauccgaaaagcugaguaauguuagugucauuucuguaucaagaaaaagaagagcauacacuuagacgcaaaauaaaaauaaagucccaaaauagagccuugaaaauaacgagaauucccuuuaaauauauauuuguggaucuguuuauuuagcaucuuuguuauuucuuauguuuugagcuccaaauaauucuuccaugcaugaacaguuugaauaugacuuacuuucaguuugggggcuugguuucuucauauuuuuuuuacaucugaaucauuguaguaauucagaaaguugcuuaacuuucacugccccaauuucuuccccacuuaaagggagaguuauccuaaaucaucucgaaagccuuccuacacuaauguuuuaugaguuuaugauucacccaugcuacacauuguauaaugugucucagccaaaauauguuuaaguagagaaccccgauugaagucaaaagugaaauaugauaaauaugucaucuuuaaaaaguuuaaauuuuuaaagguggucuggccuuggauaaaaugggaucugccauauacuaaugcuuuuuuaagccuggagacaucuaagaaggcgccuaugaugguauaaugcuucuggucugagcuaaugguaacuggggaauauuguuggagaaauugucuauuuuagaaaccgaguaaaauggugaaaaucuaaggcauuuuuuucuagauaaacuuuuuccuaagaauacaaagguaguagaaaguaaaauguggauuaagagagaaaaaugcuugcucgaaaaauuauaagaacaaggaaaggaugaucuagaugugaaauagaaaaaacucagugaaacagaauauuggauauaguagagauggacaguuuaggauaauaagggaccaaaucugcauaacuaauuaugagucugcacagauugauggauugggugauuguucagaguguggcuuuaacauaaauaaagcuaguaaaaauaaaccugagauucagaaagaacagaaacuuuuauucccuaugacagcuuaaaaaucaagagcacuuacccuaguccuaggguauagaauauugauagacuaauaagaaaauagauuauuuugcuagaaguaacaggaaucagaacaccugauguuucacguagccauuuuucuuugaggaagcuuguuacuugugaaacggggauaagaaacaucucucaguauugccauaaaggagagcuuucagucagaaauuugccauauuucuuagagggauuaacuauaguauagcauucuagguagguuauggggacuugugugaucaaaggcagaggcgauaacucauggcuguaaauugaaaauagcgaagucuugugaaaucucaagacaaaugagacggugauauugaaaugagauuaauuugcacccucugcuggguaauacacugugaucaagacuacuucugaaaaguccagcaguagaauugacauauacauacauuaguuuacaauaucacugcauuuugagaucacuaauguucauuucuguagucauugauuuuauucauugguuauucauugguuuuauuuuaacccauuuuccugaguucuaguuucuugauuuuuuuuuuuaaagaaguauuauguuuacugagucuguaagucuacaggguuccucccagauuaaugguagcuuuccuuuaaaagccuucucggugaauaaacagugcacuuuaguaguaguucugauguaauaguuaugugaaagacaguugcugaaaacuguucuguaaccauuuugccuguggaucccaucuuagaauccucuaccuuagaugaauucuagaagugagauucuugccccucauaucccaugaauucaugcccuugaagaaagaauaaauauucagaagaggaguauaugaccacucguguggcuaauaaauacaauauuuuaaugaguguuuguaagucagaauacugauaacaauagugaagaagauggcccuuaucaguuaugagagaaccacuuucacagaagacuuuuccaaccuuugauuuacaauuacagguacuaaaaauaagucuuguuacgauucccagaaaguuauauacuuuacuguuuuauuuuuauuuuuuuauuuuuuauuuuacuuuauuuuauuuuuuuaagaaagggggcacaaaugaagagcaggcugccugagacuuguucaagaagacaucauuuuguguaacugagucaguguuuacucauucacucauucagugauccuauguugcuuaccuauaaagcaucuuuaugaugccuacaaaagguggaguuuauuuccuggauuauccuuugauacucuaaauuggagcuuuccaaccugugugccaugagugucuggggccuccagacugguugccuuauguuacuguucuauaugugccugaggagagaagaguuggaaagcacugcucugcauaauuggcuuucaugcuuuauggaugauugagaaagaaagaauuugaaagaaacaccagggguugguguuguagccuaagaaaaugaaaguacuaccuuucuuugagacacuuggggauggaaugaucguuguuaaggacagauucugagaaagucuuggccgggcgugguggcucauaccuguaaucucagcacuuuggaaggccgaggcaggcggaucacaaggucaggaaauagcgaccaucguggcuaacacagugaaaccucaucucuacuaaaaauacaaaacaaacaacaacaacaaaaaauaauuagccaggcgugguggcacgugccuguagucccagcuacucaggaggcugaggcaggagaaucgcuugaacccgggaggcguagguggcagugagcugagauugugccacugcaccuccaaugugggcaacagagcgagacucugucucaaaaaaaaaaagaaaagaaagucuuacuugaugugugugagcuauagccucuguuuucuucuaaaucuucauagccuugauuucuuccuuuaauucuuuaauacaaguuaguauuaccuuggagcacauauaauuuaaauuguuaacuaaaauuuaacuguucauuuguguacaucauagaguuccacauugccuauuuaguuuucauuagauauaaugguucuucucuguaaguaggacacuucugucuuacaaacauuuuaucaaaauguuuaccauuuguauagguuauguuauuugaccaucuuuaucugauacaugguaugugacauguaaauuuaaaauaccgaauuauaauacagcuuaagauuuuuuaaguuucugaauuaacuaguaucaaaaguuugcuaaaauaucuguuuacuacuaaacacaguuuuuaguuaucauggggaucuaaaguaguuuuucuuuaguuuauauaauagauaauaaaauauuauaaauuugcuaguauuauuaaaauuugcuaaagcuaugcuuuuuaaaccauauuaugggcuaagguaugacaaaagaauaggcugaguagaaagauaggaaucuuuuaaaaugcuugaauuccugaagaugcucuguggggacaagaaaaagcaagguuauaagacaguuaccauuauaaacuuagagugacaaagauaauguggaaauggagaaaggaaaaacuagaaauauuuccaguuuaagaaguugccaaagagauuaaggaauuguuuuuaugauuaauaaguaauuagguugucgauaaaauuguuuauagaaguugaagugccuuuaagauaaugguucuauuguuuaaaaagagcauguuuuaaaaauaagguuucuuuccaguuacuguagccuaaaacgaaauuagaauauuucuuuucuaggaagaaaauaaugugguuauaauauagcaguagcuuuauuaaaaaugagacucaccccuuucuaucaugggggaaucuugaaagaccagggaaacaucuuucugccuuggguugaacuuuaucgaaguacagaacaagaauuuccugcuaagcuuuuccacugugccucugaauuauuccuuugugaaacuucaguccuacagaagugguccuccacuaaaaaccaauugccuuaacuaacuuuuccuuaggauucagccuuccuagcaguuuuguuucuugaaagauacuaguuccccuauucaccguaauaccacaguuaggaaaagaaugggagugggaguagagauaguggaguauuguuauuguuccuuauuccccuuacaaguuauuagucuaucacccacauauauaaaucccauuauugaaucuguguagcauucagauuagcaucuauuagcuuucauuuucaucuacucaucuuagcaauuucuucccaaagccagauuuucuacaucugagccucaucaucauucuuggcuacuuuucuuugcagucucgaccuucuggucuucauuucagcaggcuacuuuccuggaucucguuguuacccagaacuguuccauuugaggaauuuuauaauuuccugucauuucuuuuuuauuccccuccuacugcucuucaauuucaugucuucgcuauuacauugugccuccaauuuuuuccuuaacuagauuccuucuggcuucaguauuuuuuuauuguuuucuuuuuuaauuuaaucuaaaucuuuucagucaaucucucaaacaacccuuucauucauauuucaguagacaauauguugcuaaguuuuuuuuaaccuuaguugacaauaaaggaacuucauugaauccuacaguauuuuccuucaguacucuuuucuuaggccaagcacgguggcucacaccuguaaucccagcacuuugggaggccaaggcggguggauugccugaggucaggaguucgagaccagccuggccaacauggugaaaccccaccucuacuaaaaaaauacaaaaaauuagcugggcaugggggcagacaccuguaaucccagcuacuuaggaggcugaggcaggagaauugcuugaaugugggaggcagagguugcagugagccaagaucacgccauugcacuccagcuuggguaacgagagugaaacugucaaaaaauaaaaaacaaaaaaaaaaaacuuuuuuuuuuuuucguuuuaaagguggguuguucauucaugcaauaaauauuguugaguggcuacugugugcuaagcacuguuguaggcacugggaauauguaagugaacaaaaauagaaaucucaguucuugagguaguauacauucuaguggaagauaaauauuacaauaaguaaaacaggaaaaugauaugcuagacagugcuaaggggaaaaaacguaggaaaagggaguauagggaaguuuuuugcuggguguggggauuggcuaaaauguauauagacacagugaccaaggaaggccuuaccaagaauguagguaacauucgugugaagauuauuuauauggugauuaagaucuuauguuuuaguuuguauguucagauuuucaaaucuucaguauucuuaaaguagaauaaauuuaucuuguuucaguucuuauguuaaacuauauaagaucuugaaauuguuuggauuuggugaauguucucaaaaugugcaucaacaauaguuauaaacuuaggaauuaucagugaucccuccauuuauucaaacagaucuucuuuauucuugauucuguuucauucuuuuaaucucuaccccucucauaucuuuccugcaaauaaggcuacuauuuuuuuuuucauugcccaguuuuaccuggcuccuucuaacuucuguguuauuuaccauaauuaaauuucuaaaacuugggucuaauacuucuuuaggauuccccacugauuuccuagagacaauuucaucuccacauagaaaauguuuauaaucuggcccuguccuccuuugccuuuaaucugucugccuuuuuucucaaagguaaucauuuccaugguauuuccuuacugaguuacuuguaguucaucagaaguaccauguauaagaaaaugcccuuccccuuuuacauuaauaaauauggcacuauauagauagcauauugagagauuauguggaguagagaauguugauaaacauguugcuaaugcucagaaaacaauaauggcaggaaacgguuuccuuuuuacugucauagauggaaaaauaggaaaacuggguuaaagcaccuuggacaaacaauuuugcugugaagaauuggaauugagauaaaugauaauaauaaccaguccagaaucccauucuuuucauuauuaacccauugaaaagguaauaaauuaugcuauuaauuacuuucuguacaaccaugaauuuuguaguuuuuccccagcaguuguuuugcaacaguuaauuauuuaauauugcuagcauaccuugaagagggggaagaagucugccuauuagcauuucuguucucuuuccccggagccuugugggaacugguuccugaaaauuaagauuuagaaaaugucccaaauuauuauaccuuccugguugccuuuauuuucucauuuagcuuaacacuuucaccuuucuucagcaaacucuuuauuauuacauuuccucuuucuucuuucaaacccugcauuuggcaucugacauauuuccucuuuacaauuuauuuuaaacuaacaucauuccuuucuguaguuacugcuuuucacugguugauuuggucugucagccucaucaauauugucuuggcuucauuguucucuuuuauaccugauugugguauauuucguaauuuauuucacauccuuuccauuaucuuccaauugccauuaaacuguaauagccucuaucauagcuaaauuaaagcccaaacucugaccucaaauuaucgaccauacuuauuagcuuuccaaauguuucugcacuacuuuuguuuuauuacauucuaaauuauaauuugaaugugucaugcuuuuaauugagugguugacuguaguauuccuuugguuaaucaaccacugagugccuucuaugugcuugacuuccuguauuaguuuccuugggcugccguaacaaaauaacguagacugaaugguuuaaacaacagaauuuauuuucucacaguuauggaaggugggaaguccaagguauuggccaauuuucuguuucuggugugggcugucuuccuggcuuucagacugucacuuucucaagauguccucacauggucuagagaaagagcucugguguuucuuccucuuauaaaagcacuagcccuaucagauuagggccccaccuuuaugaccucauuuaaccuuuaucauuuccucccuggcucuauuuccaaauguagucaccauggauauuagggcuuuaacauaugaauuugaggggagcacaaucccuucaguccauaguacuuccuauuccauuguacuguuugucuguugauuguuaguugaguaguauucuaugauaugcauguacacucucuaaauuaugguaacuuuaauaagaaguuuaguaucugcuagugcuaguuuuucucauuagacuuacuuuaacuuuuguggggagggguauauuuuugcuuauucuuucagaacuccagacaguuuauguuuuuucgcauguagguacauuuacuuaaguuuuuucuuaggguuauaaaaauguggcaaggggcuauuguaaaugauauauuuuaaaaaucauuuuugguaucuuuugaagcucuucaugcagcuuuuagaauaauguuagacaauauuggugauauaauaucuauuuucuuugggaauuuaaaggaauuucuaauguugcacagauaaguaugaugucagcuguugucuugagauguccuuuaccaugauaaggaaguguucuuauguucuccaccuccccagacuagaauuugauacuaauuuuuaugaaaucugauuuugcaaaugucucacagacuuuuuaaauugaaauuuuuguugagauaauuguagauuauuaauugcuauuguaagaaauaauaaaugcuguguacacucuaaccuguuuucccaguggcaacauuuugcaaaacuauauugucauaucacagcgaggauauuucuguugauacaaucuaucauauucagauuuccucaguuacuuguauucauuuuuguguguauuuuauuuaagucuguacaguuuuaucacguuuucacuaccacagacaagaugcaaaacaguuuaacaaccacaagaaucucuucuuucuguugauuuuaucaccacaucuauuuccguuuuugccaggcaaccacuauuuuguucucucaauuauuuccguaauuuugucuuucaaaaaauguuauaaaaguguaauaauaaguauguaaccuuucaggauugaccuuuuuucuuucaugaucauucuccgaggguugauccagguuauugaguaucuccagaguuuguuccuuuuauuguugaguaguagucugugauauguauuuauaugacuuacugaaggacaucuuggcuguuuccaguuugggacuaaauauaacguugcugugaacauucacauacauguuuuuucugugaauguaaguuuuauuucucugggguaaaugaccagguaugcaguggcuggguuguaugguaguugcauauuuaguuuuguuaagaaacugcaaaacuuuuuucuagaguggguuuaucaugccacauugccaccagcgguuuaugagcaauccauuuucuaagcauccucaccagcauuucaaguagccacuauuuuuuguuuuacucauucugagagauguguagugauaauaacuuauugugguuuuaauuugcauuuuucugaugacuaaugaucaucuuuucauuugauuauuuguaccuucuuuggcgaaugucagucuuuuugcccauuuucuuauuggauuguuugagggguuuucuuguagauagcgucuucuucuagugcaguggcgugaucuuggcucgcuacaaccucugccucccggguucaaacgauucuccugccucagccucccagguagcugggaccacaggcaugcaucaccacaccuggcuaauuuuuguauuuuuacuagagaugggguuucaccauguuggccaggcuggucuugaacuccugaccuuaagugaucugcccgccuuagccucccaacgugcugggauuacaggcgugagccaccguacccagccuugcuuuuuuacuauuguguuuggagaguuauuuguauauucuagcuacuaaguccucuguuggaauacgugguuugaaaauguucucucccagucuguagcuugucuuuucaucuucugaacauggccuuuugcagaccaaaguuuuaaauugugauaaggucccaucuaucaaguuuuucuuucauggaucauacuuuggugacaaguccaagaacucuuucccuagccauaggucaugaagauuuauccuguguuuuuuuccugaaaguuuuauauaauaguuucaccuuuuacauuuaagcccauuguccauuuuaaguuaacuuuuguguaaauugugauacuuagaucaagggguuuuuuuuccuaugaauguccaguuuuuccugcaccauuguugaaaagauuggauuccucccuugaauuacuuuuguucucauuaaaaaucagguaagcauauuuguguucuuuauuauguuccauuucucuauuuguccaucccuccaccaguaucacacacuguauuauuguggcuauauaagaagcccuaauacagaguagaaugauuccuaauacagaguagaaugauuccucccauguuacucuucuuucucaauauuguuuuagcuauucugggucugugcuuuuccauauaaauuuuagacuauucuuuguguguguguguguguguguguguguguguguguguguuuggagacgaaguuucgcucuuguugcccauacuggagcgcaguggcgcgaucucggcucauugcaaccucugccucccagguucaagcuuuucuccugccucagccucccgaguagcugggauuacaggcaccugccaccacgcucgcuaauuuuuguauauuuaguagagacggggguuucaccauguugaccaggcuugucuugaacuucugaccucaggugauccacccaccucugccucccaaagugcugggauuacaggcaugagccacugugcccagccaaauuuuagaauauucuuguauguaucuacaaaaaaaccuuacugaaaccuuacugggguuuugauaggaauuguauuaaaccuguggaucaacuuggggagaauggacaucuuuacuaugaugaacuucuaauucauaaauacacugugucucuguuuaggucuuugaauccuuucauuaacauuuugugauuuucaacacauagaucuuauauguuuuguuaauuguauaccugaauguuuuucuuauauguuuuguuaauuguauaccuaaauguuuuguuuagagcaauuguaaauacuauuguguuuuuaauuuugguuacugcauguccauuguauauagacaugcuauuaauuuucauuuguuguucuuguauccuguuacauagacauauuuaauucuuuauuuaaauucccuggaauuuuuuaauguugacaucaugucaucuacaaauaggaagggauuuauuucuuccucuucaaucuauaugucuuuucuuuuucuucccuuauuucuguggcuagaaccuccaauucuauauggaauacaaugguaguagaguacauccuugccuuguuucagauauuaaccaaaacacauacacucuuucacuuuuaguauauuguuggcugggguuucuugcaggcauuuuuuaucaaauugagauaauucuacucuugcuaacuugcugauaauuuguaucaugacuagauauuggaguauguuaaauuuuuuuugugucaauugaucacauuagccuguugauacgauagauuauauugauugauuuuuaaauauugaaccagcccuguuucugcaauaaaucccacuuggucaugguguauaauuuuugauacguuguuggacuugguuugcuaauauucaguugaggaauuuugcauuuaaguucauuagagauaauagucuguaggucgguggggguuuucuugguacuguuuuuguuuaauauuggugucaagguaauacuggccucauuaaaauaaguugggaaguacucccucauauucuguuuucuggaaaagacuguaaaauugguguuaguucguuuuuagaugguagaauuuuucauugaaacuaucucaauaugaagaucucuucagaagauuuuaaauuacaaauucaguuucuuuaauuguuauacgacuauucagguuaucuauuucaucaugguugaauuuuuauaauuugugauuuuuaaauaaucggucaauuucuuuuaaguugucuaacuuaugagcauaaaguuguucuuaguaccucaguuauucuuuuaaaggcugcaggaacuuuagcaguaucccguuucauuccuguaauggauuuguggcuuugcucuuuugucagucuugcuagagauguaucaauuguauugguuuuuagaaaaguaguuuuuguuucacugauuuuucuucuauuuucaauuuuauuucuguugucauuuucuuuuugcuugcuuuggguuuauuuugcucucccuucuuuagucucuggagguaggaacuucaauuauugauuugagauuuuuccuccuuuguaaaguccagacuuuugaaaagacuucaguucacuauaguauaaaguuuugguuuuauaaaauuuaacauuauuuauuaaauuauucaaauuuauacauacuuuuuuguuuaacuuucaaagguugaauaucuccaacugucauguuuuuggauauuuuuguguuucuaaaugguuucuguguuauaauaggguauugcuguaucaauugguucauaagguucguaacuguuaaagucuuagaucuucgagauucauuucaucaacauuauaugagcccaucuccaaauuauagaaauccagugagagaaaagagaauugccuaagcuuauuuaguuuuauucuggcaguuuagaaaucuagcaaccuguggggacccaagaaaaagcugagucaggaagccugugcccgauuguuuuuuguuauuuuuuagugugccuaccaggagucagagccauauuaauuccuaauuaggagucaguuuugacaaugcccuccccuuuuguggguagaauuccccuacaguaucuauaaaagguggugacauucuuguucuuugaccucuaguccuugauauauuuccaagauguccugguggaaucccaguauaucucaccucacauuccccucaucccaugucgucguugcuuucuagucauucacuuucguuaauaguuacaggucucuaaugguuuucuauuuuauuuuucaguuaguuugguaaguuacaguuuuuuaggaaauuggcuuguuucacuuaaguuuucauauucagggucauaaaccuuuauauuguauucuuuauuaauuuuuaaaucuuuacuuuuaguuuugucccucuuuuucuuccuaacauaguuuauuuguacuuuuucuuuuuuucuuguccauuucacuggucuuugcaaauaaucagcuguuggcaaggauacucucaagcccucuuguauaccuuuuaccuaaauucuccaauuuuuaacauuugccacauugaauguaucauuuucucccucucccacacgcacacacccacauacacaaaaaacacuuuuuuucugaacuaugugauguaaguugcauuacagccugcuuuuuacccuaauuguucaguguauuuuuccuaagaacaaggauauucucuuacaaaauuauaguguauuuaucauauuuaggaaauuaacauaaauacagucuuuaaucuacagucccuauuccaguuuuuacaaccguccauguaauguucuuaugacaauuuuguuucuucaguauaagauaauguagcauuuaacugccauagcucuuuagucuucuguaaaauggagcagugccucagucuuuaaugacauagacauauuuaaagaauacugggcaguuauuuuauagaauguuucucaauuuggauuuuucuaauguuuccccaugauuagauucauauuauucauccuugcccagaauaucauauaacaucuugugcuagaaaguaaaguuguacucaaugggugaaaucuuguugaaaagacacaagucagcaugaaggaguucccuuuauccaauuaaaguaggauaaaugauuauaauucauugacuaaaacaggaauucauauuauccguuacauuauauuauauuaucuguuauauuauauucuauauuauaucauauuauauucuaaacaagcaagcaaauggugaaaaaguaguucuuccuuucuguagauauuuuuaaaugaauucauacucuuuauuucuuaauacauuuuuggguuuauuauauucauuuuuaacauuuuaaauuggacauugaguucauuuuauuuucagauuuugauuuucacucuaagcuuuuuaaacuacaaauuuccuuuuuggcuucuuguuuuggauuguugcacuacacaaauuuuuauauggaguuaauuucauuaucuuuuaggucuaaggguuuucuaauucucaugcugauuuauuugauucacuugucauuuagaagcagguguaauuucuuucaaaagaacagguauuuuaaacuaaaguuguauugcauuauguuuagagaugauagccuaugcaauaacaguuauauuugucaagauauauguuauauuguggguaaaugauuaauuuaccuaaguguuccacauauuuuagaagaauguauuuuucaaguaauucauacagguuucugcaugugucccauaggucagauguuuuaauggugauauucaaaucugcuuuaucuuuacuaauuuugugucuauuucaucuaucaauuauugagacauauauucagauauguuacucugauuauagauuugucaaguuuuucuuguguuuauucuugccuaauaaaaauguauggauuauauuucuacuaagugaacuuuauucauuauaccuuuuagccuaagaguccauuuugcuuauuacugucagcauccaccaccuuuucccaauauuauaaugucaaguuuaauuccagcugaacacuuuuucauauccuuguagucaugugagccuccaguuaaauuuuauuccucuauugguuguuuguucuaauuuuuauuauuugcacacauacguguauacuuucucaccucauuuauuuaaguaggaucuagguagaaguguggguuuauuggaguaugggaacuguagauacugguguuccaguuacuaucuuuuugagugaaaauaaaauaccuauguaugucugacugucaaauauuugaucucuuuuguaacuugcuguuuuuuauauuaacuauuuagucauacaaaaauaauguguguuaaaauaaagugccauaauuaugaaaauaugauaccauuuucuuuccuucucuccuccuuuauuccuuuuuuucucccuccuucccuuccuuuugugguagcugaagguaacggaacugcuauugugugagaaucacugccauugcuguuucuguuacuuuuauuuuucaaugucuaaagucccacucagcucagaacacaguguuaaacacaaauuuauauuaauagacaauuguaaaaacauguauuugauaacauaauucuauauagaaugucauaauguauuucuuaaaggguacagguuuuuaugucauucagaaaauuaaaguucauuauaagggcaacuauuugagauaucaguuauugacuuugguuaucaaguaauuuaaucugaauuuggaauuauuauuuuaaaaaugaaauuauuuuucauuggauucaaagguauuucagaaaguuacuaguaaaaauuuuuaugucugguuaccaagcauacuacuucuuagauaacacuauuugugaacauauaauuaucuacucguaagauagcaacuacaauguaguacuuaguaauuuaaaaguauauauuuaauuguacucucuucuuccaaauuauuaguuguuauuagugaaacaaaaugcacuuacacccauuuuuggcuuggucuauuuuaaaugcuucuggcaugcaacacaguuauuuuacgaugggaguuuugcucuauauuucccaaaauaacuuggaauaagucuucagaaguuguaguuacuuaguaaucacaguuucuccccuuuuuucccccucuguaaauucucacccuggaacuuuuuucagaugaaggaaaaggguuggagauugaagcauuuuuacagccuuuagaauccauuaacaaacucuucagaauuuacucacauaaguucuuugaagugcuuaauaguuguaucugucacucaaacaccucugucuccauacucaaaaauccucuucauaaauaaugaucucccauccucgcauagcaaguaaccuauugugggguaguggcaucaccuagucaccaacaucaccaucacuacuaagauuuauugaagauuuacuaugugucgggcaguauuuugaauacuuuauuaguucaucuaauucucaaaagucagcuggauggugagugguagagacuggaugggacccagcaggucuuggcuacaaagccuacaagcuuaacuaauuacucuacugaauucuuacacaguaguaacuguuuucuucuuccuugggaagugaaugugucauguuccuggccuguucuauuuuucauagcuuaaucauuuuauuuugaacacuuuucacucauauaaaaaucaauuuuuguuaaacaccuucuuccgcugucucuuaaccugguguaguauaaggaaaccguuuguuuucccucucccuucaucuguaucagauuuuaauaaauuuaugucaacaguauuuucaguuuucuugaaguccagaguucaccuguuuaucuguuuaucuguauuuucguaaauaacaucuguuuaauguuaacagacaaaaacauaaaaaauaaaaauagauuuuaaaaguuauuuuuguuaccacuggauugaaagacuuuaagaucuucuuaaaauaucugugguuccaaaaauauuuaccuugcuaguaaagaauuuagacuuguaugucuuaagcaacuuagauuuguuaagaucuguguuggaaugcaaaguugugcuaccaaauacaccacauaacuguauuuuccuccuuuauuauuauagucacuuuccuaaagccggcuccagccagucuauuugcagcaauuauauuguacuccaaccuggccagaucuguuuguaaaagucugaauuuuucuucaugcaaucaguauaaacauuuaagugcuuuugaauuuguugcggcuuuuucuaguuuacaauuuuccauuauauguuuuuuuuuuuuuuuuuuuuuuuugguuaaugucuuuauuucuaaucccugugcauuuguagaugaugaaaaguucaaaaaguucuaguacuaauaauaaaacauuaauuuguucuuugucaaccagccacauuuuuaauggaucagugaaggguuauucgugucauauuauuuuggcaucauauucuuuauaguuauucuuguugauugaguccuacauuuaauauuuacuuuacaguagcugucuacacuucugaugucuuuccaguuuauuaauauaaacuauauuuugaguaaaaaagagggugaggccacugguuggcuuuuaaauuuaucuuuacuaucuauuuuaugaauguccuucauuaauacgauggggaccugaugaaauucacacccacaacuaauuaauacuagcaagaaguuuauucagcuuuuaauuagaauuagggauauauuccaauagacugaauauuuuuaagauuauguuuuuaauagcuucuggcaauggccuuuaggauagucuuaacaagacuuagaauuauuuauuuccuuuugcaccaugucuugucuuacaaagaagacaagauguuaauugccauugguaauuagucuaacuuccuauuggccagaaguaauguaucccuuuaccucauuucuccuacaaaguaaauaauucacuugguaauauggcauugguuguuuuuaaucucuugucaaagauguaauugcuauuuucuacaguuuguuugcuaauuaugccaaucucaaauaugguaauucagcauugaacucugcuuccuguaugauuguuguuacuaauauuacuauuaucuuaagauacagaauuaauacagugaaaacuacauugggcuaaagucagaacuuaguguucugauauaguugagaagggacgugaaaauagccagcagaauucaguaauuuuaagaauccucuagcccuuaaaauuauuuuugcuuuucaggaauguagauuuaguucucaucagaugaugaguaaacaucuucugaggcauucuuuuuuucugcuuucuuuuuuuuuuuuuaacaacuuucaaccccauugauuuuuuuuuuuaaguuugaaguagacaguugguaucugucucuguuacuuaaucaagguguacuauacauuguguuuaguaugaugaaaguacauuuuacaaaaugcuacuuaaagucaaaagcaaaacaacuuucuaauauauugugucacuuagauaaauaagaaaauauuguacauugcauagggaaccuaugagaauuauguaaaugagcaauagacuguucuaggaggcauauccuaaaaauuaucuacaaagauguugggugauugugccaauagauuaccuuuuuucuauuccacugccuauuccaaaauucauuuuagcagcuaccauagaaguuuuucccuaaaggauaaucaguuuuaugguacauuaaauauauaaugccaacaguauuuucucguauuuuuauagauagacguaaacaaguugagaucuaguuuauaauuaguauguuuuuguacugguugguaugauauuuaaacucaguauuuucaugacuuuuacguggaacacauuucugcauggguauuuaugugagucaaagagcuaguucauuggccucuucauuuccucagugcauuuuaaagcucauuuuuauugauuuauuuacaauuucaucuuuuagauucaagggguacaugugcagauuuuguuaccuggguauauuggguaaugcugagguuugggcaauaauggauuuugacacccauguacucaauagguuuugaacucuuaccucccuccuucucuuuccccuguaguaguucccagugucuauuauugccaucuuugugucuaugaguauucauuguuagcucccucuuauaaguaagaacaugugguguuuggcuuucgguuccuacauuaauuugcuuaggauaauggccucuaacuauauccauguugcugcaaagcacaugauuucauucuucuguaugucuguuuaguaucccaugguauauguuuuauaaguauauacauaccacauuuucuuuauuuaauccaccauugauggacaccuagguugauuccaugucuuugcuauugugaauagugcuugaacuuauuuuuaaaacuacuuuuucugugaguguugggaggcucuaaacaauagaugccauuugaagacaagauuaggguagaucacauugaaauuuuauuugagaguuaauaguugaaaauauuaauuuuguaaaauagaagagggggcuaauucaguaauauuuucauguauuaaaaauuaauuugguguuauuauuauauauuaaaaaacuagaaucaaacuguuuuuaugucuuccccuuuuuaacaauuccaauuuagcauuguuuuacaaaauacugcuuuucccacuguuuaugaauauaguauaaauguugcaguaauuuaugacacuaccauuuacuuccccuugaauucuagaacuuaaucgugaauuguuguuguuguugcaaaaugguuguaacaaauauuuaauaguaaaucuguguaaaaugcuuuagcaaagugccgacucaaaaaagcucuggauacauguaaauuauuuucuuuuuuugagacagaguuuuacucuugcugccuaggcuggagugcaauggcaugaucucggcucacugcaaccucugccucccagguugaagugauucuccuggcucagccucucgaguagcugagauuacagguucccaccaccacgcccggcuaauuuuuguauuuuaguggagacggguuucacuauguuggucaggauggucuugaacuccugaccucaguugauccacccgccucagccucccacagggcugggauuacaggcgugagccacugugccuggcgguuaauucuuuucuaauacacauagagucaucaaaguauaggaagcaaaagucuugagagaauuucacugcauugccuauaaacgggcaggacugaaccuuagucacauuuuugguuauuucugaauuaauaaaacuuacuaccaagaauuauuauauucagugguaugcugauaaaagguuuaacaaucagcuuucaagaggggacacaagucaaugauuuauagcauuuacauaccucuaccauggcugcuuuuacucaacaugccaucauugcauauagcauugggaagaaaugagcagcaguguggcauuauauaguauuuccaccguacagauaugacagacauaaacuaccucaagaaccuagguaauuguaaaaauauaguaaaauaauuaggaacugaugaguuuuguguauuuauuauuuuauuuuuaaugcaauuuauuucauuguagaguuauauauucuagcuuuuaacaauggcuuccaaaauucuugaaaauuuaauaucuggcucuugggagccaguauaagcagacucuagcagaccuccccuccaaaaguauaaauuagagauuccuaguccaugaucugugaaugaguuccuugggaagugcauaaagccuaaaagauuucugaggagaaguauugguugaguaccuaauguuugucugccacuguaguuuaaggauuuggcaaacagacaaagaccagcucaugcagggccuaguaggucauaguaagaauuuuagucuugaaagcauugaaaagacauugaaacuagggagugguccaguaaaguugcuauuuuuuuuuaagaaaaauuauuacucuaccugcagaguagugcaauuacuauuaguaauucacuacuacuaguaauaucugaggggaucaucagcagugcauggaagagaugugcaagugauaauggugauuggaaaagaguggagguaaugaaaauacaaccuuucaccaaauaccagcugagcauuuauuaugugucaugugcuacuauggguuucauuugaauuauuuuuaauucuuuuccuccuguuuucuuauaggggauucuuaaaauaauuaagguguguaguucuagucuuuuuauuagauuaauugcaaagaucacuaauauauccacuuuuguuuuauuugacaacuaacauauauuaaaagcauacugugaauaugaugaaagacaggcccaggaacgaaagacugaagagaccuuauaacuguccuggaauggauccuauacuggaaggauuuuuaaaaugcucuaaaagguguuauuaguauaguaggcaaaaguggaacguggucuauggaacauggucuauagauuaaaguucuguguugguuuuaaauuuccugaaugagaucaccauacugugauuacauaagagaauaguauugcacuuaggaaauauacucaaguguguauuaaagagcaguagaacauaauauauguaacuccuuugaaauaguucauaauaaaguaaauuaaauguuuauacauggauauauguggagagaauguuaaaaauuaaugugauaaaucuggauaaagggaaaacaggaauuuucuguguuauucuuguuacuuuucuacaaauuugaaauacuuucaaaauaaaaaauuuaaaaaccaaggguauauugcuucaugcauugcaugaagcucuuaacaugaaugcacauucggucauuccacucuaagcucugggauauuuuaguacugcaauuucuguuuuacagaugaguaaacuaaggcuucaaaaguuagguaacucacuuaaaugcauauuuugaaaaaguggccaaguguauuuguuuuacugcugugaccauuaaauccuuacacaaaauauaaauacgucuuuuaagaaguuuaggaaaaugacuuuauuuuguuuuguuuuguuuuugagacaaagucucacuguguugcccagguuggagugcagugacgugaucucaacucacugcaaccuccaccuccugggcucagacgauucuccugccucagccuccugaguagcugggauuacaggcauguaccuccacacccagcuaauuuuuuauauuuuuaguagagaugggguuucaccauguuggccacgcuggucucaaacuccugauuucaagugauccgcccgccucggccucccaaagugcugggauuacaggugugagccacugcccccagccaaaaaugacuuuaaaaaguuaaauuucuauuauuaccaacccccugccuguuuccuggaaguaauuccugauauauuccuccagaaauuuuguaugcaaugggaguguauauauguguguauucuuaaaaugggaguauaauaagcauccuguuuauaaugugcauuuuuuuauuccaucuuaaucucuuuauugagugacuuugugaaguagaccacuuuauuuaaaauacuaaaaauuauucauuaaaaaguaauagcguuguaucaccucaguuuguauuuaugagcuacauuagaugcauuugauauauguauauuaauuuuugguauuuggcuuuugucaggugguuuuggaauguaugcuuaaaaaagaccucauuuauaauaaggucacuccaacauuucaccacuggaagauugaugacaagaaguuuggucuuacguuucaaaguccugcugaugcuagggcuuuugauagagguauccgaagagcuauagaggauauuucucaagguagguauucuugacuauuuucuuaauuuauuuaucgguuauauauaguagagguuaucuuucuuaaaguugacccaaaguaguuuucacacuuuaaccaugucagcuuuugugauaugugaccaggcuuugaaaccucacaauagaugaagauaaaauaauagauuccuuaacgugauuuguauuugucacaucauagucuaugucaauugcauguauuaucuugaagaguccaucaacagcugacuucagauaauucaaauguuuuaaaauaagagcuugaaggaagagggaauagaaauguacagcugcgagaaucccaguugguauucuacuuguguauguaugacaccagucacauccuuuuuuuggguaauuauauagaacuuguaauauucaaauguauguagacucuaguuauuccaugacaaaagucuuuacuugauugauuucauuauugaggauuggcagagaccacaagcucaucuauuccuuuguuaucuugccagucuauuaaaauuauuaacucaaaagcauacagguuuugaagggaagaauaauguuuuuucauguaagacuggcuuaugcuuacuuaaacaaaaaucacauuaaaacccauuucuucccauaaaggaagaacuaagacuugauuuuuuuuucuaauuaggaggaaaauuauuucaauuuaacuaacuuucuauauaaaguaacugaaagugugcuagacuacguugugauuuguguuauuuugaagaugucauuuuaauaagaaaaucugaaaacauaaacugugagaccagucacaggcaagaacauggaaauacauuguacaaaucuguuuugauagugcauaaaacuguaguuaaguaauuuauuuagcuacuuuaaaagauuagaauuugguaaaugaguaauuuuuuauucugauccagaaaaaauuacuaugaaguaauaguagccauuuugucuuuauuguaagaccccauaaauucuccuuagaucaguguucuuaaccuuggcuacacauuaaaaucaccugggaagcuuuugaagcuuaaaaugacuagucugcacuccagaccaauugaaucuaucuggggaauagagucgagucaucccuuauuuuucaaaaacuccaagaaaguucaaauauggugaagaauuguucucuagucaaggaauuguaauuugaauuugaagaaaaaaaaauaagaaacuuaaaaaaaaaaauacaugauguucugugccucauuccacagagauucugauauauuuugguuugacgccauacucuggcaucaguguauuuuuugacaauuccucaguugauucuaaccuuuagccagguuugaagaaccagugcuuuaaagagagagaaaaauaguauccauggcugcuggaauuuauaugauuuaaaguuuugaauuacuuuuaaguuuaugcucauguaccauaacaguauaccucuuucacuaggaucaaacagauuggguuuaauguuuuaaaaaaugauuuauaaggaguagcuuacaaacuucuagguagaguagacuacaguacuuagucugccuuguuauuuuugaacauuaaaaaacauuagcuagcauuauuaucagcugcuauauagacuuucaacaaucucaaauugcuuuuacucgaccuucugugacaaaaagauaaaauaugcugcucuuuccaaagggcgcauuucuucuuaucucaugccuacuccgugcuaagcugugccucucaaggguagcaugaacuaagaguacuuugcuaggacaaauccuuucuuauuaauuuauugaaacuaaagguacucuuaacagcaugaaaaucuguacagagacguugaugcaaaaaagucaguaacaacaauuggccauuaacugucaauaguggauuaaaacucauuuguuuuccaucuuagcuaaagcaacuaaaauccugguuauggguacuaaauacuguuuccugggucaaagcauuuagaaaaauugaauaaaucacaucuuagcaucaccagagcaauguaauuauaaucugccuaguaauuuugaguauuugggagaaacuaggggcagggguagcuagagauaguauacuuucagagaaaacaucucguuaguaagcagcuggaaauuuaccuauagaggagggaaauaauuacauuauucuccauuauucuaacaggggcaaaugcaaguggccaguaccuuaauugccaggcaguccagaaagaucucugauuagucuucuaaaguauuauaaugacauaaucaauuagucauuaauacuggacucuaagacaaaaauucuauacuuaauuaacuuuuaucuauuuucuuaggaugccccgaaucaaaaaaugaagcugaaggggcagaugacuuacaaguaaguaauggcuuggaaggaauuuguaaacauaaaggauguggaagaaaucacuagccuuauucaauaaacuuaucaauuacuaagaauauuucuaagacacucuauuugucagauuucuccagaagaaaagaaccaauacagguugagcaucccucaucugaaaauuuaaaaucugaaauguuccaaaaucugaaacuuuuuuucuuuuugagacaaggucuugcuauguugcucaagcuggucucgaacuccugggcugaagcaacccacccaccuccccacagugcugggaucauaggccugagccaccgugccuggccccaaaauccgaaacuuuuugaguauggacaugacaccucaaguagaaaaaauuuacacuugaccucaugugaugaaucacacuaaaaaugcagucagaauuuuguuucaugcacgaaauuauuuaaaaucauguauaaaauuaccuucagccuguguguuauaagguguauaaacauaaauuucaucuuuaaauuggguacuauccuuaagaugucuuauuaugcacauacaaauauucugaaauuugaaacaguucugguuccaagcauuucagauaagagauaucaaucuuuauauagaaaguaaaguuucugggguuuuuuuuuucuuuuuuaaggaagugguucauaagauugugggcuggguuggcagaaugggcaggcacgcugaaaauuggcacaaguugauguugcagucaugagaaggccgaauucuauuuucuucagaggaccucaaucuuuuuucuuaugccuuucaacuaauugcgugaggucacccacauuauggaggaugccuaacugccauauuaaaaggacauucaagcaacacuguguagauauucauguggugaggaacugaagcguucagacaauagccauauuagugaaccaccuuggaagcagguuauucagcuccaagcaagccuuaauagaugaccaguuguggcauguuuucauugcaaccuuaugaggaacccugagccaaaaccaucuaguuaagcugcucuugaauuccuggucaacaggaauugugaaauaauaaauguuuguuauuuuaagccacuaaauuugggaaugauuuuugacuaaugcagauucugaagaccugaaaauggagugcugcuguaacaaauacuaaaacaugggaaugacuuuggacucaggacucagacaguaaauaaaagcuggaaggucuuugaggcgaguuuuagugaaguuccgaagagacuuacuggaagcuugaagaucuuuggauagagcgucagugagggcuuaaaugaaaaugaagaaaaccauauuggaaaauggaagaaagggaauguuuauuuaguggcugaaagcuuagcaacaaugucauggcaguaaugugggaggcagaaaauguaccuaauguacugagugguuaagcuaaggaguuuucaagcaaaagguugaagcuguuugccugauuucuucuuacugcuuaugauaaacaguaaaugagagaaguaagcuaaggaagggcuccuaaacaaaaagaacccagggcuuugcugguuuugagaauucucaguuucucaguaugucaaauggcuaagauuaagaaauggcuucuaagcaaagaucaaauccagggccuucuuagaaaagcauugucuaaggaugugaguguaaauuccuuuguuaagaccucaggaggauuuaagaugaaccucagagaaacuuucgauugaaguaguagguccuauacgaaguguaaauguaugucacuuagcagaaguuuaagguugagaagaguuuuucucauuuaugagugugcuuuuuaucuaauggaguggaccucuacaagauucacaaaguuuuucaaagcauuauauuggcagaaauaccaccuuugauugaagaggggcccuuuggauccccaaaauuccacuggcaggaagcaaguugaaaacacuaugcagaugcaaauuuggccuaccuuucaaugaaaauagaaggaaauuagaaauuagaaccaagaucucaggccagagccacgaguuaugaaaaauuauucccagguccuaaguuccacucuaggaacuucuaacauugccaccuugauuucagaauuaugugcaccaauaacuauguuguuccucucauuuuuuccacuuuugagcaagaaggucacauggcaguuacccucugccuguccuaccauugucuuuuggguauguguugggcagguaauuugucucuuaaguuccagaaacgagauugagagaagcaauauauauucaaggagcagcauuuaaggaacuaccuacacccaggaaauuucaucuguaccugcaccuguuuagaagacaacauccuagcuuugaagauguuccuguaaaaagaugagacuuuuagggagucaugggaggguagaguguauuuugaauaugagaaaaauauaaauaauugguguucaaagagcagugaaguauggucguuuuaaaauacggaaacauuauuuuauacuucucucaucauuggagucuaauuccccucuuccugaguguaggcuguuccuagggacucacuucuaccacacggaauguguugaaaaugaagugugacuucugaggguagauccuaagaaaauuucuggauuccaucuugcuuucucucuuggaucacucugggagaagccagccacuauacgugaagacacuggaggagagauguaugaagagauccaugugaggaauugaggucaucugccaacaaccagcaaggaacuggagccuucuagcaacaaccacaugaagugaaccauccugaaagcaaguccuccagccacaaacaagccuucagauaauuacagccacugcuaauauccugacuagaacuucauggggacuaugagccagaaucacccagcuaaauuggucccacauuucugacuuacagaaacuaugagauaauaaauguuuguguuugaagcugcuaaguuuugugguaauuuuuaaugcaucuauagguaaagaaugcacaagcaguaagggaaguuuaacuuuuucuuaagacgauuagaaugauagcuaauuuuuucagaguuacaacugcaaaagaaaacucuuaaauuuaccuuaguaccauuuauuucauucaugauguucuaaagguuuagaaggucauucuucuuuuggaauguaugggaaguugcaguguguucugauuuaucuagcuacuuuauuaggaauaaaauagaucauguuaaguuucauaauucaucuuaugggcuuggcauaaauguuuugaauacagauuaugguuuaaggugguguuuauaucggguuuacuucauuggcaauuguuugcaaagacaacuaauauaguuuaaaagaauaaugcauuaucuaauuuuuuaacaguaaaaguaaugauaauguuauauuuaaauaaauguuuugaaggcauuaaaugucaagaguggaaauccucucccuuuuggauguucauuaauuaauucaacaaauauuugaguaccuauuucugcaccaauaacugcuagacauuuccuucauaagcuauuggacaacuuucugcuuucaacaauuaaugucuucaucaauuaucauaagucaacaaagaaauuuaccuuucuauuucauaucugucuuuggaggguuuuauaacagaucaucauuugaauuuaaaauccuaucuuucuuaucuuuuauuccugauguguaguauagugcuaaucacauacauaguuggcacucaaaaguuuugaggaaaagucuuaaaaguuaagauuuuuaaaaaccuaaccaauauuaaggugugaauguucuuuucauuugguuucuuuucuuugacuauuuuaaugagacaauugagagcuuuugguuuuuuuguuuguuuuugagacagggucuuacucuguugcccaggcuggagugcaguggcaugaucucagcucacuguagccuuugccuccugggcucaaaugguccucccgcaucagccucccgaguagccauaggcacguaccaccacucgcggcuaauuuuuguaucuuuuugguagaaacgggguuuugccacguugcccaggcuggucucaaacuccugggcucaagugauccacccacccaccuuggucucucaaaguguugggauuacggcaugagucacugugccuggucuagguuuuucuuguuguuguuguuuaaugcuagcuuaugcuuguuuuaagaucauuuuaagugcugacagaguugucacaacauuuacagcucuuauuguucagauaugcuggauugagaacaaaacccacaaaacuuaccucacaacaggcuugagguugaaagaggaaaagaucuuagauaucauguuuuugggcagaagaaagaugagaucugauugauaugaaguaaaacauugucauguuuucucauuuggccauugagaaguacgugacuaaguuaaucuucuuuagaaguaaguaaugucauuucugagccaaaaugauuagaaggcuaugauuuauguuugucuaauuuugcuuuaggcaagggauaugaauuguucauguaaugauuuucaaaggugguaauauuuuaauaaggcucuauaucugaaaacuaaguuaguggauuggcuuuauuuagguaguacagaguauuuaaugauacugcaagcuaucacaauccuuuaguaagugcugccuuaacaguuuucagaaagcccuguuguaucuuagguugaguuuuauuuauugcccaauaagagagcaaaaaaauucucuguauaacuuuuugcauaauguuauuuaaaauuuuauugacucuuagacuaauaugugcauauuucgaaaauuacaaagacaaaauuaggaaucauucauuccuaccccaaaauaauuacuguuuauauuugaauauuucugcuuagguuuuucuuucuucuggcaucuuguauacaaaugcauacuuccuuuuaaaagcaccauugggaucauacuucuaaaaugcaguuaguuuaaaaucucuuggccauuuucauugugucagucuaacuucagagucuuugaucuuagcuauuacauuauguagcuauacuacaauuuaaucauucacgucauugaauauuucccacagcauuuugcauacauuuuaauuuguaucuuugagugugaccuuaagauaaaaauccuagaaauauacuuaucauuuaaaggguugaagauuuauguguuagcaggauguguguaacuacugcuuauuaacucaaaaguagaucuacagacaguaaacaaucucugcaaaccuaauaccacauuaagccaaacuaacucuucauuagaaacguaguuuaguucuucuguugaauaagccagguuagaggacuuguuuuccuuuaccacuauugccagacauugugucuugcugcauuuuuuauauuccuucuauauuauuucaucacagaucacuguguucagguugcuuaaagaaaaugcuauaugcuguuaauguuuccagucaaagcucauagacaaauagaaaacuaaaaauucaggggcugguuuauucuuacccuuaagcuaaucaaacuaaagaaagcuaaugaacagaauaggagacaguuguggccaaauuuaaaaugaauugcaacuggaaacacuacaccacauguuaauaaugguuuuguugggcuuguggaauuagaguaauuuuuuuccuuuuuuucuaugguuccuaagcuagcauaauuugagcauauaauuuuaaauaccuaaagaauugcuuugguagcauguuuaacacauguaaugccaagauauaagggcucuuuaccaaagaaaauuuuaaaccacuucugucauuuaauaaaccaaugauauaauuauuuaaaaacuuauuuuaguaguauaugagccagccacacauuuugcaaaccuguaauuugugauuuacaauuacaagaaugauguucuugagcaguaugucgacugugauaucccuuuuuuucugcauuugacuuauuuauugggaaucauacauuaacaaggguuugcaaaacaguacuaaauuuucucuaagaacuaguaccagcagaaggggugcaaagggaggagagaagcaaaaucuuuuuuuguuuuuucugcagcugucaucuggccuuauguucugaucaagagcuacagcuggaauuauuuuauugcuuuacucuguauccuuuugccuccacacacaaaauugcuauagaagucuuugaaaaauaaaaagcuaggcacuuaucaaccauaagagaauaauucuuacaccagcagcugagaguaaaacaaauuuucauugugcauuaacuauuggcauggguuacuuuguagacaauacacauuagccugugccagcauacaauacuaaaagcacugaaagugaguauauauaaaugcuauagauguaauuuuuuuuaagcuagaggucaugccaguguauuuacagucuuugugccuaucauauauuaaacuuuuugcucuuguggaagauuuuuggcauuucucaccaccuaauuuuauguuauguucauguuuccauaguaauugucacuuuucagggguuauaacccaguuaaaaaaaaaauagaaguuugucuaagucugaacacuuuaugcucaaucauauccaaauuaagaaaguguuuugguuauuaguacagguugagcaucccuaauccacaauucagaauguuccaaaauucagauuuucuuaagcacugacauguggcucaaaagaaugcucagauuuugaauuuuuuuuacuaggguagguauauuguauuauauuauauuauaucauacgcauuuauacuuagguugaacaucccuaauauaaaaauuagguaagcaguaaggcccagugugggcagagauguaaggaaauguauccucugucuuaaacaauuaagggguuuucaguugauaacauaaguuugccaaaggguagcuugguaauauaauugaauauguguauauacuuuauucaacaauuccauuuauaggaacuaauaauaaauaauacaaguacaccaagauauauguaaaaagaaguacauuacaaugcauauaacaaaauuuuggaaaccuaaaugcccauaaucagaguauuagcuaaguaauauaugacauaugcaauacuggacuucuuugcagcaguugcaaaguguaacuuguauacugguauggggaaagguccauggaauguuaaggagugaagaaaaagagcacuguguggauagacugcaauauaaaugggaucaaauuauacauagcauguaaacacaugugcaugcauuaggaaguuuaggaagauauaugucaaauaguaauaguggcuauuccauggggguaggauuauggaaauaauuuuuauuguuuuuauaacuugaacuuugaauaacaguuauugaaagauauuuuuugccaggugugauagcucaugccuguaaucccagcaguuugggaggaugagauggaaagacugcuugagccuaggaguucaaaaccagccugagcaacauaguaagacucugucucuaccaaaagcaaaaaauuagccaggcaugauggaguccaccuguagucccagcuacucaggaggcugaggugagaggaucauuugagccuagaaggucaagguuacagugagcugugaucgugccacugcauuccacccugggcaacagagcaagaccuugucuagcuagcuagcuagaguguuuagauuuauuauggcuuaaggagcucucucuauacacuuuuuuucuaauguaucacauuuacuccugagguaucaaugugaucugauuauuggauauuugcaugucacagauuauagaauuuucagugugugccaggcauauaguucuaugcuccagggauaaaacuuaggcagagcccuccuuacagguuguccuaguucauucuagcugcuacagcaaaaugccgugacuggguagcuuauaaacaaaaguaauuugucaccauucuugagucucagaaguccacucaaggcacagacugugccuggugagggcccacuuucagguucauaagugauacuuggcuauauccucacaugguggaaagaacaggacagcacucuggagucucuuuuauaagggcacuaaucacauucaugagggcucuaccuuccuaauugaaucauagccccaccuccuaauacuaucauauugguaauuagauuuccacauaugaauuuugugggggacacaaacauucggaguauagcacugguucacaggaaaaacguaaguaaaagaguacucagaauauagggugauagauacauauaauuuuaagguaauucaaaggagggagugauuaacuugugacugaaucaacaaagacuuuuugaugaguuuguagcugagguuaagcauaaaacaguuuuuuaguggaaaauuugaagcaugucauuguugggcagaggaauugacauguaccagaaaaucagaaguaugaaacaucagaugcuaacagaaagagacagguacaucaauauuuguaaagcaaagaaaugaggaugaaaaucaguaggaacaagccauauuaagaaaguauauugacuauuuuaaaguaacagacuguguguucauuuauucuuuuguucauucuuggaguuucuuauucacauaaggaaagccacuauauaauuuuuaauaagauggauccauuauaauagaaauuaaauagcagaaauacauauaagagugaacagugugacaguaccuagucuugguaagaauauggagcaccgauugugaauacaugaauuguucaaaccaccucaaaaaucauuuucauuaugagaacuggaacauauguauauccugugacccaguauuucuauucuuugucuucuagagaaacuuuuugucauauauaccauaaggccuauacacuauuauuccuagcaacauuuauugaaauagcaaaaaauuagaacugcccaaacauccauagacagagaauagauuaauaaauuguaguguucuuauccagacucugccgccuaguaacauuuauuuuaggcaaguugcuuaaucccuuugaauuuuagucucuucauacggaguagguugauaauacuauguaccucaaaggauuauugugaagauugaguuaacccauguaaaguaguugagacugucugauacacagaaaaugcucaauauauuuuagcuaucauugguacacagaggucaaaaugacugauuauugcuacacaugucaaggugaaugaauuucacugaaaaaaaauugagcaaaaaauuucagaaugucccaugauaucagucaguucaaaagcaucuauaacuaaauauuguucagggauauuuguguaguaaaacuguaaagaagauaagaaaaugaaaaaaaauaugacuucaagauaggguuuaucugcugaggguccaagugguagagguggggggugcuaauacagagaaacacagaggaguaauuaguuguauugguuauguucacuuuccuuaaguugggugacaaauguacacguucuauuauucuuuguaugauuauguguauaguccuuuauacauauaaaauaacuccuuggagagagaacccaugaauccccugguucuagccucaacuccacagaacuauauugauaguuucugguauuuuaaaaguaaaaauaugaauccaucaauucauccuucuaucaguuagacaaaugggaucaugccauguugacuguucuguaccuagcuuuuuucauuuaacaauaccuugggaauacugaaaauaucauuuuaauagcugcacagaauucugucauauaucuuaauuuuugaccaguucccugcugguagagccauaagauauuuugauucuuguuuucuuugauauuuugauucuuguuuucuuuauuuuuguuaaaaaauagugcuacugugauuguguauguguguguguguaucuguauauacagucaaucucucaaaguagaaaugcugggucaaaaaguacggauuuuuuuuuuuuccagugccauuaucaaauugcacucucaccaacagcgcaaaaaaguauuucuauuucuccaaacccuugccaacauugaguauuacuaccuauuuuuuacaucuuuccuaguuaguauauaaaaauggcauuauacuuucaugugucuuuaauugaauggucaguauguuuuuauauacuuacauuccauuucuuuuucauaggaaaauaaaauugggcuuuaucuugugagucucauguuucccaggaagagagggcucauuucuauguacuguguaaauuauguaccuugcaaaagaguuccuuagcuaauacuuauucuccucccuguccucuccaguacgugcccagucuuccaacaaagcuuugguaauuggaaaccuuaagggguuuugaacagaaaaaccaauuagauuugccugaagaauaaugggacaaaggcuggaaacaaggaaaucaguuagaaaccuacugaaauaagacaggcaaaaaaagauaaugagggcuuugcacuaagacagugaauaguagguauugagaagaggaaauggaugugaaagauacucagaagauuaccuuguuuagaaaauuauuuuauugacauaaagacauauucugcaugaauucagaaggauuugggcaaagguauaguaugucucaguuaauuauuucagaugaagagggaaaauguauuuaagcuaaaaaaugauuucauuguuacaguauauuuguauuauauuuuuaaauauuaugauuuaucaggcacaauggccuauacccgucuguaguaucagcuacuauuuugaggccaggaguuugaggccauccuggacaacauaguaagacccugucucuugaaaaagaaaggcaaaacaggaauagaauugaugcuaaaccugccucauucuagcaauaauauucauaaacauguuaauugaaaaaaagaucagucucauugaguuacaccucuaauaaaguuuaaaauaauaaaaauuuaaaauauaaaaugauucuauaucaaaagggagaaaguaugcaguaccuugauuuuaaaauuauguaaaagcaggcuuacaaaauuggaaaauuaaucauaccaccaaggaguauuagccuucauuuuauuuccaacuuuuuaucuuuuuauggcuaugauaauacuguaaauaaaauuuuauguacugacuuuuuaacacuaaacauuuccuacauuguauauuauauuauucccaaaccugauuucaaaugacaacaccguauuucacuuuaugggcauaucauaauuuacuucaccuuucccuuauuaugccauguucaaguuguuucuuuuuacuauuuaaaauaguucucuaccuaaaggaaaagaagucauacgaaaaaguuucuugcauaugcaugcuuagagcacuauaauuugcaauuacaaaaauauggaaccagcccaaaugcccaucaaucaaugaguggauaaagaaaauguguguguguguguguguguguguguauguguauguguguguauauauauauauaauauuauauauauguuauauauauaauauuuuauauauauguuauauauauuauuugagucauuuucagaaaucucuggaacaaauacauuuccugaaguuuucuacucuucccaauuuugauuauauauauacacacacacacacuauggaauacuacucaaccauaaaaaggaaagaaauaauggcauuugcagcaaccuggauggaauuggaaacuauucuaagugaagcaacucaggaauggaaaaccaaacaucauagguucucacucguucucacucauaagugggagcuaagcuaugaggucacaaaggcauaagaaugauauguuggacuuuagggacucggaaaaggguggggguggugagggauaaaaggcuacacauuggguacaguguacacuguuugggugaugggugcaccacaaucucagaaaucaccacuaaagaacuuacucaugugaccaaaccaccuguuccccaaaaaaacuagugaaauaaaaaacuuuaaaacaacaacaaauaauaauucugagaaaaauacuuugugccuaaagcuuuuuccauuuuaguacucuuuuuuucuuugcuagauucaagaaguggucaaaaugugugaauguuuuaaaagcuuuugguacauuuuauuaaaugcuuuuuuauugcauuauuauuaaaauugcuuuccagaaagaguuguuccagauuuuauuuuacuucuguguguguagaauuagcaaugaguaugccuguuuuccuuaucaccacuuuuuaaaaaaccuguaaauuuaauaugcauuuaagcauuuaacuugcugaaagaguuaauuagguaguaggaagauacuuuuuucuaguuuaggauucucuauaauguuaauuugauucuuacaauucaugaauaauauauacuucauuguagauuguauacuuugcauuuucaaacagucuuuuguuugccauaucagacacuugaaugaugcuuugguuauuuuauucacugagacccguuuagguguguagcuauaaauucacugugcgauaugaacuauuccuaguuaauagguuaauuccagcuauauugguaaacauuuaaaaaucauuuguuacuuaaauauuacacacaauuuaauaaugaagcaauaaacacuugugauauuuucuuuaaaaaaguauuauauuuaaaguaaaauguguuaauguuuaauuuacaggauauaaauagaauaacccaacucaguacagcaagacacuaaguuuguucauaugcagauauuuuuaaagucagcuuuauuuuaauuuauaauuuuaauauaacuucucaguuauuauaauuuaguaaaagauaauucaaaaaagucacaauuaaaagcaauaucuuauaauuaccacugauacuacuccuaaaacuuaugauuguuuauaguuuucagucuccugaguaucccaacccugagauuauugaggcagauauucaauuuauaauaaaaagaaauugugcgccuguaaucccagcacuuugggaggccgaggcggguggaucacuugaagucaggaguucgagaccagccuggccaacauagugaaaccccauugcuacuaaaaaaaaaaaaaaaaaaaaaaaaauagcugggcguggcggcgggcuccuguaaucucagcuacucaggaggcugaggcagagaauugcuugaaccugggagguggagguugcagugagccgagauugcaucacugcacuccagccugagugacaagaacaagacuccauuucaaaagaaaaaaaaaaggaaagaaauugugguuuagagaaguuagacaagauucuaacuuaggucuuuucucacccauuuuuguuuuguuuuguuuuuuuucucccaguauucuauucaguuugcuuaugauuuuugacaauuauuugagucauuuauuuucagaaaucucuggaacaaauaaauacguuuccugaaguuuucuacucuucccaauuuugauuauguauuuugaaagcauguuugcuggguaucaauguuuagccaacauuuuuccaauguuuuaucagcaacugucacaacacauugggacagcuguuaugaaaauuggguaaaaauagcagccaguuuugacauaguuuuaagugacaguagauucucagauauauuuuuaauaguucaauugccuacuccuugauacaauaacagcuuuuaguuucaagagcauuuucaguuauuaccauuauauccuuaugauaacccagugucauaaaauagcaucgguauuacaauuauuuucuaauugagaaauugaaugccaaaggaauuaaaugagacaaggcuauuuuuuuuucuggaacaaaucuagaacuugcauuuauaaauuuaaaauaucuuagucauuuuugaauuuuauuuguuaauuuuagaaguagcaccaacaaaaucuuuuaaaaagaaaagcuuaugaaagguuugaacccuuaaaauuguuagcccuauagugauuacucugaauuauuuuagaauaagcuagugaaaguauuucagccacuuuuacuuggauaucagcuuuuuucuuaaauaauuauacagugaugggaaaaguaacaucccguuucuuuaaaaaauuaaaugaaacaaagcccuuccaggacuuuguguuuuguagugugcuaaauuuuacuuacuuaauauuuauuuuauauaaauuauuguuuaugacauuuuaagugucuuuagugucauuuauugagcauaucucccaaccuaagucuaauaagaguacaugauuuaaauucuacguaaucagcaaguugagucuaauuuauucauucacucauucaacacaauaguagacuaauguugucuucugucuuuugacucacuguaucaacagcagaguucuuugaacauuuuuuuaacuugcaaaauaaaacauagauuuguguuuucuuccuaauaauuucugcauuuccuauguacauuuaucacuuuuuauuauaguuaaaagcauuauuauaauuagcucuucuacaugacaugguuagccuuuuaguucuucauguuauuuuuaauaagcccauuuuucucgugaaguugaauuuuucuaaaaguucauauuauuguauuuugacauagcuuuauaaucauguacauuugaguuuugggaauugcuauucauagcgaugguagcgauauauacuuauugacuugcuaaauacuuuuuagagugaaaguaucuuauuuuguggugguggugguuuuuauucuggcaacuaaugcauugaggguuguucccaauaggcaaaugaagaggauucuuccaguucucuagugaaggaucaccuuuuucagcaagagacaguuguuaccagugagccuuauagaagcucaaauauaagaccuucucccuuugaagaucugaaugccagaagagucuacaugcaaagccaagccaaucagguaagaagauaaaauauuuuuucggcgcguuguuuauauguguagaaauugaaugaugucauagauaaggacguuaaaaccaucugcccuuuaccagacacaguaaacaaacaaacaaaaaccccacaaacaaaaccaggagaauuugauuuauaaugagccaaauccagagugaaacaauaaacauauacaccauaaaguccuauauggguguagcgauugagcaaggggacaucacaagcauucuuauuuuaccccuuaucucacaggaaagcuuucaauauuuaucauuaauuaugauguguuuacuauauguuuuuauagaucucuuuauuagauuaagaauaaccuuguguuccuacagaacuaaauuuuuauuacaugcuuuuucugcaguaauugaagugauucuauuuuuucuucccuuauucuguuuguuaaauugcagucauugguuugcaaccuugcagucuuggaauaaacccaucuugguugccgugugauguauucauuauacauauacauacauauauguauacauucaagcauacauaagauucgauuugucaguauuucaucuuggauuuuuaagucugcgcuuauaaaagagaucaacauaauuuuccuuucuuauaauuuuuuuuucuuuuuuuuugagacagagucucgcucugucgcccaggcuggagugcaguggcaugaucuuggcucacugcaaccucugccaccuggguucaagcgauucuccugccucagccucccaaguagcugggauuacaggcaccugccaccacacguggcuaauuuuuuuguaguuauuaguagagaugagguuucaucaucuuggucaugcuggucuugaacuccugaccuauccacccgccucagcuucccaaaguguugggauuacaggcaugagccacugcaccuggccccuuucuuacaauguuuuuauuggguguugcuaucaggguaugcuggcuuuauaaaauaaguuggacaguauuucuuuuuugcauauguggaagaguuuaagauugguaguuauuucuuucuuaaauguuugguagaauuccuuagugaagccaccugggccuggauuuuuuuuuuuuuuuuuuagaugguuuugaauuacggaauuaguuucuuuaacagacacaggacuauucaccuuuccuaauucuuuuugugucagcuaugacaaguuauaguuuacaguaacuuugucuguuucauccagauuuucaaguucauuggcauaaauauaucccauuuuucguugcugauacugaaaauaagugccuucucuccuuugauuauucuugcuuagggguugauaaauuuuagccuuuucaaagauaacuuuuggauuuuuuacuuuuuuaaauguuuguuuucuauuucauuuauuuccgcuucuaacuucuauuugccuacacuauuagguuuuagcuuuacccuucuugguuuuagauucuugugaaagcauaguuucuugauguuuuuuucagcuuuuuuccuuuuuuucucucuuuuucuaauguauguauuuaaggcuauaaauuuucauuuaaguacuccucuauccacauuuuacaauauuuucuaguuuauucauuuuuaauggaaaauuuuagacauaccagagguagaaugaauaaagaagugaacuaccguaugcuacucugcuuccaacaccuaucauuggcaaaaugaugauaugcccuauuuuuaccauuaucagaaacggguuguuucauuucuaaauauuugggguuuucugguuuucucuuugauguuacaaauaaagaugauuucauguaugacuucauuuuuuugauauuuguuggaacuugguugauggcccagcauauauggucaguguuuuaugugcauuaaaaaagaaugcacauuuuuaguaguuggguauagcagccuuuuuuguugaacugauccuuuugucauuaugagauauccucuuuuaucucugguaauacuucuugccuaaaaauacuuuuuugauaucugauuacuucaguuuucuucugguuagcgcuuucacaauagguuuuuuucuuuuuuccuuccaacauuucagaccucucuuuuaaaccauauauaguuggguuuggguuuuuuuuuuuuuuucccccagggugucuuugucuuuuaauuggaguauuuuguucauuuacuuuuagcacaauuauugauauaaaucuaccauuuuauucauuuuuuauuugccccauuugcuguguuuuuuuuccuucacuuugcuuauucaaauauauuuaacuacuugauucuuaucccuuuauuagcuaauuaguaauacagcuguuaaguauuuuuagugguuauccuagagauuacaaauguaucuugcauccuuaaaaucuauccuguauuaauguuuuacauuuucaggguaaugcacauaucuacaguaucuuaacucaguuuaccucccuuuuaccuuuuauguaacugucauuacaaacuuuauaaaauuuaaaaccuugcaaaaauacuauuuuaaacaguuagcauucauuuagguuuauucaccuuuuuaugacuuuugacauucuucaauaccuuauguauuauacuuccaucuaggaucauuugcuguuuauuggugcuugcugaaccucaguuuucauuuaucugaaaaaaaucuuuuauuuccuucauuuuugaaggauguuuugcuuuucauugaauucuguuauaauuuauuuucuuucaucaauuuaaaagauguaauaccauugagaagaaguuucuacccuuccuauuaagaaauaauaucuuuauuguuuucagauguuuuauuaugcuauaccuauguauuagguuauguauuuuguuuugguuguauaaagcuucuggaaucugugacuugaugucuuugaacagauuuagaaauuuucaaccaguagcucuuuaaauauuguuugaagcucagggagaguuaaagacuggagauaaauuuuggaaaucauuaucagagaaugaaaauugaaacuaugaggacaguuagaauuauuuuggaagacuauauauguucuauuuuaaaacuauuagcgguagggaaucacuacauauugagacagugaguuaagaaagagcggucacauuaggagaacccagaaaaggaugucucagaagcccagggaggacagugauggaguaaggaaaggaaaugauggaguaguuaauauuuuacgacauaaaugccccaauaaaauucaaauucaucucuauaaagguaauugauaaccguaccacaguuucagugggauuaagaggugugcaugacuggagaggaaacaaagaugauguuugcuagccacuucucuagaagcuugacuacaaaagccuuccuuaacaaauagauggaguuagaggggugcagggucaagaaaugaauauggucauaagaugaagaaaguggagaaauuaaaagauucaggacagagaaaaaaauugauagagaaaggcacaacggagacuguaaagacaggagaauugcaugagaaaagauaaaauuacuucauuuuccaagguggaagugaaguuuagguagaguuacagauuugcuauugagacagaaaguuaacgaaauugaaacuugauuaauucggcauugugggcccuacuauucuuguccuaaagucuuaaaagugaguagagagagaacaaaaaaacuucuagaucaucugggagcuuuucuuccagcaacucucauaccauagcaaauacaguuugaauuacucaagguagacacagauuguacaaggcuccagguaagucucccaggcucccuauagcuuuauuuuucacuaaucauuauuauuaauguuuaucauagcugguaccuauuaugugcuagauacuguuuuaagugcuuuacuuauauaacucauuuuaauccucucaacaaacuggcaaacuaccuaauuuuagugauuaaaaauuaucuguaguuuauguauguuauccaaauuuauuaugaaauuuuauaaaaaauuaaagaaaaauuaagauauugguacaagaaggaaaaaauugaaagccaguuuuacuuugagcaaaauaauugcaacaauaaaggcuaaaagcaaucugcauauuuucgcuagagauuuugagauauuaaaaggaacccaccaggagucauacuugcuuauaaacuuccaggcauccugugagacauuugaaucuggagauacucaguuuaacaguuuuaaguacaaaauguuuucccacauauugaguggcgggcagaagaacucaucucaacauaggagagaguggaaguaugcauauccugaacuaagucacugauucauacaguugagcagggaaagaaaacacggugaauguaacacagggauguuaugauauaccaguauuccucaucgcaggcccugggaauuuauuuggccuaccuucuuuggcugaaagaacuguaaauuuaaaggucuucuuuugauugauggggaaaaagaacugaacucuucucccaaaauagugauggcgguuaugauggggugguugaagaauguagucaucagguagaaaguacaaaaagugcugaauaacugcaagagagagaagugaacaacauuuggcagacagcucuuagcuuugggauuaugacauggccucuagagcuauucuguuugggucugaauuccaacuucuuuacuuacuagcuguguggccuugggcaagcuacuuagguucuuuguagcuuaguauccucaucuguaaauuggaauaauaucgguaucuaccuccuagaguuguuaugaauauuaaauaauuaauguuguauauaaagcacuuaggaaaaauguuaaauagaacaauaauacucguaaguaauuccuuguaauugauaauuucuuaucuccaagauugaugugacuuagagaaacaaggguuauauuauaugaauugcauaacuagauguuuauacauuugcugguguuauaauuggugaacuucucaauuuaacaggaauuagaauggaaugguuuacucuuuuaaagcugcaguagacuguagcuauacauacaguaaagaaauauuguagaaguuucuuaauaggaauaaaacacaguuccauucagcacacugcuguuaggauaguguagcaguuuuccauuuguaugugaccaagaaggccucacaggaugaguuuuuccaugguagagaaucuggcccucagcuugcagaccagacaccuuauuuucuuaggauacuaggacuaaagucgucuucagagauucaaauaauugaguuuaagaaaaugauaugugaaaaucagaacauaaaauuuuauuucaaccaucaugaggacuguaguuacuugcaguagccugauuaacacauucucuaccuaaaauaggucuuuaugagaucaucacuaaaagcuaacuuggugaguguaaaugcucgacaaaauaacuaugucuuuugaauguuuaauugcauucaacugggguaaguugauggauccuuuucuacaacagaggaacaaccuugccaaaaggacuagacaacugccuugaugaacuauaaagauuaagcuagcaaguuaacguacuaguuuugugaauccugcugaagacauggcugcugggucagacaaaggacuuuauuauuauucacaguacaauaguagcaugagcuucauguuuguguugguuucccuugcuccuccaaaucccaugggaaugaugcucaggaauauguuguccacucgguggguuugcaucccagcauuggaacccugaacuuagggaagucaagucuuuuguaaugacuuuuagugcacuucaguagccugccuuacuugcugaggaaggagauacugucuuuguuauacuggacacuaaacaagccugucuccaaaggggaaacacugugucuuucaaggguuucacuguacagacguccuugaaaagauagucuaaaacaaaaggccgauagugcauauguucacuagaucugcagagaugggacccauaaggaauugucaacuacgcuaguuuauguucccuuaguaaugcuuaaauaggcauugccaguauuugucuuugacucguuuuuuaaugcuuugaagagcuaguaaaucuuuugaggucaggcaugguugcucacacuugcagucccagcacuaugggaggucgagguagaaggaucacuugagacuaggcauuugagaccaccugggcaacauagcaagauuccaucucauauaucauggugguacgcgccuguagucucagcuacucaggagucuaaagccugagaauugcuugagccagggagguccaggccacagugagccacguacgccauugcacccaaccugggugauagagugagaccuugucucaaaaaaaaaaaaaauccucuggauggauagauacauuguuucaaagucuuauaggccuggaagccauuauaguucuuuaacucaguuucucuuacuuucacggguucauuucccuguagacaaauaugacagcauauuucaaagauuuaugacauguuuaauacauaaaaaagaauguauucacugaauacuugagaaaccacgaaacaacuuaaaaaaggaacacccccaaucuauaccuuugccuucauccuagagguaacuauuaccuggaauuguauuugucuaacauucucaugcuuuccuugauaguucuaaaacuuguuucuuuuuauucucccaauuggauauuucaguuguuuucagguuuuuauuguuacaggcauacugcuaguacaaacuuucuuguccgcagcuauucaugugcaugaguuucuuuggaguguucaggaguggacuuuuuacauugaugugcuacagaagguucugggacaaauuggacuuuaggauugauguguaccaccuacaggggauauguauugaguauuugaaagacuucggaaauaacugugauuguuccuuuacaaauggauuuuaacugcaugcuuucauauggccuuguuacuagguaaucaaauguucuguguuacuucccuguauauucuggauucagaucuuucugaguuuuauuuguggcuaguaucuccuaguuggugauuauuuuucacucuuugugguguuuuggugagcagacauuauaaauuuuaaugcaguugaauuuaucauuucucauuauuuuuacagacucuucccuauccucaucuuaaagauuuucuuccuaaucuaaaaguuuuaaaguuuugucuuuaauccacuuuaauuugauuucucuucuaugguagggaccaaauuuuauuuuuuccacauagguuacuaauuguccccgcacuguuuauuggagccuuuccccgcacugauaugcaguaccauaucugacacaucaauucucuauauauguuugagucuguuucugaugucucuaaucuaaauuagugucacauugucaucuuuacuguagaaaugcuguagcucuauaauaacuuaauauuuguagagaaagugccuaacuuuguuuucccgcuuggaucuuuuuuuuuuuuuuuuuuuuuuuucaauuuggcuguuugcccuuuuaaaauauuuagaaucagcuugucaaaucugaugaagaauccuuuugugguuuauauuugaauugcgcugaauguguguguuaguuuaggggauaauuuaucaucuuauucgugaauaugauauauaccucuguuuagcucuucuucuguaucuuuacauaaaacuuuguauuuucuuugugaaaagauaauacauauuuuauaggauuauuucuuuguaccauuuuuguuguucuauuauaaauggaauccuuuuaaaauuuuaauugugaccagcuuugaagaagcaucucuuaugacuuuuucagcugauaaauuuuccugaagauuauagcaaaaguaccaaauuuugaggguauuaaaaagcagaaauuaauugggguguaucuuaucacaucuguuuuuaguaagugugaaaaggucaauauuguccauuuauuugucuuuucacuuagagauugugugagagaacuaauauucauagacccuguugacucagguaguuuucaaaguguguauguguuuaaguggugugugugacuuuuuucugagacaguggugagaaaauugacauuuuuacucuuuagaauaguucuuagaaauguauauuuaauauacuaguugaggucauuguguucuaucaggaaaaaaaauuguucucucugcuuccuuuuguguaauguucuucuguuuuucuuuuuuucacuugaccaaauaucuagcuuauucuguguuuacuucaagucgcauuuccuuucaugccuucccagaccauuuaauccauaguuauuuccucuuguuaauuucuaaauucuuacagauucuacuuauaaacauagaauggccuccauauuguaucauuaaaugcagagaccaagggcacaguacaaaggguccuauuuuaaagaucugugugugugugugugugugugucuguguguguaaaaauuuuuggaggaaugcacuaaaaaauuuuuuuuaugauaguuaacuuuuaaaacugggucugaaaggucuaagauggaaggaagaguuuuacuucaugugcuuuuauacuauuugaaaauuuugcuaucugcauguauuacuauuuauuuucaggguuauaguguuuauuaaguauguaacaguaggaguuggcucaaaauuaucuggaaaaauaagaaguaaacaagauugccaaaauguugaugauaagugaagcuagauaauagacccauggugauucauaacauuauucucuccuuuuauguauauuagaauuuuucaccauaaaauuuuaaaaauuaaacauugauauauucuagcuauaauuuaggucugaaaugggcuuugcaauucgaaacacuuguaaauguaucaggacacuaaagauuccuauuuuuuuauugcuauauaauucaccuaccacaaaaucauccuuuaaaaaaguauguaauuuggugguuuuuauuauauucacaagauugugcagccaucagcaguaucaaauuccauaucacuucccaaaaaacccacacugauuaucagucauugccccuccuucccuauucccagccccuggcaaccauuauugugacauguguaacuacuuuauuucucuuugugguugaauaauauuccacucuauggauuuacuacauuuuguuuauccguucauuaguugaugaauauuuggguuguuuguacuuuuuugacuauguauucauuacuuguuaaaguuuaaauauguaagaaaagaccuaugguuuuuguuuguguuuuagguggggggaaaugauucuauuuuuauucucaaaaccguuuuugaaaaacuuuacugcuaauaaauuaugagguuuuggaacauacacuguacaguuucauuaaaaguaaaauucuugugucauuuaaguagaaauuguuuguauuuuagauaacauuuggucagccaggcuuggacauucagagcagaaguauggaauacguacagcggcaaauauccaaggaauguggaagccuaaagucccaaaauaggguaaguaauguuaguuuaucuugugauauggaauuuaacuaauuaauagauagguaaaguuuuccagucuuucuaauucuccauauaguugaauuguacuagaaaauuuuucauuguauaaauuugcugccuaugugcuuaaacgcuguuaguuaaaaacucugcaaacuucucauuugagucuaaaagauugccagagcugcauuuauuagauaggaccaaaaggaauuauauauuguuaauuaaauaaacuguaucugucaccccaccuuuagcucagaccuagaauuuucuuagcccuaauuccauguaucuaggaaauagaaguuugccccaaacugagucagaugcuuacuuguaguagacuagucacuguguccagggacuggagcuaaagauacaaauuugucuacuuagaagccugcauuuauggaugauguaaggggucaaaagacuuaauuuuguucuuuggccucaaagaaccaaccuucccagaaggguuguggaaguagggguauuuuacgucauuguucagagacuuuuuguguacccaagcuacacacaugugugucuuuguauuaauuugcuaggacucccacaacaaaauauuacagacuggguagcuucaacaacagaaauuuauuuucucacaauucuuagaaguucaagaucaagguuguugguagguuugguuucuucugaggccuuucuucuuggcuugcagguagcugcccucacauggucuuuccucacuuugcccucacaugcucuuuccucugcccguacaucccuggugucuuucucuguguguccaaauuuccucauaaagaaaacagucagauuggauuaaagucucucuuaagggccacauuuuaacuuagucaccucuuaaaaggcucuauauccaaauacagucgcauuacuggagguuagggcuucagcauaugaauuugaagaggacauaagucagaccauaacauuuuguccuuuguucccaaaaucaugcccuucucacuugcaaaauacauucauccuuauccuaacagccccaaagacauaacccauuccagcaucaacucuuaagucccaaaucucaucuaaauaacgucuuucaaucaaguguggguaaguggcucaugcaauaguagagguacagauccaaaacaggguaggcugucuggagacccaagaaauaguuguagucugaguccaaaggcacccugcuggcagaauuucuucuugcucagggggagcucagucuuaguucuaguaaagccuucaacugauuuuaugagguccgccuauaccacagaagguacugugcuuuccucauaguccaccaacugaaauguugaucucaucccaaaaacauaucauagaaauguccagaauaauauuucaacaaauaucuggacacuggccccaccaaggugacacguaaaauuaaccaucauagcccucauugcaguuuuuaucuguuucuuuuuuaggucccuuugaaaucaaucagacaugucagcuuucaagaugaggaugagauugucagaauaaacccucgagauaucuuaauacgucgcuaugcagacuacagacauccugacauguggaaaaaugacuuggaaagagaugaugcugauuccaguauucaguuuucuaaaccagacaguaaaaaaucagacuaucuguacucuuguggggaugagacuaaguuaaguucacccaaagacucugugguauuuaagacgcagccuuccucauuaaaaauuaagaagucaaaacgaagaaaagaggauggugaacguucucgcugcguauacugccaggaaagguuuaaucaugaagaaaauguuaggggaaaaugucaggaugcuccagacccuauuaaaagaugcauauaucaaguuaguugcaugcucugugcagagagcauguuguaucauuguaugucagacucagagggagauuuuucugaucccuguucgugugacacuagcgacgacaaguucugcuugcgaugguuagcccugguagcuuugucuuucauuguaccauguaugugcugcuacgucccuuugagaaugugccaucgcuguggugaggcaugugguugcuguggugggaaacauaaagcugcuggaugaaaugguccagugccaaaaugagcuuaaaaucuuuguuuccaggaauuagcuaacuuggauuuguggaagcuuuuggcaagcaauauggaaucuugccugguaucauugagcccacacauggaggaagcagaacucaucaguucuuggcguuucacgccaugccuaacuuuucccuugagugcauggcauguuuuguuacagguuguagaguauuugcagaaggaaaccauuucugguuauuuggcuauaaaaagucagcauaaaauaugauccaacuaaaagggauuaauuuuuggcauuuuuguauauuuaugcauuaggugaugggacuuuuaaagguuugaauuuauuaggacacgaacuaaaaauaaaagugcacuaggggacaguugauuucaaucuaagaaaaguuaacacuugggaauuacaagaaguaaaacaagugcaacuaaaucauuuauuaguuguuuuuugaaagcaguuuuauguauaaauaacaaauguuuauauuuaacuaaauguaagguacgaauuauuacauauuaaacuuuucuuccccuuccuaguucugaaguagauauauauauauauauaucuacugucacauuccauauauuuugaauauuuaacucaucuaguuaauaauguuuuuauuccaugcgaaugauuugauauuuucauccuuauuucucuuuggcuacaauuuauauugaguuauaucuguacauucugguaaucuaaaauccuuaaaaauacucuaauagccuugagugaccaacuuuuuuuuuaaagcacagauguaauugucuaauguucugaugggaacguaacacuuauuuuuauauaaaaagagacugaguaaacaaacauuauagaaaaaaagugaaguuuuuuaguuguuuuuugugguauucaaccagcaaguuguuuucuuucagaguuuccuccuucaaaaaguuauauugcauuuacaaauguuuuacaaggcagaaaguuugacuggauaguuaguguaaaagcuucauguugagaucuucacguaucauucugcuaaaccagaauauguucagcuguguuacuaauuuuucagcuuaauccucagugcuuauuauuuacauaacaauaacuuuuuaucaguuacauuuuauuuuuauuuaaacuggccaaaagcaaaauuauuuuauguuaaaaugugugcuaaacuaucccaggaaaguauuuaauccaacauuguaaaugaaguaucuuguacauauaaauuuauuucuuuugcagagcauuauauuacuggauguuuaauuuacaaaauaguuggguaaauguuccaacaaacuuuaaaguaccuugaagucaaauugucuguuuuuguuuuguuguuguuguuguuguuuucuuaaguguuacauuaaaacucuaaccaaggaaaggguucuuuaagaacauucccuuagagggauaaaguugagaagugugccuuuuuuuuaauggcuugaaguuucagaggugauaaaaauuaaaaucacacuacuauuugaagcucauuuucuaugcagguuuuuaaacgucauuuauguaucauucuuuuuauauaucacacuuaagcuuguguuagcuuuuuucuuuugccccagaucaaacugaacaauguauauaacacuaucugucuguaaaauacuuuuuuuaagaaagcauuuauauuuauaugacagcuugaacugacaacauuguguauauagaucaucuugaaguauuauuucacauugaaaagaagaaaauauauugauaacuauagauguuaugaagaagaggguauuucuaguuuuguacuaaaaaucaauuggaugaacuaaauccaaaacaugacacuguaggcagcaguuuuaagucuuauuuuuacuguuuauauauuugaaugcugcuacaacagaugaucuucaucccugaaguuuucagcuaaacuugguuuccuagaauagacuguuaacuuucaaaauuuuuauuggugaaauggaaauacuguuuuuccuugugaaugaauuuucauauuuguaagugcuaaguuuauaauucagguuugaucaaggugugaauaacugaagaaaauaacuugcuggcuauauaggaaaaugcuguggaaaugaacuguguauauacuucugggaggaacaaauuuaaucauuucuucuguuaagcacuaaucaguauagugcaacuccugguucuguacuguauuuuauaugcaacauauaugcuuuaauauuuuaauguuugugcauuaauauuuucaauuuguuuaaccacuuugcugcuaagauuuugccgucccauucccauuuuuuccuuuacaauuuuaaacaaguuucuucauuaaaaacuauggugaugaaaugguuuuuauuuuaccuuggaucuuuauaguuaacauacccaguuucuuaaucagucuacaagacuaacugaugauauaauguucucugaaucccuauauggaaauuuucuuuugaguaaaugagaauuccuuugugaaagcaaauggguaguuuaaaucacugauucuuaaacauguguauaggcaccuucaggaacauuuucucauucucuguacagauucggcacugccaauuggcuuuuccucuaaaacuuuucuuuguuuuuaucugauauaagcagauggcucaagacaacugcuugaguaauaguauugaaaauggaaucaucuagacggcaugacaagcaagacuggucugaugaacuuguucagaauugauaauucuuaaauauuucucuuggcuucaaaagggacaucauuugauuucugaagaaguaugucguguggagcuucagcaccaccuacuggaugauuuccaggccagagacaugagauggcaauagggaucugacaggguucaucacuacuaccauuaaagggcuauuuauguggugaccaccucuaccagggaaaccaggaauaagaacugucucaaaggaauuguaaaaugguuauuuaccuaaugugucuuguuggcuugcugaaagauuuuaagcacuuuuuucuuacauauccuguuuuaaaauauuuguugauauuugggacuggcaaucaaacuuaauggauguacugaggcauuuauagaaccaguugcuuuaacucucaaaagccauuaccaaaaugguauuuuuuuccuccuuccgccagucagggagaauuuuuaaaaauaauaaucaaaacaugaaaaaacauaaucacaccuguauuuuaucaugacagcuucagagaguguguguguacguuuuucucucuuuuauuugagacggaguuucacucuuguugcccaggcuggagugcaauggugcgaucucagcucacugcaaccuccgccuccuggguucaagcgauucuccugccucagccucccaaguagcugggauuacaggcacccaccaccaugcccagcuaaguuuugguauuuuaguagagaugggguuucaccauguuggccaggcuggucuugaacuccugaccuuaggugauccacccaccucggccucccaaagugcugggauuacaggcaugagcuacugcgcccagccguguguauguuucugaaaugaugauggggugggguuaaaaucuaaagggaaaaacuugaaacuaccuauuuucauugguuauucagcagugccuaaaaugagcuuuugaaguaauguaaaugcacuuucaauucauguguauagugccaucugauaucuuggguaagucuugcuuuuucuuuucuuuuuccucuccccugcccccuuaauuaaauggcacggaaauguuucuuaauaugcacgugagucuccagaguacaggaaaugugcuuuccucuaaauggucaauguaaagaaucuuaaggauauuucuuguguugaaauuuacauucgauuuugugauuacacuuggaaguauguguuaaauuggguuuuuaauuguagcccaaaggugcauuaagcaaguguaacauuuuuuccacauaaaacuuagaaaacuuuaguuaccugaaaagcaaggauucuuuacuaauuauuaugcucauucuugauuugacuuccauguucacacuucaaaguguaagaggaagcacuagaaacuggcauuauuguugcacuaaaaaagucuauaaaucauaauagcaccaugagguguuuugcaaugagacaaacaugaagaaugaauuucuuuaagagagaaacacaaccggaggugauuuauauaaaccaaaagaaaaaaaaaggcuuuaagguauuagguacuguuugccuagcagccaggugguuauaaaagauucauaugcuuugguacacugauaaauguuagccauuauuccugaaagcuucuuaaauugcaucaguuguuuugaaauuuuuucaagaauaaacuaguugaaaagucuuuguauuaaaaauacacauagauuuuugugaacauuuccaguguguagugucguuugcuuucuauuucugaccucaaaagugccucacuuguauauuauuuccauuaaaagcuugacugcauucuuucuaaugaacaaugaaaaacuguuuaacucaugucauaaugugucuccucagauauaguuaacuagcuugauaguuuugaguauauaauguaaauaauacauuauaaguuuguaaccauuucuguuacuucauacccguguaauuggacauagcagaugauuaucauaagaauuuguuuuaaugguuuuuuucccuccuggaauuaccugauuaaaccugucaugaauuauaaaag

SEQ ID NO: 13340 - RNA, 18329 nt, Homo sapiens
aggggagauaaucuuuucauacaagaugcauucugcuuuugugggccucuugcagcccucaagcccccaucugauuuguacacaaugauccagugggccagaggagcccagagccaugagcggcccaucccuccaagaacuauuucugacuguccaguaucauggagcaaguggaaagaagaaaaaaaaaacccaauuacuuuucgaagagcaagaugaaugcuguagaaggagaaggaaggggagggagauggaugggugccgauuccagaaucuucagaucugcuuggaugaaucauuaccuaugauuugcgggacaagaaucugauuuuauucaucaaccaguagaaacuuuucuuucugccucccaacaucugaaauccaacaaacaugugccuuaggaacauaccggucaucuuuuagaggcauuuuauauacauauugaguaacuagaaaacacucuuuccguaauacacacacacacacacacacacacacaccaucuugucauacaacacucccacgcaagaaaagcgaaacugcuguuugaugaauguaaacacuuggcuguuugcagcagucgggaguccugccagguuuaagugcuaagaugggaggugaaccccagggguuucccccugcccgugcugagauccuuauuuggucaagcuucuaccuaugcccuggccucggagcgagcccgauagcgcuggaucacagcagagggagcgaggcggcugacgucccaucccgaagagaugaauggaauuccaggaagcuagagucaugcuggcuugggacaguggcuuggagaccagacuucaaugacagaagcacuaggcagcggcacucauggcaaugugugcacccacagaaauguaacccacaccucggguucaggagccgaaaaaugaaaagaacguuuagggaggaaaaagggaaauacaauaauaggcagagaguaauuuauuacucuaugggucugcucuguaaauagcugaagacucuggagccagaugguucugcaaauucuccaaacaggagucacguuaagaagcacgagugggcacaaaaacuguuuuucaagacacaauuucaauuuggcuuguggaaacuggauacgaguaaguuuccuuaaaauucgaguagaaagcagcuguccuccccgggccccuugaugagaauacgcacaccgcccccaagcggccggccgagggagcgccgcggcagcgggagaggcgucucugugggcccccuggcagccgcggcaggaaagggcccgaaggcagcgaaggcgaacgcggcgcaccaaccugccggccccgccgacgccgcgcucaccucccuccggggcgggcguggggccagcucaggacaggcgcucgggggacgcguguccucaccccacggggacgguggaggagagucagcgagggcccgaggggcagguacuuuaacgaauggcucucuugguguccccugcgccccgucggcccauuuuucuuuuuacaaaacgggcccagucucuaguauccaccucucgccaucaaccaggcauuccgggagaucagcucgcccgaaagccccugcgccaccccgcgggcccuccuagguggucuccccagccccgucccuuuucgggaugcuugcugaucaccccgagcccgcguggcgcaagaguacgagcgccgagcccgugcgcgccaaggcugcgugggcgggcaccgacuuuucugagaaguucuagugcucccaagccccgacccccgcccccuucacuuucuagcuggaaaguugcgcgccaggcagcggggggcggagagaggagcccagacuggcccccaccucccgcuuccugcccggccgccgcccauuggccggaggaauccccaggaaugcgagcgccccuuuaaaagcgcgcggcuccuccgccuugccagccgcugcgcccgagcuggccugcgaguucagggcuccugucgcucuccaggagcaaccucuacuccggacgcacaggcauuccccgcgccccuccagcccucgccgcccucgccaccgcucccggccgccgcgcuccgguacacacagguaagucgcccccggcggccgccgaggaccaaagcugcccgggacauccaccuggagcgcugaggcuucagucccucugguggaccccggaaccuacacucuccccgcucgccuaccccagcccgcuccucucagccgcuggaggacucuucagggcaaggcuccagagccauccucuccagccuugagguucacaaaccaacucaucaggacaccccaagauuuccuuacucucugaaguccuccuuaagccuuuguaucagcacuccagggaagagucuguacuuccccugcccucccugcaaccccaaacuacaguuccugaucuugcucaccuucgacuucccaaaagcccccaaauuguuggucuugcgccccccacacuuuaaaaccagcaucucuuuccuccaccucucucucucucucucucucucucucucaugcucucuggaaaguaauccuguuguccuucauuucagcaaacgcggggucaaagagggauggucccggcccuguccccaugcccagccccguuucugcgcaccgucccucccugccuagcugaucucugacccucggcucuugugcuuccugcuacaggaucccugcugggcaccaacagcuccaccauggggcuggccuggggacuaggcguccuguuccugaugcauguguguggcaccaaccgcauuccaggugaguuuguguggcaccuuuaggggaaggagggacaaggaagaggugcuggcuaucccaggugugcccccucacgugcuguccucucccucuugagccugacuggacaucaggacgcagcuucacucugauccugguauuuauucaccucuuucagugguugccaggaguuuucaccccaacccuuugucuccaccccuaaggacucagcccccuacugcuggucccagccuagaaagcucacuuuguguucucuccugucuaacagagucuggcggagacaacagcguguuugacaucuuugaacucaccggggccgcccgcaaggggucugggcgccgacuggugaagggccccgacccuuccagcccagcuuuccgcaucgaggaugccaaccugauccccccugugccugaugacaaguuccaagaccugguggaugcugugcgggcagaaaaggguuuccuccuucuggcaucccugaggcagaugaagaagacccggggcacgcugcuggcccuggagcggaaagaccacucuggccaggucuucagcgugguguccaauggcaaggcgggcacccuggaccucagccugaccguccaaggaaagcagcacguggugucuguggaagaagcucuccuggcaaccggccaguggaagagcaucacccuguuugugcaggaagacagggcccagcuguacaucgacugugaaaagauggagaaugcugaguuggacguccccauccaaagcgucuucaccagagaccuggccagcaucgccagacuccgcaucgcaaaggggggcgucaaugacaauuuccaggugaggcuucuucucugagcccugcuccgugggaucaucugcuagacaggugaccugccaggagggcuacaggaaauccugucuguaaacuaacgcagcaguucucagauuuuaggcagcaugagcaucaccuggagggcuugugaaagcucacccugcugcaccccagccccagagucugggauucuguaaaacugcaacucuaacaaguaccaggugaugcugaugccgguggucugggaagcacacuuugaaaacuacucaaggaaacaagaaaugguuuuccuuuagcagucagccuguucaagccuuagauacuccuuaggcucuuaagaaaagagcuuauuucaaaugcauucccccaauuuuaaucuuguuugaaauggauacuuucuaugggcagaaucaguaccacuuugcuauuggauuccucauggggaugcagcuggucucacauaaaagguuaaaauagcaguuaguuguugcuguuacagcuucaucugugccuuaacuucuagaucuuugcaacgguggcuuugaacucccacauuuaacucuuugacacuggaaagugucauuauauccucuaggcuuaggaucagauuccauuuccuguguacccaaguaggcugauaacugaauucuuuguaaaauacucaagacuuggcagaagucacaauuaagauuuugaaguuguuuggcgauuaauguugcuguguuauuuugacauagugaucuuaagacagcucuuugaagcuuuuagaacaucuauuguaugcuuuuccuagcauacagacagucucccccaaccccauccccaccccgcucugcauucuacaaguaauguguguccucugcccacagggggugcugcagaaugugagguuugucuuuggaaccacaccagaagacauccucaggaacaaaggcugcuccagcugugaguaccccucuauuuuuagggcacauagggaaucagggggaauuccaccaaaaacaaacugaggaauuuagcaauagugguuauacauaaauuacccccagugagaucaucaagaggcauacagaagugacuccaagggguauuauacacacacacguauacacacgugcgcauacacgcaaccccucuaccugcauccuucacaccaaaugaaacgucuucuaccacuaagaacucaagaggcugguugguaagaguaucuauuugaaguuuucauuuuguuucuugccagcuaccaguguccuccucacccuugacaacaacguggugaaugguuccagcccugccauccgcacuaacuacauuggccacaagacaaaggacuugcaagccaucugcggcaucuccugugaugagcuguccagcaugguccuggaacucaggggccugcgcaccauugugaccacgcugcaggacagcauccgcaaaguggucaguggccucugcacccagcccguuagcaugaacccuggaagguuuaucgcagauggucccaaaugacugaaaaugcggggggacacuaaugauauucucucccauuuagacugaagagaacaaagaguuggccaaugagcugaggcggccuccccuaugcuaucacaacggaguucaguacagaaauaacgaggaauggacuguugauagcugcacugagugucacugucagguaagggaccuucaccagccagaauaagaaucgacggcuuuuguuugaaccuacaucuuuggggaaauacccuaaucgccacagagauucuuuuuauguuccauggccugauaacaaaguguuuuuuuuuucuuuaagaugcaauuauggcaucuauaaguucuucuuuaaacucucagaugguuuaucaaaguauuaauuauaccccaggcuaaguaucuaagagaaugaaucuacuaagacaucugaauaauuuaccuaccuuaguucaaagacuaaguguugaaugucagguaaauaaaaccugguuggaacauucauuuuuuuuucccaacccugauuuauauucagcuuuggcauagguucuuuuaguacaguagcaauuguuuuucaaaucacuuagucugacacuguuaggauguuacugucugcuuugcucagauggcacugccaggugugugauucacucuagcauccccgcaugccaguggccagugaguuuggagguucaccuggcuuaucuauuaauagcaaaguauuugaauuugcuuaaauacaaaucacagaugacuggcugugggaaccaacuucauuaaauucccuuucuuuuccaauauaaagacagaucacagaucuauagaugaggaaaaagugcuuauagaucuuccuuccuccccccaaacacauaauauaaaaauguaaaaguccuggcugaauuuucugaguuugauuucagacauagauuugacccaugauguuuguugguuccucugcuauaaauucuuuguacuguaacuuccacccuugacuaaguagcaauuaaaaagaacuuuccaaggaauggagugacacguaaacuagcacuagaacugucucuacgauagugguggcugcaaauaugacagagacagaucuaugaaaaucauuccacuagagcauugacagcccugaccauguuuuggcuuguaaaggaaauguuacaggauguagacuucuguaugcaacaugcucagcagccuguuccccucucacucucuugcccugcagaacucaguuaccaucugcaaaaagguguccugccccaucaugcccugcuccaaugccacaguuccugauggagaaugcuguccucgcuguuggcguaaguuucucaaauggcauagcuauucuucagugacuaggucaguucuacauacauccuagacagccgagcacaacacuggaaccccacccccaucuccaucaugcuuccauucaguuucuugcugcagcagcugguuaacugacagcuuaucugcuguacagagccaaaacuccauuaugaguacaucguaauuacccaucuggauugcaguaauggcagugaagaucuugguauagcucauuaauucugauuuuuugcuuugaggaaaagagaugaagacguggcagcaacagcucuaaguugacugcuuuuagaauuugaccuuaguggcacagaguuaagaaaaaucugcucaccagagauauugacaggcuuacuguguaagcauuggccugaucgggccuggaaguuuugccccuuucaucuguagggauaagagggccuaagagaauagcagcaaucugagcucuagagcaccaaaagaaauaaggcacgauaucguuccauggcacguuaucccuggcuuuuguuaccaguaaaaugaaugacuuugcugagacaauacuuaguguagcagguacaaguuauaaaagugauucauuacaacuaagauaaggaagaaaacaggaaaacagcacuugcccuucacacacacagaaacacacaugcacacacacacaaacacacccuugucacagcucagaauaaccaauuccauccagggaucauauuagcgauauuggcacuguaauggucguuuuuacauuuauuuucuguuccgcauucacuuaacaugugcguuaaaaggaacaaagcuagcuggagguagcaaaguuuugaacuugaaucagggauugcuaagaaaacuuacaacuaaugaccacagaaaguaaguucuuugucuucugucugauacagcuagaugugauuguagccguggugccugggcagaugguaaacaaacaugcuguccucuuaugacaauaugugcagagaaggccccaaacgcuggggugagaggaacaacaaacugacuaacucacggccgaguuggagccagaaccaacaacagcucggcugccuucacacucaucugucaaacacaugguguauggcuccccugacagaaaugacuccuauaagcuuccucauacucgcgcauucuuggaagucugagacuggaaaugccuacccagauauguuaagucaguaaaggaaaacucauuugcaaugcugagaggagaaagaaaaucaaugaauaggagagcauacacugugggaaggcucagcuguacugagccaggcaaagcauccgauuaccccacugcuguacacaucaugaccugggauaaaccccugggccguuggccuaagaaauauguugcuuuucauccuguauaacugcaacuuugugccggcucauauuauguucuagagagcucauguacaccauggugaccauaguuaauaauacuggauuguaugcuuaaaauuugcuaagagaguagaucuuaagucaucaccaaaaaaaguaacuguaagaugauggagauguguuaauuagcuugacggugguaaucacaauauauguguauaucaaaacaucacauuauacaccuuaaauguauauaauauuugucaauuauaccucaguaaagccaaaaagaaauaaauauauugcuuuucacccucuggcaaguggagggcccugaacagagcccucuaaagaacagcuuguccuaaucaucacguaccugaugaaccucuguuuccccugcagccagcgacucugcggacgauggcuggucuccaugguccgaguggaccuccuguucuacgagcuguggcaauggaauucagcagcgcggccgcuccugcgauagccucaacaaccgaugugagggcuccucgguccagacacggaccugccacauucaggagugugacaagagauguaagcaucuuagccucucagggacguggagaacugaccuguccuuguugucgucaccaagggcagcuccacagcauguauauuaagaacacggguucuaggaucucuggaucccaaucccacugcuuagcugugcacccuugaacacaacuuacccucucugaggcucuuuccucauuugcaacuuggagauaauaauaguucuugauaaguuuaucuugagcauuuuauuuagauacugcauguaaagcaguuagcacugaguuuugguuuaugguaagcacccuguaaauguuaggauauuaacagcaacccauaaaaacagcgaacuuauccguucucugguagaaaacauuccauguugacauuugggcauguggccaggagccaauuucuaccguacacuggguuuaguugccauugaccauuuccuggaaauacuucugcgugcuccugaugggagccucuauuuggcugucucuaagccaaaaccauuugugaccaucaacucuguacuuuaguuaaacaggaugguggcuggagccacugguccccguggucaucuuguucugugacauguggugauggugugaucacaaggauccggcucugcaacucucccagcccccagaugaacgggaaacccugugaaggcgaagcgcgggagaccaaagccugcaagaaagacgccugccccaguaagugugagguccgcugcaagggugagcaugggcagcagcucugcccagcugguugccuggcaucugcagccugcaguucagugggucauagagcaggaagguuaccuacuagagaaacaaacagaagcaaaguccugcaggcucagcaacuucuuuuaaugaaaaacaaacucacccucuuccccagcauucuuuccaugugucagagaagcagagguuucuugaacgggcuuaggagagucuaugacaagggagggauuugaaaguugaucuuaauuguugccugugguucaucuucuuacagucaauggaggcugggguccuuggucaccaugggacaucuguucugucaccuguggaggagggguacagaaacguagucgucucugcaacaaccccacaccccaguuuggaggcaaggacugcguuggugauguaacagaaaaccagaucugcaacaagcaggacuguccaauuggugagccacgcagcccaggaugaaacgacccaggagcuuugcucuuuuacugaaugcugcagucagcauucgaggagauuccagcuugguuaguccugagcgauuugauugcucuaagaugcagguggacaacauaaucccaacaaguuaucgguucccuauacccuauaauaucuuacacuguguuaagugcccagcauggcaguauggcagcuuagaccaaccauuuacugugacugucucucucuccuugucucagauggaugccuguccaaucccugcuuugccggcgugaaguguacuagcuacccugauggcagcuggaaauguggugcuugucccccugguuacaguggaaauggcauccagugcacagauguugaugaggugaggaacugauggggcuccgaguuucuggaucuaggaaagcagcuaaccugugcagucgcuuccuuauggcagugacuucuaaacaugaugcacgcucuuauuuccuccauagugcaaagaagugccugaugccugcuucaaccacaauggagagcaccggugugagaacacggaccccggcuacaacugccugcccugccccccacgcuucaccggcucacagcccuucggccagggugucgaacaugccacggccaacaaacagguacagucaacuagacgaguaaaccagaggacaggagagcuguccuugaccaaaauaacugggagcgggaggaauguaauuucauacccuucaccaaaaaaaaaagggcgaggagaugaauguacggucuaguuuuagaaacgugauuagaaaauccaugguaaauccugcaggggaaaaacagucuuccauauuuaaaaaugcugcucuggaauaaguugugagcagauggacuuguaaacgccuaggugcugagcaaauucaagaaaaauaaacauaaagcaaaguuugcuuauagccucagggagaauggggagggacagagguaacccacacucuuccaaauggagccucugucuacucagagaugacagggaucuggauucuuguuuccaugauaucugaggauucucaaaagcucuguguaacagcagcaugguguacccucaggugugcaagccccguaaccccugcacggaugggacccacgacugcaacaagaacgccaagugcaacuaccugggccacuauagcgaccccauguaccgcugcgagugcaagccuggcuacgcuggcaauggcaucaucugcggggaggacacagaccuggauggcuggcccaaugagaaccuggugugcguggccaaugcgacuuaccacugcaaaaagguagagccagguccuuugugugccuccagaaagagggcccaucaccuuaucaaaacacaggcuaaggaauuuuaaauacuuaaaguuuggacaugaaacugaaagauuaaaucucccaaagggagaggggcacuaauuccuauuaaaauuaaaucacuuggugccaaaaacaugaacagggcuagcucuuuuugggcaacuguguuccauagucaacucuucuguccaaaaaaaaguucaguacucuauccaaauaccagcaaagcaugacuuguguucacaacaucuauaaagccuagagcauuuacacaaauucuguauguauaucccccaagaaaaguuuuauuuucuugucuucccauaaaaaaaauaugcuguuacugagccaaauucuguucuuuuucuauuuggaauuccagguacacucccucgugcaugagcucagcaugaggaaggcaacugaagcagugauauauaucuucucuuuccuaggauaauugccccaaccuucccaacucagggcaggaagacuaugacaaggauggaauuggugaugccugugaugaugacgaugacaaugauaaaauuccagaugacaggguaaaaacaguuuucuaucccuuuuucaucuuuucaguucagcaacagccugaaacacuuugggauucaaggaaauuacauggcuauagcaaaaaauauaccaaaucaauacacaggauaauuagaaauuauucauuguguuccaguaguuuaaggauguagauguugccaagagaauuuuuaaaugaggguuuuguuuuucaucagaacuguuuuucucuguacuugagaaauuauaaugcauaaacaaaugccacuuuguucccuagauucauuucaaaugucacaucgaaauuacaguaaaauugacuuugggcacacuaugaacugagaugaugggauuauauucuacaucucacuaacuucuaacccacagggauccauuuuuuuaacuauguccuuuuaacuuuuguagugaucguuuuacacugagugaucaauuagccuauccacuagguagaaaguauugcugauuuucacaguuuuagacauauuaugcacaugguuugaggcuugagcuguuuucaaggacaacauuguuaagugcuccauuucuucucuuugcaggacaacuguccauuccauuacaacccagcucaguaugacuaugacagagaugaugugggagaccgcugugacaacugucccuacaaccacaacccagaucaggcagacacagacaacaauggggaaggagacgccugugcugcagacauugauggagacgguaaggugcugccugaucagagggcccgcgggagacagggacaugcacagcuuuccaaacguacuucugucuaguccuggcuauuaguaugcacuuugguggaaacauccaaggcuggagagcccagcucuuauuugucccuuguucucuucagguauccucaaugaacgggacaacugccaguacgucuacaauguggaccagagagacacugauauggaugggguuggagaucagugugacaauugccccuuggaacacaauccggaucagguagguggauggacuccuuucagagucuuucaguaaacuguuggaauaucccuuucauggccuuugaaaaaugagcuuaacaaaguucaaacacuuucauuacuguggcucccuggcuucucauagccaacuggaauacguucauguaaauaauuugccugaugugagcuccuugcacagagucucacagaucuuuagcaugaagaucugguaacuucagucuuaccuucuguaagaagggcuacuggacuugcucagcaucgucuaccauuguuaagacaaauuauacaaagcagacaucugugacugacaacuguacaauaauauuaaucauauguaauacuaagagauggaaaaauaaaugugcauaagcaaaauaaccauuuucauggcuaaugauguaaucuagcuauaagaaaaucaucaaacuaaggauacauccaaaaccaaaguaauuuaucccugucauaaacauuacccagacaguauacaacacagggaccaguggucuguuuccaucuuuucaggacuuuucagagaagucgacgugucaacaguuuuacaacugaaaccuucuaaggaaauucucuguuauaaaguauccagaaaauuucauuuaacauuaagauguaaacaguuaacauuucauuucaucuuuaguaauuaaauaucacucuauuugaccuuauuuagaaaguuuuauauguaaaacauuuuuaaauuaucccuucucagauuuuuauacgaaaacaaagauaaaggaaaaaaacuuuuaaaauguaauugcuacuauugcuaucuuucugcaggaguguguaaauagacaugacaccccacuggcuguaucaaacaauggagaauuuucccuguggugggggcauaaguuaucuuuaacaugaaugguuuauacugcaauuuacccuccauuuacaucucucuuucagcuggacucugacucagaccgcauuggagauaccugugacaacaaucaggauauugaugaagauggccaccagaacaaucuggacaacugucccuaugugcccaaugccaaccaggcugaccaugacaaagauggcaagggagaugccugugaccacgaugaugacaacgauggcauuccugaugacaaggacaacugcagacucgugcccaaucccgaccagaaggacucugacggugagucaugggagccacuuucuaagacagggacugcuggcacagcuguguagauugaagaaaugaaaccaaggcucaaagcauuugacaggaugaagggaccaaaugccaacuuagacaagauagugacauuucugacaccaguaauaauaauagcacuuuagaauuuugcugaacucuugcuuuuuugaccucaggcgauggucgaggugaugccugcaaagaugauuuugaccaugacagugugccagacaucgaugacaucuguccugagaauguugacaucagugagaccgauuuccgccgauuccagaugauuccucuggaccccaaagggacaucccaaaaugacccuaacuggguuguacgccaucaggguaaagaacucguccagacugucaacugugauccuggacucgcuguaggugaguagcgaguucuuagauccuaagagacugaugcauacauggggaaaaacaaauauaaaaccuggcaguuguaccuaucccugugggugcugaggaugucuaggaacaugauggagaaccuucugaaggcugcagguuuuaaccuggcucugggcucuucuuccagguuaugaugaguuuaaugcuguggacuucaguggcaccuucuucaucaacaccgaaagggacgaugacuaugcuggauuugucuuuggcuaccaguccagcagccgcuuuuauguugugauguggaagcaagucacccaguccuacugggacaccaaccccacgagggcucagggauacucgggccuuucugugaaaguuguaaacuccaccacagggccuggcgagcaccugcggaacgcccuguggcacacaggaaacaccccuggccagguaagaagcaaagcccuggaacagagagagagcuuaugggugccugacuagcacuggggaugcugugcuuugaccaagacucugaccagggagucuuagaaaguucccagcaucaccagcugcagcauugaacucugcuuuguaaaaacauaauaguguugaaaagggagcuugaccaagaauugcccugcaaauccuaaggugccuucagccuuuucaaacaaaaaaaccuccuucccuccucucugucugcuuuauaugugugcucaguggcacacaacaaauaugagaggacuuggaaaaauuccccauugcagcccucuaacuuagaucagcucaguaccuuucaagcauuguuucugauggaaugaaauagaaaucuuuaccugaaggagcuguguuucaaccuuuccuuuuccuuuuccuucaggugcgcacccuguggcaugacccucgucacauaggcuggaaagauuucaccgccuacagauggcgucucagccacaggccaaagacggguuucauuagguacgaucauacugauucacuuucacuuacagucacacugagggacaaaaagacaaaaaguauuaaauagcauugucacuaaacaagauuuuuuuucccugcagaguggugauguaugaagggaagaaaaucauggcugacucaggacccaucuaugauaaaaccuaugcuggugguagacuaggguuguuugucuucucucaagaaaugguguucuucucugaccugaaauacgaauguagagguaagagcaacaucaccaugaauguacacuggacaucucuauuucagacuaauaucaaggaugacgguuaugggggaguccaguguaaagacuguuuuggagacaggguuauuucuauuuugcuuuugaggacacaaggacaaaaauggaauaaugccuaggcacuguggcuuaugaguuccugaguccuuagcuauaauauuaguuugcuuagcaaucucugugcuccucauacacagugcaaagguaagcugcagaaaagcuccuauauaauuuggacuucauuaauaauacuguucuuuacaauuauauauuuauauaucuuacugcuuauuguuuuaugcaugccaucacagcacgaguuagcauucccaacuuuucccuguauacaaagaagggagaggaauguugcuuucauauuggcauguuaaauuaauguucacuauuaaacuuagcauuuuuuuuccucauucuuuuuuacuuagucauuacuuaagcucgcugaguccaacacuggcucuaccacaaaauaagugcuuaauauauauuuacugggccaaggccagauaccuaaaagaucaaugacaguagagaaagaugguugauuuuacucaaaaaaaucuaaauuauuaauguaauuuuugaguccaaauuuuuaaaauaagacucccuaaacuguuaacauugaaagccuuuggaaagcauaauauauguucuggaagguucacgcugugucggucuccuagcaucaaugucagcuaauaaaauuaaaugcuaaugugcuugaacaaccuuaaaauuaggcuuuugucauuagaaaaguagagcuauuccuaugugguuaacuuauuaacuaagaugucuaugcuuuuaugaauuaguuuucauuuguauauuuauuuauauuuguuuauuuaacagaucccuaaucaucaaauuguugauugaaagacugaucauaaaccaaugcugguauugcaccuucuggaacuaugggcuugagaaaacccccaggaucacuucuccuuggcuuccuucuuuucugugcuugcaucaguguggacuccuagaacgugcgaccugccucaagaaaaugcaguuuucaaaaacagacucagcauucagccuccaaugaauaagacaucuuccaagcauauaaacaauugcuuugguuuccuuuugaaaaagcaucuacuugcuucaguugggaaggugcccauuccacucugccuuugucacagagcagggugcuauugugaggccaucucugagcaguggacucaaaagcauuuucaggcaugucagagaagggaggacucacuagaauuagcaaacaaaaccacccugacauccuccuucaggaacacggggagcagaggccaaagcacuaaggggagggcgcauacccgagacgauuguaugaagaaaauauggaggaacuguuacauguucgguacuaagucauuuucaggggauugaaagacuauugcuggauuucaugaugcugacuggcguuagcugauuaacccauguaaauaggcacuuaaauagaagcaggaaagggagacaaagacuggcuucuggacuuccucccugauccccacccuuacucaucaccugcaguggccagaauuagggaaucagaaucaaaccaguguaaggcagugcuggcugccauugccuggucacauugaaauugguggcuucauucuagauguagcuugugcagauguagcaggaaaauaggaaaaccuaccaucucagugagcaccagcugccucccaaaggaggggcagccgugcuuauauuuuuaugguuacaauggcacaaaauuauuaucaaccuaacuaaaacauuccuuuucucuuuuuuccugaauuaucauggaguuuucuaauucucucuuuuggaauguagauuuuuuuuaaaugcuuuacgauguaaaauauuuauuuuuuacuuauucuggaagaucuggcugaaggauuauucauggaacaggaagaagcguaaagacuauccaugucaucuuuguugagagucuucgugacuguaagauuguaaauacagauuauuuauuaacucuguucugccuggaaauuuaggcuucauacggaaaguguuugagagcaaguaguugacauuuaucagcaaaucucuugcaagaacagcacaaggaaaaucagucuaauaagcugcucugccccuugugcucagaguggauguuaugggauucuuuuuuucucuguuuuaucuuuucaaguggaauuaguugguuauccauuugcaaauguuuuaaauugcaaagaaagccaugaggucuucaauacuguuuuaccccaucccuugugcauauuuccagggagaaggaaagcauauacacuuuuuucuuucauuuuuccaaaagagaaaaaaaugacaaaaggugaaacuuacauacaaauauuaccucauuuguugugugacugaguaaagaauuuuuggaucaagcggaaagaguuuaagugucuaacaaacuuaaagcuacuguaguaccuaaaaagucaguguuguacauagcauaaaaacucugcagagaaguauucccaauaaggaaauagcauugaaauguuaaauacaauuucugaaaguuauguuuuuuuucuaucaucugguauaccauugcuuuauuuuuauaaauuauuuucucauugccauuggaauagauaucucagauuguguagauaugcuauuuaaauaauuuaucaggaaauacugccuguagaguuaguauuucuauuuuuauauaauguuugcacacugaauugaagaauuguugguuuuuucuuuuuuuuguuuuguuuuuuuuuuuuuuuuuuuuugcuuuugaccucccauuuuuacuauuugccaauaccuuuuucuaggaaugugcuuuuuuuuguacacauuuuuauccauuuuacauucuaaagcaguguaaguuguauauuacuguuucuuauguacaaggaacaacaauaaaucauauggaaauuuauauuuauacu

SEQ ID NO: 13341 - RNA, 18329 nt, Homo sapiens
aguauaaauauaaauuuccauaugauuuauuguuguuccuuguacauaagaaacaguaauauacaacuuacacugcuuuagaauguaaaauggauaaaaauguguacaaaaaaaagcacauuccuagaaaaagguauuggcaaauaguaaaaaugggaggucaaaagcaaaaaaaaaaaaaaaaaaaaacaaaacaaaaaaaagaaaaaaccaacaauucuucaauucagugugcaaacauuauauaaaaauagaaauacuaacucuacaggcaguauuuccugauaaauuauuuaaauagcauaucuacacaaucugagauaucuauuccaauggcaaugagaaaauaauuuauaaaaauaaagcaaugguauaccagaugauagaaaaaaaacauaacuuucagaaauuguauuuaacauuucaaugcuauuuccuuauugggaauacuucucugcagaguuuuuaugcuauguacaacacugacuuuuuagguacuacaguagcuuuaaguuuguuagacacuuaaacucuuuccgcuugauccaaaaauucuuuacucagucacacaacaaaugagguaauauuuguauguaaguuucaccuuuugucauuuuuuucucuuuuggaaaaaugaaagaaaaaaguguauaugcuuuccuucucccuggaaauaugcacaagggaugggguaaaacaguauugaagaccucauggcuuucuuugcaauuuaaaacauuugcaaauggauaaccaacuaauuccacuugaaaagauaaaacagagaaaaaaagaaucccauaacauccacucugagcacaaggggcagagcagcuuauuagacugauuuuccuugugcuguucuugcaagagauuugcugauaaaugucaacuacuugcucucaaacacuuuccguaugaagccuaaauuuccaggcagaacagaguuaauaaauaaucuguauuuacaaucuuacagucacgaagacucucaacaaagaugacauggauagucuuuacgcuucuuccuguuccaugaauaauccuucagccagaucuuccagaauaaguaaaaaauaaauauuuuacaucguaaagcauuuaaaaaaaaucuacauuccaaaagagagaauuagaaaacuccaugauaauucaggaaaaaagagaaaaggaauguuuuaguuagguugauaauaauuuugugccauuguaaccauaaaaauauaagcacggcugccccuccuuugggaggcagcuggugcucacugagaugguagguuuuccuauuuuccugcuacaucugcacaagcuacaucuagaaugaagccaccaauuucaaugugaccaggcaauggcagccagcacugccuuacacugguuugauucugauucccuaauucuggccacugcaggugaugaguaaggguggggaucagggaggaaguccagaagccagucuuugucucccuuuccugcuucuauuuaagugccuauuuacauggguuaaucagcuaacgccagucagcaucaugaaauccagcaauagucuuucaauccccugaaaaugacuuaguaccgaacauguaacaguuccuccauauuuucuucauacaaucgucucggguaugcgcccuccccuuagugcuuuggccucugcuccccguguuccugaaggaggaugucagggugguuuuguuugcuaauucuagugaguccucccuucucugacaugccugaaaaugcuuuugaguccacugcucagagauggccucacaauagcacccugcucugugacaaaggcagaguggaaugggcaccuucccaacugaagcaaguagaugcuuuuucaaaaggaaaccaaagcaauuguuuauaugcuuggaagaugucuuauucauuggaggcugaaugcugagucuguuuuugaaaacugcauuuucuugaggcaggucgcacguucuaggaguccacacugaugcaagcacagaaaagaaggaagccaaggagaagugauccuggggguuuucucaagcccauaguuccagaaggugcaauaccagcauugguuuaugaucagucuuucaaucaacaauuugaugauuagggaucuguuaaauaaacaaauauaaauaaauauacaaaugaaaacuaauucauaaaagcauagacaucuuaguuaauaaguuaaccacauaggaauagcucuacuuuucuaaugacaaaagccuaauuuuaagguuguucaagcacauuagcauuuaauuuuauuagcugacauugaugcuaggagaccgacacagcgugaaccuuccagaacauauauuaugcuuuccaaaggcuuucaauguuaacaguuuagggagucuuauuuuaaaaauuuggacucaaaaauuacauuaauaauuuagauuuuuuugaguaaaaucaaccaucuuucucuacugucauugaucuuuuagguaucuggccuuggcccaguaaauauauauuaagcacuuauuuugugguagagccaguguuggacucagcgagcuuaaguaaugacuaaguaaaaaagaaugaggaaaaaaaaugcuaaguuuaauagugaacauuaauuuaacaugccaauaugaaagcaacauuccucucccuucuuuguauacagggaaaaguugggaaugcuaacucgugcugugauggcaugcauaaaacaauaagcaguaagauauauaaauauauaauuguaaagaacaguauuauuaaugaaguccaaauuauauaggagcuuuucugcagcuuaccuuugcacuguguaugaggagcacagagauugcuaagcaaacuaauauuauagcuaaggacucaggaacucauaagccacagugccuaggcauuauuccauuuuuguccuuguguccucaaaagcaaaauagaaauaacccugucuccaaaacagucuuuacacuggacucccccauaaccgucauccuugauauuagucugaaauagagauguccaguguacauucauggugauguugcucuuaccucuacauucguauuucaggucagagaagaacaccauuucuugagagaagacaaacaacccuagucuaccaccagcauagguuuuaucauagauggguccugagucagccaugauuuucuucccuucauacaucaccacucugcagggaaaaaaaaucuuguuuagugacaaugcuauuuaauacuuuuugucuuuuugucccucagugugacuguaagugaaagugaaucaguaugaucguaccuaaugaaacccgucuuuggccuguggcugagacgccaucuguaggcggugaaaucuuuccagccuaugugacgagggucaugccacagggugcgcaccugaaggaaaaggaaaaggaaagguugaaacacagcuccuucagguaaagauuucuauuucauuccaucagaaacaaugcuugaaagguacugagcugaucuaaguuagagggcugcaauggggaauuuuuccaaguccucucauauuuguugugugccacugagcacacauauaaagcagacagagaggagggaaggagguuuuuuuguuugaaaaggcugaaggcaccuuaggauuugcagggcaauucuuggucaagcucccuuuucaacacuauuauguuuuuacaaagcagaguucaaugcugcagcuggugaugcugggaacuuucuaagacucccuggucagagucuuggucaaagcacagcauccccagugcuagucaggcacccauaagcucucucucuguuccagggcuuugcuucuuaccuggccagggguguuuccugugugccacagggcguuccgcaggugcucgccaggcccugugguggaguuuacaacuuucacagaaaggcccgaguaucccugagcccucgugggguuggugucccaguaggacugggugacuugcuuccacaucacaacauaaaagcggcugcuggacugguagccaaagacaaauccagcauagucaucgucccuuucgguguugaugaagaaggugccacugaaguccacagcauuaaacucaucauaaccuggaagaagagcccagagccagguuaaaaccugcagccuucagaagguucuccaucauguuccuagacauccucagcacccacagggauagguacaacugccagguuuuauauuuguuuuuccccauguaugcaucagucucuuaggaucuaagaacucgcuacucaccuacagcgaguccaggaucacaguugacagucuggacgaguucuuuacccugauggcguacaacccaguuagggucauuuugggaugucccuuugggguccagaggaaucaucuggaaucggcggaaaucggucucacugaugucaacauucucaggacagaugucaucgaugucuggcacacugucauggucaaaaucaucuuugcaggcaucaccucgaccaucgccugaggucaaaaaagcaagaguucagcaaaauucuaaagugcuauuauuauuacuggugucagaaaugucacuaucuugucuaaguuggcauuuggucccuucauccugucaaaugcuuugagccuugguuucauuucuucaaucuacacagcugugccagcagucccugucuuagaaaguggcucccaugacucaccgucagaguccuucuggucgggauugggcacgagucugcaguuguccuugucaucaggaaugccaucguugucaucaucguggucacaggcaucucccuugccaucuuugucauggucagccugguuggcauugggcacauagggacaguuguccagauuguucugguggccaucuucaucaauauccugauuguugucacagguaucuccaaugcggucugagucagaguccagcugaaagagagauguaaauggaggguaaauugcaguauaaaccauucauguuaaagauaacuuaugcccccaccacagggaaaauucuccauuguuugauacagccaguggggugucaugucuauuuacacacuccugcagaaagauagcaauaguagcaauuacauuuuaaaaguuuuuuuccuuuaucuuuguuuucguauaaaaaucugagaagggauaauuuaaaaauguuuuacauauaaaacuuucuaaauaaggucaaauagagugauauuuaauuacuaaagaugaaaugaaauguuaacuguuuacaucuuaauguuaaaugaaauuuucuggauacuuuauaacagagaauuuccuuagaagguuucaguuguaaaacuguugacacgucgacuucucugaaaaguccugaaaagauggaaacagaccacuggucccuguguuguauacugucuggguaauguuuaugacagggauaaauuacuuugguuuuggauguauccuuaguuugaugauuuucuuauagcuagauuacaucauuagccaugaaaaugguuauuuugcuuaugcacauuuauuuuuccaucucuuaguauuacauaugauuaauauuauuguacaguugucagucacagaugucugcuuuguauaauuugucuuaacaaugguagacgaugcugagcaaguccaguagcccuucuuacagaagguaagacugaaguuaccagaucuucaugcuaaagaucugugagacucugugcaaggagcucacaucaggcaaauuauuuacaugaacguauuccaguuggcuaugagaagccagggagccacaguaaugaaaguguuugaacuuuguuaagcucauuuuucaaaggccaugaaagggauauuccaacaguuuacugaaagacucugaaaggaguccauccaccuaccugauccggauuguguuccaaggggcaauugucacacugaucuccaaccccauccauaucagugucucucugguccacauuguagacguacuggcaguugucccguucauugaggauaccugaagagaacaagggacaaauaagagcugggcucuccagccuuggauguuuccaccaaagugcauacuaauagccaggacuagacagaaguacguuuggaaagcugugcaugucccugucucccgcgggcccucugaucaggcagcaccuuaccgucuccaucaaugucugcagcacaggcgucuccuuccccauuguugucugugucugccugaucuggguugugguuguagggacaguugucacagcggucucccacaucaucucugucauagucauacugagcuggguuguaauggaauggacaguuguccugcaaagagaagaaauggagcacuuaacaauguuguccuugaaaacagcucaagccucaaaccaugugcauaauaugucuaaaacugugaaaaucagcaauacuuucuaccuaguggauaggcuaauugaucacucaguguaaaacgaucacuacaaaaguuaaaaggacauaguuaaaaaaauggaucccuguggguuagaaguuagugagauguagaauauaaucccaucaucucaguucauagugugcccaaagucaauuuuacuguaauuucgaugugacauuugaaaugaaucuagggaacaaaguggcauuuguuuaugcauuauaauuucucaaguacagagaaaaacaguucugaugaaaaacaaaacccucauuuaaaaauucucuuggcaacaucuacauccuuaaacuacuggaacacaaugaauaauuucuaauuauccuguguauugauuugguauauuuuuugcuauagccauguaauuuccuugaaucccaaaguguuucaggcuguugcugaacugaaaagaugaaaaagggauagaaaacuguuuuuacccugucaucuggaauuuuaucauugucaucgucaucaucacaggcaucaccaauuccauccuugucauagucuuccugcccugaguugggaagguuggggcaauuauccuaggaaagagaagauauauaucacugcuucaguugccuuccucaugcugagcucaugcacgagggaguguaccuggaauuccaaauagaaaaagaacagaauuuggcucaguaacagcauauuuuuuuuaugggaagacaagaaaauaaaacuuuucuugggggauauacauacagaauuuguguaaaugcucuaggcuuuauagauguugugaacacaagucaugcuuugcugguauuuggauagaguacugaacuuuuuuuuggacagaagaguugacuauggaacacaguugcccaaaaagagcuagcccuguucauguuuuuggcaccaagugauuuaauuuuaauaggaauuagugccccucucccuuugggagauuuaaucuuucaguuucauguccaaacuuuaaguauuuaaaauuccuuagccuguguuuugauaaggugaugggcccucuuucuggaggcacacaaaggaccuggcucuaccuuuuugcagugguaagucgcauuggccacgcacaccagguucucauugggccagccauccaggucuguguccuccccgcagaugaugccauugccagcguagccaggcuugcacucgcagcgguacauggggucgcuauaguggcccagguaguugcacuuggcguucuuguugcagucgugggucccauccgugcagggguuacggggcuugcacaccugaggguacaccaugcugcuguuacacagagcuuuugagaauccucagauaucauggaaacaagaauccagaucccugucaucucugaguagacagaggcuccauuuggaagaguguggguuaccucugucccuccccauucucccugaggcuauaagcaaacuuugcuuuauguuuauuuuucuugaauuugcucagcaccuaggcguuuacaaguccaucugcucacaacuuauuccagagcagcauuuuuaaauauggaagacuguuuuuccccugcaggauuuaccauggauuuucuaaucacguuucuaaaacuagaccguacauucaucuccucgcccuuuuuuuuuuggugaaggguaugaaauuacauuccucccgcucccaguuauuuuggucaaggacagcucuccuguccucugguuuacucgucuaguugacuguaccuguuuguuggccguggcauguucgacacccuggccgaagggcugugagccggugaagcguggggggcagggcaggcaguuguagccgggguccguguucucacaccggugcucuccauugugguugaagcaggcaucaggcacuucuuugcacuauggaggaaauaagagcgugcaucauguuuagaagucacugccauaaggaagcgacugcacagguuagcugcuuuccuagauccagaaacucggagccccaucaguuccucaccucaucaacaucugugcacuggaugccauuuccacuguaaccagggggacaagcaccacauuuccagcugccaucaggguagcuaguacacuucacgccggcaaagcagggauuggacaggcauccaucugagacaaggagagagagacagucacaguaaaugguuggucuaagcugccauacugccaugcugggcacuuaacacaguguaagauauuauaggguauagggaaccgauaacuuguugggauuauguuguccaccugcaucuuagagcaaucaaaucgcucaggacuaaccaagcuggaaucuccucgaaugcugacugcagcauucaguaaaagagcaaagcuccugggucguuucauccugggcugcguggcucaccaauuggacaguccugcuuguugcagaucugguuuucuguuacaucaccaacgcaguccuugccuccaaacuggggugugggguuguugcagagacgacuacguuucuguaccccuccuccacaggugacagaacagaugucccauggugaccaaggaccccagccuccauugacuguaagaagaugaaccacaggcaacaauuaagaucaacuuucaaaucccucccuugucauagacucuccuaagcccguucaagaaaccucugcuucucugacacauggaaagaaugcuggggaagagggugaguuuguuuuucauuaaaagaaguugcugagccugcaggacuuugcuucuguuuguuucucuaguagguaaccuuccugcucuaugacccacugaacugcaggcugcagaugccaggcaaccagcugggcagagcugcugcccaugcucacccuugcagcggaccucacacuuacuggggcaggcgucuuucuugcaggcuuuggucucccgcgcuucgccuucacaggguuucccguucaucugggggcugggagaguugcagagccggauccuugugaucacaccaucaccacaugucacagaacaagaugaccacggggaccaguggcuccagccaccauccuguuuaacuaaaguacagaguugauggucacaaaugguuuuggcuuagagacagccaaauagaggcucccaucaggagcacgcagaaguauuuccaggaaauggucaauggcaacuaaacccaguguacgguagaaauuggcuccuggccacaugcccaaaugucaacauggaauguuuucuaccagagaacggauaaguucgcuguuuuuauggguugcuguuaauauccuaacauuuacagggugcuuaccauaaaccaaaacucagugcuaacugcuuuacaugcaguaucuaaauaaaaugcucaagauaaacuuaucaagaacuauuauuaucuccaaguugcaaaugaggaaagagccucagagaggguaaguuguguucaagggugcacagcuaagcagugggauugggauccagagauccuagaacccguguucuuaauauacaugcuguggagcugcccuuggugacgacaacaaggacaggucaguucuccacgucccugagaggcuaagaugcuuacaucucuugucacacuccugaauguggcagguccgugucuggaccgaggagcccucacaucgguuguugaggcuaucgcaggagcggccgcgcugcugaauuccauugccacagcucguagaacaggagguccacucggaccauggagaccagccaucguccgcagagucgcuggcugcaggggaaacagagguucaucagguacgugaugauuaggacaagcuguucuuuagagggcucuguucagggcccuccacuugccagagggugaaaagcaauauauuuauuucuuuuuggcuuuacugagguauaauugacaaauauuauauacauuuaagguguauaaugugauguuuugauauacacauauauugugauuaccaccgucaagcuaauuaacacaucuccaucaucuuacaguuacuuuuuuuggugaugacuuaagaucuacucucuuagcaaauuuuaagcauacaauccaguauuauuaacuauggucaccaugguguacaugagcucucuagaacauaauaugagccggcacaaaguugcaguuauacaggaugaaaagcaacauauuucuuaggccaacggcccagggguuuaucccaggucaugauguguacagcagugggguaaucggaugcuuugccuggcucaguacagcugagccuucccacaguguaugcucuccuauucauugauuuucuuucuccucucagcauugcaaaugaguuuuccuuuacugacuuaacauaucuggguaggcauuuccagucucagacuuccaagaaugcgcgaguaugaggaagcuuauaggagucauuucugucaggggagccauacaccauguguuugacagaugagugugaaggcagccgagcuguuguugguucuggcuccaacucggccgugaguuagucaguuuguuguuccucucaccccagcguuuggggccuucucugcacauauugucauaagaggacagcauguuuguuuaccaucugcccaggcaccacggcuacaaucacaucuagcuguaucagacagaagacaaagaacuuacuuucuguggucauuaguuguaaguuuucuuagcaaucccugauucaaguucaaaacuuugcuaccuccagcuagcuuuguuccuuuuaacgcacauguuaagugaaugcggaacagaaaauaaauguaaaaacgaccauuacagugccaauaucgcuaauaugaucccuggauggaauugguuauucugagcugugacaaggguguguuugugugugugugcauguguguuucugugugugugaagggcaagugcuguuuuccuguuuucuuccuuaucuuaguuguaaugaaucacuuuuauaacuuguaccugcuacacuaaguauugucucagcaaagucauucauuuuacugguaacaaaagccagggauaacgugccauggaacgauaucgugccuuauuucuuuuggugcucuagagcucagauugcugcuauucucuuaggcccucuuaucccuacagaugaaaggggcaaaacuuccaggcccgaucaggccaaugcuuacacaguaagccugucaauaucucuggugagcagauuuuucuuaacucugugccacuaaggucaaauucuaaaagcagucaacuuagagcuguugcugccacgucuucaucucuuuuccucaaagcaaaaaaucagaauuaaugagcuauaccaagaucuucacugccauuacugcaauccagauggguaauuacgauguacucauaauggaguuuuggcucuguacagcagauaagcugucaguuaaccagcugcugcagcaagaaacugaauggaagcaugauggagaugggggugggguuccaguguugugcucggcugucuaggauguauguagaacugaccuagucacugaagaauagcuaugccauuugagaaacuuacgccaacagcgaggacagcauucuccaucaggaacuguggcauuggagcagggcaugauggggcaggacaccuuuuugcagaugguaacugaguucugcagggcaagagagugagaggggaacaggcugcugagcauguugcauacagaagucuacauccuguaacauuuccuuuacaagccaaaacauggucagggcugucaaugcucuaguggaaugauuuucauagaucugucucugucauauuugcagccaccacuaucguagagacaguucuagugcuaguuuacgugucacuccauuccuuggaaaguucuuuuuaauugcuacuuagucaaggguggaaguuacaguacaaagaauuuauagcagaggaaccaacaaacaucaugggucaaaucuaugucugaaaucaaacucagaaaauucagccaggacuuuuacauuuuuauauuauguguuuggggggaggaaggaagaucuauaagcacuuuuuccucaucuauagaucugugaucugucuuuauauuggaaaagaaagggaauuuaaugaaguugguucccacagccagucaucugugauuuguauuuaagcaaauucaaauacuuugcuauuaauagauaagccaggugaaccuccaaacucacuggccacuggcaugcggggaugcuagagugaaucacacaccuggcagugccaucugagcaaagcagacaguaacauccuaacagugucagacuaagugauuugaaaaacaauugcuacuguacuaaaagaaccuaugccaaagcugaauauaaaucaggguugggaaaaaaaaaugaauguuccaaccagguuuuauuuaccugacauucaacacuuagucuuugaacuaagguagguaaauuauucagaugucuuaguagauucauucucuuagauacuuagccugggguauaauuaauacuuugauaaaccaucugagaguuuaaagaagaacuuauagaugccauaauugcaucuuaaagaaaaaaaaaacacuuuguuaucaggccauggaacauaaaaagaaucucuguggcgauuaggguauuuccccaaagauguagguucaaacaaaagccgucgauucuuauucuggcuggugaaggucccuuaccugacagugacacucagugcagcuaucaacaguccauuccucguuauuucuguacugaacuccguugugauagcauaggggaggccgccucagcucauuggccaacucuuuguucucuucagucuaaaugggagagaauaucauuaguguccccccgcauuuucagucauuugggaccaucugcgauaaaccuuccaggguucaugcuaacgggcugggugcagaggccacugaccacuuugcggaugcuguccugcagcguggucacaauggugcgcaggccccugaguuccaggaccaugcuggacagcucaucacaggagaugccgcagauggcuugcaaguccuuugucuuguggccaauguaguuagugcggauggcagggcuggaaccauucaccacguuguugucaagggugaggaggacacugguagcuggcaagaaacaaaaugaaaacuucaaauagauacucuuaccaaccagccucuugaguucuuagugguagaagacguuucauuuggugugaaggaugcagguagagggguugcguguaugcgcacguguguauacguguguguguauaauaccccuuggagucacuucuguaugccucuugaugaucucacuggggguaauuuauguauaaccacuauugcuaaauuccucaguuuguuuuugguggaauucccccugauucccuaugugcccuaaaaauagagggguacucacagcuggagcagccuuuguuccugaggaugucuucuggugugguuccaaagacaaaccucacauucugcagcacccccugugggcagaggacacacauuacuuguagaaugcagagcgggguggggaugggguugggggagacugucuguaugcuaggaaaagcauacaauagauguucuaaaagcuucaaagagcugucuuaagaucacuaugucaaaauaacacagcaacauuaaucgccaaacaacuucaaaaucuuaauugugacuucugccaagucuugaguauuuuacaaagaauucaguuaucagccuacuuggguacacaggaaauggaaucugauccuaagccuagaggauauaaugacacuuuccagugucaaagaguuaaaugugggaguucaaagccaccguugcaaagaucuagaaguuaaggcacagaugaagcuguaacagcaacaacuaacugcuauuuuaaccuuuuaugugagaccagcugcauccccaugaggaauccaauagcaaagugguacugauucugcccauagaaaguauccauuucaaacaagauuaaaauugggggaaugcauuugaaauaagcucuuuucuuaagagccuaaggaguaucuaaggcuugaacaggcugacugcuaaaggaaaaccauuucuuguuuccuugaguaguuuucaaagugugcuucccagaccaccggcaucagcaucaccugguacuuguuagaguugcaguuuuacagaaucccagacucuggggcuggggugcagcagggugagcuuucacaagcccuccaggugaugcucaugcugccuaaaaucugagaacugcugcguuaguuuacagacaggauuuccuguagcccuccuggcaggucaccugucuagcagaugaucccacggagcagggcucagagaagaagccucaccuggaaauugucauugacgccccccuuugcgaugcggagucuggcgaugcuggccaggucucuggugaagacgcuuuggauggggacguccaacucagcauucuccaucuuuucacagucgauguacagcugggcccugucuuccugcacaaacagggugaugcucuuccacuggccgguugccaggagagcuucuuccacagacaccacgugcugcuuuccuuggacggucaggcugagguccagggugcccgccuugccauuggacaccacgcugaagaccuggccagaguggucuuuccgcuccagggccagcagcgugccccgggucuucuucaucugccucagggaugccagaaggaggaaacccuuuucugcccgcacagcauccaccaggucuuggaacuugucaucaggcacaggggggaucagguuggcauccucgaugcggaaagcugggcuggaagggucggggcccuucaccagucggcgcccagaccccuugcgggcggccccggugaguucaaagaugucaaacacgcuguugucuccgccagacucuguuagacaggagagaacacaaagugagcuuucuaggcugggaccagcaguagggggcugaguccuuagggguggagacaaaggguuggggugaaaacuccuggcaaccacugaaagaggugaauaaauaccaggaucagagugaagcugcguccugauguccagucaggcucaagagggagaggacagcacgugagggggcacaccugggauagccagcaccucuuccuugucccuccuuccccuaaaggugccacacaaacucaccuggaaugcgguuggugccacacacaugcaucaggaacaggacgccuaguccccaggccagccccaugguggagcuguuggugcccagcagggauccuguagcaggaagcacaagagccgagggucagagaucagcuaggcagggagggacggugcgcagaaacggggcugggcauggggacagggccgggaccaucccucuuugaccccgcguuugcugaaaugaaggacaacaggauuacuuuccagagagcaugagagagagagagagagagagagagagagguggaggaaagagaugcugguuuuaaaguguggggggcgcaagaccaacaauuugggggcuuuugggaagucgaaggugagcaagaucaggaacuguaguuugggguugcagggagggcaggggaaguacagacucuucccuggagugcugauacaaaggcuuaaggaggacuucagagaguaaggaaaucuugggguguccugaugaguugguuugugaaccucaaggcuggagaggauggcucuggagccuugcccugaagaguccuccagcggcugagaggagcgggcugggguaggcgagcggggagaguguagguuccgggguccaccagagggacugaagccucagcgcuccagguggaugucccgggcagcuuugguccucggcggccgccgggggcgacuuaccuguguguaccggagcgcggcggccgggagcgguggcgagggcggcgagggcuggaggggcgcggggaaugccugugcguccggaguagagguugcuccuggagagcgacaggagcccugaacucgcaggccagcucgggcgcagcggcuggcaaggcggaggagccgcgcgcuuuuaaaggggcgcucgcauuccuggggauuccuccggccaaugggcggcggccgggcaggaagcgggaggugggggccagucugggcuccucucuccgccccccgcugccuggcgcgcaacuuuccagcuagaaagugaagggggcgggggucggggcuugggagcacuagaacuucucagaaaagucggugcccgcccacgcagccuuggcgcgcacgggcucggcgcucguacucuugcgccacgcgggcucggggugaucagcaagcaucccgaaaagggacggggcuggggagaccaccuaggagggcccgcgggguggcgcaggggcuuucgggcgagcugaucucccggaaugccugguugauggcgagagguggauacuagagacugggcccguuuuguaaaaagaaaaaugggccgacggggcgcaggggacaccaagagagccauucguuaaaguaccugccccucgggcccucgcugacucuccuccaccguccccguggggugaggacacgcgucccccgagcgccuguccugagcuggccccacgcccgccccggagggaggugagcgcggcgucggcggggccggcagguuggugcgccgcguucgccuucgcugccuucgggcccuuuccugccgcggcugccagggggcccacagagacgccucucccgcugccgcggcgcucccucggccggccgcuugggggcggugugcguauucucaucaaggggcccggggaggacagcugcuuucuacucgaauuuuaaggaaacuuacucguauccaguuuccacaagccaaauugaaauugugucuugaaaaacaguuuuugugcccacucgugcuucuuaacgugacuccuguuuggagaauuugcagaaccaucuggcuccagagucuucagcuauuuacagagcagacccauagaguaauaaauuacucucugccuauuauuguauuucccuuuuuccucccuaaacguucuuuucauuuuucggcuccugaacccgagguguggguuacauuucugugggugcacacauugccaugagugccgcugccuagugcuucugucauugaagucuggucuccaagccacugucccaagccagcaugacucuagcuuccuggaauuccauucaucucuucgggaugggacgucagccgccucgcucccucugcugugauccagcgcuaucgggcucgcuccgaggccagggcauagguagaagcuugaccaaauaaggaucucagcacgggcagggggaaaccccugggguucaccucccaucuuagcacuuaaaccuggcaggacucccgacugcugcaaacagccaaguguuuacauucaucaaacagcaguuucgcuuuucuugcgugggaguguuguaugacaagaugguguguguguguguguguguguguguguauuacggaaagaguguuuucuaguuacucaauauguauauaaaaugccucuaaaagaugaccgguauguuccuaaggcacauguuuguuggauuucagauguugggaggcagaaagaaaaguuucuacugguugaugaauaaaaucagauucuugucccgcaaaucauagguaaugauucauccaagcagaucugaagauucuggaaucggcacccauccaucucccuccccuuccuucuccuucuacagcauucaucuugcucuucgaaaaguaauuggguuuuuuuuuucuucuuuccacuugcuccaugauacuggacagucagaaauaguucuuggagggaugggccgcucauggcucugggcuccucuggcccacuggaucauuguguacaaaucagaugggggcuugagggcugcaagaggcccacaaaagcagaaugcaucuuguaugaaaagauuaucuccccu

SEQ ID NO: 13342 - RNA, 101436 nt, Homo sapiens
gcccaggcaaggccgcccugccuugggcgcagcgcugccauggcugggggccguggggcccccgggcgcggccgggacgagccuccggagagcuacccgcaacgacaggaccacgagcuacaggcccuggaggccauuuacggcgcggacuuccaagaccugcggccggacgcuugcggaccgguaggaacguggcuugucaggcccgggcuggcgugcccuggccuccccgggcccugggccaaagcccggacacuuccagauugggccgccgcuuuaggauccugcagucuuuucaucccuuagguuccacccaugcucacuuuaguccuugcaccugcagcuggucugcagaaucccaccuaggccgaauucuucuacaguccuuuccccaugauuuccccagaggaaucccccuggauuccucccucuuaccuggcacugcuucuuauuccugccuacaucccauaacauaacugccuccuuccaaccuuguccuuuuuccccucugaaagcccuugcggaugauaccacagcaauucauacgcgccccuugcuacuuuguucugagaacgcuuuuugggcucucgcacaggccuuacguccucaaucagaauucucaagucucauccaugcauucaaaucugcacgccacauaauucccucuguacuccccaggcauccucacuguguuuuccgguauggaggaacuuuccauaccucugcaccuuccucuaagacauuuagcucagaauaaagcacacauucaucuuagcuguaguagagagaggguucuagacugagucuagagaaggaguguccaaucuuuuggcuucccugggccacacacaaaauacacuaacacuaaggauagcugaugaccuaaaagaaaaaaaaaauucgcaaaaaaaccucaauguuuuaagaaaguuuacgaaugcguguugggccacauucaaagcggcccaugggccucggguuagaccagcuugcucuagcucuagaccuuuuaaaauggcauuuuguuuaaaauaauauuuugccuuuuugucuggaaauuaaggcacguuauaaaguauuuauacugacaguuuuuuccccauccuugaagaguugaucuaccaaacuauuucugaauauuaucauauuaucauuuaaaacauaguucuaacuucaucugcuuuuuuuuuuuuucuuuuugagacagggucuugcucugucucccaagcuggagugcagaggcaugaccacggcucacugcagcuuauucucaagcaauccuucugccucagccugucaaguaccugggacuacaggcacaugccacuacaccugguuaauuuuuuuaauuuuuuguagagacagagucuugcucuguugcccgggcugguaucaaguuccugagcucaugcaauccucucaccuuggccucugaaagugcugggauuacaggugugggccaccgcgccuggccucuucaucugcuuuuaacuuuggcauuucacaacaucugcucuaucuacacauccaggauuuccucaagaaauaccaucuucuggagcuaucaggacaaaauauucucucucaaacucagggugcuucuuccuucauuaaauauuuguuuuaggcauuaggaauacagcugugggcaaaacagacaaaaauccuugcccucagggagcuuacuuuucuaaugcuuaauaauaugaaguuauuuuuaaccugaaaugguaaaaauauaaauuauuccccuuaacaugacagagaaguuggugacuggggaacuucuaucuucccaaaccuugagaaucaggaaguaggcccaagaagcagccaaaauaggugucucaaaguguacaugggacucaacacaaagcuccuaaggcuucauucugaacuaguuuguuuacuuuauacaagcuuaguugucugcuccuagggcugcagaaaaauggaagagaaaaagcaacuucuuuuagguagggauauugauaaccucaagaauuuauagcugguggcuuucauaacaagauggaauacuagacaaaccaaagcaaaaacuauagaaggcaggcagaagaauuuaaauagcugucuguggccuauuguacaccgggcaaauggccucaacacauucauaggacuggcaggcaaauaauugauggucucaaggaugaaucagaguuuagucauucaacaagcacuuauuaucaccugcuauuugccagggaaaagugaugcagguccaaaauccuuuauccaaaacucuuuauugagagggaguuucucucugucgcccgggcuggagugcgguggagcaaucucggcucacugcaaccuccaccucccagguucaagcgauucuugugccucagccuccugagcagcugggauuacagguacccgccuccacaccuggcuaauuuuuguauuuuuaguagagauggaguuucauuauguuggccaggcuggucucgaauuccugaccucaaguccucccgccucgccucccaaaguccugggauuacaggugugagccaccgugcccagccuuuuauccaaaacucuugagacuugauggguuucagaauucagaagugcuucuguucacguuuaugugugcacauuccacacauuaccuaauaccuuccucagugucuggggcagcaucgaaaaucaaacacaaugaaacauagaaauacucaaauuucacacugaacaaauaaacacuauaacuaaccucaugucaguucaggcuaaauuugcugccaauaaauucagguuagauuuuuuuuucaacuucuuuuaguggggauguguuguaauauaaauuucaguuuaguagcauauguauaucauuuauaaauaacauuuugaggugcaugcuaaaaacuuuugcauuuguaaaaaguuuagacacugcuaguuuaaaguaucuauaauuuauagauaguuacaaauuacuaacuuauuuuggcuagcuuuccacagcagcaaaaggucugcucauuuauaauuugauagcuuuuggaaacaucccuccaaaaaacuugcuucaaucccuggaucccccaguaguguauggugguguuuguuuuccuuuaucuucaacaauacuauauauguuagacuuuuucaucuuugccacauaaaugaaacauaucucauuuuaauuuuuauuuauuuauaaauuaucuagaacaccuuuguuuacaaaccauugauuuuucuuuuucugugaacugcucauacucugguuuauuuuucuacucugugguccauuuucuuguuuauuuguaagagcuaaauaucuuaagaaaacuagcauuuugggucauauaaugcauauauuuuucuccuaauuauaugcauuuauuuacguaauuuaugugauuuaaaaaauguugauagagucaaaaugaccuuuuuuuucuuuuauggucccuguggguuuuuuuucccccucuguuccaauguuacuaaaaaccaaauucgucaaaguuuacuuuuaacuuguucaugacuucguuuuuaaauuuucaucaaauaaagauauaaguagguuuuuuuuuuuaaguucuucguuccaucaaaguacgggccuaggccaccuccccgugugcaucccuccuccuccagcuaggcagcuagacaaauauaggcaauugaauuuuucagugucuuccacucauuugaaaugccauuccuacaagcccagugccugguaaaacaaacaaaaaacuuucaaaaauuguuacugaaugaaauaauucucaaauguauuucaagucucuuuuuuuccuugccuggaaugcuuggucucuuggcuugucucagcuucaaugcuacauccucagauaguucuucuuugauaaccacauuuaaguauauacccucacaccccaagucguuuguuaaggagagcaccacgucaucucuucaacggcacucucuaagcuuguacuuauguguuuauuauguuuguuuucccccaccagacugaaguuccaugagagcuggaaccauaucuguguucucaccuccguggacuaagcacagugccugacacagagucagugcuuagcaaauaugggugauggaugugugaugggugaaugaguggaugaaagaccuguggaccaaagagugcuuaacccuuccccagaccacauucgcagaauuaugcuuuauggaaggacccacacauuuaucaaggauuauuauaaagccauauaagaacugaucuuacaaauuuuguacacauaguagaagaguacaguguuuauuauaugguacuccuuguaagguucacguuauaaauuucuguuagaauuuaguauuauaaguacuuugcuucccuaaaauaauuuuuaggcuuucucuuuucugaugauaccacguuucucuuuuugcccugccugccaggacauucagagaaaaaaaucaaggcucaaucccagcaacuuaggauggcauaauaaaagaguggcuuaugggaggagacaggguuuggaguuaaggcuggguuugaaucccagcucugucccuguguaucuguaggcaagaauguaaaacucccugagccugagcuucuguaucuguaaaauggagaugacaccugccuugcaaaguugguaaggugccuggaccaugggagcgcucagccauuguuuuuucucucagacuccccuuguucauuauauacauauaauaugaacuacuucaaauccacuuuggaaaaaguguaucuaaauugaagaacaaggguauuuugcgauuuggugaaaaguaguugauugaaaacauaugcaauucucuccuugucaaggguuuucauuuguuaauaucucaguauucagaucucaauucaaaucuccccugcucgcagaguccuucacugaccuaccuguccagauaccuucuccucgcccaccacuaugucccucuacucugcuuuguuuucuuuacagcacucaucacuauuugaaaucacucgucuucuaguuuguaucagcugguugggacugugucugucuaaauuuaccccugcacucccagcuuccaggagagcacccaggcauaauaacucaguaacaucugaacgaauggaagcugaguggaacauuuugguucauuccuuagauaacuuaaaaaaggaaagugcauuuucacuggcuuagguuuuguuuuuaaaucaugcuuuuggaaaguaugccagauuaucuauuuaaaauauaauuacaaauauuuuuaaaguagaacuuuugaucuaaaaugaucauuaucuuaaucauuaaugauuggcucuacagcuuugaaaaaaauuuuuuuuguuuuuccucuuuuaggucaaagagcccccugaaaucaauuuaguuuuguacccucaaggccuaacuggugaagaaguauauguaaaaguggauuugaggguuaaaugcccaccuaccuauccagaugugugaguacauuuauaaauagcuuugacgugguuucaguuuucuguuuugacaacauagaaacagauugaaauucguaguauuuucuccuuccugcucccauuccacauaaaauuucauuuccucuauuucaacaaaacuacaucagcaauagauguuuucaugaaaccugucucauuuuaagccuguucauaguuauagaauugucacuacagauacuuauauuugccuagugacuauuuugcuuccucugauguguuaacuuuuguuuauuuauuucuucauaaguuaggaagaggaaaauuuggaagaaaacaauaaaggcauggugacuguugaaagcccuugcauaguuagaguguggcugguauuagaaauucagcaagucugugccucagaugaccuuucacugccuagagugagggagaguauuuggaucuguccugccucucaauggggcacucuggcgaguguccauugugcagggcugugcugugcacugcaguacguuuagcaucccuggcccccaccuaccaaugccacgaguguccuccaggcauugaaacaaccaaauaaccuacauauuuccagacucccucugaaggugaugucaccucugguugagaaaaacuaguuagagccaaaguguuagccaucagcacuuaagcaugucuauuugguguaaucuuuccccacccaucccacauggaaaggcagguuggccuggauggcguuaaguaguuugaaauuauuguauggggaaccagugaagguuuuugagauggaaagggacaaguaaaaggaaacucugcuuuacacagugggugguaaauuuauggaauuuauuauccuaagaagugauagggaggauaugaaaagacagauaagucaaaauugagcuccuugaagucaguaaccauucuuggcccccaaaacuguccugagaguauuauaguagguauacuauacauacuauaaaaauauuaauuaacgaaacguuaauuauaaaacauuaaugaaaaagauaauuaaaaauuuaugaaaggaaauuaaaagagugccucucuagguuguuuuuuuuuccugacaccaaauacaugaugccuuuucugauaccauguggguguccaguaguucaguucaauucugacacuaucuguaguuagcaaagaccccacagauuaaggacccaguuccacaagauugccuccauuucugaugcuaguggcaagucccaguacuucugaccauuuauagccaguauuuauaacuggcuauaaauuuagggguuuccaccacccccuccuaaguugcgauaauugcuagaaugcaucacagaacucaguuucugugaguuacauuuaccaguuuguuguaaaggauauggcucuggaauagccacauggaaguauuaugaaggguaaggugugugggaagaggcacagagcucccauacccucuccaggccuggcacccucccagcaccucccuguguucuucaaccaagaaucucccugaacccugucguuuagggguuuuuauggagguuucauuauguagagaugauugauuaauuaaaucuuuggccacuggugauugaacuugaucuucagcccccuacuccucccuaaagaucugggauggggcugaaauuucucacccuguaaucaaggcuugguuuuucuggugaccaguccugauccugaagcuauccagguacugaccagaguucccucaugaguacuaacuccgguaugguuggaagggguuuguuaugaaaaacauaagaugcuccucucaccccuguugcucaggaaauuccaagggugauaggaucucugugccaggaacaggggucaaauaucaaauauauauuuuuuuauuauaccauagccucaagaauucaaaguguuuauucuugaaaaaucaaaauaaagaaaaagguauaagugcuauaauguuauauaagugcuaaaauauuaauuauagcauuauuugugaaagcaaagauauuggaagcaaucuaaaugucaaauacuagagugagguuucuccaccuuggcacuacugacaugugggcagauaacucuuuguugugggguccuuccugggcauugugggauauuuaguagcaucccugaccucugucugcuagaugucgggaguacauuucuccccagguuguggcaaccaaaaaaagucuccagauguuggcagauauccccuggggccaaaaucaccccugguuaagaaucauggcacuagauaacuauucagguaaaucuuaauguguccacuugauaaaaauauuaugggaugauugcuuuuaacauggaaaugcuuauaaaaguuaaaaagcaaacauuauaauaucagcuacauaaacuaugaauuauauagcaaggaaauaaagagaacauuagaauuuuuuuugaaguuuaauuagcaucauugaugauuuuuucuccauucuguuaauauugcuauauuaugauuacuuauuuuuuaaauuauaacaaaaaucuuaauuugggguaauauucuuauccuuuugaaugugguacaggaaaacauugcuuuucugcagaauaguccugggugccacugugagagagagacucccggguuagauucuggaauucuggaaauuucagccccaucccagaccuuuggggaggaauucuagaaauuucagccccaucccagcucuuuggggaggaaucuaacccaggauuccauacauagagucaggacuguaugguuuguuuuucuguucuuucccucauauagacuacuuucucucagauuucuaucuauagaaauagauaaugaucauagcacccuuucauacugaagcauugagagaacgcauagauaagugcauacucaagacuucacugguuaaaugccaugaauuacucagaaaugcuugguaaaaagugaugagucaucaucucuucaguaaaauuaaauaacuccuauuuaaucugagagaguuguuauuggauauuuauugguugggaauaaaaugaaacccgagggcugguuguguaauguccuugaguugaaaguguugacuuagaugagcucuaggcagaggugcagagagugugcaugacuagauguauuuauacacaagaagugagcauuuccaccugguuucgaucagaaugagugauugggaugcagcaguguguugugggaauacuagagggaucaccagggcuccacucaucuauuuauucuuguucugcuuuaugcuagagcacaccugaaugcagagcgcuuggccuugccagugagcugucagagcuagguuaauucucauuggcugcaagcuaggguagagaauuaccauacaaaggagcacaugguuaaguuacugggcuagagucagcugcagaacuggaaugauuuuuuuuuuuuuuuaaggugaagaacucagaguuagggauccaggucaaaucguaggaaauaaauaguaauugauguugggaaauuuuaaucagauuguaaagcugaaauuagauacaggggucaagcccaguaagucuaacagcccagacagaaggcuuuggccagcccacuucuucccuguaggacgcaggugacuccacugucaacuggaguugcagggauaugguugaagucccuuugagauuaagggccuugggcccagagugcuuucaguuuagcaaauauuaaugcaaacaggcuauacuuucuggaguaacucuuuuuuuuuuuuuuuuuuuugccuuuuccagaguuccugaaauagaguuaaaaaaugccaaaggucuaucaaaugaaagugucaauuuguuaaaaucucgccuagaagaacuggccaagaaacacuguggggagguaagauuuguuaaacuggaauuaaaagaagacaguaaacuuccccauuacaccucaaauccaauuuugaguagcauguuuuguguuuuauugguucuacaaaagggaacauugugauuuuuauuuauuuaauaggauuaaugaaauuuguagucuauagaugguacuauugaugcugaagaauguuucugaaaauugcuaggcaugguggcucacacuuguaauuccagcacuuggggaggcugaggugggaggaucacuugagcccagaaguuugagaccagccugagcaaaauggcgagcaccuaucucuaaaaaaauuaacuggguguggugguguaugccuauagugcaagcugcucaggaggcugaggugggagaauugcgugagcccaggaguuugagguuacagugagcuaugaucacaccccuucacuccagccugggccauagagcaagacccucucucuuaaaaaaaaagaaaaaaagaagaagaauuuuucugaaaacaguugaugugaacccagccauacuuuuuguauacuuuggaucuugcaucaugacuugaaccuuuuuguuggaaaaugugggcagacaaacaauuucggaccaccucuccccuuugcauaucagaggaauuuguuguuuucuuucucaauaauuagugacacacucuacuccuucagugucugucauauaccugagcauuuacacugagugcaguacucauucuuuuuuaaucuucugaacauuaggaucuacauaugaguucucuccuggguggcacaacucucuguggaaggcaagacuaagugucuucuggaggcagaguaugacugugcuuuccuuaggccagaccaauucccucgaaguauaacgcuucuuugccccacuuuuguguaaaaucacucaguguuuuugccuggcagcuuauguuuaacgaucucuuuuuuuuuuuuuuuuugaggcggagucuugcucugucacccaggcuagagugcaauggcgcaaucucggcucacugcaagcuccgccucccggguucgcgccauucuccugccucagccucccgaguagcugggacuacaggcacccaccaccaugcccggcuaauuuuuuuuguauuuuuaguagagacgggguuucaccguguuagccaggauggucucaaucuccugaccucgugguccacccgccucggccucccaaagugcugggauuacaggcgugagccaccgcacccggccaacgaucucuuuaugugaaaacuaagaagaggugcccucggcuuccaugucuguuucagacuuuuauuagacauaaccaaagauaaccauucaucucauggaaaguaacuggacagauuuuuacuugcuuuucauaacacaaugagucauaguacaguccauggaaugccuuuuaguuguaaaaauuguguccauuuaaguugcugcuuccaagaacuucagugauugaugagauuuagaaagugaguguagaacggccuggauaaaaaacuaggccuuggaaaugauuccaaaguucuuucuaguacaaggggauuccagugucuaacugaaaaguaaugugaaguuauuuggaaaauucagcuccagagaaaccucugguuucuuggauuuuugauuugugauuuaaauuuuuuuuuuuuuucuuuuugagagacgaagucucaccaucuugcccaggcuggucccaaacuccuggcucaagcaaucuuccuuccucagccucccaaagugcuaggauuacaggcccgagccaccacacccagccugauuuaaauuuuuauuuugagauaauuauauauuuauauauaccucuuacccaguuugccccgacaguaacaguuugcuggaaagaagaucaaauuagccaccacauuccuuuacgccaaagcauaaucuggaucaaggcccuaacucucuucaauucugugaaugcugagaagagaugagggagcugcagaagaaaaguuaaaagguagcagagauugguucaugagguuuaaggaaagaagccaucuucauaacauaaaagugcaaggugaagcagcaugugcucaugaggaagcuucagcaaguuacccggaaaaaccuaagauaauugaugaagguagcuacagauuuucaguguagaugaaacagucuuauauggaagaaggugccaucuagaauuuucacagcuagagaggagaagucaguguguggcuucaaagccuuaugaaaggacagacugacucgcuuguuaggagcuaauacagcugcugacuuuucaaaaguugaggccaguguucacuuaccaugcccaaaguuccaggaccguuaagaauuaugcuaaaucuccuuugccugugcucuauaaauggaaaggcaaauccuguaugauggcacaucuguuacagcaggguuuacugaguauuuuaagaucauuguugagaccugcugcucugaaaaaaaagauucccuuuaaaauauuauugcucauugacagcgcaccuagucacccaagaauucugaaggagauguacaaggagauuaauguuguuuucaugccucuuaacacaacauccauucuguagcccauggaugaaggaguaauuuugacuuucaaguguuauuauuuaagaaauacauuuuacaagcuuauugcugccauagauagugauucauuugaucugaugugucuuagcaaaguaaauggaaaaccuucuggaaaggauucaccauuccagaugccauuaaauacaugauucauggaagggggucaaaacaucaacaugaacaggaguuuggaauaugauucugacccucauggaugacuuugagggguucaagacuucacuggaagaaguaacugcagaagugauggaaauaucaagaagucuauuacuagaauuagaaguggagcuugaagaugugacugaauugcugcaaccucaugauaaaacuuuaacagaugauuaguugccucuuauagauuaggagagaaagugguuucuugagugguuccugaagaugcugugaacauuguugaaaugacaaucgagcauuuaggauauuucauaaacuuuguuuugaagcagcagcaggguuggagaggauugaccccaacuuugaaagaaguucaagugugacucaaaggcuaucaaacagcauugaaugcuacagagaaaucuuccaugaaaggaagagucaaucgaugcagcaacuucauuguugucuucuuuuaagaaauugccgcaaccaccccagccuucaccagccaccaccuugaucagucagcagccaucaucaagacaaaacccucugucugcaaaaagauuaugacguccugaagguucagaugaucauuagcauuuuuuagcaauaaaguauuuuaaaauuaagguauauacauugauuucuacagacauaaugcuauuucacacuuaauagacuaccauauaguguaaacauaacuuuuauaugcacugggaaaccaaaaacuuugugugacucgcuuuauugugacauuugcuuuacugaaguggucuggaacugaaccugccaugucucagagggccgccugugcuagcauucaucugagucaucgucauauaaugagauuugaauggguguuaaacaugggaaggcacugugcaaaucacucuucuuguuuaucuaaaauucauuuccauuaagucuggaguacuggaaagucuaaaauagacauaauucuaaagaaauuuuuuuauuuucaaguaaaauagaguauaauuagguacuaaagcauggcauagggauucaucuugguauggcauucacugauacuugccuuuuaaaacuaggagucauuuaauuauuugaauggaaauaaguacucaaaaacagcuuguucuuaagcacuuccaauugcuuaugaaugauuuuuaaucuauacacagcucuuugucauguaaaaauaaacuuaaguauacucuauuuuuucaaauuuguaaagccaaaguuuauuuuuuuauuaauuuacucaacagauauuuauugucuguguaccaugugucaagugcuauuccagcacugggaaaaccacagugagcaaaccacaccaugggcuacacugggaagggaacagacagaaagcaaucaaauaacugcacaaccaaucaggcaguuauaagugccaugaagaaaaucagggugagcggucuagagagugugacaguggaguggcuguucuuuacaaggcauucaggagaggccuccaagacuuaagcagaggucugagggaggccagugagcccuguagcaccaggggaguaggaggcaagagucaguuuggaaaguaguucuuuucauccagucuuagaagguuuaucagguugauuuguacagaaaacucuaguaaaguaaauagaacagcaaaagaaaaacccuccacagcuuggcuccugccuccuuuuugguuuagaagugguuucucuuugacaugauagaaauugccuacuuuccccagcuuucauuagaagagcuuuucuuagaauaaccugccucuuagacuguagacuaguguuucugacuguaaagugaaauauauccaguaaaugccacagcuucugguguaagaaaaaaugcauuaacaucacccagcaagagcugugcuuucuuugcauuugcucccugagagaaaggcaggauaccaaaugaacuaacuuuauauuuuuggguacaaugacuucuauuauuauuuaccacccuguuaagucccuuuagaaacgguuucaaacauauaaugaaaauaagaauuuuaaaauugcuucacuguaacugagaaaaaaaaucucaauguuauguuccucauccaccaaaggaucagcacucuuuaccucuuugggguuggguaaccagucagggagggucucagaaaucuuuguucuauugauuuaucaaccuaaguaugauuuaugucuccugcggguaagggaaaggggcuuccuguguucacauaaagaaugugugaaagggagaccuuuuucuuccacauucuaucugugacugcuucucuaaguggaaauaaaauacuuucuaaguauuuaucagcuuuuuauugaccaguuacuaacaaggagauaauaaggccuuuaaauauuugccucuguacucccaacaauauuuucaguaugcuggguagacagaaaaagcucugaucuuagcaaugaguauucucugcccaacucucauuauguggacagguuuucuaguugggaagauagcuuuuacuuucaugcagucuuaaauguuuugucagauuuauuucuaaagaaauauauuuuauuggauuuacuauagagaaaaugccaauaaguugaauaggucuauaaaagaaaagugaagcuuuuuauuuaccuagguaaugaucugucuugauaauaacacaaugcaaugggcccuuuaaaagcuuuuuccugcugugauuauaucauauaccgaauucagaguaugucauaucaaaaugaauaauggcauucuaagugggccucugaccgccaguuugcuuuccuguucuguagccucuccuguuugggccuucccauuauuugaucauuugugguugauuuuuguuuacauguuuaggugaugaucuuugaacuggcuuaccacgugcagucauuucucagcgagcauaacaagcccccucccaagucuuuucaugaagaaaugcuggaaaggcgggcucaggaggagcagcagaggcuguuggaggccaagcggaaagaagagcaggaggugagaugcccuugucgaugucugugugcauggccagccuggaggauugcaaacuacuguagguuuuaucugucucugccuacaaacuuaucuuuaaguuuugcucagccuuugauucaagaaagguagacacaugugagaguaugaaaaauaugagugauucccuccugacacauaucaguacugucccuuagagcccucaguccaggucuuaaagaaauagaagagaaaagaagcuguuuaaccaaaccaccuguggucuuuuggagcuuguuaggguguacaggaguucacugcauuuuagaagcuauuuucuucuucccugugcaagacuaguaucucaugcccaaaugaguagcaaaagccagagaauaauuuuuuuauucaaacauuuagauguauauauuaucuuugauuuaaaggauuuuaaaaauaagacaguuaauaucuacgcaaacagauuaaagaaaaaauacaaagauuaaauaccauuuguauuuaaaucaaagauaauauaugcaucuaaaugguuaccauuuguauuuuauaaacuccuguuuauauccuaugcugagauucuaaagauuuguuuaaauucaaguuuguuuaaauacaaauaguuaccauuuguauuuuucuuuaaucuguuugcauaaagauauaaacucuugucuuauuuuuaaaaucuuuuaaaucaaagauaauauaugcaacuaaauucccuuuuuuauuuuaauuuauuuuucuaaaguuuuaaauuuuuuauuuguuuuuucuauuuagcacuuuaaucaacuuaucuagaacuuacuuugauucagguuauaaaaaaagccuaaguauauuuuucuuagacauuuuccuaacacauuuauuaaauaauaauucuugaagugauucauaauacuuucuuuaaacuauauguuuaaaaauaguuuaauguauuuuaauauuaacagcaaacgugcaagaagugcacagaagacagauaacauuaaaaacauguacuugcauguaggacaacucaguuagaaaaguauacugaggccaguuguggugucuugugccugcaaucccaggacuuugggaugaggcagguggaucacuugaggccaggaguucgagaccagccuggccaacauggcgaaacucugucuacuaaaaauacaaaaauuagccgggugugguggcaggcaccuguaaucccagccacucaggagucugaggcacgagaauugcucgaacccgggaggaggagguugcagugagccaagaucgugccauugcacuccagccugggcgacaacuagacucugucuucaaaaaaaaaaaaaaaaagaaaagaaaagaaaaauauagugaauggguguaaucuacuguaugauaagaaugcuacaaaccguuuaguugccaucaauaaaaaauguacuuauuuugauccuucuauauaguucauaagcuugaugaucgguguucacacacaugugagauacgccaccugugaaccuuguuaggacaucagcacauuacccaucugacaugaaagcagaagaaagaaagagaagaauuuacuuguuuuuaaaaaaauccaaauacuggcauuauccagaaaaauguaacagguuuaucuauaauuauuagaaaguuaaacugccgaaacuuguucacugaaacauuuugauuugcauuaaugcuuuacaucccccccauuuauauuaaaaauucacacaugaaugaaaauagaaaaacggccaauacgugauuucuguccccucuuuuuccacucacagucauauauguagguaccuuuugaccccauaggaaaaaaauauuuaacauucagaaguaucaggaauaauaagagaauuuuuugcggggggagugaaauuucccaucauaguggauucuuuuuguuucuuuguuuguuuguuuguuuuugagacagacuuucgcuguuguugccccaggcuggagugcaaugaugugaccucagcucacugcaaccucugccucccggguucaauugauucuccugucucagccucccaaguagcugggauuacaggcuugagccaccacgcccgacccacaguggauucuuaagcacgcucuccauguaugugucaugcuagcuggauaucuuucagcacaauuguuacauguuuggcauggauagauagcauacagguugguguuuucaaaaaggccaaccagauaggccucacuugccuucugcaaagcaccaauagcugcacucuggaagcacagaucuguuuuaaaauccugagcaauuucucucaccagaugcuggaggggaguuugcaaaucaguucaguggacuugugguaacgucuaauuucacagaaugccacaguaccaggccugaaaugaucgguuucuucacuccuccaguagaaggugcagucuugcaagcggcuuucuguagccaguggcuucaacccaggaggcagagguugcagugagccaagagcuuuaccaccuguggauuugugggcagucuccuuuguauuauacaagccaugguauagagaccuccuuacuuacccccuucuccuucugcuggaguuauagguggugcagcggcggcugcaaacgcaauucucaagugcaucuuaacugcuuaccuauacuacguucuauuugucaaugaucuguucaacucaucuguuuuuucuugaaucucuaccacacucuuugaauuauuguaucuuuauaaugcuuuaauaucugacaagucaauccuaccccuccccaucccuucaucuuccauuguuuuuguuucucagccauucucacccauuuauucuuacagaagauguacagaauuacuuucccauagucaaaacaaaacaaacauccugggauuuuuauugauuuuaaaaaaucuuacauauuuauuuaggaagaauugauaucuucacaguauuuagacuucccauucaggauuguuucuuuuuccauccagggcuguuuguuuuuguuuucuguuuuuuggauuuuuuuucuuuuuuuuuuuuuugagacagcaucgugcucugucgcccaggcuggagugcaguggcgcaaucuuagcucaccgcagcucaagggauccucccgccuaagcugccugaguagcugggacuauagccguacaccacugcaccugccuaauuuuaaaauuuuuuuguagagacaagaucucccuauguugccaggcuggucuucaacuccugggcucaaccaauccucuggccucaaccucucaaaguguuaggauuacaggcaugagccaccgugcccagcaccauuuguauaucuauuuuuauuuuuuguugaggcuuucuaauuuucuuccuacagauauuacuauuucuuaaaguuacuuuuaguguuuuguucuuagguucuuaugcuugucucuuuuuucauuuuauuuuguuucugcuucauuuuguuuauccugugcuuacauuaacacugucuuuuuguaggugccauugauuuuguuacuuauuuucuauuuaaguguguagccuaguuauuguugggaguuuguaguucuuuuuuauuauuuuuauuuuauuuuaauuucuugagacagagucuugcucuguugcccagacuggaguacagugguaugauacuggcuuacuacaaccuccauuucucagguucaagcaauucuccugccucagccucccgaguagcugggauuacaggcacccaccaccaugccuggcuaauuuuuggacuuuuaguagagacgggcuuuugccacauuggccaggcuggucucaaacuccugaccuugugauccauccaccuuggccucccaaagugcugggauuacaggcaugagcuaccgcacccugccgggagucuguaguuuauuauuguccuuguuguuaggaaggcuaauuuuuauuagaagauagugacuauuuagcuaacaauuuuguuuugacauacugcuauagcuaccuauaaguuugggguguguuuuuacacauuguauuauugcuguuaugguuuuuggugaaucucuuaauaguuuugauaauuauaaucuggaauuuuagaggaauaaugcaaaauagagaucaaaauaccacuuuuaacauugagaaagcugauuagaaaauacaggugauugaagaauggcagguagguaugguacuugggccauggcuaccucaggugcaggcacugaggcuugcucagcccaccuucaccaagcugaccgggacccccauggcagagagcaggcacaagugcuuguucucugcagauaggcagauaucaaacaggaggagcuaagacaagugucggaagaagugagaagccaacaguguugcuguaguggaaaucuccugcacauagaaacaugaagaauggggaguaaaugccccuccccacacacgcucaaaccuguuuaaaugggaaugccuauugcguaagaacucugauaaaacugauagaacugcaguuuguacuaagaugcuguguuuucagaucucuuaggaagagaggguuugaauuauugaaaguuaaaagauuuuucuguaguuccauaauuuauauguuguauggguuucagagauuggcauuugaugaugguuugauuuauuucagcaacgugaaauccugcaugagauucagagaaggaaagaagagauaaaagaagagaaaaaaaggaaagaaauggcuaagcagguacccuaucaacuccaccauaauaauuuacauuuugcaaaacaaaguguuuuuauuuccacugaugacaucuguguuacuaucaguaauacagcuuaaaauaaagcacuaaaaauaaauaaauauucacuguguauuucagacucccuaaauagguggcaaaauuuagaguuuuauguugucaguagaugauuuagacuuacauaauuacuguaauuuaucaaaugagggagggaagagauugcgucuuuaauaauuaaccuggacuaaaauuguucuuuuuuuugagacagagucucauucugucgcccaggcuggagugcagugguaugaucucagcccacuguaaccuccaccucccagguucaagcaauucucaugccucagccucccgaguaucugggauuacaggcguaugccacuacgccuggcuaauuuuuguauuuuuuaguagagaugggguuuugccauguuggccaggcugguccucaacuucuggccucaagugauccacccaccuuggccucccaaaguguugggauuacaggcgugagccacugcaccuggccuagaauucuuaauacuuggaaaauaaaaugauuuguugauacugaagagggaauagaaaccauauggaucugccugaaauuucauccagugaugaaaaagaguaauucaacagagcagauuuaaaaggcaguggugaaaaaggauagagugcuuuuuccuuuauuuuuccugagucuagcucaagcaaaaaaccagucagacguguuuggagaaauucagagaaaauuuuacucauucucuuuuacauaaauuagagcauuaaacuuaagggacaugaugugguagcaggaagaggcacugaagcacaagcaagcuucuccugguuuaaagcuucagcuuuccugcugccucacuuugugaccuuggcaaggugacauucucugugacucucuuuacuugucccuuaaaaugggacugauaaugccuuucuuucugucuuguauaauuaccuccacagauaaguguacugcccuaugugaaacuaaaccugcguaaaaauguaagaugagaucccuguuuccaccagugcuccugucuugcuccugaccugccuuccugucagccacucucugcccucucuuugauucucccuucuucuguucaucuccuguuacucuucucccuaacuuuuuacacuauugcaagauucuaagcauuuucauuuauaaaauuuacauuuucuugaaaccauaaccuggacuucaguucuugagccaguacauauuuaggcauuaacauuuuuuuaauuuuauuuuuuaauugaccaauaauaguuguauauauucauggaguauauagugaaguuuugauacauauaauguauagugaucggaucaggguaauuagcacauccgucacugcaaauauuuagcauuucuuuguguuggaaacauucaauauccuccuucuagcuauuuuaaacgauuaaaaguuaaguucaauuuuauuucacuuguaaacauucagcuuaaaauuugcauucuauacugaauuaauaauuauguaccaugauuuucuuccauguaugacuuacaucuaaaguaaguuuuacuuuucuuguucuaggaacguuuggaaauugcuaguuugucaaaccaagaucauaccucuaagaaggacccaggaggacacagaacggcugccauucuacauggaggcucuccugacuuuguaggaaaugguaaacaucgggcaaacuccucaggaaggucuagguaagucccugggauuucugaucugggagaaugacagauguagaaggauuuuacuacauugaagauguagugaaauuugauggaaauuucaggcgauagucuuaauaacuuuuuucaaaccuuauauaucuuaauauauuagcaauauauuagguguauuuuuagcaauaugaaacuaaauugcguuuaacacuuuccaaguaucuaucaugaaucuaguuuuguugcucauucccuuuuuuuuuuuuuuuuuuugagacggugucucgcucugucacccaggcugcagugcaauggcacgggcucagcucacugcaaccucugccuucuggguucaagcgauucuccugccucagccucccaaguagcugggacuacaggcaugugccaccacaccuggcuaauuuuuguauguuuaguagaguugggguuucacuguguuggccaggcuggucucgaacuccugaccucgugauccacccgccucggccucccaaaaugcugggauuacaggcaugagccaccacacccagccucauuccccuuuauaacagccuauaacacaucacaaacuugccuuaguacgauuuaacauuuauaaacuuaaauucaguaagugauuuuaaaauuuuucuuccauuugaaucaucaucauccaguguuucagucuacaaugccuuaggucccaccacaguuguaaggagugccugaaaaugagcacaggugagacaucuguuacaugagaguaggaaccccaguuggcugccagggguccccucccuaauacugaggugggcuccugggcuguucccugucaccacuggucacuuaaaagauacuacuuguucuucuauaucuuuuucacugaagaauuccaacuuugcucucuauuugcuguggcccccuguacaccagaaaggaauuuuggugaagaaaccauuuaugagugggguggguuauuaaauaguguagggacuucaaccuucauuguauguuuaaauuaucucuugugagacucuaagcacaacuuaaaaccaccacuuugcuuccaugaaaagaaacauuuuaggcaccaaacugaagauuuauauaaacuucuguauaguuuguuuauuagaaggagccauuuuaguucuuucccuaauuaucuacuacuaaaaaaacaguucagaaaucauuuugacacuaauguuuaccuacuauuagguuuaacuaaauuuuuaaaaaaauacuguuucugguaaccauuccuuuuuaagauuauaacuccuucccaauuuaaauuauuuuugaaucugggcuucuaauaagcaacagaguuugaaguugucagagaauuucacuaggaaauaucuaacaaauuuuuguuguauuagaaccuuugaauuaaaucaaugauauaaauaagucuuuucagauauauggaagaugauuguuuuaaguuuaaacauuucuauuuuuguggcuaacuauaaacagugaauccaagguuaggcuuguuuuugagaucagagauagcacgcugggcacgguggcucaugugugugaccccaacacuuugggaugccaaggcugaaggaucacuugagcccaggaguucaagaccagccugggcaacaaacuccuucccaucucagagccucugccgaccccucugccuggacuacucaaccucuggcauuuugcuugcugagccccuccuucucauucaguucuccccucaaaugcaaccuucucagggaugccuuccugagccccccucuacccuauuucccugcuuugucccuugcucuccaauucucugcuuuauuuuuuacauaacacuuagcacuagcugaaauuguuauucacuuguuuacuuuggaaugugaggucugugagagcaaagcccucaucuguguuuuccucaaagccugaaaucgugccuggaagacacaugguaggugccuggucaacaucugaugcagggagggagccagggagggaagaugacacagggaaagugggacacuguguuucugguguuuguagggucuacagccucuuuaaccagggcaguuuugcuucucuugaucugugggguauguaaaaaaccagugagguuuuauuuaacaaaagauguucacgcugaaaagaagagaaagagagaaaagagaaccacucacuauucuaguggaaagaacguaaaggccugauacucaaaggcuuuucacugaugagucuuggcuuuuguugaagaacuuuauuuucugugcuucaagucuucuuuucccaccuugaaggauucacuuuuuagaauauuaagguaaaaaucaaaaaacauaaaauuagcuauuuuaauguguacaguucagcgugaggcuguauuugugaagugcagacauaguccccccaacccacugccuuguuucugggauguugcuccucauaagugggcaauaugaauuuuguagaagaagcaaaacuaaaaaaccaaaaaaccucuauaaaauagcucaugguagaaaauuaccuucacauauucagacuugcugucuuugcagauuaccguaguguagcccagaaucuagaauauaucaccuauuuauaucuaccaucaacaagauuagguuaucuaguuuguuuucccuauucuaaagccagguaugguaacugcuggcuccucacccuuacagagaagagaucauuaaggguauaagacaugggauucucucugcucuccucaaaaaacuuggggaaccauuaaaguauaaagguguaggggagagaggauccuugauacgucucuccagacaugguccucuguuguucaguuucugugguugguuccauggaggcauagacugguuuaccucaaauuaaacaauaucaggaauucuuacuaauguugucucuacaaaguggcucuguguuucaaauuaagggaccuagaacuagcauuuucuguggcaucuuggugaguuagacaggaaggugagacuaucccugccccugugucucagauaagauccucuuucucccuccugccccaacaucuacacauugaucauaaugguagagcaaucuuuuggaugguagcccaauucucuaguccccacuugaaaaauugucaucucucuucuugccacuuggcuuuuuaaaaaaaaaaagauuauccuuuuuucuuuuuucagguaucaagcuccuagcugccuaauuuagucaucuaaaauuguauuauguuucucuguucuuuuuaaagaccuagauuaauacuauuugguaauuuuauuugaaacacccuucauauagguugggaacugccacagauacuuggcaaaacugauaacaugggugauauuuuuaauauuaugauaauauugcaaaccucaugaacauccauacucuagaauagaucaugaugaugagaccagagucauagcuucugaacaccauuuguuugcacuguuucugcuggaguacagaagucguuuuacuuaugaauggauucaaauccaaaagguuguuccaagcccaguucuugaugggucccagguagacaguauaagcauccaauauauaugaaucuuuuuggcgaaaacaauagauauggaugacauugcauuugucucuuuauuccuucuuuucaaacucugugauuuacuuuuuauccuucagaauuguuucugcuacaaccugugccaugcagcauguaccacauuugucguuuucuuacuuucacuuuuaucucuacuuuucuuucaauccuaguuauuccuuaaucuuacagccaucaacacucauuguguuuguacuuaucagucauaauagggugauucacauucuaaaacuccuuaaaaccaagcauuuacacauuguaaacuuaagaacagaaagauggccuagacuaaaaugaccauuagcaccaucugcugaggaggccagagcugauguagagaugcuucugcauaguuuauguuacuaagucuagcauguaauuuuaaaucuuugcuuuuauccuuuucuccauaaaucucagugugucccuaguugcacacauaacuuuagaaguagaaauuugaacagaacuacaauguauuugcuguuuucugauguuuagaauauguggacaugggccaggugugguggcucaugccuguaaucccagcacuuugggaggccaaggcgggcagaucacgaggucaggagaucgagaccagccuggcuaacacggugaaacccugucucuacuaaaaauacaaaaaaauuagcuaggcaugguggcgggggccuauagucccagcuacucaggaggcugaggcaggagaauggugugaacccgggaggcggagcuugcagugagccaagaucgcgccacugcacuccagccugggcgacagagcgagacuccaucucaaaaaaaaaaaaaaaaaaaagaauauguggacauaugugugguguaagauaugaguaucauaauacauaaucuugucaccaguguaggagggguuugaggaaagagaggauguguaggauuggaagcagaaagaccagauaauaacagaguauugcauauguccaggagaaaguuggagaugaacuaaacagggcaggggagauagagaggagaaggugguacuugaagaccaauuagaugcagauguaggagcccaaggagacucacagguuucucaccugugagacagaauggaugacuaugccccuaaccaaaauuaaagagucaaggggaaaaaucagguuuagagcgaguggagggaguggcaguuuuauugacguugcaauggugugagggauaaauagugcagaaguggagacaggaagugcaguaaugugacuaugaggaacaggauggggcggguggugcaggguugagggaggggaauguauggaucagagagauuuauaggcuggugggagggaacccagagagaggggcugacugaacaucugggagaaagggacuaacuaauagacuaagaucccagaggagaccuuuguaggggaugggacugaggacagggguagccauccuuccucaaagucacccacaaagaaagaauagugccaaugccaaguaacuuuauaggaggaacaauagaaauuguggacuguauuccucuugccucguguucucagugaaaguaaaagucaaaaucaugcugagaaugagagggugaucucucuagagaucuguccaugcacgucaucgaaguguuucugauaaguguucaauccugaccaucaagagcucucucccuugccucuucccugcaacccucuccccuaauuuauuguuuuugcauuaugaucuaguuucuuagcucuugcucccaccagaaaaaaaguagaaaaaaagaaagagaggagaggcuggguuuuaaguguuuuggagaagucauggaagggaaugaugggaauaucuaccaaagacaagcaagagaaggaaugugcacucaauggcuggaggcccaguuggaaaccaggaauuuguggcagcuccaacccccucuguuuugcagcuuucuccagaugugcaugugcgugggaaugaagcaauaugggauaccuguggaauugaucuaaaucacugcugaccaguagaacuuuuuaugauaauggaaaugaucuguaucugugcuguccaauauaguagccacuagccauguauggcuauugaguacuuaaauguggcuacugcacaugagcugaauuuucaguuuuauuuuaauagccacagcauugggcagcacagaccucgaguuagggguuugugguuuucauguggagaagaugacaaugggaagugggggaagugaauggcuuucccauuagcaccgccuacucaauucccaguagaaacagauguuagacugcgagugggcuaauaaacaguaauaaacgggagaaaauggaggggcauucuugccuauguuaaucuauaacauuccuauguuaaucuuaaagaaaaaaaugaaaaaugauuguucaaauguauuguucaaauuuauuuuuaaggcgagaacgucaguauucuguauguaauagugaagauucuccuggcucuugugaaauucuguauuucaauauggggaguccugaucagcucauggugcacaaagggaaauguauuggugaguaaacuagcaaaaucuauucauauuauuguaauggcaaaaguuaaucacaaaggaaugggauggauuagacacugugucauucagaccagugcaguccaaggaagaccaucaagcugguagucauucuggcucccauccuuaaugacuggaaugagaaaucacucagguuuccucuaauguaagauggaaauaaaaaccuguguuuuugucugggcaccguggcuaugccuauaaucccaauacuuuggggggccgagguggaaggauugcuugaguccaggaguucaaagcugcagugagcugugaucaugccacugcacuccagugugagugacagaaugagacccugucucaauaaaauaaaauaaaauuuaaaaaccugugcucuuggaauauuauuaacauaacgaucauuuuaaaucugucaucauuauaauuauccaagcuuauugaaacaaaaaaaugauuaaaauauuaucagucaguagaauuuuacaucauauacagcuaaugcugaucaaauguauguaacaaagugaauucuaaugccuaugaucuuuuuuguuguugagacaggguguugcuccaucacuaggcuggagugguacaguggcacaaucauagcucacuguaaccucaaacuccugggcucacucaauauucuccccucagccuccugaauagcuaggacuacaguaaugucuguggucuuuauugaccagaucucauuuucuuaaguggauauccauccauuuggcauuuuccugcuugacauauuauaccugaccaagaagaccaccuuauuuucuauaugccuuauuuagaaguuuugucuacucguggcuguuuggcgugaagcugguucagcaaaucagaauuugaauugcucauacuaaagucaaguuuuugguauuucuuccuuuacccuaaauguaugucaucuuuacccagccuuacagauaaaaccaguaauugguauagaaaccauuuguacauagugaauuuggcaauuaacuuucauuuucaaucccaugcauauuuuugccagaaguaacagguagccaaauuaugugaaaugaguuugcuuucuuuugggaucuuuuccccuuccucuuuaaggagauacaaauaagcaaaagaguugccaggaagcagccagcagguggagggagaagaaaccaaacuucucaauaaucuaugagcuaaauacuuaaccuuggcagacacacagcagccuggacaguaaaggauccugcacauagacagagcugccauauuuagacaaaggaaucauugggcagguucaagacauugguaguggugguuggcuuuagaccugagacuguccuugacucagacauuucagauucaugaagugacaacauaaaacuacuucuaauaaccuggggaaaucaagaaggcaaauuaauucaauucuuauuaccuuaacuuagucucuuauucucacugguacucauuagacagauucaccauaguuaauacccuuauuaggaggcacauuuucaguuggagaauuuuuaauaaaauuaccaaguaaauuauucauuuuguuuucucacagugggucugauuuuuuaaaauaugcccuaauugucuaugaaauguuuuuauaaaagauuaacuacuaauuuuuuuauuuucaaugaaguauuuuuauaaaaaacaauauuuguuuuucauuuuaaaguuguuagaacuagacagaggagagaacuuacuuauagauaugacuauagcacuauagagacugucugcauaaaugaucauugugggcauauaggguuucaguuagaguucuuuugauaauguauuuucucuuagccucgucucaguauauucuuuugucccuuuuauuauucccaucaugaaaaacugacaagaagagucuggcaauacuaaaauuauaauuuuuuaaaccccagcaacuaugaaaugccugccuagucccaauuagggaaacaaauauugcaaaacacuguacugcauaacacacaaauuuaauuaggcuuuauguaaauaacgucuuacuccaucccauaaacauuuaaugccauguguuucuaguagacugcuuagaucccacauuucucagguugcuucguuugguugacaaauuuuuaaacagcaggauuuuuuccccuuaggcaaagacugucaggaguuauuuaugacuaacagaucauuuuaauuaaaaucucuaaauuaucagcauucccaugaaauaaaaacugcuugucagauaaaaagucaaagugagcuaguucagccauauuuuuccaaaguauuuuugcugagacaucuuuaucauguauaugcagguuacuucaccuuugauuauucaaauagaaaagauaauuagcaaugucucuuuaaaaauuuguuuucauuaugaagauaguauagcaucauggaaaacuauuauuuauauaagagaaaaaggcagauuacuauauaucgggguuaucagcugggggccauuuuguagccugcaggacauuugaugaugucugcacacauuuuugauggcuaacauuggggucggggugcuauuggcaucuaguggguagauaccaggauugcugcuaaaauccuacagugcacaaaacagcugccuacaacaaagauuaccugguccaaaaugucauagugucaagguguuauauauaugcuaugauaugguaaauuaugggguaaaggagaauagagggaacuaaaagaaaaauaaaacaaguggugauuuuuuucuccuuuuccaauuuuuuagaauuuucuauuaugguuuuaaugaaaauagagauuuuuauaagaaaauuuuugguguuacagaaauuuagcucucccuguguaagugagaaccauaugacuaucacuaaauaaaugugucucauuuucuagcuucaaaucuaaacugucaucucuuguucuuuccuuccaaagcauugaccaguuuguauuuacugagcauauucaaauuuugcacuuagaaagucauugauguauucagauuuucaaauuacuguuuuacugugcacacuaaucuauaaugaucucgauggcuuguucucuauuuucauauucuuucugucauuuuaguugguauuuagcuguaugaguguacaccaguagacacagucagcaaagguagacucguuaugaaaauaacauugugcauaauggcuaguagcauaaaacacuggccucuuuuguuuuuugagacagagucuugcucuugucgcccaggcuggagugcaauggugcguuguaggcucacugcaaccuccgccucccagguucaagcgauucuccugccucagccucccaaguagcugagacuccaagugcccgccaccaaaccuggcuaauuuuuuuguauuuuuaguagcgacgggguuucaccauguuguccaggcuggucucgaacuccugaccucaggugauccaucugccuuggccuuccaaaaugcugggauuacaggcgugagccaccacgccuggccaaacauuggucucuuuauuugccugauacuaagaucucauuguagauucuugccccuuauaaaaaauuauuuuaggacucagguauauugcuaaauaucaaaaauuguuuacaaaaggacauuauuacauaaaguccuauuuuccauaguuagcgcaugguauccauuguugaacuaaagaauguguauuacccccucccuuccuucccccaagagaaaacauaccagugggauuuaauuacacuuucuguuuaaugugcaggcagugaugaacaacuuggaaaauuagucuacaaugcuuuggaaacagccacugguggcuuugucuuguuguaugaguggguccuucaguggcagaaaaaaauggguccauuccuuaccagucaagaaaaagagaagauugauaagugcaaaaagcagguaagcauccaagguggcugacugagcaaaaggccuaaucucaggcuuuaggagaugacagaacaaaauagcccugcauuuguuugcccugcagagaugguccagagcaguaugagaacuguuugaccagggaggacagugaaggaccaguaccucuuugccccuugccucugguuucagaacuuucacaacaugaucaaagcacuuccagcugccuucuuaaccuccuuucuuagcccuuaguauggcauuaacagucaucuuuccaacugggacuaaauacuaguucauaauuggguuuuuuugcaauucuucuuuucccuacucuugaaauauugcuucagggcuggguguagugacucauaccuguaaucccagcacuuugggaggccaagguaggaggacuacuugagcccaggagguugagaccagucugggcaacauggugaaacccugucucuacaaaaaauuuaaaaaucugugggcaugguggcacauacuuguggucccagcugcuugggaggcugaggugggauaauugcuugagcccgggaggcugaggugggauaauugcuugagcccaggagguugaggcugcagugagcuguguucaugccacugaacugcaaccugggugauagagcaagacccugucuccaaaaaaaaaaaaagaaaagaaaaauacugcuucaaaacugaauuuugggggaccggaggauuuuuaaguuaauuuauaaauuaugauuuauaaccaagcauaaggagaacauucaguauugcauauugcaguguuacauaauaacaagguuuacaaaaacguagauaaagcaugguguucagaaauguguguguauuuaaguauagaaagaaaacugaaaguaaaugugccaaaaucuugaguuaucacuggguggugaccacauagauaacauguggguauuuucuaucaaacuaauuuuuuaaauguugacaaugaucuuuauuaaaucagaaaagauuuuuuuuuucugucuucaaccuuaacuccucuuugccaugugagguucugaggauuaggauguggccauuauucugcugcucaaaucauauacuauauuuuuaaaaacccaaauacaaagcuaaucagaaaagguuauuuuuaaauuaaaguuuguuuuuucuaguggcuauaccucaaaagaauuuuauuuuaaaaacuguucacuaauuuuguaguauaugcauaguagguuuugagauuagagaaguugagaauuagcuaaauuuuuuccaucuuuaugaacuauuagauugaccauaugguuuggggaggauucaguuuagggcauauuuguucuccucucauuugaaaguauauuuucuaucaaauacuucacuuuugguuuugguuuuguuuuuuuaugcccccaucuuguaugaucaaauacuucacuuuugaaaugaaacccaaguuaauguugacuggcccaauauucuuuuuuuuuuuuuuuaacuuaucagauucaaggaacagaaacagaauucaacucacugguaaaauugagccauccaaauguaguacgcuaccuugcaaugaaucucaaagagcaagacgacuccaucgugguggacauuuuaguggagcacauuaguggggucucucuugcugcacaccugagccacucaggccccaucccugugcaucagcuucgcagguacacagcucagcuccugucaggccuugauuaucugcacagcaauucuguggugcauaagguccugagugcaucuaaugucuugguggaugcagaaggcaccgucaagauuacggacuauagcauuucuaagcgccucgcagacauuugcaaggaggauguguuugagcaaacccgaguucguuuuagugacaaugcucugccuuauaaaacggggaagaaaggagauguuuggcgucuuggccuucugcugcugucccucagccaaggacaggaauguggagaguacccugugaccaucccuagugacuuaccagcugacuuucaagauuuucuaaagaagugaguaucacugagauucucucuaauagcacuuuacuccuguacuuuugauugugcuggagugugccagacaucuaagugauguggaagcugagaagugaggaacaggacuucauucuuugcucucccaauccuguccuagucucauauguucuguuuucucauguagguuggugauucucuuaacuaccacauucucugaaauucacuuggaauucacacuugauuuucaaacuccuuuugggggacugaugggauacucuuggaagucaauagagaugguuauggugagaaaugcccuagguauuccaaauacugaccuuugcucugguuccuaaagggucaaagacgaggcuccuuauucaaaaacagcuuugggagugagauucugccccuugugcuucuuaaccauucuucauuggcugucucauucauuuaaguuguagaaugcaaauaacuuccuuagucuagccagaggaguuucaauaccuguaaaucacaggugcauguuuaauuacaaagccaaguuuuauccaauuugggagaacccuucuugagauguuuccucaggccuaagauguuuguccagguccuucacuuaaguguuuucuaauuucguccugccucuguuuucaguccaagccagagcuaaguucugucaguuucuguuaaaugggagauaagaucccuucagucuggauuuuuccagaugcuccucugguccagcuauccugcaggaguugaccugggcugguuucuucccuuucugacacucuuuguuuuuuaccuucuuuuucccaaucauuugcuuuuauucacuucuuccauuugcaacauuucuuuuacccuucacauuucuuucccuauuccaccuaucgcaguagccaguuggccugguuuacauuguuaugcucugucacugauggucuuaccauuacagaugugaaaguagcugcaccuguguuugagauuguuuuuguguaaagugaauaugauauauauauauauauauacacacacauacauacaguuguggaaaggggccaaguuugauucuuuauguugguuucucgccuugaaguauaugaaaauauuaagauuucuaaagaaaucuuuuaugguaucuuuuuaaugcaauggagcuuuaaacauauuuauuuaaaugcacccuaacaaugagguuggccaaaaugacaaauaugaugauagaaucacagauggaaaguuucauuuccaucuucaaaaugucaccuuuaguguucugccuucuucauugaugaagaguaauuuagucaagguuagcaauagcaucauguguuguuaaaaacaguacugggagguuuaaguagaaguaccuuuccuuucccguuuaguagcaaaaugaaugggcucgguagguaaaacuuuccuaguucucuucuuaaauagcuguaugcucugucaguuuuaaacuugagaucagcacaauuucuuauucuuuuuuuuuuuuuuuuuuuuuugagauggagucuggcugugucgcccaggcuggagugcagugguacgaucucagcuuccugcaagcuccgccucccagguucacgccauucuccugccucagccuccugaguagcugggucuacaggcgcccgcuacuacacccggcuaauguuuuguauuuuuaguagagacaggguuucaccauguuagccaggauggucucaaucuccugaccucgugauccgcccaccucggccucccaaagugcugggauuacaggcgugagccauagcgcauggccuucuuauucuuuuaacaagauuuuucuuuagacuauuuuguauacuucucucccuggagugguuugauagacugugcuugguuaaggagcugccaagaacuguuuuuaugaacuuugcuguccagcccugguuaacaaaagaaaaaugccauucacaaagaaugaaaacagcaaccuuccauuuguaguuauauuuuuacauauuagugaacacccuuuggagcaagauuuuguuucaaaucagccucugugauggguaagacucuggagucaaaacaucuggguucaggucucaccucuauguccuacuggcugagugaauuaacccccugcccugcguuuccuccucugugaaacugggauaauagcacugccuaccucaugaggugguugugaggauuaaauuaguuaacagccauaaagugccuggcacuuggcccagacugagucagugcugguuuucaucaccauccucaguagugagaacuaugaagaaauguggguguugccaggcauuuuaucccuuuuuguucaaagcugaaccuuuucuauauacggcuacccuguugccaaaauuauugauucagagaaguucauuuuuaaagugagaucuugguggcuauaaaucucuuaaaaauacugugcauucuagguaggcuguaacauuuuucugauccagauuuacuuucaagucaauaacauuuaugucacaguugaguuacaguugauaacgcaauucagaaacccaacagggcauauauagggaugcucauugcagcauuuugugaaaaugugaaaaauuggaaauaaucucaacaguaggagaauguguaaauaaauucugguagguccacgccuauacagaaguuuaaaaaaaaucuuuaaguacuggcuuagaaagagcuccaagacacaugguggaaugaaaaaagcaagcugaagaauaauguauauaagaugauauugcuuaaaaaaaucaaaaaacaauacuauuuuguuuggaugguuguauguuuauguguauaaaugcauagaaaaaucucuacaaugagacacccuaaguggaagaaagaauuggaaggggagguuggucaaaggcuuuaucauuaucaguaauguuuuaauauuugcaaggagaagguauauauguuuuaaugauauaauuaaaaaguaauuuuaaauuuaaaggaaaauacgguaucuuauacaaaugguuuuauuagaauuuuuuugccuguucaagcuaugaaauuaggaguaccuugcuuuuuacugcugcaacauaaaaaaaaguuaccauuuaugauaguugcugucaccacuuuguauguauagauuuuuaaguccagaacucacaacgacaguugauucuuuuaaguauauuguuuuaauuauaggucaagugcuaccaagucguacuacuugggccguuguaaugaaaguagcuuggcauggugguucaugccuguaaucccagcauugcaggaggccuaggugagaguaucucuugaguccaggaguucaagaccugccugggcaacauaguaagaccucaucucuacuuuuuuaaguauuccagcacagcagggcgugauaccucacaccuguaaucccagcacuuugggaggcugaggcaggcagaucacuugaggucaggaguucaagaccagccuggccaacauggcaaaaccccauaucuacuaaaaagacaaaaauuagccaugcauggugacacucaccuguaaucccagcuacuugagagccugaagcaggagaaucgcuugaaccugggagguagagguugcagguugcagugagccaagauagugccacugcacuccagccugggcaagagagcaagacuucgucucauaauaaaauaaaauaaaaugaaaauaaauaaacaaaacauuccagcauggugguacacgccuguagucccaguuacucaggaggcugaggcaagaggaugcuuugagucuaggaguucgaggcugccaugagugaugaucgcaacacugcuuuccagcuugggugacagagcaaaaccuuaucucaaaaaaaaaaauuaaaauuaaaaaaaaaggccagcuuaaaucaguuacaguuuaacuacuuagacuuuaacuuagacuuuagcuugcauugaaaucauuuggagcucuuguuaaagcacagaucacuguccaaaccuccagagaugcugauuuacuaggucagggguauaguagaauuuguauuucuaacauuuuuuaggggauacugaugcuacuggccagggaccccacuuugagaagcccuggguuaaagguauggcuuguuuuucuucauuaaaaaacaaaacaagaauugucuauuacaccauuaaacaguaaguuaauggguucaaggaaugaagauuaaaagaaaguauaugaggccgggcacgguggcucacgccuguaaucccagcacuuugggaggccgagacaggcagauuguuugagcucaggaguuggagaccagccugggcaguguggugaaacccuaucucuacaaaaaauauaaaaauuagccaggccugguggugccugccuguagucccagcuacugagaugggaggauugcuugagcccgggaggcagaaguuggaaugagcugagaucacaccacugcacugcagccugggcgauacggcaagacccuauuucaaaaaaaaaaaaaaagcauaaaccaauuuuuaaaaaaaguaugcaauagaauaugggacuuuaaaaaagccuucccuaaauguuuccaacuugcuucauccuguaaugagcaggcuucaucuaaagcucgucauacugagccacucugcugcaccaacucucugauuugcuuugucuuucgaaagcuuuauuuauaaccgguuccugcaaaggcuuaguuuggcaugacaaggcauuaaacuguucaucgaggugaaaauuuauagccuacuugugcuaccuuagacuuuuaaaaaauuguuccaugaggguaagucuucucaucuagagaugccuuuuuuugauucgccucuuguacccagccugucgcauagcauguaaauccugcaggaauguuuauuaauuuaaauucaccuaugagaguacauucuggucuuugaguaacaugaauucuauaauguguaucuuuaaaaaauaaacccauaguuaaugccuuggauuaacuaguuuagcacugauuguuugugaugcuaagauucuuccuucccucucaccgagaugugugugcuuggaugacaaggaaagauggaguccccagcaguuguugaaacacagcuuuauaaauccccagccaaaaaugccucuaguggaacaaaguccugaaggugagucuguuaccuuucuuuauuugguaaccuguuugacauuaaauuauuuugaaaguauacauaaaccaaaaacuggaaggggcugcauguguuauuuuaugucuuuuauucugaacuaaauccauuaguuugaugugugccaugugcaugggacuguuuugccacccugauuuuucuagucucuauugauggaaugaauguccauugcuguagucucuuguaguguuuagucacccauagugccauguaacuagauuuuuccugcugcaccugagauuaaggaaccucgguagagauugggauggaucaugagaccugaguuuugguucuagcucuauaguuaagucacuuauucuauauaaucccccaccuguaaacuugggcuaauuauauauuucugccuacuuuaaggagggcaaggugaggaaaaguuuuaaaaggccacucagguaagagguaauuuuucaaacuacugguuggagcucuucuuccagggcuuccaucauuguuggcuauguagcucuuccuaaauuuccaaugccucaugugccucuuacucccuguuuuaucucagauucugaaggacaagauuauguugagacuguuauuccuagcaaccggcuacccagugcugccuucuuuagugagacacagagacaguuuucccgauacuucauugaguuugaagaauuacaacuucuugguaaaggagcuuuuggagcugucaucaaggugugguacagagucauucccaguccccuuuagagcuccuucucuguuccauuuccacaaagacucauggacuuuacuuuuauuuugggaguggggagggaagugaauauggcuguuggauacuaugcucauccucaccuuccuggaguuaaagguuuuauuuaaguuacgcuggacacaguugagaauugucccacuccucuuuccuugcuucauguggagcauuaacaugaaacacacaugguuauaacagcacuucaaguggaaucaagaccuccacagaaagaacauuuuugugugcuuugguucagaaagaacauuguucuuuuuuucuccuguuugcuguuagaguugcuguagauaaaaagguucuaagguuagaagagagauggacuucaaacugggagauggccccagcaggucucgauggcuuuuauuuuccagcuauuauugggacaggaaaguagcgauguauuauuaagguacacuguuguugggucuuccuuucuucguucuagucuauuugggugacuuuuauuauuaucugccccuuguagaaagagguuucagcuguuuuuauauaauagaaguauuucuuuguaaauuaggagacccagauuauuguauuaaguccauauacaguacaugucaucuuucacauaugaagguaacccaccaucaacugaguauauugucuguuaaggauucugagaguaucauuaggaagcauuacuguuacuguagaaaaacuuuuacacuaaaaaaggaauuaaauuaguuuuccugugguaaaagacagacaagcaagacagauguccugaucagaaagaucauaauuaugucuaagaggaggggaugauugaagcguauacugucccuuuaacacaauaucauuuugaucaaauccuuuaacuucauucuauuuuaaauucuugaacguagaauaguaacaaauuucaucucuuuacaaguacuuaauaaugauaggcaagcucauauaacaaaaacaucugaguaacuuaagcccccacgguuuccaguaguuucucccugugagaauccacagcccucaccuccuaccucugugcuucugugucagaguagggcagccugcccagugaucuggcauucauuagcaguuggacccauuacuguuucugcaccuuuucacuucaguaaaugaauuccuagggguuuccaguauagcaagcuuuacucccaacccaguucguauaugauguguacugagacaggagaucgaaaggcaaugccaagauccccaccucccgcccuacacuguccucuucccuauuaauguggcaguaaaagaacacagggcuaucauuuuuuggagcaccugccauauuucagauugugugccaggugauuuacaaaccuugucuuuaaaucucaggacauucuuacgagauggguaugauccucauucccuagaugagggaacugaagcucagagaagguuauguccuuugccugagauaagggagauaaaaccagcauucagacccaccucuguuguacuacaaaguguguguucuugucacuauuuccauacaaaaaaagauaaucugaaacucaauuuuguaguacuuccuucuuauucccaggacuucacuuagacuuuuauuaguuuaauugaaacuugugagccaaacaagagaaugauauucuguuuuguguuuuguaaucaacuaauuucuccugccacccauggccacauggcauuugcuuuucuagaguauaucaucaccucaguugaccugcacggaugugacuacaagguuucagugaauaagacucuguaaaaguuacuucagucaccccaauuacauagugaaacugccuggcauaaggaugccucuauguaggaugggaggacuugccuuugcaacguuuucuugcuuucuuauuauuuuacuguguuguuaauuguauuguucugguuucaguauacaucaucuuagguauauaacaaaaucaaugggcagugauuguguuaauagcaauugcuguuauugacuaagcuaagcaccuuucucugugaggccuugauacaagugcuuuacagucaccauuugggguaguggaaaugguauaaaugccauuuuaaagauaagaaaauugagucucaaggaaauuaaguaauuuucccaaguucacacggcuuuagaaaucaaggaauuaaccuuuguguucaggucuguuaauauuuuugguguuuaauuuguuuuuagugacuuuaaguguaaaaaaaaaucagagagaaacuaaaaucaucugaaacuuuacacugacuuuagaaaauaauuuuuaaucuuaaaaucaagacacuuagaaauuuagauagcagauacauuggaaaagcagggagguaacugucaguaaaauuaauuauuaaaauggagauuauguuuuccccagggucucccagcaagcuaaauauaucuagagucgggugggcuguuuucugaauuuuguggcagucaaagcuuucuucaguuuaagaauuucaggcaugugguucuugacuguagcugugggacucauuuagaacuucacgcuuuccuugggaggggauggggugcggugcaaaugccuguuugugcaaggcuccgagcggcugaccuuccccuggcugugccgcaggugcagaacaaguuggacggcugcugcuacgcagugaagcgcauccccaucaacccggccagccggcaguuccgcaggaucaagggcgaagugacacugcugucacggcugcaccaugagaacauugugcgcuacuacaacgccuggaucgagcggcacgagcggccggcgggaccggggacgccgcccccggacuccgggccccuggccaaggaugaccgagcugcacgcgggcagccggcgagcgacacagacggccuggacagcguagaggccgccgcgccgccacccauccucagcagcucgguggaguggagcacuucgggcgagcgcucggccagugcccguuuccccgccaccggcccgggcuccagcgaugacgaggacgacgacgaggacgagcacgguggcgucuucucccaguccuuccuguaagcgcacggcgcggaccagcugccucugaugcgcccccuaguuuccuuucuuuauuuuuuuuuccuuuuuccuuucauuuccuuccuuccuucuuuccuucuuuucuuucuuuccuuuuuugagauagggucuugcucugucacccaggcuggaggucaguggcgcguccuuggcugcaacauccgccucccgggccagcgaaugccccccaacauuaauccccaccaaguccaagccagggaaaaggggauucauuuagaaauccagacguguugaccauguuuaaaaacaaaaacaaaaacaaaacaaaaccaccacuuuuagagaguaaccaaaugcaaucuaaaggagcgguccccagcguuuuuaggcaccagggacugguuucauagaagacaauuuuuccacagacggguguuagggaaauaguuucgggaugaaacuguuccaccuuacaucaucaggcauuagagucucauaaugacugcugaaaaagcgcacaaccuggaucccucgugugcacaguucacaauaguguuugcgcuccuaugagaaucuaaugcggcugcugaucugacaggagguggagcucaggccuuaaugcuugcucaccuccggcugugcggcccuaacaggcaguggaccuguaccuguccauggccuggagguuugggaccccuaaucuaaaggauuuuuuuucccgcuauuuucaaaagaucuccaaaauccaagccauggaaaaaggaaaauucaauaccucaucuuauacauugaauagaauuucucauaggacauuccuuuggauaagggcuugcaacccugugaaacauuuaagaacuaauuuggagucuugauacagugccaacugcagcccccaaagguaccaaaccaauaauuaugauccuaaauuuuaugcuucucagaauccacccuggauguuuacuuucaugauuuuguuuuauuuuauccaaguggauacaguuuaugauuacucuucacuauuaaauuuuuugaggaaacuuaaucuggcuaauuuuuauuaaaucaaggguucuguguuuugcauaauagcaaguacaaaucagcacaguguagaguauacauugaugccugugggcucauggugugaugucuguagccucuugugcuuucuaguauuuaaaaauguccauguuuauaaugauaauagggauuucuguuccuuuaguauuucuguuucccuuuuucaggccugcuucagauucugaaagugauauuaucuuugacaaugaagaugagaacaguaaaagucagaaucagguauauauaugaauagaaauuauaucauuuuauucgugauauaauugacgucugaugucauaaaccuuagguaaaguauuaaggcuuuaaucugauauucagauauagaaaccauaaauuuuaaaagaugauuauucauuuaaaauauauucuaccuguguuuauuuauagaccuucuuuauuuauccacauaguaaaacauaccuccuuuuagaagagaggagucaguugagacacugcauuuuuguaugugaugaaaacaguuuucuaaggguuugggaaacuuuauaugguuggggauaagaauugaaugcaaauuaaugaacuagauuugcauuuauggaguuaccucaucauggaguuaccuuggucugucccacgucaauuaaucuugauuccuuauuuucauagaccauccucuagaacaguguuuucacacuguguaucgugauccuauaaugcagggguguccaagcuuuugucuucccuuggcuacacugguagaagaauugucuugggccacacauaaaauauacuaacacuaaugauagcugauaagcuaaacaaacaaaaaaaucacaaaaaaucucauaauuuuuuuuugagauugugcuguuuuuuuaguuguguuuucaauggagaaauacaucaucuguugacaaaauagcuuuugaaaaauacgaguacagauacuauaaaacaaagcaaacuucagucgugagacacuacauacaucaugugaaagcaacagucugaucuccagguugugaaaacuauaauuaaaaagucacuacacagaaaagauccaaguuuccagguuggcaaaacuucggugcaguuacaugaaacguuuaacaaacugauuuguuuuccccaauguguaaacaaaaugacaagacuaagucugugccugguaauuucaauguaacucugaagcuacacaaaacacacagacaccuuauacacuucaccuguuaguaugaccaucuuuuuuguuagguggugggaggaagggcaaggugacuguguaaagcaaagaugugggaaguagaaauauuauguacuagacguuauaaaaucauggugaaaagaaagcuuugauuaaugcguagccuaagggggaaaagacuacacuccaacuucagaaaauuaauuuagaaggauaggggaagagauuaaguaauugcaguuuaacaugaaaaaugcacaugugauagaauggagcacaauggaagauucauaaaacaugcucaucagaaaaaucuguuaaguuuacuuuguccagauuaagaaagaguaaguuuaucaacaucuggcaucccucauacuuuguaaagauagaucuucugcugcuuaauuaugagaaauuauuuuauucaaagaggggagcuugucaagugcuugcuagaaauuauuuuuaaaaugcuucuacauguaaaauguacugacaaauuuugguaaaccauuuaaaaauaagaauuaguuuugaaaucuuggagaaaaugucuuuuugcccacauuuaaaacugaaaaucaauuuuacuauagacaggaguucuguggaguauacaaaauuccucuuagaaaucaaauggccaucccagauagauaucaaguuucacaggcauuacuuuuagucagucucaaguuucagccacgggaccaaaauuuaguguucuguaccauguugguuucacaucacggcuuaagaaaauacugacauuuuguuucuuaugaaauaaguccuaucuugugcauacaagcaaaaagaaaaaggaagaaaagaggggaggggaaggcgcaagaagcucuuuuuuguuuguuuugaagacaacagauugaaggcaaaagaauacagagcuuucauaagcucaaagaaaaauauuugcuggcuagucgcugauuuguaugcacuauaaaacauuccauaaauaaaacugauauaucauuucuuaaucaugaccccaucaaaacgaaguuauuuccuaacuauucuuucaacgucaauguacccuagaguugacauuucauuuuuaaggguugcagcuaccucauaggaacugaaauagacguacgcuuacccuuucucugaaguauaacagugcacaaugguauccaauuugaagacuaaugguaaagaaaauucuucagaaaaaacugaaaauccaucaagcugaaaaucuauaauuaguucuacuuucuaauaaaaaguacauaaaaguacaucaucagaauaaauaauucuuaugccaguuuguauugcaaauuuuccaaacaaugcaucaaacauaaacccaauccagaugucaauugugaauacaaauagagcuugagguuguuuuuauuaaaggcaguaauuuuugaaauaguuaaugcaacuguugcuaacacaauaauaggacuccuggccucacauacuaaccuggacuucugaucaagugcuaauuagcccaguaagggaggucaccaaaaacuacuagggcagucaguuguggcuguggggaauuauucuacuauuggggacugaaugcaacaacuuuauuacuauuauuauuuuaagaggcagggucuccaucugucacccaugcuggagugcaguggugcaauccuagcucacugcagccuagaacuccugggcucaaaugauccuccugccucagccucccaaagugcugccauuauaggugugagccaccaugccuagccugcaaugacuuuauuaccaggaauaaaaauauaauuaccagcaguuacaaggguucauucauaguaaagaaaagucuaaguguagacucuuaaauaagcaguucaauguauuugaaggagaucugaguauuagccaguguguuuuucuauaaguacuuuccuugucaaugaaaucacuacuaauaaacauuuauuaguuauaaauuuaaaccaggaauaauagcauaaauaaacuauguuggcugcaguggcucacaccuguaaucccagcacuuugggaugccaaggcagguggaucaccugaggucaagagugagaccagccuggccaacauggugaaaccccaucucuacuaaaaauacaaaaauuagccaggcaugguggcgggcaccuguaaucccagcuacucaggaggcugaggcaggagaauugcuugaacucaggaggcagagguuacagugagcccagaucacgucauugcacuccagccugggugacaagagcgaaacucugucucaaaaaaaaaaaaagucugaacuacugcuaaagccaaaguuaauguuugguguuagcauuuguuaugcacauaauuauuacaggggcaccaaauccugguuuugcucaguuaagggcagcauccaugggcauccuaauugauggguagaaaccuccaagagauuaacaguguaauacagauaauccccagcauccauaaaugauucaggaguagaaccugauuguuaccagagcagagcuuuuuuuuuuuucuuugauaaaggaaaaaguucaaaaaaauucuuccucagaaaaaaauuauaaaucagaaauggucaaauacuaacuaauacuuuuucugcacuugguguuauaaguauucaaauacaucuauugagggaaaaagacuuuuuuaagaaaaguaucauguaugagaaagaaaauuagcuguuggggacaaacagaguaaugguaugggaaguguccuagagggucauucacuguaaguggcagcugagggcauguucuucaagcauguaccucugagggcagugugcccuuugauaauguggucacuuuuuuuuuuuuuuuuuuugagacagagucucacucaucgcccaggcuggagugcaguggcacgaucucggcucacugcaagcuccgccuccuggguucacgccauucuccugccucagccucccgaguagcugggacuacaggugcccaccaccaugcccggcuaauuuuuuguauuuuuaguagagacaggguuucaccguguuagccaggauggucucgaucuccugaccucgugauccgcccgccucggccucccaaagugcugggauuacaggcgugagccaucgugcccagccaucacuuuuaaauuguuuuaccuaaagguggauuucuagucuucuguuucugaacuaagccuaccaccaaaaaauauggaauuccaguaaaacugaacccuucaaauauuagccuguaugcauucugaccuucuuagccauagaugguuaucagcgguaagaaagaauugacuugacaaggaguuuuucuguuuaauaccugccuauuuucuguuuacuguaucauuguucuguguagcaacagaccuguaaaccacacagaggauacuggaaauagcacauuuucaauaauucugugagcuucuuuuuuuuccuuuuucuuuucuuuucuuuuuuuaauuacacuuaaguucugggauacaugugcagaacaugcaguuuuguuacauaguacacaugugccauggugguugcugcacccauuaacuugucaucuacauuagguauuucuccuaaagcuaucccuccccuagcuccccacccccuaacaggcaagccccaaugugugauguuccccuccuugugcccauauguucucauuguucaacucccacuuacaagugaaaacaugcaguguuugguuuucuguuccuguguuagugagaauaauaguuucuagcuucauccaugucccugcaaaggacaugaacuuguucuuuuuuuauggcugcauaguauucuauaguguauaugugccacauuuucuuuauccagucuaucauugauggacauuuggguugauuccaagucuucacuauugugaauagugccgcaauaaacauacgugugcaugugucuuuauagcagaaugauuuauaauccuuuggguauauacccaguaaugggauggcugggucaaaugguauuucuaguucuagauccuugaggaauugccacacugucuuccacaaugguugaacuaauuuacacucccaccaguagugugaaagcauuccuauuucuccacauccuccccagcaucuguuguuuccugacuuuuuaaugaucaccauucuaacuggagugagauaguaucucauugugguuuugauuugcauuucucuaaugaagaccagugacgaugagcuuuuuuucauguguuuguuggcugcauaaaugucuucuuuugaaaagugucuguucauaucuuuugcccacuuuuugauggaguuguuuuuuucuuguaaauuuguuuaaguuccuuauagauucuggauauuagccuuuuuuuuuuuugagacugaguuuugcucuuguugcccaggguagagugcaauagcacgaucucagcucaccacaaccugcaccuccuggguucaagugauucuccugccucagccucccaaguagcugggaucacaggcaugcgccaccaugcccagcuaauuuuguauuuuugguagagaagggguuucuccuuguuggucaggcucgucucauacgcccgaccucaggugaaccgacugccucggccuuccacauugcugggauuacaggcaugagccaccgcgcccggccuggauauuagcccuuugucagauggacagauugcaaaaauuuucucccauucuguagguugccuguucacucuaaugauaguuucuuuugcugugcagaggcucuuuaguuuaauuagaucccauuugucaauuuuggcuuuuauugccauugcuuuugguguuuuagucaugaagucuuuucccaugccuguguccugaaugguauugccuagguuuucuucuaggauuuucaugguuuuaggucuuacauuuaagucuuuaauccaucuugaguuaauuuuuguauaagguguaaggaagggauuugguuucagcuuucugcauauggcuagccaguuuucccaacaccauuuauuaaauagggaauccuuuccccauugcuuguuuuugucagguuugucaaagaucagaugguugcagauguguggcauuauuucugaggccucuguucuguuccauuggucuauauuucuguuuuaguaccaguaccaagcuguuuugguuacuguagccuuguaguauaguuugaagucagguagcaugaugccuccaguuuuauucuuuuugcuuaggauugucuuggcuauacgggcucuuuuuuggucccauauaaaauuuaaaguagcuuuuccuaauucugugaagaaagucaaugguaguuugaugggaguagcauugaaucuauaaauuacuuugggcaguguggccauuuucacaguauuguuucuuccuauccaugagcauggaauguuuuuccauuuguuuguguccucuuuuauuucauugagcagugguuuguaguucuccuugaagagguccuucacaucccuuguaaguuguauuccuagauauuuuauucucuuuacagcaauugugaaugggaauucacucaugauuuggcucucuguuugucuauuauugguguauaggaauguuugugauuuuugcacauugauuuuguauccugagacuuugcugaaguugcuuaucagcuuaaggaguuuggggcugagacaaugggguuuucuaaauauacaauuaagucaucugcaagcagagauaauuugacuuccucucuuucuauuuuaauacccuuuauuucuuucucuugccugauugcccuggccagaacuuccaacacuauguugaauaggaguggugagagagggcauccuugucuugugccgauuuucaaagggaaugcuuccagcuuuugcccauuccauaugauacuggcuguagguuugucauaaauagcucuuauuauuuugagauacguuccaucaauaccuaguuuauugaguguuuuuagcaugaagggguguugaauuuuaucaaaggccuuuucugcaucuauugagauaaucauaugguuuuugucauugguucuguuuaugugauggauuauguuuauucauuucuguauauugaaccagccuugcaucccagggaugaagcugacuuggucgugguggauaagcuuuuuaaugugcugcuggauucaguuugccaguauuuuauugaggauuuuugcaucgauguucaucagggacauuggccugaaauuuucuuuuuuuguugugucucugacagguuuugguaucaggaugaugcuggacucauaaaaaagggaggagucccucuuuuucuauugcuuggaauaguuuuaaaaggaaugguaccagcuuuucuaacuaccaucagagaauaccauaaacaccucuacacaaauaaacuagaaaaucuagaagaaauguguaaauuccuggacacauauacccucccaagacuaaaccaggaagaaguugaaucccugaauagaccaauaacaaguucugaaauugaggcaguaauuaauagccuaccaacccaaaaaagaccaggauucacagccaaaugcugugagcuucuaaggauagugguuauguucugcucacugacuucucccuaaggcaacuggguggcccuguguugggggugggcacaaauacuuaaugauggugaugauuuugcuuaauuuuggccuccauuuugaguuauuguguguucgucuuggguuaggaugaagauugcaaugaaaagaauggcugccaugaaagugagccaucagugacgacugaggcugugcacuaccuauacauccaggugaggucgugguguguaguuaggugacacagcaacacccaguaguggcgggugggccuguuucaggguauuagaacaagauaauggacagaggagggcuuauugccacuaccaaagauuaauuggccgagaggauuaccauauggaggcccuuuuccccagccuugaacucaugcuuuccugccacauaucaggagcagccacagggcagcucugggcucaggcuguguaaguucacauccuggauccaccuguuaggacugcaugaacucgggcaagguucuucagcaucuugugccucaguuuccccaucuauaaauuacauaauaguaguucuuauagacuuguaaagaauaaauaacaugugaaguacuuagaaccauaucugaguuccauaagugcuagacugcaugagcacagaaacucuacuuugccuaaccaccugaaucuggacaaguaagauaugaugugcacacaugccuguacaugcaaaaguaacaccaaggugacuuuaggcaaaguggcuugaccaggaaccucuggagaccagugcacaggcaagccaguuccaauggggcaugacugagaagucugagcuuuggccugccuaccugccagagcaacaacauccuaaacaggggugagugggcucuuccaguagaggaguggccauaaaacaaguuggccgggcacgguggcuuacgccugcaaucccagcacuuugggaggccgaggcggguggaucaccugaggucaggaguuugagaccagucuggcuaacacagugaaaccccguuacuacuaaaaauacaaaaaauuagccaggcaugguggugugcuccuguaaucccagcuacucaggaggcugaggcaggagaaucacuugaacccaggaagcggagguugcagugagccgagauugcaucauugcacuccagcuugggcaacaagagugaaacucuaucuaaaaaacaaacaacaacaacaacaacaaaaacaaagaagucuuuccucugccccaagggaacaggacugugggucacuguuaguauuucagucauaacugcaagcaggcagaucuuuaaaugugagauacagaacugggcagaaaaaggaacccucgacaaguuacagcauuuugaaugagaugaauuagguauuugcuuuccuggaguuggagcugguuuuagguauuccguaacauaaauaucuuugagguaccacuuacacagauaauaaagcauuggucccccaaaccacuguuuauccucuauuauauuccauuaccuucuacacaauuagaaugagauagaaguacacaaaggaggugcauccgacaugcaucaggaucacggugugggcaucagagggggccuugugaggcccggagggugaaccagaguuuacugacaauuauuccgaaggugauagaacaaagucuggucuuccucucuuuaaaaacaauaaaaccuuucuucgugagaaaucucaacucuggcacuaguugaagcauauaggcuaguuucauaaaucaaauggugcauguugauuuaagauuuaagucauguugcacuguuuucugauaugugaauacacucaagaaggggugagacagagccccugugucacugucccaagaagacuugaauguuuuaauauuuauaauauuuuucucuaaacuugaaggucauuuguguuuaauguaagaaaagcuaaugauauaauuagguuaacuaacccuccuuguaaauuuggguuuggaagcgaucuuguaaaacaauaaauaaaauuuuacaacauucucaguuuuuuauguuaauugugauaaguauuuuaaacaagucauauuuuuaaaugagcaauaauauaaaaaauuaaaaaugguuauguuggagugccaagaguaugcauauuuacccccaagguauuuuuuaauacuguugguuucuuuuucguguagaaaaccaagucuuuccccuaaccguuuaaaacccaugguacacguuuuaaaauggaggauuauguaaauugcaguuauacuccuucacuuaaaacuguuguguaaucaaauucuccugguuugucuguauauagauggaguacugugagaagagcacuuuacgagacaccauugaccagggacuguaucgagacaccgucagacucuggaggcuuuuucgagagauucuggauggauuagcuuauauccaugagaaaguaaacuuuacaacauuucauaucugaagacuuauguuuacauaaauuuaugacugcauaaaaauaucaaauguaagauuggagaaaaacugaaauagagggaaagcuauggguauauugacauaaucuauuuuuguaggaaauagaacaaagugucaaagacaauaaaguauuacaaaguaucagaguauaacauuaaaaaauguuaagaaaacuuuaaagguuaggacagggaucagcaaacuguggcccacaggucaaaucuaacccacugccuguucuuguauggccugugagcuaauaaugacuccuauauuuuuaaaugguuguaaaaaauuagaagaacauuucgugacacauaaaaauuacaugaaauucaaaugucagugcucccaagguuauuggaacauagcuaugcucauugguuuacauauugccuauggcuguuuuuuuuccauaccagcagauuugaguaguugcaacagggacuguaaagccuaaaguauucacucucuggcccuuuacagaaaaaauuuguuaaccucugggagaggagaaaguauuugaacauguagggaauaugaggaugauuccuugagugcuuuagaauuagggccaggugcgguggcucaugccuguaaucccagcacuuugggaggucaagaugggcggaucacuugaggucaggaguucaagaccagacuggucaacauggugaaaccccaucucuacuaaaaauacaaacauuagcugagugucguggugcacacuuguaaucccagcuacuugggaggcugaggcaggagaaucacuugaaccugggagguggagguugcagugagcugagauuguaccacugcgcuccagccuaggugacaguaagagacuucaucugaaaaaagagaaaaaaagaauuaagcaaggaugugauuaauaccugccaaguuacuugauucuaacugaauuagugccacccuuccuaggaacacggggaaaccagaaggucaucuagcaagaagagaaaugagacuuucugaguaacuuagcuugucgcaugucuaaaaugucauuuuaaagcuagaaauugccauuauaauauaaaugcuaaugggccuagcuucaggaugaaacacugcuuacauuuuuaaaaugagauugucuaaugcauuaaccaauauaaauucauuauuuuuuuccuuugccucaaauuucuuuaaccuuaaaauguuuguacuguaccguauuuauacugagaagcaagggcuguaauuuacacauguguaguuuguaaaugauuugguagaagcagaauuugcaagguuagaaaugaaaaugaauucuaaugagggccauuuaagcuguauuacugugauuuuauccugggaugcuagaacaaugcccccugugcucuauuccacuccauccaauuugcucaguauuggcuaaccauuugcuggcaucuaacacugugccauaccuggaaauacaaggaggcacaagugugugucccgugcuugagagggacuucuugcucuuagagggacccagaauuuaccuucauguaaugguaaaagagaucauuauuuucucuauuauaaugcaugaaacaauacagauuaugagccauuaggaaaaugagaaagcagucucauguaacaaguaauuguugcacaccuacugugugugcuggggaugccaaguugaacuguuagaauuacuguggaaggcucaugaaugaguuggcaauugcaaauguugguauagugcaaaugcauggaaaaaagcgaguauccuacgaaggggagaggguacaaagaaaggaauagaagaaggaauaaaaauggugugucucccugaccagaggagagguuuuguaaugcagcagagguaaggguaacuuggugaacccaguggaaggggccuuggaugccacagggaacuauuuagaauucaccuggucaggauaccaccagguagaacuaggaaacaguaaagaggucauaggacagucaggacauauugcagaggccagacagccuggaccaggguggucugugggagaagaccucauacgauuuucaucgcuagguuggccuuuuaaauuaggaaguagguauaacuuuaugcauggaaaaccauuguuuguuucuucacucucuuucaacagggaaugauucaccgggauuugaagccugucaacauuuuuuuggauucugaugaccaugugaaaauaggugauuuugguuuggcgacagaccaucuagccuuuucuguaaguauuuuaaaaauuagacuguaccuaaaaacagacucagaugucuugauaauccuggaaguguuagcggauagaauagugcguucacagaacuaugccgucuaauccucaggagauuauacaaaccugaagggguaugcugcaaaugaucuuguaggcuuugcaauugugaguauauuuuuuugagugcauuccacuugagggacacaaaauuauuggcuugggaacaauauuguggucaaagguguacaguacuuuaugaaaucauuugguauuuuggucuaccaugccuggcacugggcuagaugcuuuauaccucagaggcuuuuguugguuuggggaaaugaggcucaaaaacguaaaacaccaggagaccauacaguuguaaggcucaagaaaggcuggauaacgacaguggcauuucagauguccuuaaauggugguugggaguccaacagguggagguugagggcagggccugguggccccagggugggaauuccagagagagcacagcauaagcagaggccccgggguaagcagacuuggcugucggaagaccagcauacugucugacuggucgaaacugugaggugcaggggagaguaagaggaugcggggcaguugaggagucacuggaagguugggcagucuuguaggugguaggcuuugaaugccagaggaggaauuuugcuucacauuauaaacccaaguuauuaagcaccaagaucugugggaaaugcaguuaauuccaagggugaucaggaaaggaaaauaggauuugaguuaauggugagaauaaccacuggggccaaguuagaaggugagacuaggaguggaaagggaggagagggaaggcagacaguacggacagggucccgaucaugcuccccauggaguauaugggagagugcugagaccaaggacgggccagaugguggggaucuugauccccaaacuaaagaauuuaacuugauaucuggaaggcuguagcauagugagauagauaagagcucaggcucuggaaucucacugaccuggacuagaauccuaucucugccacugcuuuguagcaugauauuggacaauuaauuaacuucucaauaccucauuuguaaagugugccuaauacuagugccuagcugaaaaaguuaucaggaagauaaauaagaaugcagguaaagcaccuagaacagugcccagcacuaagaauguugaagccgguguuacugauggugaugcuuguaaugggaagcaccuauuacaagugcagacauaacaauagugacuuaggguauugacaacacuguugcacauaguggagcaaggugaggcuaccuggggggcauuagccaugagcgaggguggaacauauuugcugagcagccucuaggaaagaagaauaaaaauugaugcagagaaaguaacagcaguggguaaguugaaagaugaauuuguuguuuuuaauauaaucuuacucuucuuagaaaacagauucuguuuuuggcauuugcaacaugaaaauaaauugguuucucuaaguguuugcauauuucuguccuaaagaaagaguuguacagugauugccccccucccucuugauuucauuggguuuucugagagccuugcauuaguggguuaacuaaacuagaaaaaaaauuaaaacucaaagcguuauuauauuauuuugauuuccauguaauauuuccucagucuucauuuagaaacagacaagccauucucauggaauaauaucauguuuuaauuggauauuuggcuuacuuauauuuuuaggcugacagcaaacaagacgaucagacaggagacuugauuaagucagacccuucagguaaacccagaagacuauauauuucauccauguguuaaagaccccagaauuucuuaaccugaaaccuguuuuuuacuuguaaagguuuuauucuacggcagauuuuaauugcuccuuaaguuaacaaaauuauggaaacguuuuaaucuuuuuuuccuuuucaauuuaugaauuauucuuugaacuuuaagaaauuagagcuucagugaguagaauaauuggcucccagggguagacaguuuuauuuugucuaaccuccauugguaaugugagguuaccucaugaccugauccaucuggggucuuaucuggcacugucccuccucuucaauagcaaagacauccuuguguagaaccgaauguguggccauacgugacuuaugguuauucauuugguacaaugcaugcucugcuuccugugaguggcauagacaguuaacagaucaugccucacuuuuaagaaaccuuuuuuuguuuuuaguuugugucuucuguaagugcuauuauugggacguuuucccucuguuuuccuccacacaggucacuuaacugggaugguuggcacugcucucuauguaagcccagagguccaaggaagcaccaaaucugcauacaaccagguaagagguuuuguggggaaaaggaaucucaaaauuaagguaauaggacaucuagaucacagcauuugggauuuagucccggcuaaaauagucaagacauccacucauucacacuccaggaaggacucaugguccuaaggauagugacugaaacuggcacugcugcugccaggagcuuacaguccauccauccauccauccauccauccauccauccauccauccauucauccauccauccauccauccauccauccacccacccauccacccauccauccacccacccauccauccaccuguccauccacccguccauccacccauccauccacucguccauccguccguccguccauccauccauccauccagccauccauccauccauccauccaaagaaugugcaaaccaaccccuaucuugggcaaggugccaggaacagauguggcuccagcccucagggagcuuguccacugguggaugaaacagacaacaaauaaguaaaaaauaaaagauauagccacaaauuguggugagggcuaggaagaaaagaaauggaacugagugacaaagagaacagauugaccagggaagaucucuugagaggauggcauuuaggauaaaggaugagaaaggacaagccacacagauuugggggcugacacaugccagggagggagaugguaaggagcagaggaaacugcacacauaaagagaaagcccugagugagagagacagcuuggcacauuuaagacagccaaaaggaaggcuaguguggccacaguguggcaagcaacaggggacagaggcaugaaguuaagcuggaaaagaaggcagggaaagaucacacagagccagguuggccuggauaaggagugugcauuuaauuugaaguacacagggagccagugaagaaucuugagcaagagaguucacucuggcugcugcgaggaggcucugcaggaaguccugguaaggcgguuggcagcuggaacuggacugcaagcaguagaaauggagagaagugugcugaauuaggaagggaauugagagauuuucccaauggaagggauguuggaugagaauuaggaagggauuugagagauuuucccaacggaaggaauguuggaugagaaugaggaagggaaagaguccagggcucagguuucuuucuggaacaccugggugaagaguauuugacugaagugaggaaaccuaaggacagacauaagaggaaggaggagaagaugacagaaaaauucaguuugaggcauguuaguuugaaauaucugaugagaaauccaauuagagauuucgaguagauuguuagagacccaacacuugaguucagaggaaaggugagaaucagaaggauaaauuugaaaucagcacacagauaggauuuaaagcuaugagacuggaugagaucacuuagggcaagaguguaaagcuaaacuuuaaaaacacauuaggugccaggcauggugguucaugccuauaaucccaggacuuugggaggcugaagcaggaggauugccugagcucaggaguucaaaaccagccuggguaacauagcgagaccucaucccuacuaaacaucaaaaaaauuagccaguccugguggcacacgucuguagucccagcuccucaggaggcugaggugggaggacugcuugaggccaggagauuggggcugcagugagcugugaucaugccagugcacuccagccugggcaacggagcaagacccugucugaaucaauuauauauguguaaaauaaaauacauuaggaaagcaauuugcaucaaagcaaaugcucaggcuugcaguggagauucaagccuggguuuugguucugacagggagcauuggacaacaacauaaaguugaaacagacaucuaaguaccuggugagggugaggguuaggguaucaggagauggacugcacacacugugagugugggcagacaccuuuagugucauuauuauuauuauuauuauuuugagauggagucuugcucuuuucgcccaggcuggagcacagcggugggccaucagcucacugcaaccuccgccucccagguucaagcaauucuccugccucagacucccgaguagcugggauuacagacgccugccaccaugccuggcuaauuuuuguauuuuuaguagagacaggguuucaccauguuggccaggcuggucucaaacuccugaccucagaugauccacuugccucagccucccaaagugcugggauuacaggcaugagccacugcaccuggccguauauacauauuuuuuuaaaaaaccaaagugggggcaucuuagacaucaguaauaaauaucccugaguggugggaucaugagauugcuauuuuauucuuggugcuuuuguucuauguuuucuauagccaacacguauaggaaaugccacagugaauguuuuuaagaugucggaggucaccagugacaauccaagagucucgccgcccccucuuugaguccaaauguauucaagaguauugcuugaaaauguuuuccauuguccugaaagcggcucuacacccugcaccucugugccccugaccaugugcagucuuuuccucggcagcugugucaugcucgguuuccucagaugcacucccuucccaacgccaucuucuccuucguggcacccuacuuagauuuucucugcacugacuugccuuuuugcuucuuuuuucuuuuuauuguagauacuuuuuuuguuuuugucaauuauuuaauaguuaucuugauuauuuauauccuucuaguuuuuugacuuuaguguuuuuuucuguagcuuuuuauuuuuauuuauuuuuuauuuuuuuccuagcuuauggagguaugauugaugaaacuugucuauauuuaggguguacaaugugauguuuugauauauguuuacauugugaaaugauuaccacagcgaagcugaccgacauacccaucaccucaccugguuuccauuuuuuguguaugguaagaacgcuugagagcuacuuucuuagcaaaccucaagaauacaaugcguuauuauuaauuauagucaccaugccgugcuuuagaucuccagaauguauucauuuuauaacugaaaaugcgugcccuuugaccagcaccuccccuugacccccaguccccagccccugguagccaucauucuguucucuguuacuguggguuugacuuuuauuuagauucuacauaccagugagaucauguaguauuugccuuucugugucuagcuuauuucaccuaacauaauguccugcagguucaucuauguugucacaaauggcaagauucucuucuuuuugaaggccauaugacccuguagucaggagcuggccuuuucuaucagccgcagauuuuggucuguguuucacuuuuaagaugguuagcuaagaugugaaacaaagcaaauucuuaugaucaaucucaguuguccuugcucuucagccauuauuuccaguuuucagccagugguuuucuaugucuguggauacaacuaaaccaguuaccauuaauuuucuaggaaggccaggcguguuggcucaugccuguaaucccagcacuuuaggaggccaaggugggugaaucacuugaguccaggaguuggagaccagccugggcaacauggcaaaacccacucuguacaaaaaauacacacaaaaaaauuagcugggcaugguggugcacaccuguagucccagcuacuugggaggcugagguggaaggauugcuugagcccaggaggcagagguugcagugagccgagacugcaccacugcacuucagccugggugacagagugagacucugccucaaaaaagaaaaaaaauuucuaggaaaauguuuaaagacaucaugccaaauauuuuaucaucaucugaauacaaaauauaucauuuagccuuuauaaccauaauuuuuaagaacaaaucuucgcauuuuuccagugugaccuguuuuguacuccuacaaacuuuauuucagcuaacaaugcuuauccuauaauucccugguaaauuauacuuucauaucaaggcucucuaaaugcaauuauucuucccccucagaaaguggaucucuucagccugggaauuaucuucuuugagauguccuaucaccccauggucacggcuucagaaaggaucuuuguucucaaccaacucagagauguauguaucagguguuuuagugccuacauuuucaguaaccggaaucuuagcacagagaucagaauucaaagcaggauauuuuucugguauuuauaauauagaagaggcugcccuacuguaauuuuaaugacucauuuauucagauaugcaagacuaaccaguuuucccauuuuuagugaaacauuuuucugagcaaaggaagucaccucaguuaaauucuuaaaauagcaguuuugggagccaaagaucaucagcauguaggagggaucuuacuggucucuccacuauguuuccacagugagguaaauggaacccuaccucugaugaugggaaacuugccccaguuuuguuuguuuuuggaaaucuuaccuggagaaauugcuagguuauaguugcuuuuuaaaaaauuauucugagauuuacucuugauuuuaaagcaaaggaagaagccacaaaauugggcuugauaugaauaugguuauaacaagggaguagauuguaaagaaauggguauuuaguucuagaaguuaaagaugccuguugaaugggccaguuguaguaacgucuaaagaaaacuaccaagaccagaaguuaaaacggguccgaaaaaaauaucugccccuugaaauguuuuucccaaugaaauuuccauuuguguucuugggauuaauccuugccucauuuacugccugagcuaaaaagggaccaguguuacaugugcgaggucagagaugcccaugagcaaaccgcauuaagaugaaagugaagagugagguuugggugagagugauuuaaauucacauauuuaugagcgagacaucuggagagccaccuucuuucuuacugagcagagugaagcaggaauauuuauuaaguuaauucauaaacacgauaacuagaaugcaguaagaauacuccuguauuccacuauaagaacacuucucuggauaauuuugaaaacaaauuauuuuacugugaguacaguguggacagcuguguucguaaaguauaggacuaagugaagugauuucuauugccucgccuugacugcaaugcucuuagaugauuauguccuuaaugaagugccuuucuuuagucuaaaauucauguuuauuuaccagaaaggugagaacuuuuggggaaguagagauuuuuuuucucuuacucuaucuguguugguauaugggugugguuuuuuuuuuuuguuuuguuuuuuuuugccuuuuuucaucugcauguuuaauuaaacuacuuuguuguucucugaagccauuagguuuuuacuuuguacccagaugugcuuucugccccuugaaauuuuuuucucagugaaauuuccauuuauguuuuugggguuaguccuugccucuguuacugccugagcuaaaagggaccaauguuauaguaugugaggucaaaggugcagacagcauuaggacgaaagugaagagugagguuugggugaggcugucauuuggguaaaguuuauauuaaaauaauauguauguaauuggaagaauaagcgucagguuucaagaagguaucaccuaucuuuucuugcuagcaaauuuuuauuucuguauuugauuuucuuacuuauggugaauaaaugcuuucacuguggcagucugccaaaaccuugcugauuugaauauauuuuuuuagcccacuucgccuaaguuuccagaagacuuugacgauggagagcaugcaaagcagguaauuuucugaugcgucaauuacuaugucuucagucuugcauuuuaauuauuauuuuucuucuuuuucaauuaguaaucuucugccacucauucucuuguguccugggaacaacguggggaaaaaauaugaaaagaugaagcacuuaaaaugucauuagacuugaacuacaccauaaaaaugccaagggcuggcacagaaaauuaacaaacugcaggguucuuuugugcaauucguugugcuuuugaagugcuauuuggacccuuggcuuagcuguugaaaaaaaaaaagaauccuuuuacaacucauuguuuuugauaaagcuuggggcuuuaagaaaaaaauauaauuuaaaacuguaauuuuguucuguuuugugguugcaguagcucagauuaugggggaaggguugcauuuucuggacagucuauugucacaguauuuuaaagcaaaauaaauucuccuauauaccauaaauaucugaguauaugugugugugacucaugacauaggcuaauauuggcauccagcaaauauuaaaaaaaauauuauuggugaauguguguauugggcuucugguaugccuuucuucugagugccaguuguuugucuugguacagugguuaauacucuugucauauggaaguuucucaaacugacuuacugacaauuauaaucaaggcaaacuccuuauuuaaaucauuaauguugagaacaaaagcauagauggaauauuguauuaauuugguccuucuugcuugcugguuauguaucugaauggacaugccacuuuucuagacuuuaauuucccucaccuauaaaauaaaaagauuaaguacucuuuauuuauauuagcacuaacauugugucauuugguaaguuuaacaugaugguuauuuauggcuguagggaccuauucugccucaucuguuuaauuagugaaggccauuagaaauacauugagucauguuucugcuucuuuugguagcuauuauuguuucugggugucauaaguaaacauucauuucauagccuuuccuuaugacaaggucagucuuauuugguguuuccccuuguugacagcuaagauggcccaggaacuauacaaaccauuuuucaccaugaggacugcacuccuaccaucagauauauauuagauacccuugagcauuugagucugggcuguacaaauuggcaccaaaacaaaaacaacaaaaccacaaccaccucccaugucauagucauugcuuuuuagcugaaaggaggaaacuuagaagaugcuuauagaaugagcauagcauaauuuuuugccaugcacauuuaccaguacagcagggucuauuaugcucaauaggguauucuuguuuuugucaguuuaauauaccuuucauaaaaguuguaucaugucauuuucuuucuauauaauacuccuauaucccauacaaacuaauugccuguguuuuuauuuuacccuaauacuggaaggagagugguaggggggcauauuuuaaagauuuauaacuagaaaaugcuuaauaaaguccaucuaauaauugagguuuucuuaucucaaauauuucucuaacuccuuauaaaucuuuauuauaaacaagaggauuaaacaucauuaaggaaccucucaaagguuuagauugccuucauaugguucacugcuuuaaugagguggcugugaagauauaacaaaucaguaacauaaaucaagagaauucaagggaaugguaucaaugcaaauaacauaaauggagaagaaaccauuaaaacaagauguuuuacauugcuuuuaggauuccagcaguuauuaugcauuacaauuucuacuaaaauuaggcauguaaagcuauuuguuuuaucuuuuuacaucuuuuuauacgauauuuucuguguuuauaaggccuaauuucugcuucuauguaguuguugauuugauuuuuuuugguugugacaauaagguauaaaaacaaggggccuccuuuuaagaaauguucauacuacauuguugcacaacucuguggucauaauaaagcagaaaaaauaaugaccuauucagaaauuucagaaugucaguuaagugcaagaauaguggcaccuuuucuuugaccugaacugacuacugacuuguccggagaauagcugagcauuauccauugcaucccauuagcagugugccuggguuuuauuguagaaaucagucaucuccuggcuguugaaccacgauccagcaaaacggcccacagccacagaacugcucaagagugagcugcugcccccaccccagauggaggagucagagcugcaugaagugcugcaccacacgcugaccaacguggaugggaaggccuaccgcaccaugauggcccagaucuucucgcagcgcaucuccccugccaucgauuacaccuaugacagcgacauacugaaggugggcuuaagccacgcugcacaaagggagcuucaccuuguccacaaaaggaucaagccaguuucucacagauucuuuuaaugccucuaacauaaguucuuaugugagguauuggaagccccuaaaaguacaugcaaaauguguguauaugcauucagggaagaggacccauacuuucagucaccuacuugaaggaguccuugaccuuuccuccucccuacccacccaagagauuaagaagcagugccuacaaaaauuagccgugcgugguggcaugcaccuguaaucccagcuacccgggaggcugaggcaggagaaucgcuugagccugggaggcaggcggagguugcagagagccgagaucgugccacugcacuccagccugggagacagagcaagaccccaacucaaaaaaaaaaaaaaaaaagaaacagugcauuuagagacugaucccuagcccaaacgcccagagccauaagcaucaaccagcucauaucuagaugaaguauaaaguaguucccagugcugguugcacaucuacuucaucucagaaacucucugacaaugcagaugcccaggucccguagcccaucuaguggcucagaaucuccaggugugaggcauuucagaaucucauuaaaagcucccaagcaguuucugaaguguagccagguugccaguuugggaagacuuuaacauuuaauuucuuuuaaaaagaaaaaaaaucugaagcauauuagugaaauguuaaaauguguuaaaguugggugaguagguaacagguauuuguuauauucucuauuauguuucuguuugcuuaauauauaugauauaauuuaaaaagauagaguaguggaggaagucauaguaaaauuuaugaaagaucaguauagauuuuagagaccaaacacaauuuuuacuggcuggcaauauuauuauagaaagauauuugcaggauuauaggugacuuuuuuauagaugucuuuuuucauauguguuguuucuaaauuuucuauagugaaaugguacuacuuuuauaauacaaaaacaaaugaaaaagaaagcuauuggcaaaauauguaaaugccauguagcuuucaacaggccugccaugaaucaccuugguaugugggaggggccugaugcuguuagguggucaucgcgccacaguaucccugagagucagagagaauguguuuauuugauuaucucccucugaaaggcaaauaucaauguggccaagaauuuggacuuugaacccaggcauccuucccauugguugaaagguuagcucuugcuuuccaaagcaggccaugaaagauauguguccucuucccugauguguucaaagagggauggacuugucaagacuuguuuuuugaaccuggaaauaagcaguguagugccuacugcaagccacagauuaauauuuuaaaggaucccuuugauaaggcuucaaugaugauguuuuaaucgguccuguuuuagggcaacuucucaauccguacagccaagaugcagcagcaugugugugaaaccaucauccgcaucuuuaaaagacaugguauguacgcccuuuuuaaaaaugauauuucuucucauaagacuuuuuucaucauuagaaaguacuguuaguguucgggcauaucauauuuuacuuucaaauucaguuauaaauaauugacaucauauggaauuuaagcuuauuuuugaaacugauuugaauauuacagccuuacuauuaauacuaaaaugcaauugguuuguggagucagaaauaugaccaaacugucaaacuuaacucuagaugagcucucuauuuauaaauuuagagaacucaagaaaaauugauaugacuucaauggucccaguagcaauuacuuaacugucagguuuguguuaauuuuagguugccuucuaaggagaaugugaaccugaugaugagcuauuuuuucucauuugguguaggagcuguucaguuguguacuccacuacugcuuccccgaaacagacaaauauaugagcacaacgaagcugcccuauucauggaccacagcgggaugcuggugaugcuuccuuuugaccugcgggugaggcugggaacacacugcugacaaucagaaugcuguaucuagucacagggauggcaucucuguuaaaggauuuuucccccaggcuuauauuauaaaugucaccuuugggaaauguauucuugaggaaguugucagagugagaguguuacugggguggaggaaauguuugguccugaaugccuccaccuuccuaauagcucagguguuuauggcucuaggaacuggaggaacccugcauugcaggugccacaugugcaccccccaguguugagugaccacagcagguuaaccccacccacuuagacaaauaaauguaguuuguuugucuuuuuaacuuccuggcuagaucuucaguaaacauccuaacauguuaaugccuagaacaguuaaauucuucuaacagcaagugucucuccuaauuggguaugcugaguuuugcccgugccugcuuucuuccgacccccagggauccugucgacagcagcagucuuaacuagucuuucacucacacaguguuggcuacuaacaagcuaucuguggugcuguaugauagagcaaggaaaacaugcaaugcaugugacagacaagguuuaauaccucucacauacagaaagcacugacaaguggagacaugagcaaaggauauaaccaggcagcucucagaagagaauaugugcauggcugauaaacuucugaaaagcuguacugccucaccaauaauaaagaagugcaaagcugucucaacuucacccaucagacaggaaacauuuuuaaauuaauguuauccagagaugacaggaguguaggaaaguagguauuuucauauguugcugaugggaauguggacugcuaaaccuuuagaaaaguaaucuaaaaguuuauaauaaaacuuuaaaaauuuuguugcacauucuuuauccuuagaaccagcaaucccacuuugagcaauuuacucaaagaaagaaaaacacaucaguguaugaauguuaaaaggauguuaauugccauauuauugugguagucaaaaacugucugucuguuuaucaguaggaaaaugguugaauaauuugucaccaauauuauggaauauuaaggagcuauugaaaagaacauugagcuaggcacaguggcucaugccuguaauuccagaacuaggcuagguaggaggagugcuugagcccaguaguucaagaccagccugggcaacauaggaagaccccaucuuuacaaaaaauuuaaaaauuagcccagugugguggcucgugccuguggucucagcuacuugggagguuaaggcaggaggauugguugagcccaggaagucaaggcuucagugagccaugauucugccacugcacuccagccuaggaaacagggcaagacucugucucaaaaagaaaauuuaaaaauuuuuuuuuguagaaacgggcucucgcuguguugcccaggcuggucucaaacugcuggacucaagcagauccuucugccucagccucccaaaauacuggaauuacaggcaugagccgccaugcccagccaaucuauauuuuuauauagaucaaauauguauuuuuuauauauguauaagaugaaaauacagucagcucuucguacauauccuuggauuccacauccacguauccagccaacuguggauggaaaauacucagaaaaaaaaauuccaacaagcaaaauuugaauuuaccaugugcuaaacacugcauugaauccacacaaaagaagggauguauaggcauaguaguagauauuauaaguaaucuaaagaugauuuaaaguguacaggaggaugcgcauaggcuauaggcaaaugcucugucauuuuauaucaggaacuuaaccauccacugauuuugguauccuugggggagucccggaaccaauuucugagggacaacuauacauauuuagauauagccauauuuauacuugauuuguaggaaugugcauggcacauuguuagcuuuuuuuaaaaaguaaauuucaaaggaacucuauuaucccauuuuuauuauagagaaagaaaaguuuuuuuaaaaaaauuguguguguacaggaggcugaggcaggagaaucacuugaacccgggaggcggagguugcagugagcugagauugcaccacugcacuccagccuggacaacagagcaagacccugucugaaaaacaacaacaacaaaacaaaaaaacaaaaaacuguacauaagguauacugugugugucugcauguacuuuuuuguuuuauuuuuuuuuuugagauggagucucacucugucucucaggcuggagggcaguggcgugauuucagcucacugcaagcuccgccucccggguucacgccauucuccugccucacccucccgaguagcugggacuguaggugcccgcuaccaugcccggcuaauuuuuuguauuuuuaguagagacaguguuucacuguauuagcaaggauggucuugaucuccugaccucgugauccgcccaccugggccucccagagugcugggauuacaggcgugagccaccgcacccggccugcauacacuugauauauguguagauauauauauuuggcccucuacauccuugggugguuucuguauccauggauccaaccgaggauggaagauacucagaaaaaaaaaaaaaauucacaaagcuccaaaaagcaaaacuugaacuugucacauucacgugucugaaugaccgugcacaucagguuguuuguaucaccaaagaguaaggugucaaagaauacacucauuuugaccauacuuuuuggaggggggaguggaaucuuuuuuuaaauguaugucauauggcuuauugugaaacagguuuuguguuuauagucuaagaagaaauuccuuccacauuccucacuucuguuuuucuuuuauagugaguaaagugaugugggauuauucugagguagagguaaauaaacagcaaaucagaugagacauuugcguuuuguugaaaaaaaaagaauagaaguacaaauauuuacauagcuauacuuaaagcuggcuucuuauucucuaaauauuaggagacuaaagugcagauuuuuaaauaucagcucccauucuauaagcugauauugaaaugcaaaaaauuaaaaagugaauguauguugagaauuuggcccaucagugguaaugauaccauguuggaucuguuggggcaaucuaacaaugguuuuacuaguugugguuacuauuugaagguguuuauuaagaauuuauucuaagagauugauaggaaaaucaggaaauucaccauaagagauaauacccauuuugacugcauuacuauaaaagugacauuuuuuuuaaauucauaaauaaauaacuugcacuaauuuuaguuggacauaauaaaagcuccacagagaauauuuaacuaaaagugaauuuuaaaaaaaaccuaagaaaugccacagugaauaagguugaugguaugucuagcagcggaguccaccacugaccaaaacacugaagaacauuucagggagugugaguggugagcagugcauaacuuagugaauacacuaaaagccacugaaguacauacuuuaaaggggugaacuuuaugggacaggaguuauguuucaauaaagccgcuauuaacaaaaggcacauuuugacauugaccuuucauauuuuguuuauuuuucagaucccuuuugcaagauauguggcaagaaauaauauauugaauuuaaaacgguaagaaacaauaggagauuccauuugguagacauaggaaaauaguugaauaauuugucaaccaggaaagaauauuuuauuuccugugauccuuacacaguuaagaauucuggguucagaauauugagcuuagaauaugaaccagaagcccagccacaguaccccuuccuguaagguaacuaggacuguuagaaggaauguagcagguagguaccgucauguucccacagucuauucuguaccuucuaaauguccccaagcaacauuacuaauuauuuucacaaacgguugcuugauaaaaacaucuggcuguucaugaucacagauggccccuuuuaaaacuuaauuggugggacaaauggccaguggucucuaugugaaaacugccuacacagguaaccgaacaaaagcugcuuguagagaaguggaguaaacccagcaggaacgcugagcgcugaggaccuccaggcacuuagcccuggaaaaaggcuuucuguacauucaaauaccacagggguccaacacugagaucuucauaauuuggagcaguauuguugucaaugaggcacccuacuuuaaagcuccuuucuucaacugaaagcaaagcucuuuacaugcuuuuauucuagcuacaagugaauaauuaauaaucguaguccuaugguguggguaucccuguguagaaagcaaucacuaagguaaaauuuuuugguguaauuucaucucuauuucagacauuuaaaaaaccuuaagccccauagcuuaauaguggcaaaacugggaauuggaaccuagaucacaaggcaaggcuguuccaggucaaauuugucuuucaguccucuugaucauaccaccgauuaauuuuuuuucauauuuguuucuuauaucuuguucaacaauuucuuauacauauuucuuucuaguaagcaaugaccuuagaaaucuggguuucucucuccagauacugcauagaacguguguucaggccgcgcaaguuagaucgauuucaucccaaagaacuucuggagugugcauuugauauugucacuucuaccaccaacagcuuucugcccacugcugaaauuaucuacacuaucuaugaaaucauccaagaguuuccagcacuucagguuccuuuccauauuuuaacauuccaagauuccccacuauauuucuucaccaagugugguggggaaaaccacagcuacagaccugcuucucagucuguccugcagaugaaucacaucuuuacuaaaguaacugagaagagcuugcugguguugcuuuugagguucagcucaggcucuuaccuucacaggaacugguuuuguuuugggggauggguauucucugcccauucuucuaaaaugcaagauaucaggcuaagauuccuaagaugcucuuagccuguucauacccuguuuggaacccucaguggcucuauccuacacccgaucucuucacuccccaacuucccuuuucaccaagucugcaugcugccuagcugguggggacugcugccagcacuucucaggcuucccuccccaccccacacacacacccugucauuccugccaccgucagucaaauguucccuugucuagaaagucuuugcccagccaugguuugggcccuuucuccccaggaagccucacugcacccucauuaauuaguuggccaccuuuucuucucaacucucacaggucuugaucugagacacccauguacuaccuugaguuauguucauuguuuucuccaagcagaacauguguuuuuagggcagagccuacgaguccgcuuugccauauacccccauugcagccagcucggcacauggcucaccacucggugaauacucauuaaucgauuuguguggacaaaaguuaacaauaacuauuccacuggccugugcuuaugagucgauuacuacuggaccagauccuucugucuuugaaaucaacucucucgggcuuuuuaacauagcugaagaccagucagaguuguuuuuguuuuguuuuguuuuguuuuguuuuguuuuguuuuggagacagugucucgcucugucucccaggauggugugcagugauacuaucacagcucacuagccccuaccuuccaggcucaagcaguccuccugccuugcugcuugaauagcugggucuacaagcaugugccacugaccccagcuaauuuuuuauuuuuuuguagagaugggguuucccuauguuccccaggcuggucuugaacucuugagcucaagggauccuccaaccuuggccucccaaaaugcuugaauuacacaggcaugagccaccaccccagccagucugaguacuuuggauauauauaauauaguauuaaauuagaguauacucugacuauaacagugcaaaaagaauguaugaaaaaaaaauaaacuaggaagccauaugcuaaauucaauccuuccauuguguuaggaugacaaauuggugguaaguuuccagauuuggucauguaccaguaauugcuuuuauaaugaaaauaguaauuuuucuccauaucccaggaaagaaauuacaguauuuauuugaaccauaccauguuauugaaagcaauacucuuacacugugggaucccagaagauaaacucagucaagucuacauuauucuguaugaugcugugguaagcauuuaauuacuuaugauguugaaagauaauaccuugauguugaaagauaauaauaauaguuccugaugauuuucuuacccaugcagccaugaaacugaauugggagccuuaucuccuuccuucauugcucuaaauugaaagaaccaauugauuuuaauuauaucaacaguuaacaaguauugguugagcuuuuguuccauccucagcccuguacuacuaauaaccuccgggguguuuuuuaaaaggcuaacuucuaauuuuaaaagaucaaauuauuuaauuugucagauaguaaaguuauucaccaaccuacuuauuaaggcaaaucacuaaguaauugguccugauacuugccaauaauaauuucaaagauaguuaacauugacugagccccgcucugugagcuaggcauuguucugagcuccucugauggaugaacucacuucauucucacaccagugcugcuauuaccuuuccuuuagagaccgagagcaacuguucauguugagaauaaacagugugccuugcccuugauucuuccagucugccugugcuuaucaguaaagucauguauagauuugcauugauugaauuaaggcagaauggcuucgaacucugguggggccucauuuaccaccuccuuccugugggacugaggcuauggcaccuccaguuacucuucccuaauuuagucacaucauaguauucauuacuuuauaguauaugugcggguacagagacuggaaggggacgcauugaaaaaaugaauuaguguuauauuaugaugcuaagauggaagugaaugcuuauguuuucuaauaucuuuucauguuaaguuuuguuuucauaaugaauaagaggcauccaggagauguaagaacuaacagcaccagaagucuaugguuaagacagaguaguggaaguccucacauaauggcuuauuguuuuuauacaccaaaaggauuaacuagcuuuucuuucaucuggcagguacacaucaauggcccaaacuuuacugcuuguuucuuagugguucuuuacucccccuaaagcucugcugcuguuugucagugacagauacaauaugaugucaaucggacacuggcagaaaccccagggauugugcaaggggcuucagcucuuacugauucauguccugcggcuacggcacaucugccagcgugggaugaaaugcccagagccuggccuuuguuaggggagcccagagcaaaaugacucccucccugcccaaacaaaugcccucauuaagccuguccagauuugggucaccucaccauucagcaaguacaacuuuccccuuuuaauucuuuugucaggguuuuucagauuuuaaaauaaguuaauuacgguuuugugugaauugggagaaaaaauuuuuuaaucacagaauucaaucuauccuguaccauuaggagcaguuuguucaaaaugaaggcuauacuuguuagaauucgccuggaaauugugucuuguucagugccagauuucgcgacucucauuguuaccuuuuucuuccacguuagacagagaagcugacgaggagagaaguggaagcuaaauuuuguaaucugucuuugucuucuaauaguguaaguaccuucuaaugguauuauuacagcuuucucuguaauuuugugauaccagaaaaugucaucaaauucucguugcaguaggguagcagccagcgcuuccuaccaccucgcagaugcaguuuuucccuugaguguuagguaccauggcaaccucugggauuaggagaagggagaaacuaaugcugugaucaaagaaugucucuccaugcuucuucuugauacgcuguaaucauccugcucuuucuugaucagcagauacuuuucuuugucaccccuuauagagcugugccugguagagccuccugcugaacauaccuaauaccaguuguccucuuuugaauuagauuauacaggacuagaaggaggcacagaauucugcaaauucaucuggggagcuacccuuccccuaccuccaugucuucuaacuccucagaguugaauuaaagcucuagcuuuucugguauaucucuuaaucuuaaaaucuuacauuugaucccaucaucaauaagggaaaucuuauggaauaaacaguuuggucauauucucucuguaggcaucagauugaucccagaucuuugguacaguaacccacacuuaauugaguagcugaacaacagaauacaacagggauuuuguacauuuuccugaauauuuaaauaaggaaaguuuuuuuuuaauuucccggaaccugucuaggcccuugucugacacucaauuauaugaucuugcauugaucagcaaaauucacauaugggauagauuaaaauaugauuguacacagggcaggaagagucacucaaucuuucggacaccuacaguguggcaggcacaauggcagggauauaaagaagaguccauagacugcauucagcuucuugguucauauuggccuuuaaaaagccauaaggggauaugcacagcauguaucugcccucaacucuguaaaacagcuuucagagggcacacggaaaccagaguucaaagaaaucaccccuuugcggguagggaaaguaaaccagaugcauagcacuaggaguucugaaaauugagccagguuaaaucuuaaauauuuaauauugggggagauaguaaugauaugcaaaguaacacaacagcuaaauauccaaauaugaaggacaauauacaguauuuacauauaaucuaaacauguacacagcacacaccuaugugcagaaauagucccauguguaaauagcacagagaaucugcacaagacugcucaguucaaugauucuauacccaaguuuccaacccaaaagguuauuuggacuaaagucacauuucagaacaucuuuuuuuuuuuuuaagaaagucuuauaaauauacauucggacguaauagccacauugguuguucacaugucaacuucuuuucuuucuguuaaaucucuaaccacugguuauucgaugaugcuaaguguuaauuagacgugucugauucaguuaaaaacagaaaaauaguaucuaauaaaggcauuugguacuuugauuauuuuaaaauggacucuaaggguauuaggaaggggaguagaaauauugccaaagaguuucacauaucugacccaguccucuuauuucacaaaugagacaccugaggcccaaagagauguugugauuuguccugagucacauggaguuaguugaugauagggugaggaccaaaaucuggagauauugacuucagugcuucugguaguuuauuauugggguaauuuaauguucaaauuuauagagaagaaaucauuuuuauuuucuuaaaaaaauauuuuaaaucgaauacaugauuuuaaauuuaaauuuuuuucuuuuuauuuuuuugagacagggucuugcacugucacgcaggcuagauuacaguggcacaaucauaguucacuguaaccucaagcucuugggcucaagagaucuuucugccucagccucccacuuaauuuuuuuuucuuuuuuauagcgggauagcaggcgugagccauugcauccagccaaaauuuuuaucuuuaaucccucuauuagucugcugucacacugcuaauaaagauauauccgagaguggguaauuuauaaaggaaagagguuuaauggauucacaguuccacauggcuggggaggccucacaaucauggcagaaggcacggaggagcaagucacgucuuauauggauggcagaaggcaaggaggagcaagucacaucuuauauggauggcagaaggcaaagagagagaacuugugcagaggaacuccucuuuauaaaaccaucagaucucgugagacuuauucauuaucacaagaccagcaugggaaggacccgcccccacgauucaauuaccucccacugggucccucccaugacacaggggaauugugggagcuacaguucaagaugaaauuugcauggggacacagcuaaaccauaucauucuacccauggccccucccaaauuucauguccucacaucucaaaaccaaucaugccuuccugacagucccccacagucuuaacucauuucagcauuaacucaaaaguccacaguccaaagucucaucugaaacaaggcaagucccuuccgccuaugagccuguaaaaucaaaaacaagugaguuacuuccuggauacaaugagaguacaggcauuggauaaauacacccauuccaaaugggagaaauuggccaaaacaaaggggcuaaaggccccaugcaagucuagaauccagcagggcagucaaaucugaaagcuccaaaaugaucuccuuugacuccaugucucacacccaggugaugcugaugccagggguaggcucccauggccuugggcagcuccccaccuguggcuuugcaggguacagccucccuccuggaugcuuccauggacuagcauuuaguagggacucuguaugggggcugcaaacccacauuucccuucugcacugcccuagcagagguucuccauaagagccccaccccugcagcaaacuucugccugggcauccaggcguuuccauacauccucuguaaucuaggcggagguucccaaaccucaauucuuguuuuccgugcaucugcaggcucaacagcacauggaagcugccaaagcuuggggcuugaacccucugaagcaacagccugagcuguacauaccuuggcccccuuuagccauggguggagcagcuuagacacagggcaccaagucccuaagcuacauagaggaggggggcccuggggccagcccacgaaaccauuuuuuccuccuaggccuccaggccugugaugggagggccugccaugaagaccucugacaugcccuggagacauuuuccccauuguuuuggugauuaacacuuggcuccuuguuacuuaugcaaauuucugccgcuggcuugaauuuuuccucagagaaugggguuuucuuuccugucucauugucaggcugcaaauuuucugaauuuuuaugcucuguuuuccuuuuaaaacugaauggucuuaacagcacccaagucaccucuugaugcuuuguugcuuagaaauuuauucugccagguacccaaaaucaucucccucaaguucaaaguuucacaaaucucuagggcaggggcaaaauucugccagucucuuugcuaaaacauagcaagaaucaccuuuacuucaguucccaacaaguuccucaucuccaucugagaccaccucagccuggauuucauugaccacaucauuaucagcauuuuggucaaagccauucaacaagucucuaggaaguuccaaacuuucccccauuuuccugucuucuucugagcccuccaaacuguuccaaccucugccuguuacccaguuccaaagucacuuccacauuuuuggguaucuuuacagcccaacucuaccgguaccaauuuacuguauuaguuuguucucgugcugcuaauaaagacauacacgaaacugcguaauuuauaaaggaaagagguuuaaugaacucacaguucucuguggcugaggaggccucacaaucaugguggaaagcaaagaggaacaagucaugucuuacaugguuggcagcaggcaaagagagagaacuugugcagggaaacuccucuuuauaaaaccaucagaucuugugagacuuauucacuaucaugagacuaucaugggaaggacccgcccacaugauucaguuaccucccacuggaucccucccaugacacaugggaauuguaggagcuacaauucaagaugagauuugaguagggacacagccaaaccauaucaagauuauaggagguuuuaacauuuuuuggguuuuuuaaaaauuuaagugauuuaugauuaacucuaagauuaagcuaugucaaucugagccuucauuuagcccuuagguuucaugugccaauuuauggaugaacuagguuguacuugccuacagucuuaaaauggcuauaauuuuguuucuuaauaauuucuacuuuagcuccugggaguuuucuuucuggcuuuaugacuaugguuguuuccucuuacuccagcugaguaccagggacugugagaucaaucaucucuagccacugaccucuucuggggcagucuaugaguacagcuggugacagccaggaucuggcauccaggugggaggagagggaagggaggaucaggaggcugcccacaggagaagacaucucaagguugcaaauaggaaugauucaagccaaggaagggaauuucuagcuaauucuguauuaaaacaagucagacuuugccuuauuguccccccaugucuaugccugcaguaacaggaauucaugagaauaagaaagguaaagaggaaaaauacuggccugaaaauagauaauggaagcucugcuagugccagggucugcuuugcuggggucagcauuaagugugaguaaauguaucugaauaaaagugaaccaugaguaugugucuaaagcauuccugcaaggugcuuucaaguuguuggaaaaggauaauccuuagucaggauuguggcaaagccuaaaauaaucuuugaccacaaagauaaucguagcaucccaugugcuccugcuccugcaggugcacacagucggugcaaagggagucuuccccugcuguggaugggcagcugacugugccccuuugcuuuccagcugugucgacucuacaaguuuauugaacagaagggagauuugcaagaucuuaugccaacaauaaauucauuaauaaaacagaaaacagguauugcacaguuggugaaguauggcuuaaaagaccuagaggagguuguuggacuguugaagaaacucggcaucaaguuacagguuuggcaacaguuugauacuggcaguacaaauguguagcauuacuaauagcacagggaggaaauguguuucauuucacuaaugcuaguuaguguuuuauuuuuccagaaaaacugcuuucuguguuuuggagcauuugauauuuaguaauaauuuuggcuuaaaucaggauuucuuugcaagugccacuguuccuaucaugaagcaguucuuacuauguuagccucagagaggugguuauucuuaaagagaagagaauuuauuuuacuugucaggcuaugguuaaacagacuuugagcuagaucuuacugaauauuuuguuuaugcuaaauagauuguucugaugcuauugaugggaaacaccauuuucagcauuauauuccacauucuaaauuucaaacccuugacacauuuguguggcaucucucuuuauaggucuugaucaauuugggcuugguuuacaaggugcagcagcacaauggaaucaucuuccaguuuguggcuuucaucaaacgaaggcaaagggcuguaccugaaauccucgcagcuggaggcagauaugaccugcuggugagggcuugcccuuuauuuauuugcucugacuuaauuuuauuucuucuaaacuuguuauuuugaaauuuucaaacuaacaccaaaaauuugaaccaguaauaucauuggauacuucuauuaauauauguuucaucuaggaauagaaauauaaugugaaccacauuuguaguuguuuaagcuuaaaacaauuauauuauuuugcaagauaguugcaaagauaguacugagagggcucauguacccuuuacucuguuucuauauauauauauauauauauauauauauauauauauauauauauauauauauguauuuuggagacagggccuugcucugucacccaggcuggagugcaauggcgcaaucuuggcucacagcagccucgaccucccugggcucaaaugauucucucaccuuagccucccgaguagcugagacuacaggcaugcaccaccacacccagcuaauuuuuuguauuuucaguagagacaggguuuugccauguugcccaggcuggucucaaacuccugagcucaagcaauccacccaccucagccucucagagugcugggauuauaggugugagccaccacaccaccccuugcauaaguacaguaaaauaucaaaaccagaaaauugacauuuguauaauguaugugcaucauucuucuccauuuuaucacguguacuuucccucaacaaccaccauaaucaagguacagaacuauuccaucaccacagagauuuauggguaucaacaucuuaucaauucaaaugaaauguagaaacuuuaucucccuguaugucucuuuaccucaugccccauuuauaauauaauugucuuaaauauuucuucuaauacauugagauccacaucaaacaguguuaaauuuuuuacuuuacuguuaaauauaauuauaaaacucaaggggagaagaaggucuauuguauuuaccccaaauuucugguuugugaugagaaauuugcuguuauuugaguuacuuuuccccuauaggaaaguuauuucugacuugaugcuuuaaagauuauuuucuuugucuuuaguuucaaauuaaaucaugaugugucuuggcaugaguuucuuuggauuuauccuguuuaggguuugcuuagcuucuuaaaucuauagguuuaugucuuuugcgaauuuggaggauuuuuucaggcauucuuugauuuuuuuuuucagucucacacucuuuuuucucuccuucuaugaccccagugacacaaauguccuugagguuaugggacauuuuuguccaggcugaucucacacuccuggcugcaagcaauccuccugccuuggccuuucaaagcacugggauugcgggugugagccaccacaccugaccuguaauuuuaaauuauuuaguaacauuaaguaaaaggagacaagugguauuaauuuuauaauauaucuuauuuaacuuaguauauccaaaauauuauuucaacauguacucaaacuucuaaaaauuauuaacaaggauuuuacauuuuuuucaaagucuuugcagccaguauguguuuuacauguacagcaugugucaauuuggauuagccauauuucaaauacucaguagucacuugugacuaguggcugccauauugaacagugcagaguuagaugaaacauuuguuaauauuuuuucuaaauuugcaugugugcuugcuucucuauuuuacuacacacacacauuucuuuuuguugaacucuuugaugaugagcugcugacagagugcucacucuuuaaucauuguuuuccccguaaucacaguuucuuuccuauuucauaaccauaacuguuugugucucuccacagauuccccaguuuagagggccacaagcucuggggccaguucccacugccauuggggucagcauagcuauagacaagauaucugcugcuguccucaacauggaggaaucuguaaguucuggcuuggcuucccagcauacuucgaggugucuuucauuucuaaaaguaugauuugccuuuugcagucauuuacauggggcuucugaugugaaagcuauagacguaggguuuugaaacuuaccuuuaauaugauagacaagccuaagacuugaugucaaucccugcauuucaguccuuaucaucuguucucuagcuggacgaccuuagaccaggggucccuaacccccaggcaguggacugguacccauccagggccuguuacgaaccgggccgcacagcaggaggugagcagugggcaagcaagcauuaccaccugagcuccaccuccugucagaucagcgguggcauuagauucuauaggagcaugaaccuuguuguggacugcacauggaagggaucuagacugcacgcuccuuaggagaaucuaacuaaugccugaugauccgagauggaauaguuucauuccaaaagcauccccucccaacccccgcaccauccaugaaaaauuuucuuccaugaaaccagucccuggugccaaaaagguugaagacuucugccuuagacaauuaauucauccuucccuagacucauuuuccuuaucuguaacguaccauauaaaugugagauguuauaguuguuaacaggcucuuaacaaaacuucuuguucaggccaggcaugguggcucaugccuauaaucccagcacuuuggaaggucgaggcaggcagaucguugagcccaggaguucaagacuagccugggcaacauagcaaaaccccaucucuaccaaaaaaauacaaaaauuagcugggugugguuaauuagccaugcaccuguaguuccagcuacucaggaggcugaggugggagaaucguuugaacccaggagggggagguugcagugaggugaaaucaugccacuuccacuccagcuugggcaacagagccagacccugucaaaaaaaaaaaaagaaaaaagaaaagaaaagaaauccugcuguggucuacaaagcuagaaauagcuuuuuuucccccuuguauuucaggcaagauuaguuuuccuagagaaaaaugguauuuuccagauggcucaggguaguugaaauaauuucugucuugaaagacuaacauaacauuuuuuuuuuuuuuacuguggccgagcaugguggcucaugccuguaauuccagcuauaucccaauaaggccaaggcagguggaucacuugaggccagaaguucgagaccagccuggccaacaagcagaacaacaucccuacuaaaaagaccaaauauauauauguauauauauuuauuuauuuauuuauuuauuuauuuuagccgggcaugguggugcacgccuguaauccagcuacucuggaggcugaggcaggagaauggcuuaaacacaggaggcggagguuacagugagcggagaucgugccacuguacuccagccugggugacagagugagacucugucucagaaaaaaaaagaaaaaguuguuugagugugucuuuuuuuuuuuuuuuuacaauguguuuugaagcaaagucuuuggcacgcuguguuucuaugcaggauuucaagaaugcccaucuucccaagagugcugccuccccuccugaugcugguuucacuuccaugccugcagucuugcuccucuaacuguaaccggucuguuucugauccagguuacaauaagcucuugugaccuccugguuguaaguguuggccagaugucuauguccagggccaucaaccuaacccagaaacucuggacagcaggcaucacagcagaaaucauguacgacuggucacagguaaugggacaaaaagcaccugugagugaagugcaaauugcuauggcuuucauggcaaauauccucugcaccuauagacugucaaacucuguuuaucucuguaauucgaguugccuccuguguuaguuucugauugcugcaguaaccaauuaccacaaacuuacuggcuuaaacacauauuuauuaucuuacauuucuggaagucagaaauccaaaagcacuuucacuggguuaaauucaacagggcuggcuccucugggaagcucuaggggagaaucuguguccuucccuuuucuggcuccuagaggccuccugcauuccuuggcucauggccucuuccuccaucaucacacucagcaaugaagcgccuccuuccuugcugaccugugcuucuguucuuacaucugucucuaacucuugucuguccagcucccucauacaugcacccugugauuacguggggcccacccagauaauccugguugaucacucacagguucuaggaaugaggauauggacaucuuugcggggcuguacuccagccugccacacuucugaaggcacucagugcuuaguguguuuugggcucuguauccugagaccucccacagcaugcaggccugacacuugccguggguguggagguguggaaaguggcacccaggacacaugccugcccuuuggaaugggggcguaagcagaccauagaaggggugcacucccaggagaucauccagguuguacccacauucgcccacacuaaaggugccccagagcauggcgaugaccagggacacagacccaccacccucccaccugcucuguuuacaucaccugccaggaggcuucugaagcugcugcuguuuacucguguguguguguuguaucaaaauucacaucagaagugugcugagcaacaauuuuuaaucauuugacagaacaguguccucuucuacuuguucacauguuucauaaaucauuagagaaguguucuguccugcaguaaaauccaagccucguggccagugaccucaguccugcacagugacaccccacaggcuucucugcccccuccugguuugcuucuucaguucugcuuuucaccuucccuuauuuccuuuguuuccuucauuuuccucagaggcuuuuucagcguguguguguguguguguguguguguguguguguauguuguguuguauaauuuugggcaucuuuuauuaagucuugaagcuuuugaaaaccucuuacuauugauugauuauucauggcccuuuaaacaaucaugaagggaagggaggcaagagaggccuuguuccucccuugaauucuaugcggcuucuugcuuaauauuuauaucccccugaagucagcauuuuaguaauucacauugagaauauaauuggaaacaguauuuucauucuccuuaauuacuugaagcuguuccaggugcucuguguuuauuuucuuuacuauguuuguuuguuucagucccaagaggaauuacaagaguacugcagacaucaugaaaucaccuauguggcccuugucucggauaaagaaggaagccaugucaagguaaagacgucagagauuuuuuacaauucaauaguuagguguuaccuguggagcaccugccuucacacugaggcccgggccguguaggugacuggaaauccguucccucuacucucccuuuccauuguuggguuucuuuuuuuuuuuugagacggagucucgcugucucccaggcuggagugcaaugacgcaaucucggcucacugcaagcuccgccucccggguucucgccauuuuccugccucagccuccccgguagcugggacugcaggugcccgccaccacgcucggcuaauuuuuuguauuuuuaguggagacgggguuucaccauguuggccaggauggucuccugaccucgugaucugcccgccucggccucccaaagugcugggauuacaggggucagccaccgcgcccggccguuguuggguuucuugcugaagaaaauguguauaaaauaaggaagagaguccaccuucauuaaagcuuuaaaaagcaaaacaaacaaaaaaacuggcugugguuuuuuccuacuuuucuccucuuguucucuuuuuccagcuaagaaaauaagaauaaguaaaguuguaucugcugauaggcauauccucucauugcuuuguaaccaauuuuacuuuuuuguauucaacuaaaaguguucauaaauauaccaccucauaaccuuuauuucuaauuauuuuuaaagggaaaaaaacuuucuuaaaaauauuuuucucuucuaauuuuuuuuugguuucgauaucaggguaauguuggccugaugaaaugaguuggagaguguucucuccucuucuguuuucuguaagauacuguauacaauuaguauuagaaguccaaucucaaauauuucuauauauagagcuauucugguuaccucuuucuucuagaggcagcuuugguaguuuauaucuuucccggaacuuuuccauuucgucugaguuuucagauauuccccuguuauuguuucacugucucuaggaucugcagugaugcucccuccuucagaccugauauggguaauuuguguccucccucuuuuuugucuaaucagccuggcuagagauugaucaguuuugucuuuccaaggaccagcuuuuggugucauugauuuuucucaguuuuuauuuguucauguguuuucuauuuuauucaucuccacucuuauccauuacuauuuucuuccuucugcuuauuuuggauuuaguuuauucuuuuuuuaguuucuucagguagaacuuuagaugagguauugacaaacuacaccuuggaccaaauucagcccauagccugcuuuuauaugucugugaacuagaaauuuuuacauucuuuguuaaaaaacaacaacaaacaaaggagagugugugacuccaacuauguauggcccucaaagcuuaaaacauuuccuaucuggcccuuuacagaaaaaaauuugaagcuuuguuauuauacauguuuaggauuuuauaucuucuugaugaauugucuucaucauuauaaaauauuccuuaucccugguaauauuucuuguucugaaaucuuuugguuaguguuuacgucacuaccuuucuccauccuuuuauuuuuaaccugucuuuuuuuuuuaagagaugggggucucaucauguugcccaggcuggccuugaacgccugggcucaagcaaucuucucaccucagccuccagcugggauacaggcgugugccacugcaccuggcuaacuuaucuaucuuuauauuuaaagugaguuucuuauacacagucacuagguugaguuuuccuuuuuuuuuuuuuuuuuuuuuuugagauggauucuugcucugucacgcaggcuggagugcaguggugcaaucuccacuugcugcaaccuccaccucccaaguucuccuaccucagccuccugaguagcuggguuuauaggcacacaccaccacacccagcuaauuuuuguauuuuuaguagagacaggguuucaccauguuggucaggcuggucucgagcuccugaccucaugauccacccaccucggcuccccaaagugcugggauuagaggcgugagccacugcgcccagccuccuuuuuuuuuuuuuacucugagaauccuggcuuuuuuuuguuuuuuuuuuugagacagggucucacucaccuauguuggagugcaguggcgcgaucucagcuuacuggaaccugucucccaggaucaagugauccucccaccucagccucccgaguagcugggacuacaggcacgcaccaccaugacuggcuaauuuuuguauuuuuaguagagacgaggucucuacuaaaugccaaaugccaugagauuugcuaaaugccaugagaguccuacagauaaaguucuccaagggucccucaggcugggagauuuacauaagaggcagcagugaagucuucaggaaggugcugggauuuauccuacccucaagaauucgugguccuggaagggccuuuuaggaagagggaacugcaaaggugaugguaguucuuuuaguaguugucccaaagauagaggcaggccagcagagaaccauucugguacaacccugaauagucuauuuugggugagacagauggaucagaagcagaaaaugguuauagcuacaucauggagagcccaaaugccaaccaaggaaucugguuuuuuuauuuagcaguuauuggggaggccccgaauguuuugaacagaaggagacaucaaaguuguguuugagaaaaauuaaucugcagggauguguagcauggaauagagugagggagaaaccgaggacagugauagcaguauaaagaauaucaaacuagccuaggccaagguugggugcuggccaggggagugaagaugaagggacagaugccauaaaagugggaugacaggacuuggguuuagaaaggagagggaggagugguagaugaagcugagaucugagaaaccuugguggcugaccagauuuaaaggggaagauguuaaagaaucacaugaaaugagagcccauucaucuuggccuuaaaaaaaaaaaauucuaucaucugugauaaacuaguccagaccaggguuucucaacagcagcgcuguucacauuuugggccaaauaauucucuguuguagggggcuguccugugcauuaacagcaucucugaccgcuaccuacuacaugccaguugcaccauccaaaaaugucaccagacauugcuaaauguccccuggggagcaaaauugacccugguuaagaaccacugacccaaacuauugauuuaguagucuuacuguggugcucugagcuagucuucuggguucagaaaccuccaaaugauagauccguuucauucuuuuuaagguuaagucuuucgagaaggaaaggcagacagagaagcgugugcuggagacugaacuuguggaccauguacugcagaaacugaggacuaaagucacugaugaaaggaauggcagguaacuuaggaaacaaaagccgagaaaagugacuucaguuaccuauauggaaacuacguaaauuuauuuuaaaagucaauuugagccaggugcuguggcucacaccuguaaucccagcacuuugggaggccaaguuuggggaaucacuugaggccaggaaugcaagaccagccugggcaacauaccaagaccccauuucuaaaaaaaaaauuuuuuugauuagcugggcaugguggugcauuccuauggucccagcuacucaggagcugaggugggaggauugcuugagcccaggaggucaaggcugcagugagccauguucauaccacugcacuccagccugggugaagagaaagacccugucuaagaaaaacaaaaagaaagaaaucaauuugauccuuuugagaaacaaagauaggucaggauuacuuuuaaugaaccauucuguugcuucugaauaacucaaucaggaguuuaauuguaugaccaucuuguaugagacuaaucauagcuuacauucaacauuuguucuucauaccauuuccaagaauacuuuaucauuuugaaaagccucaggagccaaaaucuaucugucauuaucuuauucagucugcuaaucagugaauuucaauaauauuuuguccguguacuuugaaagauguaacguucugggaaaagaucucacuuccucaugaugggaguaucaaccauauggguaggaauuugacaaaguaaauuaaaagccuuaaaacuaaacauuuuuuuuaaauugacccagcaauuccacuuucaggaauuuauaauaaaaauuauuuuaaagaugucuaucaaggcucauuuauaacagcaguucucaaacuuuuuggucuuagaaccccuuuacacccuuaaaaauuauuucaggaucccaaagaacuuuuguuuaugugaguuauaucuauaaauauuaaaacauaaacauuuuaaauauguuuauucauuuaaaaauaacaauaaccccauuacaugcuaacguaacauauuucuauugaaaaacaacuguuuuccaaaagaaaauuaacuuaguaaggaaaauggcauuguuuaaaauauuugcacaucuuuuaguacacuguuuuacauuuuuguaaucuauuuuaacacuuuaguagaagaaaugauucuccugucuguuuauguauucaaucuguugugauaccacaaaucauauagucucuggaaaacucgguugcacauuuaugagaggaugagagugaaaaggcaauuaauauuuuaagauuauuaugaaaauaguuuugaccuugcaagaccccuugaaaggauaugagggaccuucaagauucucuagaccacacuuggagaaccucauuucaaaauauacauugguagaagauuguuugaauuaugauaauuuggugaaauauugugcagccuuuaaaaaugaugauucuacuaaagcugaguucauugacauggaaagauguccauaaauaggauguuuaauauaaucccauuuuguggccgggcgugguggcucacgccuguaaucccagcacuuugggaggccgagaaggggggaucaugaggucaggagaucgagaucauccuggcuaacacggugaaaccccgucucuacuaaagauacaaaaaaauuagcggggcaugguggcgggcaccuguagucccagcuacucgggaggcugaggcaggagaauggcgugaacccgggagguggagcuugcagugaguggagaucguggacugcacuccagccugggugacagagcgagacucugucucaaaaaaaaaaacaaaaagaacaacaacaacaacgaauauauaaucccauuuuguuuuaaacaaaauauacaaccuauacauaaaaaaaugucuagaagaacguaccaaauuuuuaauuguaguuuugguuagugggauuacaagggaucuuaaauuacuuuguuaagcuuuucuauauauuugcaacuccuuuuuuuuuuuuugagauagagucucacuuuugccgaggcugaagugcagugguguauacaugacucacuauagccuuaaccucccaggcucaggugauccuuccuucuuggccuccugaguagcugggaccguagucauguaccaccuuguccagcuaauuuuuuuaaauuauuuguagagacaggaucucccuauguugcccaggcuggucuccaacuccuggacucaagcaacucucccgccucaagaaauucuuauauguaugcucauuaucagaaaauaccacacgguaauuuuucuggcuuacaucagcaauucucaaccaacaaugauuuugcuucccagggcacaucuggcaauguauggagacauuuuugguugucacaacuggggaguuuuacugguaucuaggagaggccagggauacugugaaaacauccuaaaggguacaggacuacuaccccccaacagagaauuuucuggccuaaaauuucaguaguaccaagauugggaaauccuggcuuacagaaaacaaaccuugcucuguucuucucaugcccccaccccuucuuauuugcaccuagccuuaauaaauucaccauuagguguuucugagggaacauaauguucuggaaaucaccaguauuggaauuauagaucuaaaucaaagacagagguuuagaagagaaaccaagaaauagccaaguagugaguaugggggaacauuaccaagacacuuaaaaggcuacaugggauuuaguuuuagcagggaaagguucaaaguuuuuccuccagcaaaugauuauuucccuguuuucccaagauagagugcuguugucucucucaaaggcuauaaauuaauucacagcauuugaaagaacauccauucacggcuuuuuaaagaauaucuuuauuuaccaaauguucuccugugggugguugccaaggcuacugccauaaugaagguggggcugcuguuauucauguuuccuuguauuaugaggggggcggaaagaacacccauuauauuucauugaaaucagcuuauuguguggauccaggauuucacgcccagcugaauaaaucagaauguuuuccuuaggcauuuguuaacuuaaaaagacauccuuuauaauuuuuacuugcucuugaccaaagcauaacuaaaugcaaauuuuuuguuuuuguuuuuccaccaauaaccaagaagauguuuuuauauuuaauggaaaaguggcucacuauacauguaguucacuguaaguuauguguugcuugugccuuauugacuguucuuuaauuguuuuuguuugcuuguuuuuagagaagcuuccgauaaucuugcagugcaaaaucugaaggggucauuuucuaaugcuucagguauaauuacuaauuauaaucugaacauaaugaugcuuauauguuugcucuaagcacuuauuacuguagcuaacugcuugugacacuggaaaucuauuuuuaaaauaacauauacgcaauaaauuguaccacaugggaugcaucccuaugcuuugaaauccacauccuagaaaaggauaaaacaacuggaauuuagcugacucuucuacucuaucucuuauuuuuacaagugauuuaaucuuccuuuuacucaauuuauuguacaagugaaauguguauaauuuuccuggagauuuuccucauacagaggauugaaggaaguauuuugaaaucccuugaagaaggacacuauacacauuuuguuuucgugaaagccaagagggcacaguggugauaguuaugccuuugcuuucaucaccucuagcaaccuuacuucuuuuuuaaagaaguguuccaauuaaggccaugagaagacauauuuggcuuuuaacagaauugagucuuucccauucucuucuguuagcacuaacuuuguguugccaucagauuuccaauucuugcaggaauuuaaagaaguaugcagguuuggugauauucagcuugauuuucuuaggccccugagguuuugaugacuccuguugccucccugccccuuccaccaccccccaaccccugccugaggagagaagcaucaaaacugcuggguguugggguucugggcuccucaccuauccggugcagaugguuguagggauagaaaacacagcccagucgugaucuagcccuuagaaucacgacaggaugucuacuaauaaacucugccaucucucuguaguauguuguagaaagugggaccagauaaggccauaaauucugaaacucucuuggucucagguuuguuugaaauccauggagcaacagugguucccauugugagugugcuagccccggagaagcugucagccagcacuaggaggcgcuaugaaacucagguacacugggucaggguuucuuuggcuuucuaauaugaguuacagaagagaaaaacaacaacaggaaaggaaaauaagauaaacauggaauuucuuggaaauauuuuuuccaagaaaaaaauuuuucuuccaacuugccuaacuggguggcuucuggcuccaggauucccaucuguccuucagagaggggccauugugcacugugggcaccucaaggcagcuguugucagagugacugcaucuaaaugaaaacuaucuaaucuggcucuaaagguaguugagguuuguuugugcucuaaauagcaaaguagaagaggccgaugacaagacuuaaggcaggcuucucauuccauacaugguuucggcauuugcuauaugccuacuggugugcuaagggcuguguaaaauguagaaaacauuaacauggccccaguccucaaaagaguuuauaacuuagaagcauaugcauuauauagagaauaauaaaagcaaauaaauauaggccaggugcgguggcuuaugccuguaaucccagcacuuugggaggccgaggagggcggaucacuugaggucaggaguucgagaccacccuggccaacauggugaaacccugucucuacuaaaaauacaaaaauuagccaagcgugguggcaaacgccuguaaucccagccacucgggaggcugagacaggagaauugcuugaacuggggaggcagagauugcagugagccaagaucauggcacuacacuacagccugggcaacagagcaagacuuugucucaaaauaaaauaacuacaguagaacacugaguuaaauuuauagaauaugaauguuagaguaugcuguggacauaugcaaaagagugaguguuaaaagagagcagucaauuuuagaaauguaaucagacugaaauacaaaaaucagguacuuuauuuuuguaagcucuucuagcuguuucucaggauuuggguggaaaccuauuuuucccgucuuccuacugccuucaucaccuaccaaguuucaguucucacaccauguccucauugcugccaccucucccuuuuucccaauuuagcuucauacuaucaucucucugucucugugugcacuguuucacugcgcuacgccuuuauaaggaaucauuucaaaauuaugaagagauaauugacaaggauuauuaaacaaauggucaagauaaguuauaaaaaccucauuuccccugagaucauauugcuagacaccccuuucugaguggauuaagagcaaaucuucuuuuuuuuuuuugagacagagucucacucugucacccaggcuggagugcaguggugcaacaucagcucaccacaaccucugccucccauguucaagcgauucuccugccucagccucccgaauagcuaguauuauaagcgccggccaccaugcccugcuaauuuuucuauuuucaguagagacgggguuucaccauguuggccaagcuggucucaaacuccugaccucaggugaucccccagccuuggccucccaaagugcugggauuacgggcaugagccaucguacccagccaagggcaaaccuuuagacaccauuuggaauccuuucuaggcuuugguauguaacccugugauuguauccugggauaggaaauaagauggcaagaaagauggcuugguuuaacauguucugaauuccauuuucuuacuauuuagguacaaacucgacuucagaccucccuugccaacuuacaucagaaaagcagugaaauugaaauucuggcuguaaguggcuuucuuuaguauuuugaagguggcuucuguccauacugucaaaguaguugccucaggguucagagcuuuuuugcucagugucagcagaauuuggaugcaggccuuauugugaugugaacuacacgcaauuuaaaacuauuaagaacuagggggagaauuuaagguuuuuuguuucuccucuuuguuccucuuuaagauagaggaaaaugaaaacaaaagucauuuuccuacauauaucaggccuuugccuugcuaagcuuacaccgaauacauguagcagcgucagaccuuucgggugugguguagagggacagggaguacaguuuccacugcuuauuaauucuccagggcuaagaucuuaucacugcacaguucauuaagcccuuuuacagcacaauagcaucucagacucugcaaacccuauucauacugcugcauuucacgugacacuauggucacaaggcaguauugugcugcugagaguugauguacauuuguguguauucacagguggaucuacccaaagaaacaauauuacaguuuuuaucauuagagguaagcaauaugaacucuucugcacuguggccuuuaagaucccaaaucuuugcuauuaguuugccaaaauacugaagacggcauucauuagugauaguauuuuucuggcagcugcaggaauuuaguaacauuuuuccuuuuauguaacauauauguuccuaaauccuauguugaaggacucauacuuuucuagugacuuuauuuuucagauacuuauuuuauuaaaaacaaaaaacaaaaacaaaaaaacacauauacugcuuuuacuaugugucagggucuggcaggccuuguuguaagcauuuuacaaguaguaacucauuuaaucauuaccaccccaaaauguagauacuguuauuaucccuuuacagaguacggaaguagagagguuaaauaucuuacccacagucacccagcuaguaaguaguagaaccaggauuugaaccuaagcagacuagcagaaucgguguucuuaaccacuauacuauacuaucucucaaaccuccauuccagcuagggaagcucauuugcagauuaguacuauacaaaacaaaauccuuuuguaaaaauuaauuagguccuuuauaaauauauauauauuuuuacagguacaucccuuuaucaucaaauagccuaaauaagaacuuuaaaaauuugaauaguuaucuuugcuauuaagaacacucaacuauagucauagcuacaggugacuuuugcaacaugucauaucaaagaauacuuuuuugucuauccagaguguuuagucacaaauuaaauuagauuaauagugaacuuagcccuagaacuaguauuuuauauaucauuuuuuguucucuuacaaauaagcauauaccacuaucucacuggcaguguacugauuuaugauccagucaaauggauauacuuaagagcugcuaucaccguuguacaaaaaguaaacagaggccgggugcaguggcucacgccuguaaucccagcacuuugggaggccgacguggguggaucaccugaggucugggguuugagaccagccuggccaacauggugaaaccccaucucuacuaaaaauacaaaaaauuagccgggcguaguggcaggcgccuguaaucccagcuacuugggaggcugaggcagaagaauuacuugaacccaggagguggagguugcagugagccgagauugugccacugcacuccagccugggcaacaagaccgaaacuccaucucaaaaaaaaaaaaaaaaaaaguaaacgguaggcagaaauaacugcucuaaagucacaucagcacacuagggcugcagcauuguuaaucaggcucuaauuagggagucuuguuuuaaggaaaacuggugcuucagaggaaccccagcagucuccuaacugguucugcuaucucccuauuacugauucuccugguauacuugaagagggaaaugacacuggaauuucauuagugacccagaaaaaaccagcuaguaaacccuagagaccuguuguuaagucuuaucuauuuuuuuccuagugggaugcugaugaacaggcauuuaacacaacugugaagcagcugcugucacgccugccaaagcaaagauaccucaaauuagucugugaugaaauuuauaacaucaaaguagaaaaaaaguaaguuaucacuugggcauagcaggguucacaugguuaaaauucagggcgggggguuucagagugacauuauuuuguugucuuguugagguuugacgccugguaagcuguucuuagaauugcagcugacaaccaauaaaucuugcuuggacugugaaucacagucaugaucucaucaauaacaaaacacagggguccuaggaguagcugucccaauuacaauuuuguucacccagguaauucacuuucuaaguauguuuaaaucaaagaaaauaaccaugacuacuuugcuguauguccuuaugucauaaugccaaucaaucaaucaaucauucauguuaucauacacuuaaaaggcaacaaggaagccuaugaggugaaugguuaucuccuuacuaggaccuuauacugcagaccccugucagucacaccuuguauaaaaccuauauaauuuuuuaaugacuagccuuccaucuuguuuuugcuuaaauaaagcuccuacagguguuauaaaaauuuauuagcucuguucuucacucauuaaacugagucuguccuuauaucuuuucuuuucuuuugcagggugucugugcuauuucuguacagcuauagagaugacuacuacagaaucuuauuuuaacccuaaagaacugucguuaaccucauucaaacagacagaggcuuauacuggaauaauggaauguuguacauucaucauaauuuaaaauuaaauucuaagaagaggcugggugcaguggcucacaccuuuaaucccagcacuuugggaagccaaggcaggaagacugcuugaaaccaggaguuugagaccagccugagcaacaaagcaagaccccaucucuauaaaaacuaaaaaaauuaguugggcaugguggcacaugccuguagucccagcuacuccagaggcugagauggaucaucugagccucaggagguugaggcugcagugagcugugacugcgccacugcacuccagucugggacaacagagcaagacccugucuuaaaaaaaaaaagaaaaaaaaaauuuuuuucuaagaagcuguccuacaaaguugagcuuuguuaguuuuucauguguaauauauuauaaauuuaucuuuugggauauaauaaaugcuuucauauac

SEQ ID NO: 13343 - RNA, 565 nt, Homo sapiens
uuucuuuuuuuuugcagauugcagaucacagaacuuuauuaagaugaaaucacugcgaauuacacagaagcuaccagacuaagccaaaauccaugagguucaugugaacuuacaguuacagaaauaagaaacaaauggcauauccaaaaccauaaggaaauauccugaugcccaggugaugaagccuguggggaauaaguccacacauuuauuucaaguuguuaaagaguuugugggccacgcaaugguccguugcaugcaaaaagucaaagagcuccuccgugcaauccucuucuguaugugauugagaggauacacacucaucacagagcuccagccacuccugggccuuuacacauuucuccaacugcuggcauugcucucucacuguuguuaggggauccugauguagaaacacuaauucccccucuucuucuuccuccuccuuaggaucuccagacucggucagcaucuuucgcucguccuccaguccuaugucuggcuacgguucuggauucaacacgagcagcaacugcggcaccuaauccacuucaggaucuagaag

SEQ ID NO: 13344 - RNA, 20731 nt, Homo sapiens
uacuucaauuagaaacggaaagagaagcuuguaagaagcugacaggaaaagaguuagaggcgccaucuacuggagcagcugcaacugcaagacucggacaagaugcucuuaucuacagggauggaugcucucgucuaccgagauggaugcucucgucuacagagaucuccauuaacuccccaaauucuucaacaaaccacagcucaaagaaaccguucucuaccaacaccaacguucuuccuugcaaguacuauccucaacuauugcaggacaccucaaccucuggaagaccacagcaaaggacuguugcauaaauaucuuaccaagauauuccagcucuuuuacuauuggaguguuaggcaaugcgucuucauuaucuggggccagcuuuaagaggaccaauucccucuuuugaaaaugagguucucugggaaucaauggccaauguuuauuaugaaauaauaaacugguccacagcccagacaggcugugugugucagcagcagcccuuauaugacauagcucugaaggaagaauugaaaucaaugcuuuguuuuuguuuguucgguuuggcuuuuuuuuuuuuuuuugacacaucuaaaguuuauuucuuaacucuugcaagaaaaacccagaccucaggcuccaagacuugcaaagacugguuuugagaggcaggcaaugacagaagugaagucaauuuguuccuuaccauuagguucucccacuggagaaccaucucugggaacacagugaugacagggucuggagagguuccauagugaauccaugcauucugcucugagucuacaacaccgacccaaaacguuuuucuuuucuaaaaucauucccugagauguacucuaucgugugaaaauacuacaacaacuucuaggaaugucuagugaacugaaaacuaaauaacauuuucauauugaagaucaguagagcaaaacggaaauccaguuuuaguaacauugucuaggaaagccaagaugaaugaguaaaugccaaagacucagggaaauagggaauaacacuuuaugguauaucccaagcugagguagugauggauaguuagccaguuguuuaucugaucguuuucuuuuuuccuuuuuuuuuuuuugugagacagagucucacucugucacucaggcuggagugcaguagcgcgaccuuggcucacugcaaccuccgccacccagguucaagcgauucucucaucucagcuuccugaguagcugggauuacaggugcgcgccacaccacacccagcuaauuuuuauauuuuuaguagagauggaguuucaucauguuggcuaggcuagucucaaacuccugaccucaggugaucugccccgcucagccucccaaagugcuggaauuacaggugugagccaccgugccuggucuagaauucugauuuuuaaauuauugaauaacacagaaacuugacaucugaaaaaauguuuuguuuuuguuuugauuuuuuagcuuuaaaaaacugaaauaguuccuuaaugucaguuucugggaacucacugaaaggaucacuuccaaucaacucuccuuucaaugacugucaguagucauuuuuuauauaaccuaggagguaucagagguggccuuuauuucagcccaagaugcaaggcuuuaaaauucuuuuuugaggccaggugccauggcuuaugccuguaaucccagcauguugacaggccaaggcagaaguucugcuugaggccaagaggucgagaccagccuggguaauacagugagacccugucucuacaaaaaaugaaauuaaaauuaaaaaaauuagccaggcggcugggcacggugguucacgccuguaaucccagcacuuugggaggccaaggcaggcagaucaccugaggucaggaguucgagaccagccuggccaauguggcaaaaaaacccaucucuacuaaaaauacaaaaauuagccaggcaugguggcaugcaccuguaacuccagcuacccaggaggcugaggcaggaguaucacuuaaacccaggagauggagguugcagugagccgagauugugccacuguacuccagccugggaaacagagugagacucuaccucaaaaaaaaaaaaaaaaaaaauuagccaggcaugggugugcacacuugugggcccagcuacucgggaggcugaggcaggaggaucauuugaacccaggaguuccagguugcagugagccuugaucaugcuaccguacuccagccugggugacaggcugucucagaaaaacccaaaaaauuuugcuuaaacaacaaaaauuuauugucucccaguucuggaggcuaaagucugagaucaaggugucaacaggguugguuccuuaggaggggugugagggagaaucuauuucauaucucucaucuagcuucuguaguuuacuggcaguuucuggcauaucuuggcuuauaaaaugacuaauccuugcaauuuugcuucaguugugauucuggaagauuuggcauuuagaucagauauaaagcuuuccuuuuaaaauuccuaaccuacuuuaacuucaacauuuggaauguuggaaagaaaaaagaaccagaauaauugcaucacuuauuauuuacuugaauuacuaaaacauuuucaagaaccuuuugucuagaugucuugguaaugaagagauagaagaugcaaguucuugggcucuuugugucggagagcaugcggggucuagaauuccaaagccaugaacugcuuuuagaucccucaguucuuuuaugauggagaaguuguauuugaaucugcuaaggcaaauuaaagcaguuagucauuuuugcaaauuauuauuauuauuauuuuugaaacggagucuugcucugucgcccaggcuggagugcacuggcgcuaucucagcucacugcaagcuccaccuccuggguucaugccauucuccugccucagccucccuaguagguggacuacaggcgcccgccaccaugccuggcuaauuuuuuuuuuguauuuuuaguagagacaggcuuuuaccguguuagccaggauggucucgaucuccugaccucaugauccgcccaccucagccucccaaagugcugggauuauaggugugagccaccaagcgccuggcccauuuuugcaaauuauuaauuauugcuuaccauuauagucuccaaaauacuagguguaugguguuaucuuuccaccacuggugaaaacaacccauggucuaggcacuuuggaguagcacccaccagcugugugaaggucaaauggaucuuaaagaguugugcagugggacugaaagaggagagucacuauuucagagauaaccaaauguuaaaaaaaagaggugagauauuuuaauauuuguuguuuaaaaguuuuaucuugauaguauuacacaauuauacaauacauacauacguaauguaauaugcauguacaguuuaaaaauaacaauaauaaggccaggugcaguggcucacacauguaaucccagcacuuugggaggccaagguuggggacgaucgcuugaggccaguaguucgagaccagccuagguaacacagugagacucugucucuacaaaauauuaaaaauuagccagguguggugguaugcacccauauucucagcuacucaagaggcucaaaugggugaaucacuugagcccaagaguuccagacaggccugggaaacauggcaaaacccugucucuaccaaaaaugcaaaaauuagcugggugugcuggugugugcugcggucccagcuacucaggaggcugaagugggaggaucacuugaaccugggaggucgagaguacagugagccaugaucgugccacugcaauccagccugggcaacagagcaggaccuugucuccgaaaaaaaaaagaaagaaagaaagaaagaaaaaaacagcaaugcuguauauacaccacccagcuugagaaauagaacauuaccagccccuuuguuucuuuuuuaaaaaaugauuuuuaauuauuuuaauuuuuuuuuccuacccucuuggcagguggcagauuacuagcaccuuugaugcuuccugugugucccuuccuggaggcauccucccaccaaaaagauaacuacuuuggccgggcacaguggcucacgccuguaaucucagcacuuugugaggaugaggcaggcagaccacgaggucaggaguuugagaccagccucaccaauauggugaaacccugucucuacuaaaaaaaaaaaaaauacaaaaaauuagccaggcgugguggcgggcgccuauaaucccagcuacucgggaggcugaggcaggagaaucgcuugaaccugggaggcggagguugcagugagccaagaucccgccacugcacuccagccagggagacagagugagacuccauuuccaaaaaaaaaaaagguaacuacuuuuuguuuguuuguuuguuuguuuguuugagacggagucacacucugucgcccccggcuggagugcaguggcgcgaucucggcucacugcaaacuccgccucccggguucaugcgauucuccugccucagccucccgagaagcugggauugcggugcaugucaccacgccuggcuaauuuuuuguauuuguaguagagacgggguuucaccguguuagccaagauggucucgaucuccugaccucgugauccaccugccuuggccucccaaagugcugggauuacaggcgugagccaccgugucuggcaaagauaacaacuuuucugaauuucauguuaaucauucucuuguuuuucuuaccaaauauacauauuuauacauauuuguagucuuaaauauguuuugucuguuuuuuaauuuuauauaauguauucauuuuauauaacguauucaucuguaacuucugucacuggacacuguuuuauccguauaauucguucauuuucacugcugauuaguuugcaauuaucugaacauacaauuagguauccauucucuuauugauggauauuuuuguuaucuccagucuuuugcugcaagaacacugcugugacuguuuuuauaugucucuuggggcacauguacaaguguuucuguagguagauagcuagaaguagagucauugguuauguguguguucaacuuuaguaggcaauucuuaacuguuuucaccuaguuaaugguugacaaaaauguugcaguuuugaaaacguggacaagcuucaaaugaaaagaagaggaugacagaggacuuggaggggaagaaaacaaaaaucauaaucauagacaauauuguucaccauguacaagacaguguucuaagcagaaugagugccuuuggugaugauaccucgucaggaccacaguaaacuuacccaacuaaaaacuggucacauuccauggcuguucugcuucugucuuugguuuucaauaauccuauguucuagaauaugugagucuugaggaucaaucauccaaaccucgaaaaggcuuugaaaucaguccauuuucucuaaagucuuuggaagcaagauugacucaagcaagucuaggucauccgugaaaagauacagacauucagggaaacccaugguuccaacccugacuggaaacaaugccaacuuugaaaaaugcagcugcuggaccagcugcauuuucaguugcugcauucagcugccucagccucucacaugacuggacagaaugaaaauugguauaaucuuuuuggagggcaguuuccuauuaccuauuuauauuuaaagccauugaccccauaauuacacuaaaaaacuguccuguagaaacuaugcuacaaguguggaaggguauauaaggauguuuacuauggccugagaauagugaaaaacugcaaacaccuaaaauuccagcaacagaagauagauuguaguacaauggaacacaaugcagcuauaaaaaaaaaaaucggcugggcgcgguggcucacgcuuguaaucccagcacuuugggaggccgaggcgggcggaucacgaggucaggagaucgagaccacggugaaaccccgucucuacuaaaaaaaaaaaaaaaaaaaaauuagccgggggugguggcgggcgccuguagucccaccuacuccgagaggcugaggcaggagaauggcgugaacccgggaggcggagcuugccgugagcugagaucgcgccacugcacuccagacuggggcgacagagcgagacuccgucucaaaaaaaaaaaaaaaaaaaaaaucaaggcugggcaccguggcucacgccuguaaucccagcacuuugggagacugaggcgggcagaucacgaggucaggaguuggagaccagccuggccaauauggugaaaccccgucuguacuaaaaauacaaaaaaaaaauuagccgggcguggcggcgugugccuguagucccagcuacuccggaggcugaggcaggagaauugcuugaacccaggaggcggaaguugcagugagccaagauugcgccacugcacuccagccuggguggcagagacuccgucgcaaaaaaaaaaaaaaaaaaaauccaaaaaaucaaguuacagaacaauuugcauggcaugaucucauuuuuauuuuuauuaaaggaaauacauauagauuuuuguaucuaugaauagaaaacaggcaggagaacccuuuauuuuuaucauuauuuuccccccuccccauuaccgcuagagggucuugacugcaaguuguccagguucuuggcauuuugaacaaagaauaggacaaaaugcacagcaacgcaaggaaagaaugaagcaacgaaaggaacgaaaugaaggcagggauuuauugaaaaugaaaguacacuccacaguguggcagugggccaagcaguggcucaagggcccccaauacagaaucuucucggguccaaauagccccuagagguuucccguuggccacuugguguucaccucaugguugcaaaggcaaccaaucagaggcuaaacugaaguuacaaaguugcacuucuaugcaaaggaagacuuggccagcaaucaguuugauugguugcagacaacaaccaaucggaggcugaagugauguuacaaaggucacagucccauggaaacaucugaucgauugcaaaaagcaaccaaucagagguacuuucaauuucccaucugcggggcagaaaaguuggggguuugcaaagggaguaaccucugguccuuuuguuauuaggaguggacaguuagggcuuuccuaucaauuuaguucuaggaagucagugugaaauggccuuagguucccugccuccagaccuuguucugccucacccccaccccuuugggaccccuuaguuauuaauagugguuaccuccagagcaggggugagggaagggggcuauaauaaaaguuuuaaaaggauacuuuuuuuuuuuuucuguagagccagagucuugcucucucgcccaggcuggagugcaguggcgcgaucucggcucacugcaaccucugccucccggauucaagcaauucuccugccucagccuccugaguagcugggacaacaggcgcacgcugccacgcccagcuaauuuauuuuguauuuuaguagauacaggguuucaccguguugcccaagcuagucuggaacuccugagcucaggcgaucugcccgccuuggccucccaaagugcuaggauuauaggcaugagccacugcacccagccaaaaggauaccauuuuauaaggauaaaaaacacauucaagaacagccaacuguucagcauagcaaaggacaacuagauucaaccugggcuccuuauagguaguacuuuugucacagguuuuguauuaacauuccagugagaggugaagucagcaggacuuccugggucaguggggacuuggagaacuuuucugucuagcuagaagauuguaaacacaccuaucagcccucuguaaaaaugcaccaaucagcgcucugugucuagcuaaaggauugugaaugcaccaaucagcacucuguaaaaaugcaccaaucagcccucugugucuagcuaaaguauuguaaaugcaccaaucagcacucuguaaaauggaccaaucagcacucuguaaaauggaccaaucggcaagacaugggcagggacaaauaagggaauaaaagcuggccacccccacccccuccaaaagccagcagcagcaauccacugggguccccuuccaugcuguggaagcuguauucuuucgcucuucacaauaagucuugcugcugcucacucuuuggguccgugccaccuuugagagcuguaacacucacccgaaggucuguggcuucauucuugaaguuagggagaccaagaacccacccgaaggaacggacacacuagcaccuagcacagcauuuaauuaacacagagagaccaauugcuugauuaguaugugcaagauagaagaacacacaugcacacacacacacacacacacccugcuuuuuaggcaucugcagacuaguggaguaauuguaguuaggaacucuuguuuuguguagagauccuuugaagcaauggcacccaauagaacuuugcuaggugauggaacuauucuaugucugugcuguccaauaugguggucacuagaccaaguggcuuugaacacugggaauggggcaaauacagcagaaaaacugcauuuuguuucauuuuuauuuuuauuuauuuugagacggagucucacucuguccccaggcuggagugcaguggcacgaucucagcucacugcaaccucugucucccggguucaagcaauucucugccacaaccucccgaguagcugggauuacaggcaccugccaccacgcccagcuaauuuuuguauuuuuaguagagaccagauuucauccucuuggccaggcuggucuugaacuccugaccuugugauccacccgccucggccucccaaagugcugggauuacaggcgugaggcuccgcaccuggcuuauuuuuauuuuuauuuuuuuugagacagagucuugcucuguagcccaggcuggagugcaguggcacgaucucagcuuacggcaaccucugccuccuggguuccagagauuugccugccucagccucccaaguagcugggauuacaggcacccgccaccaugcccagugaauuuuuuguauuuuuaguagagacaggguuucaccauguugccuaugcugguuucgaacuccugagcugaggcauuccaccugccucagucuccuaaagugcugcgauuacaggcaugugucaccaugcccggccugcauuuuauuuuaugagacagagucucacucaguugcccagacuggagugcaguggcacgaucucagcucacugcaaccuccaccuccuggcuucaagugauucuccugccucagccuccugaguagcugggauuacaggcacaugcaaccauggcuggcuaauuuuuguauuuuucauagagacaggguuuuaccauauuggccaggcuggucucgaacuccaagacucaagugauccacccgccucggcuucccaugcauuuuaaauuuuauuuaauuuuaauuaaauagccauauguugcuagcauuggacaacgcagcuuuaaaagaucuguugagaaauuaauauauagacucuccucagaaaaguauacacauauaccaaauuuuacauaaaauuucaagagauccagggauccucucaagcccauccaugugucucuagcucaagaaccucugaaauaaugagaauaggauaaacagcacuagagaggguaaaauucagaacuuaagaggugagauggaaaaugggcaaaugcuaaugcucccauucagaacccugggauccuggaaggaaucacacuaggugugccucccuccuucuccugucacacagaacauuuaccacauuguuuacuguuuacuuucccacauugugcuggacauucggacuguauacuucauaagaguggagaccuuaucugucuuacucaccauuauauacccagagccuagugugaauccagcacauaguuggcucucaaauaucugccauaugaauucauuuuauuggauaucucauucuucccaguccuaggaccccacagcuccugaguuauggagggucucagugauaaggagaguuggcuggcucauggaauggagauaggguuuucuugaagcugagcaaauacucagauucaugagaauccccuaucacuggugugauauacaagccacugaaaggcuucaauaggccaggugcgguggccggcgccuguaaucccaacacuuugggaggccgaggugggcggaucaccugaggucgggaguuugagaccagccugaccaacauggugaaacccugucucuacuaaaaauacaaaaauuagcugggcguggugugcaccuguagucccagcuacucgggagacugaggcaggagaauugcuugaacucgggaggcggagguugcggugagcugagauugcgccacugcacuccagccugguaacagagcaagacuccgucucaaauuuaaaaaaaaaaaggcuucaauaguaagugauagggagacauauacuagagccccaggguuaaacgcucuccuugggugucuccuccucugucuuuucgaguucuagaauaugaccaccuucucucaaauugucccucuaucuggaauccucuuauaucucuaguaggcaaauucuaacucacuguuaaaugccucuuucucugggaaaucuaugcuaguacuuccagacagaauuauaucauauuuccacugguucccuuuguacuugcacauuucaucauguguguucuaacagggcaggggcagccauucaucucuguaucccagcaauaaauaauguuuggcauauaguaggugguuaacgaccaauaugaaccacuaaaagaauauaaacacaauugcuuuccccgccuacacuacuucugcuccauauguucuggucaaaggcaauggauucgguaugaauaagccuuuguuauucaccaugaaguuaccugaaaacaaaaauccaugguucucuuuaugaguacuccaacgaaauaggaaauacaugacagguguacaacagaaggaacaggaaagaaaagguuucugccugagcagaagucaaagggcuguccaggcagaaaugcagggcaagaaacaagcagaaaugcagggcaagggccaggcgcgguggcucaggccuguaaucccagcaauuugggaggccaagguggguggaucagcugaggucaggaguucaagaccagccuggccaacauugggaaacccagucucuacuaaaaaacacaaaaauuagcuggaugugguggugggcgccuguaaucccagcuacucaggaggcugaggcagaagaauugcuugaauccaggagacggagguuguagugagccgacacagugccacugcacuccaggcuuugcgacagagcgagacucugucucaaaaagagaaaaaaggccgggcgcaguggcucacgccuguaaucccagcacuuugggaggccaaggcaggcagaucacgaggucaggagaucgagaccauccuggcuaacacggugaaacccugucucuacuaaaaauacaaaaaauuagcugggcgcaguagcaggcaccuguagucccagcuacucgggaggcugaggcaggagaauggcaugaacccaggaggcagagcuugcagugagccaagaucacgccacugcacucuggccugggugaaagagcgagacuccaccucaaaaaaaaaaaaaaaaaagaaaagaaaaagaaaaaaaaaugcagggcaagaacauccucaguaugguaaagggcauuuaugaaaagcccagagguaacaucacacacaauggugaaagacugaaaacuauccgccuaagauaaggagcaagacaaggagacccacuuucccuaugcuauuucuauucaacauuguacuggaaguucuauccauagcaauuagacaagaaaaagaaacaaaagguauccaaauggggaaggaagaaguaacauuaucucuauuugcagaugacauggauuauauauauauauauaaauauaauauauaguauaauuuguguauuagauaauauauaucccuaaagaauccacaaaaaaagcuaauaaauucagcagaauugcagaguacaaaaucaacauacguaagucagucauauuuuuuuuuuuuuuuugagacggugucucacucugucacccaggcuggagugcaguggcaccaucuuggcucacugcaaccucugccuccuggguucaaguguuacuccugccucagccucccaaguagcugggacuacaggcgcaugccaccacacccggcuaauuuuuguaguuuuaguaaaggugaaguuucgccauguuggccaggcuggucucaaacuccugaccucaggugauccaucccccgacuggccucccagaguacugggauuacaggcaugagccaccgcccccagccaaaaaucggucauauuucuauagacuaccaaugaauaaauaauuaaacaugaaauuaagaaaacaauucuggccgggcaugguggcucacgccuauaaucccagcacuuuggguggccaagguggguggaucacuugagguccggagaucaagaccagccuggccaacguggugaaaccccaucucuauuaaaaauacaaaaauuagccaggugugguggcgugugccuguagucccagcuacucgggaggcugaggaaggagaaaugcuugagcccgggagguggagguugcagugagccgagauugugccaccacacuccagccugggcgacagaaugagauucugucucaaaaaaauaaaauaaaauaaaauaaaauaaaauaaaauaaaauaaaauaaaauaaaauaaauaaaaacaaaaaacagacaaaugggacuguauuaaacuuuaaaacuucugugcaucaaagaacacaaucaagaaagugaaaaggcaaccuauggaauaagagaaaauaugugcuaagcauguaucugauaaugaguuaauaccuagaauacauaaagggcuccugcagcucaacaacaaaaaaaucaaauaugguuggcccuccauguccauagauucugaaucuguggacucaacaaauccuagauugaaaacauuuggaaaaaaaaauggaugguugcaucuguacugaacauguacagacuuuuuuuccuuauuauucccuaaacagcacaguauaacagcuauuuauauagcauuuacuauguauaguaaguaaacuagagaugauuuaaaguguacgagaggacguuuauaugcaaauaauaugucauuuuauaugagacuuaagcaucugugaauuuugguaucuugggaugaagguggagguauccuagaaccaaucaugcauggauacugaaagacaauuguaaaucaaaaaaugagcaaagaacuuggauagacauuucuccaaagaugauauaaaaauugccaacaagcauaugaaaagauguucucaguaaucaucagagaaauguacauuaaaaccacaaugagauauaaucucacauccauuaggauggacacuaucaaaaaaugaaaaaaaugacacguguuagugaggaugugaagaaaucggacccuugugcaguuuguaggauuguaaaaugcugcaaccacuaugaaaaacaguauggaggcucuuccaaaaauauaaauuaguauuaccauauacccaacuauuccucuucuggaauuuccucccauccuguaggcugucuuuucacuuuuuugauagugucuuuugauucgcaaaaguccuuauuuugauaaagugcaauuuauuuauuuuguauuucauugauuauuauuuugguguuguaucuaagaacccauugccaaauuuaaggucuugaagauuuaccccaauauuuucuucuaagacuuuuccugggcucaacuaauccuuuugccucagccuuccgaguaccuagggcuacaggcguacaucaucgcacgcagcugauuuauuuauuuauuguagagauaaggucuugcuauguugcccaggguguucucaaacuucuggccucaagggauccuccugccucggccucccaaaguguugggauuguagguguaagccauuguccuuggccuauuuucaguuaauuuuuguguaugagguaggggucuaacuuuuuucuuuuuuaugugaauacccaguuuucccagcacgaacuguuuaagaaaaaacacauuuguuuaagacuauucucuccccacugaacagucuuagcacuuuugucaaaaaccaauugaccuuagauggauggguuuauuucuugacucuugauuuuauuccaucacucuaugucuauucuuauacuaaugccacaguuuugauuugcauucccugauaacuaauaauguucagcuuuuuuuuuuuucauauguuagcuggucauuuguauaucuucuuuggaaaaaugucuauuccaauccuuugcccauuuuuaaguugggcuguuagucuuuuugcuaagacucucacauccagaauauauaaagaacacuuacacuccacaacaaaaagacuaacaacccagaaugagaugccacuucacuccuacuaggaugacuauaaucaaaacaaaacaaauguuggugaagauguagagaaauugaaacccuaugcuugcugguggcaauauaaaaugguucagcugcuguggaaaaguuugguggauucucaaacauuuaaacauagaauuaccauaugacccagcaauuccacugugagguauauacccaaaagaacugaaaacauauuuaauguucacagcagcacuauccacaauaaugaaaugguggaaacaacccaaauguccauuaacugaugaacagauagacaaaucgugguauauccauacaacagcuuauucugccauaaaaaaagaaugaaguaccgauacaugcuacaaguugaauaaaccuugaaaacauuaugccaagggaaacagagacauaggucacauguuuuaucauuccauuuauauaaaauguccagaauaaacaggcaaauccaaacagacagaaaguagauuagugguugccagaggcugguggaaggggaguggaaagugaccacuuacuuaauggguacagguuuccuuuuggggugaugaaaauguuuuggaaauauaugagguuaugguuguacaacacugugaauguacuaaaugugacuacgcuguacaucuuaaauugguuaauuuuuuuuuuuuuuaagagacagggucucacucugucaccuaggcucuggagugcagcagcacaaucacaguucacuuuaaccuugaacucuuggccuccagugauccuuucacuucuaccucccaaaguacuaggauuauagccaugagccacugugccuggcuaguuaaagugguuaauuuuauguuaugugaauuuuacaucaguaauaaaaaagaagccggaagaaaaccagacaucaaagauguuagaaaaagggauauauuuacaaaccaaaaagucuccaaauucccacuggaaggagguagcaaguaugagcaggucucuuuagaagcccguccucauuccuauagaaaccccaaguacuagcccauggggucagcccuugcccuauagcccauccuugucacaacccaagaagcaaucccuccauuggccacacccucaguccuuuugccagucauccugugcccaggcaggcauuggugaaaaguacucaaagccuggcccuuuauagcguagggcauguaggaacaucacaaggucuuggggcaagggauccugucgcaccagccggcacucugcacagagugggucugucucuugauucaugacaucuguuucaacugccuucucugaugccaaggcuauuguguccaacuccugaggggcugccucagcuacuuccuccaucuucugggcagcugcagccaacucuuccaggucguccuugcccaacucugaggagggggccguagagucugugaguccuggggacaggucacccucacagagaucuagcacauccaggcucuguuuggccuggugcucugcuaccaggucccguagcaacuccucguuugucuugggaauguagccgccccggccucgagaaggaccccaggcaacugaguuguagauggggucguugagaaugggauggcccaagaacugaagguggacucgaaucuggugugugcggccugugaguggccggcaccguaccacacuggacuggccauuguagcuuagccucuggaacacugucucacagggcuugccccggggaucuacacggcacaccccuacuuuguaagacaccacuaagauggguucuuuacaggucacuuccucaguggggaacuccccuuccacccggcacacguacuccuucuccagcuacauaggagggaagagggagaaagucaguacaaagccuaaauucauggaguccaaacucuuuguggagugauaaggaccagugucagaaaauucaaacuccagcucuaccauucgccaguuuugcgaucuuggguacauuacuuaaccucuaaauccuacuaacucaucuagaaaaugugaaauuagaaaagcauuuaccagcugggugagguggcucacgccuguaaucccagcacuuugggaagcugagguggguggaucaccugaggucgaaaguucgagaccagccugaccaacaugaagaaaccccgucucuacuaaaaaauacaaaauuagccaggcgugguggcgcaugccagucaucccagcuaccugggaggcugaggcaggauaauugcuugaacccaggaggcggagguugcagugagccaggaucacaccauugcacuccagacugggcaacaagagcgaaacuccaucucaaaaaaaaaaaaaaaaaaaaagaaaagaaaagaaaagcauuuaccucauugggcugugauaagcauucaguaaguuaggcucuaaugugcuugauacuaagccugguauauagcaugcacucaauaaauguauuaugauucagauccagaauuacaagucucaggacaacaaucauuaccauuaaacuccucuacccaagacuuuuccaacuacaucuagaaucuuuucaccaagcaggcucuccccauaaucuuaaaagccuugcucagccugucagcacuuuauuuucuuauguuaauuuauuucuuugagacggagucuuguucuauagcucaggcuggaacgcagugacaugcucauggcucacugcagccucaaccucccauggccaagugauccuccuaucucagccucccaaguagcugggacuacaggcaugugccaccaugccaggguaaguuuuuuuuuuuuuuuuugagacagagucucacucugucacccaggcuggagugcgguggcgcgauucggcucacugcaagcuccaccucuuggguucacaccauucuccugccucagccucccgaguagcugggacuauaggugcccgccaccacgcccagcuaauuuuuuguauuuuuuuuuaguagagacgggguuucaccguguuagccaggaugaccucgaucuccugaccucgugaucugcccgccucggccucccaaaguguugggauuacaggcgugagccacugcgccuggccuuuuuuuuuuuuuuuuguagagauagggucucccuauuuugcccaggcuggucucuaccuccugggcucaagcuauccucccaccucagccucccaaaaugcugggauuacaggugugagccuggccuugucagcauuuuaaagcuucaaaauagcaaacuacuaagagaggcaguguaugccaucucuaaagauuuuuuuggaaacauaugagauauccugcauuuggcacuuuagguguugaccugccuuaagguaggaagguaggaaggauggccagauaaauaugaaggaccacuucggaacuccaugaugcccuuuugacacagagcauucgugagcccaagaaguggccuguaggagacaaaagccugacucaccugccggucccgaaccugcucgugaauucucucagagacugcagcugucuuggcaaacauaagcaccccugagguaaggcggucaagccgaugcaagggguguagcuccuugaguuggugcuccuugccuaggaugaagauaacuguguugugucggaagcggccacaggggugaacgggaauggaggaaggcuugucuacaaccaccacaucuucguucucagcuagcaggcgaaugggcucugcugugacugguggcucaugccugugcacuguguuccgcaagaaaucauuguccugucaaagacauagguaauaagucagccuagggaccgcagccuguaaucagucaacuucauauccagcuuccccuguuccucacugacauggaaaaauggugaaagcacaucuugggcugaaaaagcagugugcagagugugaucucauuuuguaaaaauacagacagacacaggcagauagcuggcacugaaaaaguacuggaaggacauaugcaaaaauguuaacuguguuaucucugggugguuagauuaugaauguuuuuuggcuuugcuaauuguauuuucucuacaauaaagguauuuaaaagguaaaauuuuuuagccgggcgcaguggcucacgccucuaaucccagcacuuugggaggcugagguggguggaucacgagaucaagaccauccuggcuaacauggucaaacucugucucuacuaaaaauacaaaaauuagcaggcgugguggcacaugccuguaaucccagcuacuugggagacugaggcaggagaaucgcuugaaccugggaggcggagguugcagugagccgagaucgcgccacuacacgccagccugggcaacagagcaagacucugucucaaaaaaaaaaaaaauaaauaaucaagguaaaauuuuuuuaauggaggaaaaaaccuccauaaaucaucacuuauuacgaucuugaacaaacaaaacuaaggcuuaaguccagggauaugggcucuagaccaggauuugccacaggcucgcuacaugcucuugggcaagucauuuaucuuuucugggucucugcuuccuguggaaugugaggguuagaccagaucugugcuuuagaaauugggauaggagagggaauucgucaauguaugauauauugacgcaaaucgauugaucaauggaacaaguuacuccaaaaccauccauuccccaaaugcuguaaucgccuuuucuccacucacaaccaugguaaacuaguguuacugagagguaaacaguguuacuucugacaggggugucugguaccucauagaugugauggaauuuuaaaggagucaaagcacugggcuaaacaauucuagucucuaucccugacaucucauaacucuauguuaaauaguuuaaguaguaguuauaggaacauaggcuuugguaguggcacuguugauagccuuaccccugugaguuuccuuaguuuccucagagguaaaauggaguggcaauaccuacuucacaaggcugucauuagaauuaguggacauacaauguuuaacuuugugcccagcacacaguaaagagacauaaaugauagccccuauuauuacuauuugcacagagaucuacaacgcaggguaaagugaucagugcccuugccacaagacgguguuuaaaggaauuaugaaaauuccaacuucugucccuuggaaacaaggaagcugccuugaggaagaggauaaacaggcugaguccugaagcacagacacccuggccacuugcggaggugggaaacgggcuaaaauaguguuccaaaugaaagcgagaacgcuuuagaauugccaugauuuuaauccaguaccuaugcuuuacuaagacuaaaaaacaaaacaaaacaaaacaaaacccggccccuuuuccucgcccgcuucuggccagccccaucaggacuccaccuugagcacgauguugagguccugcaccggcuucucguugaguugcaggcggcccgcccggaccgcggccucauaguaggccaggggcugagcucggaacucgguacugaagacgugcagcaagcuguggcccacccagcgaccuuugcaguagguccggaagucaaaguaauagggccgcaccuuacgcaggccgcccucgaaguaauaacugguuucugcaaagugcucaucuccgaagcucaccccgguccgccgcuucuucgggggcggcacgacacgcucccugguugcgccccgccgcuucuuaugcuugcccgggccuggggcugcagccgagggaugcuccccgccuacuggggccggcuccacuucccggccagccggcuucgggggcccgggggacagcucaaccuucgcgucgccaccagcgucaccguuuugcugaugcgaagcccucagcccgcccucugucccaaccuggguagacacuguuucugccauugggcccuuaucgccacuccaaguccugguaaagcuagggcgccuaaggucguagcgccaauguccaagaacccugagccauccgcggcgguccagccacauaaccacgcugcccccacuccacucccagggucgcgaucugagg

SEQ ID NO: 13345 - RNA, 19436 nt, Homo sapiens
aucaaauuugguuuauuucaaguuuguaacaaaauauauucuaggcaacuuuucagacauuguuuuauagcaucauaaaccccauaccacugcugucauuccaaaagcugccaggacacuggaaguuaucaagugguccagcccaggaauacagguagaauucacaugauaggugauaagaaagcaaugucugugggccacucugaucccucuuuuuaccuugguagguaagguaugaucuuaagacuauauguacugaguccuauuagucagugaaaaagauuaaagugacaaguuaugugcuuuguuccuauagcuuugaaguucauccaccucaccagcaauuggaaggucucaggucuugcaggcucuacccauguguaauccuggggcaggugugaaucuugauuuuuuuaagagauuacucaagggagagaacaacagaaacggaagccaugaguacugccccaauucuagauuagguuagagguuagaauaaauuaacuaauggggagugguaguggguagcagucagacccaggagacagauuugugugguuuccugaucucagcaaggucuaaggaaaaaagccuccccgcccccccaccuuaaauaguggcaucaagucaugaaggccagugaaacgugguuagucucguaaaaugacuuccaguucuuccagguccuucuggauagccaaauccuagggagacaaagaacaaaucuagggcucaaaauuuaaaccagcauuuucccaaaccaguggaaccuaagaagaggggcccuuugcuuccuuccugagcucugcuacagucuuuuuccuacuuccccaggauagccuggagccuauuaaaucugucucuuccccuagagguagacucuuuuuuacuagggaaauaagaccucuaggaaagauuauuuucuaaaaaugucacaugaugauucagugaugacaggcaguuuuguuugguuuuuuuuugagauggaguuuugcucuuguugccgaggcuggagugcaauggcacgaucugagcucacugcaaccuccaccucccggauucaagcgauucuccagccucagcuucccgaguagcuggaauuauaggcgugcgccacuaggcccaacuaauuuuguaauuuuaguagagaugggguuucuccauguuggucaggcugucucgaacucccgacuucaggugaucugcccaacaggcaguauuaaaaagccuuaccuccuucgugacaucuggcagcuccagggccaacuucauccaccaucuagcuucagaguuuuucccuaguucucuguagcacugaaaagagacaacagugaaaccugauacuguguacuuucaggaguucccagaucuauguugaaguagacaaaugaguuuaccuuggaaauauauacccuuccugcuuuggaaaauccuggcuguaguucuucagccugggaaaagggacaaagauauuucaguaagagguuccuauauucuaaucaggcugaaguuuauuaaacuagauuucuaguccccaaccauguggcugauucagugggucugaagaaaccuauauuuuugauaagcugugcaagugauucugguuuucccauagaacaggcaaacacaaaauugcccccgacuaggaaaaccccucccauuaagggucucaauaauguccuuaggaaaaaacaagguuacccugguguuuuugccugccaccugccccucucauaccuuuaggaagcucuggagggcaucuuccacaguggcacugagagggcuuucaagcaaggcuguagcaguuuuuuuuucuagccagcucaggugagagaccugccacaaaaagaucaagguguguauaagagguuuuaaaagguuuuuuuucuuuaaaucuuuggggauauauugaaaauagggucaaacggggcugggucgaaccaccaauaauacgagcauucagaagaaagggcaccugagccagagaaggcugaggaucuuguucuuccuggcaaggaaaucggugucagaaggcauuuaggaccauuaugucaagcacugaaacgcagcuuaccugauagcaccaccugccaagaagaaagugagccaugggguuuucuggcuggagagcaauggcuuuguccacaugcuccuaaggggaaaauguaaauauaaacuaacaucagacaccagaguugcuaaaagagaggcaagggccggaugcaguggcucaugccuguaaucccugcacuuugggaagcugaggcagguggaucaccugaggucaggaguucgaaaccaguccuggccaacauggugaaaccccaucugugcuaaagauacaaaaauuagccgggcauggugguacaugccuguaaucccagcuacuugggaggcugaggcaggagaaucgcuugaacccaggagguugcagugagccaagaucacaccacugcacuccagcuugggcgauagagugagacucugucucaaaaaaaaagaagaaaggcaagucacugaggcuguagaaaaguuuuuggcagggagcuggaaaggaguggggaaucugggauaggccagcacaaggaaggaggaaaagccuguccucaccuugaagcuaaagccacucuggaugcgccucuggaugcucucaugcucagccagcugaccacaaagcaccgcauaccuaggggggaagcagcaagcucagggacaagggcugaguaccaucacugcaaggaauggaugccccaaccacagccuaguugcauuguccccuaucccuguacccucaacuagagcugaaaauaccuaauuuucaucuguacguaauccccauucuuuacggaccucuggccccaauuaguauucuuuaguagauaaugguaggcuuacaagucuccaaaguauucuagguauaaaaaaagcuggguucaccacaguaaaucucucuuacacaguaaaucucuccuacacucauaaggaguacagccacaggcauuaauaaaaacuugaaaagcaugaaaacaaucagcauaaaaguaugagaccugacuauacuacuuaucuucugggcagacaaaaaagugggucucauuagccuuuaagcauacagguguaucacugggacuugggaagcaauuucuuaggauagucacauugggaggggauauucuaggaauuucugauguuacuuggaaaccaacagaaccagaggaagaaagaccuccuauauaugccuucucccccacauccccccucccaaagggaaccagccagccagcuucccaucaucugucuucagaaacaaagucuuacuuccccauccccccagcauuguuccuagcagcacaguugacauucgaugaguaaccagcccaaguugcuuuuucauguauaugcuaaguauccgggggguaucagauacuucuagaggcucauuuccauguuuaauccaaacagcuguuccucaggaauagcuguucauccuuggaagcccagggaagcagugacacccaagaaacaguuaccuggccucugagaagaacccuugcagagacaaaaguuucagcaacagauggagaaacacagccucucacuuagcucacagucugaggguggagacauggaaagcaaggguggcggugggaaaggaaaggaacauuuucacuaaaacucaggugcuggaaccagaccccaggauaugaguuagccguggcccagguaagcugacagaacuuugccucacaugagaccacaaaaagggcugauguuuuugcagccuaauaaauugaccacuaaacuucuggggggugagcucacaucuacuuuuccucacaugaaccaagcaaagaagccaaaguaccagcagccagggaucacacgcaggggaaagaagagcuuaugcaggauaggggagcugcagauugucccagccuccugagagccaagaacuccaguuuuguagcuaggaugacucuuaacaaagcuacucauuucuccaagccccaucagaaaaaaagcuuguauuccccgcuugccucaucccuaagccaccuccccuaccagaaacuucccuugucucuggcuagggguagacugaggcauguggagauacaagccagaacucccucuccuggauccuuuggaaaaugccucuguggcccaggcagagaaaagaaagggcuguccucugcuuuggcccuugcuggcucuucccagaacacugcaggguguuauuaccacaggugacagucagcacucucaucccccuucuccagagcagccucugcuucuucuuuuccuguaggacgaagguagauccagaguugacauagcucuuaugcacacuuucauaggaaggcuugugggaagaaugacugcuuuagcucucaccaaucccuacccagcuuggacuuguuuggaaauaguugugaacuugagcagaaugaaaggccgcaaagaagccagucacaguggcucacgccucugugcuguguaaucccagcacuuugggaggcugaggcggguagagcgccugaggucaggagucggagaccagccuggccaacacagugaaaccccaucucuaccaaaaauacaaaaauuagcugggcgugguggcaggcgccuguagucccagcuacucaaaaggcugaggcaggagaaucgcuugaacccaggaggcagagguugcagugagccgagauugcaccacugcacuccagacuaggugacagagcaagacugucucagaaaaggcugcaaacggcuucuaagggaagacuucagggaugacuucugcuucaccuuggcuuccccaucugucauuagaaaccccaguuaccuucuuuuuauaaugcccaccugaugugcuugaagcagauuuuagcauuuaaaauauaaaaggauccagccaggcacgauggcuuaugccuguaauccuagcacuuuggaaggccgagguggguggaucacuugaggccaaguguuugagacaagccugagcaacauggugaaacccugccucuacuaaaaauauaaaauuagccaggcauguuggcacauccuguagucccagcuccccaggaggcugaggcaggagaaucacuugaaccugggaggcagaaguugcaacgagccaagauugcaccacugcacuccagccugggcgacgaacuccaccucaaaaaaaacaacaacaacggauccaacacaaucagaaauuguccccaacagaccuuacucuggaggggcaguguccaugaaucucaaguuguauaaaauuuaaguaaguggggagagagaucacagcuuugaaaaaauucccuaaaggggauggguacauuggcucacaccuguaauccuagaacuuugagaggccaaggagaggauagcuugggaccaagaguucaagaccaaucugggcaacauaggcagaccccaucucuuuaaaaaaaaaaauucucaaaaggauccacgauccaacaauauuaauuagcucuaggccaaaacucuuucacaagagccacauggacugaggucugaccagagaugacguucacuuagucuuacccgaguuuucuagguuaguguucuaacaaagaaaugaaagcccauaaacaugaaaguucugacaagcgucacuuaagaguaucgaggcuggagcuuacggaccaccagauaaggaccaucaugccuaugcacuggagaagacacugcaacauaggauuuuuuuuuuuuuuuuuuuuuuuuuugagacaagagucucacucugucguccaggcuggagugcaauagcacgaucuaggcucaccgcaaccuccgccuccagguucaagugauucuccugcgucagccucccgaguagcugggauuacaggugugugccaccacaccuggcuaauuuuuguauuuuuaguagagacaguuuugccuuguuggccaggcuggucucaaacuccugaccucaggugaugcgcccaccucagccucccaaagugcugugauuacaggugcgaaccaccgugcccagccaagaauucuuugaagaaaacaaguuuggaagggaacauggagaaaauggaacaaauguaaugcauugaggugguaaacuggcuaaucugaaauguuuuccuuuuuuuauuugagacagggucucucucuguugcccaggcuggagugcaguggugcaaucucaguucacuacaaccucugccuccugggcugaaacaauccuccugcuggcauguuccaccaccaugccuggcuaauuuuuuaaguuuuuuuuuuuuuuuuuguagagacaaggucucacuauauugcccaggcuagucucuaacuccugggcucaagcaauccuccugccuuggccucccaaagugcuaggauuauaggcaugagccaccacaccuggccacaaaugcauucuuaagacaacugaugcugugaaagacucuaccucucuucccaaagagagggaccacauggccccaccaaugagggacgcugccucuuuggggauuucucucugcccucuucaaaguacugucucacuaggaaaauaauagcaaagaaugagacaacuaguuccugccaagcuagacagacaguguuguagacaagacauugccugagaccccacagaaugacugccuccuggugguccagcuccuagagauacaaugaaauaaacuuuauacccaguaaggauaauucuuaaaggcugugaucucagagcagaaccuucaaagacauuccauagucaucugaccuccagcagguaaagcuuuguccaugggugcuaagcucaggaggccagaccaaccaagugcugcccugcuaaccacugccuccacuucugucuuugggguucaugcuggcuacuagcacuaauaagagaugaccaaugaucaagagggaaaggaaagguuguugacaugaagaguccaaaaaucagcccaaaagcugagaauccucaucugaaauuuaggagggaaaacaaacuuuuggagagaaaaaguaaucauaaauaagcaucuuuuguuaaaacuuccaggaauuuuucugagggucuacagagacauccuacucaauuggucuguucuuucuccauugacagaauucuacaaauguuuagaauguuaacuuugagguacuguuugaguauacauuaucaaggauucaauaauauuuguaaggcuguacuuacaauagaaagguagacaaauccauuuuagacaguuaacuggccaggcacagugguuuaugccuguuaucccagcacuuugggaggccuaggugggugaaucaguugaggccaggaguucaagaccagccuagccaacauggcgaaaccccaucucugcuaaaaauacaagacuuagucggguaugauggcaugugcuuguaaucccagcuacuggggaggcugaggcaggagaauugcuugagcccaggagguggagguugcagucagccgagaucaggccacugaacuccagccugggcaacagagaaagacuguuuaaaaaaaaaaaaaaaauagauauuaacugaaccacagaccuagaaacccauuacccauugaugguaccugacucaguguguggaguucagcaggacacaucagucucuaaaguccaagcauucucugaccucaugacagauaaggccaagcccugagccuggcacaggucagaugcacccuauccuccaggguggagccuuugccaacagacuugccaaguggauuccagagucuucuaagcuagcuauauucuuagaacaccugccccaccagcucagaaaacugaaaccagauuucuaagcagcagcaaaaaaccucagguuaagaaaaaagguuuugcccucuguggcuagagugagaaaaacgaauaacauugauaggauacaacuacuccuagaaacacaugcacguguguuacuaaucagcaugauauacagauaagcaaagacugcucucuucuuccagaggagaaagcaagggucuuugggagccagaguuugucccuaguggguaacugagccacaacugcugacagcaucuuggugguuccccggguccccaggcagaugggccagccccaccccugaaucagucagucaccuucccacaggaagcugucagcacuuaccaucuagggcauaugacuucuucucgcucaccuccucagugagcucacacaugucacuguaggcucgggccaggcgccagagaaaguccugccggcuuccauacugcagaccagacagaaacgggugaggccccuuuuuccucaacuguggagaaugggggccuuggccuucccccacacccuagguuugaauuuccaagcuaguauguuacagucaucaauaucaggccagcuccuacacgcagccuuccccccagucaucccuucccacgugcaguuaauguaugacacauucucugucuagccaguagcuugcacaauuacggggugagggcauucugaccuccuagaacugcugggaggaaaggucaacuccaagaugucauaaggcacgagaggucuuuugcugacacaugaagaaagugugaaaggaaaagggaaacuucuaacuucuggggggggggcauuuauaccugggugggcauauauucugucagugaaccugacaagagaauuaugguugagugaccuacacaguugucgcuuguaauggggcuggcagcuuggacucugccucaagggaaaugaggagaaaaaaaaaauacaguucuuuccacauuucccccuagaggugagagguagagcucuuucugcaguagcucuacagaaagcagagaacuacacucccccucccaagaggggaggcagcucuggggcaagcaguacacuggcccuaggauccacgcugggccuccuuggaagaggauaugugaccugggggacagaugcaaaaccagcugucucaccauuucucgucccaugucaccuuguaggggcaguaaccacacgggccuucauuccccaggggucaggaacagagagauggagggagggagggaaggagaaggagacaggcagcuggagccucaccaccagcuuguuguugagcagcagcuggaagcccucccgcuugccuugcucaucaccccugugcagcucgucggccugcugcaggaggggcagcacauccuccaagccugaggaaccuccagccuccagggcacuggaggcaccugaagcugccucuuccuccaagucaagagaauccuuucuccccaucuucacagucucacagcucacuucaucuuccccguccucacuuucuuugucagagucccgcucauugucagacuccgcauuggcuguuguguaacuggcagagaaauguaagggacaacaagaggauuauucagcucagagccccuagggucugucuaucccucacccccaaagaagcacucuacauggcauuguccaaagcaccaaaucacaaucauucauaccucuuaagggcagacuuuuuuucuuuuuuuuuuuuuuuuuugagacagggucccgcucugucacccagacuggagugcagugguucgaucuuggcucacucaaaccuccaccuccuggggucaagcaauucucccaccuaauuuuuuuguauuuuuaguagagacgggguuuugccauguugcccagacuggucucaaaccccuggccucaagugauccgcccaccucggccucccaaagugcugggauuacaggcaugagccaccaugcccagcagaaaucauuauuugagagaaaguuuccuaugggaacuaagggcugggaaaaugauccaggaaggaaagagcagacaaccagcugaggcccugugacaguuaaggcaaaugugagaagucccugcucguuuuugccuuaucagucagagacacuugccacaaccaacaugggugggugcagccucaggccaugggcagccacacacacauccacaaacucgcaaccucuggcccaagucaacaaccaaaccuaaaccgcaacaggaguagcccauaguaaccuugagaacuuaagggugugaggagaggugauaggaaccacuuugcagccagaagcaagaaggggaagacaaugcaaacuacccccugaaaagguguuuggggggcugccauaugccagguggcuccuaaggagccccaacccugaugcacccacuaaagaggaagcugaguuucucuuggaucucagccaccagcagcugauuaggguguuuucccuaaaugccuaaaauagauaaggacugagcaggggaaaagguaggacuucugggggucagaagcaaacacaaggcugggggcgguggcucacgccuguaaucccagcacuuugggaggccgaggcgggcggaucaggaggucaggagaucaagaccauccuggcuaacacggugaaacccugucucuacuaaaaaauacaaaaaauuagccaggcaugguggcaggugccuguagucccagcuacucgggaggcugaggcagaagaaugggcgugaacccgggaggcagagcuugcagugagcggagaucacaccacugcacuccacccugggcgacagagcaagacuccgucucaaaaaaaaaaaaaaaaaagaauaggcucccuguggcuggagcaaaacaggacugaaggagagaugacacaccaccuacaaauaaagucaacaacugacagccuaaugucagggcagaagugcuguccugcccagaaaaccagaaaccacaagguggcaggcucugaaggcucuggaagugagcagccagaccugguacccaguccgugcugacugcauccuuacagaggagcuucagccucaucuaaaaaagaggccccagacacaucuacuacaagaacuuguaagguauuuaaaaccuuuccuaacugcaccuuuguuuuuuaagagguuauccaaguagauuuccccuuuaguuauuagaaaaaaaaaaaaacaccuuuagaaaucaaagggacaaggauaagugucauuagauuucguaaccaaccuggguacugaugagggagaccacccacaggcaaccuagagaaugaaacucccaacugcaccugccagauugagaaaaaucaaaccagagucuccucugcccagccaggcccaaaugcaaaauggguagaugguuuaucuggaacgggaagcuggaauugcaucaucucccuuugcuagaaggagggggagacccuauuucuugcugaguugagggcugccucagccaaucaggaguccaaagaggagucucucugccuccagcacucccagggagggaccuagcccugcuggagcccaggcaucagcacagaauccccugggaccugagcugcgaugcugccaucccucuggauccuaaaggcccagcucacaaagccaagaagagaggucagggagccuugcugccacaaacagagugaaagaugguagagcccugugaggcagggaggcuccagggaagcuggcauagaaaguagacuuuaauugcaucucagccccacuuuaaggaacccucaacaaucugaaacccuacugccugaggcagcuucuggggccucagaagagauuaaucacaugccaagggcuaccacauuuacaccauucucucucacuuuccaccucccagacuaacccagccagccuuuggagaaaucuaccagagaggagugacccuuuuaacauacccugaggcuuuugagaucugccagagacgagcagggaccuuugaaaaggcccuuugguccugugcacuccggaggacaggaguucccacagugggccagagacccaaggcucccucugagcagagacugccacucuacucuuaagcaguaaugaaggacucaguuacacacaucucuccuccuggcaauuaaguuucucuuaaccuaaaccauguuagagacugaguaugaggccuucaaagauaaccaggcacauggacccugaccuugagauaagacccaacuuaaugaggucauaaaugcccaagaaggagucuucacgaugaggcugcaggcaauuucucuuggcugagaugccugggaaggcuugcuggaggagcugguauuuuagggcaaguuggguucugacagagggaacucaagcuguguuugguacaaugcccggggaacaagcucacagagcugcacagugauucugccucugccacccucaaucuccugagaccucaaaguuguuauuuggaagaaggaaggaauacagcuuucagugaaaucaagcagcccaucaaaucucagcccuucaucccucaaagcagcucuccuugccccaagacacacauguucaaagccauuucagaguuuguagacuccuagagcuccccccuugaccuacauggcaaugaccauggcacaaagaaucauucaccacggccacugcccuagagaacagccggcucaaccacacaguguugcaccaccaccugcucucaugccacgggacugggcaugggacacagccugaaggcgcuauaauuaagaaauccacucuuccccuugccccaucacaggugucuggcagcccuggccugcuccuuguggccuugggagucccagugagcaccccuagcagugaaggacccccaggugucccugguuaacugcucuggcucccacugaccccagaaguuuguacuucuuuauuuuuuugggauggagucuuucucugucacccaggcuggagugcaguggugcaaucucggcucacagcaaacuccacccccuggguucaagugauucuccugccucagccuccggaauagcugggauuacaggcaugcaccaccacgcccagcuaauuuuucuauuuuuaguagagacaggguuucaccauguuggccgggcuggucucgaacuccugaccucaagugaucugcccaccucagccucccaaagugcugggauuauaggcaugagccuccacaccccagccucaguaauuuuuuuuuuuuuugagacagaguacugcucuaucaccgaggcuggagugcaguggugccaucuuggcacacuacagccuccaccuccuggguucaagugauucuucugccuccgccuccuagguagcugggauuaccggugccugccaacaugccuggcuaauuuuuguauuuuuaguagagacgagguuucaccauguuggccaucuggucuugaacuccugaucucaggugaucuaccugccuuggccucccaacgugcugggauuacaggccugagccaccgcgccuggccuaguacaacuucuuuaaaucaucacaaagaggaccaggugcggugguucauaccuguaaucucagcacuuggaggcugaugugggagaacugcuugaggccaagaguucaagaacaggcugggcaacacagugagaccccaucuguacaaaaaaaauaaauagaauuggcugggcaugguggcacaugccuguagucccagcuauucagaaggcugaggcaggagcaccacuugagcccaagagguugaggcugcugugcugugauggcaccauggaacuccagccugggcaacagagugagacccugucucaaaacaaaacaaaacaaaaacaaaaacaguugugaagggccucaagcuuucuuugauuuugggcagagcugugaccucuccuucuguucaaccuccuuacagaguucaaacaucaauuccccacccaaguggccugcuuccuuggguugcagagauguucuuuacaucucagugcccacuaucaacuacuuccucggucucucucuucaauucagauguaucaaauauuaauuucauuuuugcccccucuuuaacacaacuucuggaagcaucucuuggcccagagccauuuagguaaauugaauagaaaagggccaccucuguuugcccuugagaaugcagauaacagggaucugacaacccaggcaacagcagucccccauggaagagcagagagcucuucaccaccacuccacagguuucuggagaccccggagcacucaucaaauccagcguuggugauaaugacauuucagucaaccacggacugcgcauaucagugggugcauacgauuauaauggagcugaaaaauuccuaucaccuaguauuuacauuguauuuuauuuuucugaggcagggucucacucugucacccaggcuggagugcaguggcacaauuauggcucacugcauccucaaacucccggccucccaaguagcugggacuaccgacccaugccaccaugcccagcucguuuuuuuuuuuuuuuuuuuuuuucuuugagauggagucucacucugucucacaggcuggagugcaguggcgcaaucucggcucacugaaaccucugccuccuggguuccagcaauucuccugccucagccucccgauuagcugggauuacaggcaugcaccaccacaccuggcuaauuuuuguauuuuuaguagagacaggguuucgacauguuggccagacuggucucaaacuccugaacucaggugauccgcccaccuuggccucccccagguaguuauuuuauguagagacguggucuugcugccuuguccaggauggucucaagcuccugaacucaagcaauccuccugucucggccucccaaagugcugggauuacccaugagccaccaccacaccuggacugauuuuaacuucuaguuuccauguaccugcuuauagcuaauuccucugauccagcauaaaacuuggcuguucucuacaccagucuuucccuuaagaagaauaaaggcuggacaaggagaaaucggccucuaggccucacacaggcuaccugaauaacuggagcuagcagcagauaaggucagaugggucagaugcugcuacugacaucacacucuauccuugggaccagaguuucaaaguggugcuagugguuuaaacucaaaacacccuuagcaugaccagacuuggaggaggcuguccaccagacuccugccagcugccccgccucacagaaaggccuaucgucagcccuccugggccacugagaacucaggacauccaccucccaccuguaaaaaugcaaaggaucacaggcaaggcuccccugugggaagagggugacucccagggaggagcaugcuucgugcuuagacaucuccguauaccagcucagccacccaaggaaaggaacaaagucaaacaaugcuuaucaaguccuugugauaacacagaaaaaugcccaaauaauauaucauaacuauguaauaaacuaagauaacagaugcaagcaauaacugcuauuaacaucuacauuugucugaaugacauaaauuggauggguuuuuuguuucaacucuucuguauuuauuauacucuuaccuguuccaaaaaucauuugcagcagcuugguuugaauuuuccauugauaauacuuuuacaaaacacaaccuggcuguagccauaacugccuccaagagagacaacucaccccccuucacucucagcaucugugaacguggcucccgaggaggccgugaaguagacagagcuggagccaguggagucacuccucucccggacaaacggaaaccuucgccgccgagccacucucugguucucuuccauguggcaucuggaaagcaggccccaucccgaaggguaccauuaggucccauccagcuugucuuucugcucaccauggggugccucuuacuacugcuccucauuaaagggcuaaaagcagagaaaauccuaagucucuaacccucaggagggcaagcagggcagcuuccugggcccagcccgcacagacagacuagguuaggcaaacagagcgcuucagcugcuacaacagaucaaccaugagaguccagaagcagcaaggagcaugugcaaggcgagguaccaaauguacagcuucaacccagauuaggcuagaagcuauagaacugguuuauucuuuagagacagacagcgaaggccagaacacaccccagcugaaaagcugcaggggagggauaaagcaggagaagaagccgcauuacucaccggaccuccccaacaaucucccccgcaagcccucgcaggcugcuucucagcuccuccaccucccgccgcagcgccacaaggcuggucagcacaaaguccaggcgguccagcaccuucuccuguccuucccguggaaggcugggcagcacugaggcaucuccagccccaccugggacagcccgcaggagcaucacugaagggggaaacgaaugggagccagugacacacaggaauaugguggggaagagaucucacacccagaauucaagaauaccugcuuuccauuggaagagaaggcccagugacgcucagauagcacacguucacagccaggucaugguaacaagucucaagaaacuacccagggaucucuaaacgagagcccucugcuccaagaaccuuccauaccagggcccuucaggaaugcugcacaccacgauagauaauguaacaugcuugcccaaguguggaaccugaaggaggacagcuguccugcuagaguuaaaaaaaaacaaaaaccuucaccucaccauauagugcccaauaccaaggagucaauaccaaccacauagcaaaacuaaaacuaaaacugagcucccucaaauucugaucucucacuucacaaauaauaguagggaaaacuuggaguuucucccagaacuucauuuaguauaucagagaaggacuaggagaaagggggcaguuauuaagagaaaagguacaccagaaaaagcccauccaaacugccucagaaagacaccgucacuaagcccugcugacccaacccuagaucucagaguaaauuccagcagugaaaugcuagcaaagugacagccaccuaugguaacugaacuggaaaaugcaaaaacaaaaaagaaaccagagaggcaggacccuacaauacggcaagcauaaaucccuucuuaaaggaaaucugguaaaaaacuaggccaggccacaacauacauccaauaaugcucaagaauguagugcaagaaagaucccuggcaauguggccacuuucuucuaaucucagaagaaacacuacugcgaagcaauuacaaacaaaauacaagggaaggaagcacacuccaauacuagauuaccacaagauuauaaaaugcugacaaucauuugcaaucuaagcugauagcucuuugaagacuccaaaacuaacuuuuccaaaccaucuaacauuggcaaucagagaaaacacucauuuccaauuagcaugggagugagauaauguaaacgcuccucuuggccaggugugguggcucacgccuguaaucccagcacuuuaggaggccgaggccaggaguuggagaccagccuggccaacauggggaaaccccaucuuuacuaaaaauacaaaaauuagcugggcaugguggcacgcaccugugaucccagcuacucgggaggcugaggcacgagaaucacuugaacccagggaggcggagguugcagugagccaagaucaugccacugcacuccagccugggcaacagagcgagacuccaucucaaaaaaaagaaaagaaaagaaaaaagaaaagaaaagaaaaaaaacacuccucuugcacaaagaugguaguaguuugaaccagcccuagauccuuugcucaaaugaauugacaaaucugcaagaacuacucauuucagcuguacaggcugccagccacauucagcuucaauugcauuaagcgugcuccuagcccuaugccguagaaaguccacuggaccaggugaccaggcccaaccuugccacuuaaucugugacagccucaggaaaguuauaccaucuuuuugaaucuugguuuccucauaggagggauaaaaagaaaaaaaaacuugaaugagauaguugccaaguugucuugauaguugccaaguugucuucaaauucuaauauaugauuuaauacauaagccucaagacuuuuaaucccuacaagauuauucuuuuugcccucuuuuggacucuuccucuacuuauuacacaccucacccaacacuaagcaagugccuuuaauacccacauagcacuauuguggccagaacuaaaagugaaaguuaaacagucuuuuugaaauauacuuucuugugaguacaggcgaaagaguagagaaaaccacgacugcuuuuuuuuuuuuuuuuuuuuugagacagagucccacucugucacccaggcuggagugcaguggcgcaaccucagcucacugcggccuccgccuaccagguucaagcgauucucgugccucagccuccccaguagcugggacuacaggccgcgccaccacgcccggcuaauuuuuguauuuuuaguagagaugggguuucaccauguugacaucugguugaacguuggccaggcuggucuugaacuccugaccucaggugauccgcccgccucggccucccaaagugcugggauuacaggcgugagccaccgcgcccagcccgacgacugcuuuuucaacaagcuuccaaaaaagugaaacccuaaagcacuucucuccguuacccugucccacagucuccaccgaaagcagcccagaccucaggcccauuagucugcagugaccgcggucucaggagacgggcuccuaccguggcguccgggaucugaagucugcguauaguccagggaguugggcaggcucuggcugcggccaugacgcuggguccguuuccaucgcuggcuguaaaggaggcacaggaauccaaggccggcggcgguacccagcaacagucccagcccggcacgggcaccacccagggcucccagucuagacaugcugcaccugcggccagcagaagucaccgggagcaggcaggcgggcgggcgggcggggguaaggagagagagagauucgugaacccgguaaacccacccucaaggcugaaccccggcagguauccccuugcccaaacccugagcucucgacuacgugcaccccagucugaacccuaaggcuuccuccagccuccugggccccacugccucucuucucacccagccuggacguagccgccccuccaguacaccccccgacccgggucacagaguccggcuucugggccuucaacccccaccucagccucacgacacugcagaccacaaacccggcgcccuggcugcaaacuccuggccuuccgccgcggcccccgaaggcgcucuggccuggcaggagauccacucagacccuuacccggccgccagccaccauggcagcagccgccgcgggcucacgcugucagugaccgugacgucaggcaggcggcgccaggugcucggcgcccugcgggaaggcgcagagagaugaccgcgccggccccg

SEQ ID NO: 13346 - RNA, 2467 nt, Homo sapiens
uccauagauuguguuagaauuuuauucauucucuccuguauccacagcucgguaccuauacacaagaggaggaaagagggaggccacugauuuaggucguagaaauggugugugucagagcuucccucuccccuuugcuacucuuagcgagucccggggggccaccaacacauggcccagccagugcugcugggcucugguuucuguguucuggugaggccaugggguggggccguagcacagccuguggcuuugacccagugggcuuggccugguuggcaggcccaucgucggaggguucaggcggcagaacugucuaaucccgggagacgguucuggaaaccagcugugccgcuucgcuguugaaugcccaucccuggauccaguucuccucucuucgaggaaggaaaccugccagggcucccaucacuaguaauucugggaauuccccaaaguaccccuuugcaagccgugcgcgugccuguggcuggcauucucuagagcugccuuccuucaccagggauugcuccggguagcuguguuggcagacugagccacguccucauuucugcuaaggauuugccuggucuuuuuccugaguuauacucuaucucuaccuaucucuuccuauguggccagccccuguaugcgccuccccuuugcugguggcuccaggccauggucuagacagcgcuguccauuagaacuuugugcagcgauguuuacguccauucugcacugaccagugugguagccauuaaucauguguggccaccgggcauuuggaauguggaaucuggaauaacggugcagcugaggaacugaacuguuaauuuuauuuauuucaauucagugucaugcagugaguggccaccagauuagacagggucaggccuucuccccuuucuuccugggccuucccacuuuccucuucugccuggguuggacugccuuuacccaagcuuguccugugaccucucucuguugacaguggcuuccaaagaggcuggcauggggcacucaucucuucugcucagucuguguccucccacucccugaucugaccccgugccaccuucuggcucugccagccucuaccugguuccuguagugccgcacagagccucccuuucccggcacagccucccuuucccggcauagccagcuuucuucaggguccugccaggaagggccgcccccccaacauuuccagauugccucugucccuccacucuggggugccuggaaggacuguccaggacccagagagcaggcagagcccuggauuccuauccuggaauccucccccaggaugaagaagcucugccugccugaacccuccagcgaugggccuggaguccugucccuguccuuuccuuaauccccagccucuggaucuuccagucaccccggcuuugcccacccucaccccauuuagaagcugggcucgcuaggaaacugcucccuuagcaucugcagaacuuccucaagaagugaaauccccagguccacuuugaaggagaggaagggaucacugaggucugggguagguguccucuggaagcagggaguguccacaaggcccuucucugagugcugguggagggcacucgacagagagagcgccgauggcaggguggcagaguaggcugcuguguaggcaggugggggcuccaggauguuggggcagcuugagcucucucgguagaggcgugggggcuuggguggggccagcaggguggcccggggcugcucguccccccacaguggcaggcgccggccaucuggccucccuuguagcucccggaugacuucucgguugcuguacuccucgugguccccaccugcugugcuggccuggcuaagcacacuacucugucgccggagccgccguggccgccccaggcucagcugcuugaagaaggaggcguugcggaaggagccuuuccgccaggucuccauggggcccaggggagccagcagacagguguucaggagcagccagggugcauguggucccugcuggggcagugagugccagcagcuggggaggcuccccuaggagcagaggccucaggguuuccacucagcacagaccuuugaccacaucuuggauggugagaggagggcucaggaagaaggaacuuuuuugcccaggagagcagacagcugggaguuccuggcagcaagaguuucccacagggacaggaguggccugguuacugaauaggguaguggaaaaaaacccaggaggaagaagcagcacuuacuggagccagaaugagggcagcuccggcggaggcagagguggaccuucucgggcugggugaggcuggcgagcgcuccuuccacaggcaggcagcagauggcccgagcucacucgcccugguguuugccuggcuccuauaugucucuggggcaguguggggccgugcccucucugccaguggcucccggacucugauga

SEQ ID NO: 13347 - RNA, 816 nt, Homo sapiens
agguguucagcugcuucaagaugaagcugaacaucuccuucccagccacuggcugccagaaacucauugaaguggacgaugaacgcaaacuuuguacuuuuuaugagaagcguauggccacagaaguugcuguugacgcucugggugaagaauggaaggguuacguggucggaaucaguggugggaacaauaaacaagguuuccccuugaaacagggugucuugacccauggccguguccacuugcuacugaguaaggggcauuccuauuacagaccaaggagaacuggagaaagaaagagaagaucaguucaugguugcaucguggaugccaaucugaguguucucaacuugguuauuguaaaaaaaaggagagaaggguauuccuggacugacugagacuaugaugccucgucaccuggggcccaguacagcuagcagaauccguaaacuuuucagucucucuaaagaaaaugaugucugccaguauguuguaaaaaagcccuuaaacaaagaagguaagaaaccuaggaccaaagcacccaagauucagcgccuugucacuccacauguccugcagcacaaacagcggcguauugcucugaagcagccgcauauuaagaaaaauaaagaagaggcugcagaauaugcuaaacuuuuggccaagagaaugaaggaggcuaagaagcaccagggacaaaucgugaagagacgcagacuguccucucugcgagcuuccacuucuaagucugaauccagucagaaauaagauuuuuugaguaacaaauaagaucagauucgcaaaaaaaaaaaaaaa

SEQ ID NO: 13348 - RNA, 7201 nt, Homo sapiens
agucuggucucuccccaucaugccucucacuuccagucugggcuucuaauaggagggccccgacuucuucccucccagucauucucucgaauggagaaucuuuccucauuccagggacaccaaggcucaggaaggggccuauccaucaucaguagagccagacaagcucucccaucggacguccuguggcugggcccagaaaugggugccgcugccugugggacugcccuuccgggaggaccagggugucuucagugcucuuggccugcacguggaggagaguaggcagaugucuggugcucuuuaagcucaaaggcaucauggcccucucuguggaacaaagggauacaagucagggauccaggcagcccuugagcucucgcacagaacauuccaccugcacccaccggaagcagcgggcacagaagagguccccaucgcagccagcgcagcguaggguggcauccucauugcagaugcagcaccaggggagcuccucuuccucagccucaggccugggguccacauccugggccuucagggaucagagaggaauggaggaaguaagguacccagugggguaugugagcugcugcaggagcagucagccaggcaggaagcaaggcuggggggagccugggggucugcaucuggggcuuuucucaccucaggcucugccccgcgggguugcguccagggucgagaagccugcucugcagggauguuaaagccacuugccucauccagggaagcuucuucagugagcugcggacagggugaagauguacuacuccccugcuucaggcccaggcccuccaucucccaguauuucugugcacuguggacuuagcuucucaaacucaucuuuuucuuuacuuguggccuguggcugcugauucccuaucuccagggaccagugggcaggucugggucugggucacaggagggggcccaaagagaacaggagcuucacaguuacuguccacccagccccagaguagagguggggcaaugaggcggagacgggacaagggguggcagguggguaauccaggcccaccugcugcaggacucuuuggauggcugucuccucauccucgucgucaucacugucugggaggcgauaguccuggagggucacuugaagagggagacaugggaacaggggaugggggagugagagugagagauuucacaugaguggcugcccuccugccucccagaacugguucgguucccaggggcacuuauuccagagcugagaagccucuucagccacccugaugaccugucccugccugccccagcccugcagggcugggccaucacugaagcaggccugagggcuagguugggggcuggagcgaaagccucagccccugaauggacugaagguccccugcccucauggcugccccugacuccucacccacugcuuugcucuaccaccuuccuuguggcucugggcugggcucaguagaucucugggcgcaaauacccccagcaccugacucagcccugccagggaggccuugaccaagggauaccagugagcagcugcuccccagccuucaccucucucgggguccuguccccgcagcauggcuagucgcuuggccagggccagaauccguuccugccucguguucuccucccgcaacucaagugcugccucagccagcagucugcucuucuccuccuccaaggaccaguuggccugccucuuggaauuagugcucccugggccacccugguugagaucauucuggagagaggcagcuggaagggguaaugccaucagcaaggccgagacaucccaguaucucuccucagaagccaaugagcccauuucucaaccuuuucuuuucuuuuucuuuaauaauuuuuucuuucuuucuuucuuucuuucuuucuuucuuuuuuuuuuuuuuugagauggagucucgcucugucacccaggccggagugcaguggugcaaucucagcucacugcaaccucugccuccuggauucaagcgauucuccugccucagccuccugaguaacugggauuacaggcacgugacaccaugcccggcuaauuuuuguauuuuuaguagagacgggguuucaacauguuggucaggcuggucuccaacuccugaccucgugauccacccgccucagccucccaaagugcugggauuacaggcgugagccaucaugcccagcuuuucucaacccuuucuaaucacagaucaucagcuuuuugcucagcacuagcgccuaugguuucuaucacaaauaaaauuaguauuccuccauuuuuccaaauguaaaaaacuaauaauuuuacccaugucuuuuccaaccacauccauccccaucuaccugauauuuuaacauucugcccuaagggugggcguccuaugguuugagaaucacugcccuaaaggaucaagacaugauaaggcccagguucagccgaucucuuugccuuucagggcaggaauuagcaucuccugggauuagcacagagagggcaaugaaggaagcuaagagcuuguauaucacugggcaggaagaauuuuaccagauuagguguggcucugacacagucaccuucaguuuaguguuucagagcaagagguuuaaaaucacagcuuuagguuuaagucucaucucugcagcuuaauagcugugugaccuuggucaaguuccucaagcucaccaggccuguuuccucauuuauaaaaaagaauaguauguaccuuauaagauuuuuuuuuuaaacagagucuugcuauguugcccaggcaggucuuaaauuccccagcucaagcuauccucccuccugccucugccuccuuaagugcuuaggauuacaggcgugagccacaccuggccucauaagauuauugaggauauucaaugagauugugccucuaaagcaggacuucucaaucuuaguucucuugacacuuuggaccggguaauucuucaucaugaugugcuguccugugacauaguagauuuaguagcaucccuggcuucuauccuguaggugccaguaauauccucuggguugugacaaccaaaaagucucuaaauguugccacaaguagccugggggcaaaaucauccuuuguugaaaaccacugcucugaagccuucaaacagcacuguccaacagaauguucuaugaugauggaaacauuccauaucauguucuauaucugugcuguccaagaugguagccaugaagcccauauggcuacugagcauugagauguggcugguuuuacuaaauagcuucuuccuccuuaucaacaucaugauugcagagaauauucacugaguacucacuaugagucagguauguucccaagcacuuauuggauuaucucguuuacuccuccugauuucccugugagguagguuuuuccauacauaccuucauuuuacacaugaggaaagugagacuuaggucaaguaacuuguccagcaucacacagcuaauacgugguagaaaugggaaucacugucugauucuaaagcccgugcacuuaaacacuaggcuuacacuggcucccuuuggaguaagcacucaaugaaugguaacucuuauaacguugaucacucuccgauuuauauucaucucccagaggguggacagcagagccucuccagucuggggaaagagguagggcagauuccuagggagccaaguggagggguuaccugggccuccuccuuuccagcuuucaucgauagccaccucagcugccagcugcguuagcagauccugugucugcugggcuuggguccugguguccggugugugaugugccugcacagacgaggaaaccucaguggagagcagggguagcccagaagcagucuaggucagggauggaugcuaaguaguucucaaagcccagggaaaggagagggauccagggcccacauaaucaaguaggucuggccguccccaacaggacugaggggccacuuuuuccugcccuacccuaucgugcuguuugucccugguccccgggucugguagcaggccugaggaucaggagguaggggugggaggcuuugccaacuccugcaaaguacauaaaguacaaagguuggugcaaaaguaacugagguuuuugcaauuaaaaguaaugacaaaaaccacaauuacuuuuguaucaccccaauaccuguaucugggcuucugcuggguccucccgcuagcacccccgcuucucuccuaagccauaacacucaccggcugggggguuugagaagguagaacucugcccugcaacgcugcaagucgugccuccauuuccuggguggaagggauggaacccugacguucauccuuuagggcagccagccgugccucuaucucugccugugaggggacuaacucugcaauuggcauggggggagccuuguaagggccagaggcaucucagucccagaagcccuggacuguguccucuaggcaaccccaucugccccugcucacugggcuuguucuccuggcggagucgugcuaggcgcucagcaaucaucuggucuugucgugucagucccuggcucugggaagugcugggcuuuugcuuggcuuccaaggcugccacacgccuggcaggauaugagauagaggcucuugaagaaggcagaggggaagagugaaggcacccacucacuguuucccauucaaaucaaaucauuucugggcacuuagggaggccuccaaugggcaaucugcugugccccucacucaugucacccugcagcccaaccuggcugaccagccagacgguccagcugaaaggacaagcucuaccaagugccuguccuggagagagggcugaagagcugcuuuaccagcccaagagggcagucaggagccagagaggagagaauucuccugauucugugcucauuuuaucuagaagaugggggcagggucuuucccuauggcucccuuauccuuuccccaaugcucuuugucuuuuucucuucagcacuuacuucuuauaguucugagguggugaccacuuggaggcauuggcagaagacccucuacagagaagaaaucuaguguuauaaauccugccaucccaccaggcagugccccccacuccaaacacuuccucggcugacucucgcgacagaguacaaagcugugagggcuggccagaugcccacugccauacuuggcugaacuuucacccaugccugccucuuaccuggucaggaccucauggcauugcuugcagacuuucuguuggguguucccaguccgaggcacugcugcacugaagcuuaggcagccugaacagaaggcccugccacaauucuuacagccguacuacaagaaacaugaagcgggagaucccccucucacccgccccugcaggcugcucccagggacucuccaagcacacacagagagaagucacugaaguuaugaccagcugcugggaggaagaagaggaguggggccccuaaggccuagggauggugaguaaagcaauuccucgguuuccaguaccuuauucaagccaaaugaagguuuauacaaaauucccaugcuuucuacccugucuucaauucccugacccagggauguagaagacagauagauaaagcccaguauuucaggccacugacucuuccacaaaggagaaucagagagacagggcagagccgaugccuccucugcucuugcagagauggagggaggcuuggcucaggaugggcuaacaauagccuccauuuauuaagcacuuacuaugugccaggcacuaaacccaguacuuaacauucaucaugugauuuauuccuuacaauuuacacacauuauuuuacuuaaucuugaugccaaccgugauuauccuuauuuugagagggccagagagguuacauaacuuauccaaaccaaggucaccgccucaauaagacagcagagcucagauuugaacgcugacuccaaaauccagguuggugaaugcugcacgguccugccuuccugcgugacacuaauuuacuccaucuaguucccaucaucuccuggucagaaucccuggccacaacugaggcagagggaaccugcaguuuaccagaggaaucuggcaggucugugauagggacaggacagucagccuucaccauggugccccggaagcaggaggaagugugguaaucuaacuccagcgaccuggagaagggcaggcugcgggauggggaagauuucagagcagagggaguaacgggcuuggugugauggacaccgcgcuucggaggagcaggguggagagaagaaaaccgccagaugcuacacugggccgacagaaaagaguagcuuugcaaaaacgacggcagcgcgcuuuacaguuuauagggaacucucaccuaaagcacuucaguggacccucacauaaacccugaaagcgagagaauguuagccccauuuuacagaaauggaaacugaggaucaaugacuucaucaaaaccacacagcuggaaaggagccguaagaccaagucuuuggacguuaagucccgcgcuuuucccuccucuccucccuggcccugcagcccucggggagggaagacucgccuccuucuugaagagggugaacuugacagcgcagccguagcaccuacucuccaugguggcucccagcaccgcagggucugcagagcugagaucacgccggccaaguccugggccccuuggacccucaccccagcuccgcccuucccuucccugcccugccccgccccacacgcccacuggcacugucccgccgcgaccuagagcagggaauccggacgcucuccugcagccagcguacggcagcggcggcaacgggggcugcugggagucguaguucauucacgacugccggccucccucagagucagucaagccugacccagaacacaauucccagagggcuaggcgccgcucggagccugcaguccucacgcgcgcuuagacucuugggaguuguaguacgaauccgucaggccggaaccauggcagugaccaaggagcucuuacagauggaccuguacgcgcugcuaggcauugaggagaaggcagcggacaaagaggugagaacgguggcgaggaaggcugaucuugagaggucuggcgguccuuccuguccuagcgccucggccacugcuggcauccgcucuccagg

SEQ ID NO: 13349 - RNA, 2035 nt, Homo sapiens
ccuucacagacuuaagguuuuauuugcagacucugcacugcucuagcuucuaggcugugugaccuugaggaaagggaugauccccaacccgguccuccuucagguucuaauuugcagcuccucccccuccuuuugcugggccuugacucucacuuccugccccacuccuggcucagccaguuugggcagugccuagggagcccagagacccaguucuucccaggggccagccccgcccucccuggccuuggggauugagggcagcccaggugucagccugcuccucauccaccccacuucccucucuccuccuccucgucaucuucuuuccaggccuuauccaccaucagucccaggcuccaagaccucuuuuccugcucgcucucucaaucucucgcccacuccaucccaaacuucucuccaaaucgggguugagccccuuccagcccuccauaaugccaagcguuccccaagcucuuucucaccccugugccaaggaaggguccuaauucagccaggcugaccugagggcccaggacaagaaacuggguucccaaacugcucggaggugacugacccuguuaggaccaucccaugaaaaucaaagugccagguuuuuuucugugagcuuugacuggagaaauccaaaucagagccuucccuccuaggcucacccaggcauaucagagugggcaguuagaggcccaugucccccgaguguucagaagggaacugaguccuaugagguggccaggcccugccaguagcugccgcaaaggcccgggugccccaggucucagaagucuuuggccuccugccuacuacuugcuaugcagccauagcugcucaaacgaagcagaagaacuucuuccagcggcagcgggagagggugcgcacaccuuuggcauucaguuucuucuccagccgggcuuugugcucaauggcacugagaauagccgagucaaauacuuccuucaaguucuucugcgucaaggcugagcacucaagguagcagcaggcucggaucuucucggccagacccugagccugggguuggggcacggggcccucccggccccccugguccagcugaauuaguacguugacaucgucccucaggucggccugggugcccaccagcagcacaggcgccuggggguugugcgugcggaucucgggcagccauuucucugugauguuuugaaaggagcugggcugcaccacgcugaagcacgccaggaagacaucgguauccggguagcaaagggaacgaagucggucaaaauccuccuggggugggaaggccaggugguaaggauuagccccccgacacauggaauccauuucucacccggggcuggaaaccugagacuccaagagcccaaggcuuucuccauuugcuccauaugggguccucccagccuccagcccaucuccccgcagaccaguagaggccgcgcccagcuucucaccugucccgcugugucccagagcucaaugcgcaccggagcuccauccaccaggacuugcacugcaggggcggggcggggagagccugaguuaggaagagcguccugggccgcaccagcgccaccucggggccugcuccagucuccuccccgggguccucugcgcccucccgccgagacgcccgccccagcuccccggugcacagccccgccgcagccacgcggccgcacgggcgauugaacguacguaccagagaagguguccagcgcagugggccgguagcgcgcgggguacccauugcagguguagcugacgaugaggcugcucuugcccacggcgccgucgcccaccagcacgcacuugaugcccagcucugggggcgcgcuacgccgccgcgggggaggggucggggcccggagcgggggcggcucggccucgcucagcucccgcggcggcauggcccgcuccgggggcagcagaggggccagcccgggucucggcuucgcugcgcucggugaagcaggucccgcuggcugccucugacugaauggguccaggcugggcg

SEQ ID NO: 13350 - RNA, 5617 nt, Homo sapiens
aaagugccaccagcagcaguagcgcccagccagaggcgcuccgggacgcugccgccauccccucgggcgucgcucucuccacccgcgggcccucaaucuggcucuguucgcgacgccgcuuucccgcgcguccgccagccggcggggucccugaaaagaggcgcuccucucgggacgcugcuccccuuuggccuucucgcuggcuccgcugcagcugccgcuguagguaauccaggugacuacggcugggcggcgaccgcgccgaggacgcgucuucugucuaauccuggggcugcaagcgggcuagugccgguguacgcugcaccaaggcggcuggggcugcggcucuuggccucguguucccggccugcgcgcagcgccgcuacugaaaccugcgcgcugggggccuuccuuauauauauuggcuccucuccucgccgccugucacucagacucauggucauucuccccuccccucccggccucuagcugcuacagucccagcgccgcccggagggggccuccgcccccgccgcuccccccuccccgucagccagucgggcgcagguccccgccccuccgugccgcucccaaccucuaggucccccagcucugcgcgugccgaggugaccaguccuccgugauggcgggguuaagggcugagacccuggccgccggaggauagagggguugcccgguaauggggcaggaggugagugggugguucggggauggucuugggggcggagacacuaggcagucccuguaggcugugcauccgcagcaggcgcuaguuaccuaguguuccaaagcagguaaaaagaacuuaagcccggaaugcaaaaaccagcgcuagggaaauccgaucuccuuuuccuuccuggagcuucuggagcccuugucucaacggcccccaaccuaugagugcccacccaccacgcguccccagcgcagcagggaagccagcagaagcguuaaccucucuguggccacucugagcaaggcuaggggcuaagggucuaaggcucggggcccucucugugcaccuguugggcgucucccucucuagcuaagggggggcgugcccagcgcgugccuucucccuucugcccccugccagggcuuggcgcgugccagagacccagacgcgcggucccugaggugggggagggcggggcguggucccggagguaggaggggggcgcguccucagcuguaugguaaugagguucuggccccgccuccagcgcguccccucaccugaguccagcuucaguuccugcgcccacugccuccccccaccccagcagccccaagcccccggccgcgcccugucgcucagcuggggcaaggaggaacucuccugacgccagaguuggcucaggccacuggagaaucaaggugagggacugaggccgggucggcccggguccucgccucauaaggcgggaugugggguggaacuggaggcuugcggagcuguuugaguuucaggcggcuucccaagucucgcccgagaggguccccuggguggccccacuccuccaagcggcagcagcgcagcugcuuucucggaacccggcgugauccccggagaccgcagaccggggagggccggcuucucccagucucaggggugccggggagcucucucuuugcgacgccgagggcagcgggggcccuguggcuucagcugucagcccgcccgcgaggugauggcuguagucgggcgguaagaucagcgcggggggggagccgggacgcggcgcgaacccgggggaggcgguaagggugggggagcggcgagaagcccaacagcugccaaugccgagcauggucugauuuuuuuuuuugaguugggugguggugguggaggacugggggacggguguggugggggggggaaggaugagaaacaagagguugggagcguggguugggggaggggcgaggugaggagacgggcuccggggucccccacgcacggccaccccucccagccaccaucuggcgcgagcggguuggcguggggaaccgagguggggcggggcggcagaugggcccaggcugcgcucgggaguuaauguagguuaugggcaggcggagucccaggcccgagggagggggaguccggggcgugccucccggcgauccuggcaagugggcucccagaucuucucuccgccuauacccuauggaucccuggacuugccucucuaagaugccagcgggugccccuugcuccccuccaagcuggcauccagcccuaccuagcccuguccucucucaacuccaaauccuggcccaggaguuaauaaaaacauccuccuuuucuggcgcugguccugcuuaccugacccucaagggagacaucuagucccacacaaggcaucucucccaauacuggaaaaucuggaacacucucuacccucauacacgcccagacuaaugugcccaaauguacuuugcaaauuaucaaggaccaaacaaaaguugggauuauuaucuucagagaggcagcacccaggagaucccagagaucuagaaaggcucugaccagaagaggaaaggguuaaauucucagcaucaaaagacauucaugaaacaccuauuugcggaggcgcugucccagaagcucauucccgggcuaggacacugccacccuuggcccuggguaccuacgagcgcucccacacgcugcggucgagcuuugcccacauuugcugagcaggagagggucaugcugcggguggggagcccagugcgaaggccgcaaguguuucugucagcccaaaacuggggcugcgccuuccuucuucucccacucgggacuuucggacuugcgggcggaagaacgcuacacgcgugguccugggaugggaggccaccgaucaccguggggcuggacccccaucgaagucggcugcccccgccccugacgcagacccuccacaacagcauggaaagggugcacagauagacccagaguccgaaagaccacugacccuccgcaggcccaggguuccucaauucgacccgcacccucaacacuccccaacgucggaagcgggcgcagggucgaggccuggcuucaugaaaggcccaccgccucugccccuagaggccuucugcuucugcugucccccuacgcuuggccauugcgcauaguccuccagccauaagaaccggcacugaggaccgggaagcgcuaaggucgccuuccagcgguguccccaagcugaccccagguuauuggggcgcaacaggagccucguagagccucgggacuccucccccgcagcguagccucugugcccuccccacggccgcaggcgcagcuccgagaccuucagcgcgguuuugccucuccucuccccaacccccucucaggggacggcgcucuucgcggggcacacugcacccggguaggagcgcggugggggccgggccaccgugccugcugggcagaccaggggcggggaagcaggccuggcuugggcggggcgcuuaagccuugaggggcgccgcugcggucgcugcggagaaggggccacgugcagggagcggcggccggggagcugcacagaaggcguggagauuugcaaacuguugcugccacauggcugcuccauucgauccauucacauugaaaugaggccggcgcgugccucaucugccgcagggcgcugccacgcgucagcccggcccgccgcgugccaacuggggcagugggacuggcagagccuggcagccgugggggcgcagcccggggccugaggccaggaggguguugggggagggagucgagcuacccuagccauucaggcgccgcaguuucaaggaccuuggcccuacaauugggagugagcuggcgagaaaggcccaggaccgacggguuucagaggggggccgggaucgaugccgccgcuccccgcagaugcgccccggcagggcuacucuccaucugccgcugcucgcaccugccggucaauaaaucgauuuuacaauuuaaugcagcagcuucccgcccgccugggacagaugccgcagcagaaccaccuccgcccucgccccuccccucgaggggcgccagcgguuagggacgggauucccgcucagcaggcggugccccgcguggccuccuucaccucucucuggagcccccacaaggaaccgccugcugaggguuuuucccgcgggacagaguggguuccccauagaacaggccugagacuggagagaggagugaggaaggugaugacuuggugguggccuugagaacucaucugggggcuucaagggaggaacaggaugcagugacugaugauaagaagggccccggugagaaggaagggguagggcaugggcgcugagggacaccgaacucugaagaaucuuggucagggggacugagcagagauggggaggaggcaggaggaacgagucucuccccacccuccaggugagucuggugaauaagccugacauggaccugcuucuuggcacuuccuaaccauguggucuugggcuuguaaccuaacucuagcucuacacucaguuuucucaucugugcaaugggauaauaauaauagggauggccggugugguggcucaugccuauaagcccagcauuuugggaggcugaggagggcagaucacuugaggucaggaguucgagaccagccuggccaacauggugaaacccugucucuaccaaaaaaaaauacaaaaaguagccaggcauggugguguuugccuguaaucccagcuacucaagaggcugagggaggagaauugcuugaagcugggaggcggaguuugcagugggcagagaucaugccacugcacuccagccugggcgacugaaugagacucugucucuaauaauaauaauaauaauaauaauaauaauaauaauaauaauaaccuuggagccuuggagaguggcugagggacuguaucagauuaugcauucaugggacccaauaaacagucauuuccuuucccccaggugacauccagacagucaggggcagacuuagaguggaggggagcucccugacugcaaaugaguuccagaaggaaaugaaggaaaaaggagaaccgcagacaaaugcucauaagggaugaggcaugaggagcagaggguggggaaaaaagagaggaaagcuagguggggcucggaagggauccggacccuguggaaaaagccaacuguuggagguccuguuuguggcaagagggugugacaaaguucuugacuggagggagaagacuggagcuuugagaauggguuuggggaagauaugaagguuuggaggaacuaacugcucacagucuuggccuucggaaaccaagacggcacuccugccagggccaaguguagguuucaaauuguaaccccuccuccuucaugguggcaguucagagcugagaccuguggcaggaaagaggggcaucuucugcccugguccuugaagcuccuggcagaucagcccucucugugucaccaagacagcacacugaccgggcuggaccauccacuggcugauggcucaugacugaugacccaaaugugccaaggaagggauguccaagugguugggacccuuggcag

SEQ ID NO: 13351 - RNA, 27267 nt, Homo sapiens
uggcggcggcggaaacgcgaucucugcggggcaagauggcggcgcccagacaggccuggagcacguagguggcggggcuggagggacggauuucaggugaucugggaggaggacccaggguagcguguccaguuucuuugcuggaaccugccugcgggccuuuggucuguaagggagcaacuguggccuccucugugcauagaucucgggcacggcccuucaacgggcggcgaaagcugcgacucgaugauuccucauuguagaguugggugguccaggaggcuuaacuggagcccuugaccugagcgguaagggcagucacgcgucccgacucgggauuggauccuggcucuggaggauaggcugcaauguaagagccccagagacuccucagaggccaacauaaacccagagguccauuguuaggacuacuuuuuuuuacgaguuacucuuuaggcauuacucuuuaggauuacaggcgugagccaccgcgcccggccaacccauucuuauucuauuaauaacugaaaauguuaucacuucuagcacugauugguucuggacaaaucugcgcuggauuuguggggaaacacacugguggcuuuacuuaggacuaaaauaauuguuacugagguuuauuuauauaaguaacaggcacugggcuaggcguuuugcguguauagucauuuaaauccucacacauuuccuauuauauaggaccuguuacucacauuuuacaguuguggaaaugggacuuaagacagcauagaggccgcgcacgguggcucacgccuguaaucccagcacuuugggaggccgaggcgggcgggucaccugagaucaggaguucgagaccagucuggccaacauggugaaaccccgucuguacuaaaaaaauacaaaaaauuagccgggcgugguggcaggcgccuguaaucccagcuacucgggagccugaggcaggagaaucacuugaacccaggaggcggagguugcagugugccgagaucgugcuauugcacuccagccugggcaacaagagggagaaucugucucaaaaaaaaaaaaaaaaaaaaaaaaaggacagcauugauaauuugccuaauuucgcacauuuagugcauuuaguaaguagcggaacugguauuugacuucuggccuauugauuccaaaacuggugcccauaacccccuggcucucuuugugauguagguauggcgcacccuaugaagugagcuggacuuugcuuuuggaucacaugaauccauggauaaguaggaauuguuucugcuuauguagacucuuauaggagugaauuguuaccauacuauggauucucaguucaucuaguucagccuuccuuagggccuuuggguaggcauugggguaggagacuuuuuccuuguuuguuggucagacugcccaacaauuagauaugguuaucugcccuuuggcuauauaaauaauaagaaucauaacuggcguuuguguccuuucauguaugagacucuguucuaaucuucuuacauauauauaauuaauucaggagguagguacaguuaucuucauguuacagaugaggaaacaagcacaguaacuucaguaaaauaccuugcuuaagcuuacacaguuaguaaauggcagagccuggauuugaacacaggcaguccauuuucauacuguuuaccucccauccaggaaaaggcacaucuguauacuucgcuguugucaugcuacaaauaguaauuaauacaaguucuaugccaaauuuaagaugaaauuuuguagacaggucuuugcucacuucauccacuuccuucaguucucuacuuaucuaaguuuucucuuucaauauugaccucuauuuuuaaccuuuagggauuuuucccaccucugaaaucguguagcacugaucuucuaugcaauuaauuucaucacugggauguacugccuuguaaauuuauauguguguuuaccauauucucucaccccaacuuuggguacaucauugaccaaaggaagaccuuuacaaucuuggagacaucauuuaaacuguaaaccuuuggaauuucuagacuugugugggcaaagagagauaaugaagugggaaauuauuaaaagacccagcauuucggcauggucucugucuccccaguaagccccuugaacccagggacuggauuuuacucccauuucuuuauauuuacagccccuuguacaccgcucagcccagaguaaacucucaaaaaauuuuuugauaauguucuuaaggucacaccgucaugugauuguuucaccauuucuaccccuuuagccugcccccaaccccuguguugggagguguuuccaaggcuggcuuaguuauuagaucugauccugcuuagaaguagaugaagaaaaaguaaggaaaugugucauucagcacuuuuuuuuugagacagagucucaugcucugucccccaggcuggagugcaguggcacgaucuuggcucauugcaaccuccacuucccggguucacgccauucuccugccucagccuccccaguagcugggacuacaggcgcgugcuaccacacccagcuaauuuuuuguauuuuuaguagagacggcauuucaccguguuagccaggauggucucgaucuucugaccucgugaucugccugccuuggccucccaaagugcugggauuacaggcgugagccagcacacccggccuucauucagcacuauuguuaguuccagcuaucuagcuugucuaccucuccaucucauccuccuucaacuuuuaggagguggucaacuucaucauguucucccauguaccauauuuauucccugcuuuuuuuuuuuuuuuuuucaagauggagucuagcucugucacccaagcuggagggcagugguguaaucuuggcucacugcaaccuccaccuccuggguucaaaccguucuccugccucagccucccaaguagcugggaguacaggcacaugccaccacgccugccuaauuuuuuuguauuuuuaguagagaugggguuucaccauguuggccaagcuggucuugaacuccugaccucagaugauccacccaccucagccucaaagugcugggauuacaggugugagccacugcgcccggcccuauucccugcuucuauaccuuugcccagcucucccuucuggcuggaggccuaucuuauccuucaaggucugguucagugguuuucaacugggggugauuuuuuucugaggugacauuuggcaaugucugcagacauuuuuacuugucacaacuaggggaggagguuugaugaugacgucuaguggguaaaagccaggaaugccgcuaaacauccuacagugcgcaggacagcuucccacagcaaagaauuacccagcuauaaagaucaauagucccuauugagaaaccuuaguguaguugcagccuuugcucuucaggagauucuuuauaguucuuccccaucugccucacuauuccagacuuccaggacacccaggcaccacacagcaguaggcaguagaacauaguggguaagagcauggacugacugggauugaauccuaauccuagcacacacuuacacugagaccuugagcaaauacuuaacuucucagcacuauucuuuucucagcuguaaaauuugaauaauaguaguaacuggcccguugcaguggcucacgccuguaaucccagcacuuugggaggcagaggcgggcagaucaccugaggucgggaguucgagaccagccugaccaacauggagaaacccagucucuacuaaaaauacaaaauuagcugggcgugguggcacaugccuauaaucccagcuacuagggagacugaggcaggagaaucgcuugaaccugggaggcggagguugcagugagccgagaucgugccauugcacuccagccugggcaacaagagugaaacuccaucucaaaaaaaaaaaaaauaguaguaaccuaccuccuaggcuguuaugaggauuaaaugaaugaauauggaaaaagugcuuagagaacaguauguggugcauacuaagugcucaauaaguguuagauauaacaauauuuuuauuauuaucagcaucuagcucagggguuccaaaacuagccagccagcuugcagauaucuuuggccagcccagcguuuuuuguuuuauaauugauuuauaguuuauauaccacagaagucaucauuuuauuuuauuauuauuauuuuuuugagacggagucucacucugucgcccaggcuggagugcagugguacgaucuuggcucacugcagccuccgccucccagguucaagugauucuucugccucagccuccugaguagcuaggauuacaggcaccugccaccacacccggcuaauuuuuuuuguauuuuuaguagagacuucaccauguuggucaggcugguuugaacuccugaccucgugagccaccugucucagccucccaaagugcugggauuacugaugugagccaccgagccuggccagaauucaucauuuuaaaaguuuacaggccaggugcaguagcucaggccuguaaucccaguacuuugggagcccaaggugggcagauuucuugagcccaggagaucgagaccagccuguacaacauggugaaauccugucucuguaaaaaacacaaaaauuguggggcacgguggcucacgccuguaaucccagcacuuugggaggccaaggcagguggaucaugaggucaggaguucgagaucagccugaccaacauggugaaacccugucucuacugaaaaacuacaaaaaauuagccaggcaugguggugggcgccuguaaucccagcuacucaggaggcugaggcaggagaaucacuugaaccuaggagucagagguugcagugagccgagaucgcgccauugcacgccagccugggcaacaagagcaaaacuccgucucaaaaaacaaaaaacaaaaaacaaaaaaaaaaacaaaaauuagcugagugugguggugcaucuguaguccuagcuuuuugggagacugaggugggaggacggcuuaagcccaggagguagagguugcagugagccaagaucacgcuacugcacuccagccugggugacagagccagacucugucacaauaaauuaauaaaguuuacaauucauggcuuuuaguauauucacaagguugaacauuuucauuacuccaaaaagacgcuccauacccauuagcugucaauucccauuucccuccagcucuccuagccccuggcaacuacuaaucuacuuucugucucuauggauuugccuauuuuggacauuccauaugaacagaaucauacaauaugagguccuuuuuggcuagcuucuuucuuucuuuucacuaaauaaaauguuucugagucauauagcuucuuucacuuaguauaauguuuucaauguuugugcauuggaacuucauuccuuuuuguugacaaauaaauguaaggucucuauguuaauuucuuuuuugccuuugugccaugguuacguaaagucuuaaccuuuggagaaacugggugaagacuacauauggaaacuguucauacuaucuauauaaaucuguaaaucuaacauuauaacaaaucacaaguuuaaaaaguacauaaauuuacaguauauagagaaaaauagaaauaugcauauuuuaucaugauacaaaacauuugauugcugaccuguuuguugauuuuuuuuguuuuuucuuuccuuuuuuauccucuaagccucugaucacuuaucauugucaagguugagcagacagagaagugcauacauucugcagcuugagugccuaacuugagauucuguuucugacauuuacuguggauuuggggcaauuaaauuaacuuucugugucaagugggaggaucacccaagcccaggaguuugaggcuguaguaagcuaugauagcagacugcacuccaaccuaggugacagagugagauccugucuguuuuuuguuuuguuuuguuuuguuuuuuugacagagucucacucugucgcccaagcuggagugcaguggcuccaucucagaucacugcaagcuccgccucccggguucacgccauucuccugccucagccucccgaguagcugggaauacaggugcccgccaccacgcccggcuaguuuuuuauauuuuuaguagagacgggguuucaccguguuaaccaggauggucuugaucuccugaccucauaauccacacgccuuggccucccaaagugcugggauuacaggcgugagccaccgcauccggccaaugcaauuguuuucuuaauuccauuuucugcauguucuuugcuagugcauagacauacaauuuuuuuuuuuuuuuuugagacggaguuuuacucuuguugcccaggcuggagugcaauggugcaaucucggcucacagcaaccuccaucucccagguucaagcgauucuccugucucagccucccagguagcugggauuacaggcgcccaccacaaugcccagcuaauuuuuuguauuuuuaguagagaugggguuucaccauguuggccaggcuggucuugaacuccuggccucaggugacccacccuccucggccuuacaaaaugcugggauuacgggcgugagccacugcgccuggccacaaauguuuuuuauauugauauuuuacagcccaagguuuuuaauaauuuacauaccuuuaggccaagcauguucucuccaguuugauacagaaucaucacccccccauuaugacaacauuuaucugcucggccccugaugacauuuuccucaggucuccugcugguuguuccugagaguuuuaucaccuauagauuguaaacaaccuaaguuggcuauaaauauuguugcuaggcugaugacaucagggagggcugaagacagagggaauggcaguaagguaugaaugaggaggaaugaguucauguuaacccaaggauaaagaagaucuucgcuguugcccaauaaagagaaucaggguucaguugcagagggcccauauucuuucuugcucuuagggaugaauaagagggaacccccacacggagacacugcuggagagagucguacuggggaggcagcuggagcagcaagaugcugucgagaccgaagccaggggaguccgagguggaccugcugcacuuccagagucaguuucucgcagcuggugcagccccagcagugcaguuggugaagaaaggaaauaggggcgguggugaugccaacucagaccggccuccgcuccaggaccaucgggauguggugauguuggacagugaguucccauggaugugaggcugagaaguagagaggguacagccucgggccccucccucuuccuguugugguuggauucagacacaucauuauuauuucagacacugcauagccuguguuucugcagccccauuuuacagaggaagaaaaugaggcucaaagagguuaaauaucuuacccaagaugacacagcuugagccagggccccauggcagcugucuuucuucccuagccugcagugucuuccuaggaaggugugcauauacucacguuugggaucuuuucuuucucagaucucccagauuugcccccagcuuuggucccuucuccuccaaagagagccaggcccagcccuggccacugccugccugaggaugaggacccagaagagaggcugaggaggcaugaucagcacaucacugcugucuugacuaagauuauugugcgucucacucuggcugaguaggauaagauguucuagggcaacagggauauuggaugcucggggugggugaggcuuaucaguggagggugcuucagaaagguagacuuuuaccccugaggucagguugggggcuggguuagaaucacugcccugaagggaggaggguccguaaccccccagagugagguucucaucguucagaacugggcuaauaggaucggguccagccuggggaaguuucuccauugugcuucacaacuuugugcuuuguugcuacaggaacgagauacaaguucaguggccgugaaucugccugugcccagugguguugcuuucccugcuguguuccuucgcucgcgggacacacagguaggcaaggguaagcuuagguggugcucaggagacagacaggugagucucauagugcaucuucuccaggcagguaguuuuaaugaugauaagcaauuuaauuuacaaagcaggaucauacuaagcacuucauacccauuacuucuuuuaaucuucauaacaaacauauaaggcagguaucaugaugauaccuuggggaugaggaguccuuauucccauuuuucauaugaggaaacugagaccccaaagagauaaauaacuuguccaacaccacacaucuaauagguagaagagccagaacuucaacccaagucugucagagucuaagaccuuuacucuuauagaccucuccuuuuucugagaacuaggguugugaucccuggaaauugagcaaauccccuuuuaucucuuuguuccagaggccuugauauaaagagguugagaggaaagugggaugaugagcaucaguaaccuggguuuucuuuuugccccacaggggaaaucagcaacaucugguaagagaagcaucuuugcccaggaaauugcggcaaggaggauagcugaagccaagggcccaucaguuggggaaguugugcccaacgugggcccaccagagggugagccgggguugaagaggauugggcuuggccuuuuuaaaagacacaaucauagggucauuuuugaagauaugucuuccugccucaaaugagaggugcauuugagccaucucaaguagucugagaauacuagguaugggaggcuuggguccauaucugggucucaggugcugggaguggggcaggccauuaugcaguccuaagagaaagggaauagggcagaagugucuggcagagacuguaaaauaaauguguuggccaagaucccuuuaaugaugcaaauuauuagcuuaacagcugggagcaggccccuggcuauagaugccugccuagauaucuaagaggagucagaaauuaggauguuucugaggaaaaccuuuucauauaaguacuagggaagcagugaguggagaagccaccuggagucccugugccagacccaguggggucuccacucugaggaaaguuugggucuauaccugucuccagggcuaauagccuuauagaagaaggccaaaaagcccaguuagagcccuggaggacagagcaaugaaugugaucauaccuuucuuccaggugccgugaccugugagacacccacuccuaggaaccagggcugccagcuuccugggagcagccacagcuuucagggacccaaucuggucacagggaaggggcucagggaucaagaagcugagcaggaagcccagacuauccaugaagagaacauagcaagacugcaggccauggcuccugaggagauccugcaggaacagcagcgguugcuggcccagcuugguaugggugccuggcuuuccugcugagaccaggcuaggagaggaauaccacuuauugagcuaggcuuacugugaguuccgggcacugugcugaguacuuuaaugcuuuuuuuuuuuuuuuuuuuuuuuuugagauggucuugcucugucacccaggcuggaaugcaguggcacgaucucggcucacugcaaccuccaccuucacggcucaagcaauccucccacuucagccuccuguguagcugggauuauaggcacacaccaccacacucagcuaauuuuuuuuuuuuuuuggggggacagaguuucacucuuguugccuaggcuggaaugcaauagcacaaucucggcucaccacaaccuccgccucccggguucaagagauucuccuaccucagucucucgaguagcuggaauuacacgcaucugccaccacgcccagcuaauuuuuuuauuuuuaguagagguaggguuucuccauguuggucaggcuggucucgaacucccaaccucaggugaucugcccuccucggccucccaaagugcuaggauuacaagcaugagccaccaugcccggccuuuuuuuuuuuuugagauggaguuucggucuuguugcccagguuagagugcaauggcgcgacguaggcucacugcaaccuccgccuccuggguucaaaugauucuccugccucagccuccugaguaucugggauuacaggugcccaccaccauacccaacuaauuuuuguauuuuuaguagagacggaguuucaccauguuggccaggcuggugucgaacuccugaccucaggugauccacuggccuuggccucccaaagugcuggagccacugcgccuagguuuuuuuuuuuuuuuaagacggauuuuuccucuuguugcccaggcuggagugcaauggcgcaaucucugcucacugcaaccucugccucccagguucaagcaauucuccugucucagccuccaaaguagcugggauuacaggcgccugccaccaugccuggcuaauuuuuuuauuuuuuguauuuuuaguagagacgggguuucccuguauuggccaggcugguuucgaacucuugaccucagguggaucaaagugccucccaaagugcugggauuacaggugugagccaccgugccuggcccccagcgaauuucuuuuaagguuuuuguagagaugaggucucacuauauugcacagguugguuuuuguuuuuuguuuuuuguuuucagagucucccucugucacccaggcuggaguggaauggcacgaucucggcucacugcaaccucugccucccagguucaagugauucuugugccucagccuuuucagcagcuggaauuagagguguguaccaccaugcuuggcuaauuuuuuuuauuuucaguagagauggggucucaccauguuggccaggcuaguuucgaacuccuggcaucaagugauccaccgaccucagccucccaaagugcugggauuacaggcaugagccaccgugccugaccuuuaaugcauuauucaguucuguccuuaaacuuguccugugagguaggugguauuaacccuauuuuacuuaugaaagaaacugaggccuaaaauuuaaaagaaauucuacccaggucacacaccuuauaagaagcacaggacacaggauuuaaacccagaucuaccuggucucauaugcccugcuuuuuuuuuuuuuuuuuuuuuuuuugagacggagucucgcucuguuguccuggguggaguacagugacacgaucucagcucacugcaaccuguaccucccuaguucaagcgauuuuccugccucagccuccugaguagcugggauuacagaugugcaccaccacacccagcuaauuuuuuuguauuuuuaguagagauggguuucaccauguuggccaggcuggucuugaacuccugaccuccagcgacccaucugccucggccugcugaagugcugcgauuuuuuuuuugagauggucaccgugcccagccgaggcccuacuuuuuaaccacugugcuauguauaacuguacuacccugguauaguauacacuaugcuuuauuauagcuauacucuaguauauguauagucucuucuacucugugauacuguucuaugcuaugccucaccccuagugucuguucaccaaaaugccaggcacucagucaaucuuguuacccacuguauacuagcaccucuauagaguauaauacguguuagggcucaguauggugccuugcccuguaauuccagcacuuugggagguugaggugagaggauugcuugaggccaagaguuuacgaccagcuugaggaacaucaugagaccccaucucuacaaaaaauaaagauauaaaaaauuacagccagguguggaggcucacgccuguaaucccagcacuuugggaggcugaggugggcggaucacaagaucaagacauugagaccauccuggccaacacggugaaacccugucucuacuaaaaauacaaaaauuagcugggcgugguggcacacgccuguagucccagcuacucgggaggcugaggcaagaaaaucacuugaacccgggaggcggaccuugcagugagccgagaucgugccauggcacuccagccugggcgacagagugagacucugucucaaaaaaaaaaaaaaaaauuagccagauaugguggugcaugccgguagucccaguuacuugggaggcugaggcgggaggauugcuugagcccaggaguuugaggcuguggugagcuacgauugugccacugcacuccagcauggguaacagagcaagacccuaucucuuuaaaaauauauauuuacagccugagcaacaugguaaaaccccgucucuaguaaaaauacaaaaauuagccaggcgugguggcaggcacuuuuaaucccagcuacucaggaggcugaggcaggagaaucccuugaaccugggagauggagguugcaguaaguugagauugcaccacugcacuccagcccgggcgacacagcgagauuccgucucaaaaaaaaaaaaaaaaaaaaaaaaaaaaaaauauauauauauauauauauauauauaugugugugugcauaaauaaauuagcuaagagaaggaaauucuuucuguaaaugccuucuuuuuggcccuagucaacauuaacuuauucauucuacagccacuuacauuggaacugugaccugaaaccaaagggauaggcauaggaaccugggccaguggacugugagggauagagggaaaggugggcaggugggcaggugggccuagugaccccacaggugugagaaggcugggucauugaugggccacaggagcacccagaaggcucaggcccaggcucggaagcagcuuguccuguccuuggcacccacagacaggcgauauucagcggguuccaggucuguaggaggccagggaggaucuacccucacucacucuccccucuaccuucgccucuagaccccagcuugguugcuuucuugagaucucacagccacacgcaagagcaaacaggagagacagccucugaggagcagaggccaggaggacccucugcuaaugucaccaaggaggaaccccucaugucagcuuuugccagugagcccaggaagagagacaagcuggagccagaagccccagguuugcaggaggcgggggucauauuuugguggauaaaaguaggggaaauugucccuuuuccuaggccuggcaaaugagagaagagagaagcuucugugcuuuuggacaucuaacauuaauccucauuauuggcuucaagucagucuucauugcugaugcaugucuucuuccugcacaugcuuccuguuuucuuguccuguuacugccccuucuccgccuucccuuuuaagaggcagcaaugcgugauggcugaaucccacuccacccgcucccggcagacuaucuuccuguccuugcuguagcugccccagcucuggcucuguccaucccacuguucuuucucucucugcucacagugcugggggaaagauggcagggccagaguaauaagagaggcagaaucugacaaagaucuuaugaacaugccagaccagaagcagagaggccaguggaagcacucauuucccagaaacuagauuauuucauuagugauuaacaaaauaagaaauugaauuaugagagccaggaaccucaugcccccggaggagcuccaggccagcugagcagguuggguggggguaggcgugaaggaggaaaaugcugugggauuuguuucuguauccugccccccaggagcaguauaguugccuccuccucauuguccccacucuccuacuccuuuaagggcugguacuggaaaguggagauggugccuuccugacauaugugguccuccuucuucaucuuuuucuccuuucuuucucuuucuuccuucuccuucuccuccucucuccccucccaacaaauccuuggggucagcaaggggcuggagcccaggauggagugugucugucauauuugagacuuucaccccagccccaggaguuccagucccugggccaugccauuuagccauaaccgaggguagaagcuggcagauccuggaacagaaguggauguggcagcugcugggugaugguggggaccccuguggauagugagcugagccguuuggguaauacuaucaugcuuugucuccccagcucuggcauugcccgugaccccucagaaagaauggcugcacauggacacugucgagcuggagaagcuccacuggacccaggacuugcccccuguccggcggcagcagacacaggaggugaggagggccaccuggccuacaaggggugggugagauagggcaggagaggagcugcugcucuugcccucagaacucaggccuuucuauugcccagagccugagaagcaucucuccuuugcucucacccaccuuuaccaucacucugccuggcccccaaggccagauaagccccauuucugguagaaguagagucaguaccuaaguccugaaaggccugggauuaaagguggggagugggugugggaagguugcuggagcccccagaccacaguccucuuucucuucccauuagaggaugcaggcucgauucagucuucagggagaacuacuggccccugacguggaccugcccacccaccugggucugcaccaccauggagaggaggcagaggugaggcaugggacuggagaggauggggcagcucuuuuaacaaccccauggaaaaggaucucuggucaacugccuuugaccuucugugugcccuguucuaguucaugccuuugcugugcauucaguuucuuuuuuuggagacagaaucucgcucuggcccaggcuggagugcagugguaugaucuuggcucacugcagccuccaccuccuggguucaagccauucuccugccucagccuccugacuagcugggauuacaggcgcaugccaccacguccagcuaauuuuuguauuuuuaguagagacgggguuucaccauguuagccaggauggucuugaucuccugagcuugugauccgccugccucggccucccaaagugcugggauuacaggcguggcauucaguuucuuaggcucaaaaucuugauccucucuccguauucuggucaguugcuagaauuugccgaucuucugucaccuccucaugaugccuccugcacuguggccuugcuuccuuggucugcucacucuccaugcccuccauucuccgccccccugccauuccaugucucucggggcugcugugcugauuucuucuggcccagcucaggccaugccuugccuccagaaguuucccagcuucccucugcucacaaaauaagguucuggucucagcugggcaagauauuccuucuaccuuuugucccugcugacccugcugcucugccuccuucacuuccugcuacaccacucugcuggcuucuccccacauaccuccugugcucagggcccuccaggacuccacucgcuccaggaaaugccuuugccuuuugcuccaugucaggccaucaaagcucuacccauccacugagaccaauuuaauuuuccagguucccuucucucucucuccuguccgccggucgcaaauuaaacaucaguuaucacguuccucugcaucugccucauggcaugguuacuuguaugcaagucuuaucuuuaccggcuugaggcuccauggaaagcagggcagauuucacuuauuuaucuuugucuuuccugugauaccuugcuugguguuuugggggcacugugcuguauccuggcugcuucugacuucuugucccugccccagagagcgggguauucccuacaggagcuguuccaccugacccgcagccagguuucccagcagagagcacuggcacugcauguguuagcccaggucaucagcagggugaguggauugccagccugguccugcccacccuucccuucaccccacagccucagacuuccccaucuccugcccuuuucacucuggcucacuagccagcuaugugcuuuuaacaaccuaggaucauaggggggcaaacgaaggauuagggcaaagccucuagauaacuucagcaucuucagcaagguuuuacccuccugcccucaggcccaggcuggugaguuuggggaccggcuagcaggcagugucuuaagccuccuuuuggaugcugguuuccucuuccuacugcgcuucuccuuggaugacagaguggauggggucauugcaaccgccauccgugcucuucgggcucugcugguggcuccuggagaugagguaccacagggauaggaauggggcuugggcugggaggugccaggguccauauuccuguuccugggcauggccccauugcuaaggcuuugcgggcaagauguagaaugggauggcaggcgucucccucaucuccuaaagucccuaaagcccaggaggcuugccuuuaugguuuuuauuggggagcauccucucuacuccuggauccauuuccuggccccuucagcauugccccccaacucccguuccucuggcaggagcuccucgacagcaccuucucuugguaccauggagcuuugacguucccucugaugcccagccaggaggacaaggaggaugaggacgaggaugaagaaugcccagcaggaaaagcaaaaaggaaaagcccugaagaagaaagccggccuccaccugaccuggcccgacaugaugucaucaagguaaagggacagcuucuuucccaucccauggcccaggggacaagcacaugcuggaaagaggggccaucaaugcccaggguccagcugcauuugucaguggguuucucucuccaacucccaggggcuccuggcuaccagccugcugccucggcugcgcuacgugcuggaggugacauacccaggaccugcggugguccuugacauccuggcugugcucauccgccuggcccggcauucccuggaaucagccacaagggugagaaaaaagggagcagggaaugggcaaaaagccuagcugggccuugucuugacccacagccucccuuccucccuuuuaccuccugucucccauagguccuggagugcccucggcugauagagacuauaguucgagaguucuugcccaccaguuggucuccugugggggcagggccuaccccuagucuauacaaaguacccugugcuacugccaugaaacuacuucguguccuggccucagcugggaggaauauugcugcccggcuggugagcaggacacagggcaagggaugggggaaugcaugggacaggguuggguugggagcuaaacauggcuccugaacucuggguggccagcucuugccaucuucuuccucucugauccaguugcuuagaaaugcaacagaaaucaccaggcaugaaccuguuuacuggagccuguuuacuggagccuggugcaucauauagguauacuguggucucaugauguaauaggaggucucccuguucccuagacccagaucagaagggcuucaugcacauaggcauucaucaucuauagccaaguagcccuagagaaggugcccagcaagccuugcuauaaagagggagggcuggguguaguggcucaggccuguaaucccagcacuuugggaggccaaggcaggaggaucacuuggggccaagaguucaggggccagccuggacaacauagcaagacucugucucuacaaaaaacaaaaacaaaaaauuagcuagaugugguagcacaugacuguagucucagcuacucgguaggcugagguagaaggaucacuugagcugggagguggaggcugcagugggcugguugcaccaaucacugcacuacagccuaggcaacagggcgagaccccgucucaaaaauacuacuacuggccaggugcaguggcucacgccuguaaucacaacacuuugggagaccgaggugguggaucacuugaggucaggaguucgagaccagccuggccaauauggcaaaaccccaccucuacuaaaacuacaaaaauuagccagguauaauagugugcgccuguagucccagcuacuugggaggcugaggcaggagaauugcuugaacccgggagauggaggguggagugagccaagaucacaccacugcauuccagccuggguggcagagcaagauuccaucuaaaaacaaauaauagggccgggcgcgguggcucacaccuguaaucccagcacuuugggaggccaaggcagguggaucaugaggucaggaguucaagaccagccugaccaagauggugaaacccugucucuacuaaaaauacaaaaaauuagccaggcgugguggcaugcgccuguaaucccggcuacuccagaggcugaggcagagaauugcuuaaaccuggaggggcagagauugcagugagccgagauugcgccacugcacuccagccugggcgacagagcgagacuccaucuaaaaaaauaauaauaauaaaaauaaaaaaauaauaggggcugggugcgguggcucacaccuguaaucccaacguuuuggaaggccgaggugggugaaucacgaggucagcaguucgacaccagccuggccaacauaaugaaaccccgucucuacuaaaaauacaaaaauuagucgggcaugguggcgcaugccuguagucccagcuacuugggaggcugaggcaggagagucucuugaaccugggagacagaaguuguggugagccaagaucacuccacugcacuccagccagggcaacagagcaagacuccaucucaaaauaauaauaaauaauaaaaaguaaaauaauaaaauugaaauuuuaaauaaauaauaagaaggaagggcaggguggaugagguaugacuuuguggcaccagaggggccugggucaggguugaguuaagccacucucuguccagcugagaguagcuggacuugagacucacagcugacccugauccucagacugugcccauuuccaguugagcagcuuugaucuccggagccgccugugccgcaucauagcugaggcuccccaagaacuggccuugcccccagaggaagcugagaugcugagcaccgaggcccuccgucugugggcuguggcugccuccuauggccagggcgguuaccuuuacaggugaggagaggcaggggguaggcucccccuagacaccuucaguucugcucuucuggccaaaucaaacaccucagccuugcucaaggucccaagcuuggaggaaggauaagaaugagugggagggcuucugccagaugugaaaaggcuuaggagucaggcccagccagggaagagggggauaaaccuggcuuaaccguauucuaugcucaaaaucauuagccgggcacuguggcucaugccuguaaucccagcacuuugggaugccaagguaggcguaucacgaagucaggaguucgagaccauccuggccaauauggugaaaccccgucucuauuaaaaauacaaaaauuagccaggcgugguggcacacaccuguaaucccaacuacucggcaggcugaggcaggagaaccgguuuaaccugggaggcagagguugcagugagccgagaucacuccaucacuccacugcacuccagccugggcaacagagaaugucucaaaaaaaaaaaaaaaaaagcauugguaucugugaaaucacauuuaaauucccuguugggggcagccuugaaggacaacauccuuuccauucuuuagggcugagccuuccaagagugccccacucuuccuccucauccuccuuuaucaaacugcagaucccugggucagggccaugaccugugucucaugucuccacuugcuuucauacagugaaaaucagucccuguucuucccuagggagcucuacccagugcugaugcgggccuugcagguggugccgcgggagcucagcacccacccaccucaaccccuguccaugcagcggauagccucacugcucacucuccucacccagcuaacccuggcagccggcaguaccccugcugaaaccaucagguaguuuauagccaggacccacaggacagguggagggcuccuccacagggcugggguggcuggaguguaaaggggcgugaggcagccagauccucacuguggcacccuuuggcacuuuuguagugauucugcugaggccagccucucggccaccccuuccuuagucacuuggacacaggugucugggcuccagccucuuguugagccgugucuaaggcagaccuugaaguugcuguccagaccugagauguggagagccgugggcccagugcccguugccugccuguuguuccugggagccuacuaccaggccuggagccagcaagugagugccuccugccggcuguccaccaggcccccgcacccugccuucagcuacauuccacccguugcucccucucuguguccaucucuccacuccuacuuccccauuuacuaucuucccuuuuaauuccuacccuuccuccucuuucuaccuccauauccccguggagcuucccaggagccauguugguggggaccagagagcccacgcagcagcucagccuuccuguagccugugugcucccucuuuaugcccccuacacaucggggccuucucucccuucagaaggcucagccugcagaagccuccaaaugugcucuuuugggcuguugggaugguggcauuggccuggguacacagggucuaggagaaugaauggcugggccaucagcucagugaauuccuugguccaccagccaagcucaugcccggaggauuggcuccaggacaugcagcgccugucagaggagcugcugcugccacugcugagucagcccacacugggcagccugugggauucccuuagguauguacuguguuugguagcugggggaagcaggggaggaggcaauuucuuuccuugugggauuccuggguccagcucccagguccaucccagggugcaggcccucggcccgagggaaacccgagucccuagcaggcagcaguggggugggcucugaggagugugagcagcacugaccuccacagccaggccccccguuagucuuagguacagacccagaagcucuuuccagcuuggcacacgccaggccagagucccccucagacucuccacuucaccuacaggcacugcucccuucucugcaacccgcuguccugugugccagcccuugaagcuccccccagccucgugucacugggcugcucgggaggcugcccccgucucagucuggcuggcucagccucacccuucccauuccucacugcccuccucucucuucuuaauacccuggcccagauccacaaggggcuguguggccagguaaguguggggugccugauuaggggccaggcaaggggccaagauggcaggaaucagaaagaaagugggagggugggaugggcgcgguggcucacgccuguaaucccagcaguuugggaggccgaggugggcagaucaccugaggucgggaguucgagaccagccuggccaacauggagaaaccccaucucuacuaaaaauacaaaauuagccaggcaugauggcacaugccuguaaucccagcuacucgggaggcugaggcaggagaaucacuugaacccgggaggcggaggcugcggugagcugagaucacaccauugcacugcagccugggcaacaagagcgaaacuccaucucaaaaaaaaccaaaaagaaagugggagggugucccauggggaagggaggccuucugcuggcacucauuucccugagucuggagaggggcagccaccuggggagcccuagaaggcaugagagucaauuucuagaucugaacaaaauugcuuuuccucagcuggcugccauauuggcugccccgggacuccagaauuacuuccuccaguguguggcuccuggggcugccccacaccucacaccuuucucugcaugggcccugcgccaugaguaccaccugcaguaccuggcacucgcucuggcccagaaagcgguaggucccccugucugacagguucuccugucaucccauuaucuccuuccuguuucuguggaacccagccugcuucugccaggccaugcagcucccacuuuccuccagacaugcccuggaccucugcccuucagccucacuuuuauccucuuccucacuucucucugccacguccccuucuccuguacuagguaguucccugcuuuucugucugcaggcagcgcugcagccacugccagccacccaugcugcccucuaucaugguauggccuuggcccugcugagccggcugcugcccggaagugaguaccucacccaugagcugcugcugagcuguguauuccggcuggaguuccucccguaagugcuugguugguggcaucaacucagcccuuuuggacgcugcugcaguuguuaacagagcagcccugaauuuggagccaggagaccuaaauucucuuucuuccaccgacgacacuuaacucuuccgagcuuccauuaccucauuagugaagugaggaucaggcuaaccacacccaagaaugauugugagacuucagugugacugcauggcuaaaaaaaugguaucuaaaucaguuacacacauguaauagccauccgcuacugaguguuuacucuguguuugauacucccuuauguauuuaucuacauuuuaaguauuuuacuuggaccaugagauagauacuauuauuauccuuauuuuacucugaggaaacugaggcccagagaaguuauguaaacucaugccuaggcagcuggcuguagugugcauccucuuaacugcuacacagcacugcgcgggaaguaguuaagggagcagagaggcacaggucuggaccuaggagccuccaggaaguuccaaagagcuggcacagccuccaagugcugugguuccagcccucauuuuuggcuuuugggucccauuacagggaaagaacaucaggggguccagaggcagccgacuucucugaccagcugucguuaggaagcagcagggucccucggugugggcaagggacucugcuggcucaggccugccaggaccuccccagcauccgcaacugcuaccugacucauugcucgccagcccgagccagucugcuggccucccaggcucugcaccgaggggagcuacagcgagucccaacccugcuacugcccaugccuacggagccgcugcugcccaccgacuggcccuuccugccacugauucgccucuaccaccgggcuucagacacccccucgggacucucucccacagacaccaugggcacagccaugcggguccugcagugggugcuaguuuuggagagcuggcgcccccaggcucucugggcugugcccccugcugcccgccuggcacggcucauguguguguuccugguggacagugagcuguuccgggaguccccaguacagcaucugguggcagcccuccucgcccagcucugucagccucaagucuugccaaaccucaaccuggacugccgacucccuggccugacgucuuucccugaccucuaugccaacuuccuggaucauuuugaggcugucucuuuuggggaccaccucuuuggggcccugguccuccugccccugcagcgucgguucagugucaccuugcgccuugcccucuuuggggaacacgugggagccuugcgagcucugagccugccucugacccagguacuuucucagcccagcaggaccugcaaggguacccugcacugggccucgggggcaguccugagccuugaggagcuuuggaagaccucagcuuccucaucuuaccucuugggggcuuugaggggauuaagagaaucaaugaaaagggcuuaacaugggcugggugugguggcucacgccuguaauuccaucacucugggaagcugagguggguggaucacuuaaggucaggaguuugagaccagccugggcaacauagugaaaccccauuucuacuaaaaauacaaaacuuagcugggcgugguugcgggugccuguagucccagcuacucaggaggcugaggcaggagaaucgcuugaacccgggaagcggaggcuacagugagccgagaucgcgccacugcaccccagcccagugacagagcaagacccugucucaaaaaagaaaaaaggaaaggguuuaaccuggugucuggcauauaguggguauucauuacuauuaauaaggcauagcuccuugcuuaucagugcuacaaucuagauaagaagagauuuacugaaaaccuacauaguugugaauuauucagaugcuaggugguaucaggauucagagaagggaaagaucaaauugggcuuuguggaagaaguggggauugacccaggcacuguagguuggguagaauuugaauuggugaggagguagaaaggcaggagauuccuaacagaauaacauaagcaaaaggagcaugacaaagggcagaaggagggaggagagauuucuguugggaacuuaaggcuaaaaauaagaagugaagucugagagggccucaaauauuaggcuaaggacuuaaauuuauaagcuguaaagaguuacuauguuugccaggugcgguggcucaugccuguaaucccagcacuuugggaggccgaggugggcggaucauuugaggucaagaguuugagaccagccuggccaacauggugaaaccgucucuacuaaaaaaaaauacaaaaaauuagccgggugucguggugcaugccuguaaucccagcuacuccggaggcugaggcaggagaaucgcuugaacccaggaggcagagguugccaugagccgagaucauaccacugcacuccagccugggcaacaagagugaaacuccaucucaaaaaagaaaaauaaaaaagaguuacuguguuauggcugcgugagguggcucaugccuguaauccaacauuuugggaggccaaggugggaggauugcuugaggccaagaguuucugaccagcuugggcaagaaagcuagacaccaucucuacaaaaaauuauuggaaaauuagccagaccuggugauuugcccguagacccaguuacucaggagccugaggcaggaggaucacuugagcucaggagguugaggcugccagugagcuaugaucacaccacugcauuccagacuuggaaauagaacgagacucuauuaaaaaaagaaguuauuguauuuuguuuuuuguuuuuaagauuuuggguuuuuguuuuuguuuuugagacagagucucgcucuguugcucaggcuagagugcaguggccugaugaucuugguucacugcaaccucuagcucccagguucaagcgauucuccugccucaaccuccugaguagcugggauuacaggcacacagcaccaugccuggcuaauuuuuuuuuuuuuuugagacggagucuugcucuguugcccaggcuggagugcaguggcgcgcucggcucacugcaaccuccgccccuggguucaagcgacuccccugcuucagccucccaaguagcugggacuacaagcacccaccaccauguccagcuaauuuuuguauuuucgguagagaugggguuucaccauguuggccaggcuggucuugaauuccuaauuucgugugauccgccugccucagccucccaagugcugagauuacaggcguggcccacuacacauggccaauuucaugcuuuuuaauggcugcuucucaguucccaguuuuccccaacaucugcucuguagucuuuaacccugauccuugugcuagaaggacagauguuugucuaggaccugaucucugcccucaugauuugguuucaugugaucguuauccacacaccuuauguauguauauacauuccuacccucccccucagcacgucauuuccccugucacaguugccugugucccuggaguguuacacagugccuccugaagacaaccuggcccuccuucagcucuacuuccggacccugguuacuggugcgcuccgcccacguuggugccccgugcucuaugcuguggcuguggcucaugucaauagcuucaucuucucucaggacccacagagcucaguaaguuacaucuccaucuucagaggaaggaagggagcuagcaauugagcugccucugggccagcuggggaagagguaagugucaagcaaggccagugguggguaccagcccucggcucagugccaccucucccuguucugcuucuaggaugaggucaaagcugcccgcaggaguaugcugcagaaaacauggcugcuggcagaugagguagggucagggccauuaggagggugggauauuagaggaucuugggggacagagaccacaacaggaucucauuacccacuucauaaguuuucuuuccuuucugcagggucuccggcagcaccuccugcacuauaagcuucccaauuccacgcucccagagggcuuugagcucuauucucaguugcccccucugcgucagcacuaccuccagagacugacuucaacagugcuccaaaaugggguaucagagaccuaggauaguugauauagauggaaagauggguacguuguccuguauccagccuuucaacagaugucuggccagacgaagaacauuguguccuaaugguaggcaggagaccaaggagcagaaggcuugccuuccugggagcagguuguuugagcuguuuuagagcagugagcccuaccauuacauccugauaucuggggcuucugaaggucuguacugggagugaagaguggcuuagcuauuuacccgcucuuuggggacagggcaaacuaaaugcaucccuucuuaccuaacucccaaccccugcccugggcugaggcauaugaaugcuauaguugugcauuaaaauaaauguuuuuuaucuccuggaaauuugaucuggacugauuucagccauguuaguucaggguuaguaucuggggguggguuaucccaggugaggagcaggacugcugugagagagauggggaagaaucauaagugggagguaaaaacuuuguccacaucuggagacaacaagaauguggggccu

SEQ ID NO: 13352 - RNA, 3269 nt, Homo sapiens
ugguaaauccaaacuggaucccugaaauguguguggugguaugauuauuuuuagaauaucaucuaaaaacacuuaaaaguucucauaggacccucagauucuugacaucucccgaccucucuagguuaggcggacuccacuuugaaaaacuauggauaguuuuccucucccaccgagaucuguaguacugaaucuucaaaguucagcguuuuuuuuuuguuuuguuuuuuuaaaguaucuaguauuuaguuauauguuugccugguguagggaaggaguaccaaaagagaaucuccauuccccuucuucccaaguuguccucacagaucccccaguuagagagaucauuuggguuaacuugucucuuuggggaugcaugguuguuaaccagucauucacaccuuaugaucauauauuuuaaugcuaaaucaacauaaauuuacuucuuccccagaaaauggaaaauuuuuaugaggaaaccucagauccuugagaggaaggcauucuugguaaggugggagauucugacagggcagcuuguaggaaagaaguucuuggguucagggaagaggaggaagguguuaaacuguuacuuuucaauuuugccuaggaucuugaaugcucuugcugaccgugccugacuugggguuucagaaugccuucagaagucucuaaaguagccuacacguuuucuaguucagacuauuccagcaguuucugucaauguuguuguauaucuccucaggaagagcaaaguguagagaaauaugaccuuccuaaguaaaaaguaggucagaucaguaguguuggauaagccuccuucuguugacuccuuccuuagucuucucauucuccuucauaguguuuuguauugucacauagcaugucacguaguagguucucagugcuugcuaauucuuaucaaagaaggcaguuuuggaucauugaccacaaaaucugcucuccuacucccuacuucuuuuuugccuuuuaagaaacuacgcuuccuuuuuacuggugucaggagcacagaagaaagaacagcugguaaggaguagagaaggagaaagaaaacuacuuuuugaagguuaggagaaauacuguccauugauuuacuucagcaacugccugacacauaauagauauucacuaauacuuucuuugcaccucauagcuuaaaugucuugaagaaacaaaaauugaaugcacaggaucaaggcacuaaagcuuagauaacacacuccugcaucguuucccuguuuuaucaagauaucuuucaucuuuauauccggcaauuuaguggcaacucuucgcuuuccaacugcgcacugagucuuucggucuccuccccauuuuccuagucgucuucgguuguggauguuguaaacucgaccauccgucucucaaggucuuuggcuucaagguuucccaaugcucuggagcuguccaagccccgguacuccgggguggaagaccucagauucauuugacgggcuuguggagguugggggucugcggagccccguguggguggggcugggcgcggccggggcggagccggcgaggagcccuagggaaagggugaaaggcacaguugagaaaggcccgccgggcauugguuucacaguuuccacgaaggcuucgugugcaagccugaggaguuuaggugccucccuccugccucgccuuucuugguucuagaaccuucaguaggcuuuucuggguugcagggacccggaaaagcagcggcuuccacucggggggcgggucccaagggucuugcugcugcucuggggccguuuggacuccugguguugggggaggggucagggaggugcugcucgcgucuccuuuugcgccugcgcggcgggcuccgagcggguaggagcgcgugcgcggugacguggacguccggugcgcgcgcgcaggcucuucagcuggagcggacacacggugugcgaaccgaacagaauaacccgcccccagcgggaugugaaggacuccgggugaggccggccacgccccgcacgguaacucucgggccuggguggagggcaucgcuuaguacuggcccgauuggaguuuuucgagaguuugaagcucuuguguauuugaacggcgugagaaacguuccgcugagagagcuucgcacgcccucgccaggccgggccuugcgcagggccgccuuuggcgcgccccuguggucccugagcgaggcugcgcaugucaccucgcgcgcguccccggccucacuuccgcgucgcucagcuaccuaacugggaacaucgacgccagagagagcggccacgaggcgggaggggugagaagcgcccauggcucggcccugcccucgcguguguggggugccgcuccgcgugguacgguccgcgugacgacuucucgcccggcgccgggcucuaggucgagagccacgcuuacgcgcuuuucaguuuagagccuaggucucgugguucuagaacuccaagggaaacggugucggcgucgcuuuucugagaacuuggcgcagcguuuugacaccugugcaaacgucuuuucuaacaaguaauuuccggccaaauuguuugaggcaggacgucaaguuuaauaaaggagggcgaggaagugagcuguaggaguggggacuugguaaacaaaggaccggugguguguaagugcagaaaugagggaggggaaaacaggugggaagagcagguguuauuuucuuuauuccucuguggggcagccuuuuaccuaguucuguuuaugggguuucccguuucuguuaaauggucaaguaggucucugcccucagugcaagguaucugggacauuaacaucacccccccaccgcccccccaaagcuccaguagccaaaguugagggaucuaugugucagaagaauauggggaaacuagggaucguuucagacugggucgggagugcaaaagugguagugucuugcuguacagauuuuugccuugccuuucgaacccugggaaugccuucuuucucuggccgggguggaagcaggaacggguaaaugaggucugaaaggagggguuacugauggcagaccaacacgagaaaccaaagugcacucuuuuauugggaagauaacuuucccaagguucgccucgccggagcaaacacguggaucaugagaagucucgagcccacccgcgcguguuguuguagagcuugccaggcuuaugcggcugagucccugguuaacaacugcuugcucuguucguucuuuuugggcacgaugc

SEQ ID NO: 13353 - RNA, 74582 nt, Homo sapiens
ccuccucgggcggcggccagcgcggccggggcggcucagugcgagccggggagagucgaacccggagcagggucccauccgagcguggacuggcggcaggauguucagcuggauggggcggcaggcgggcgggcgcgaacgcgcuggcggcgcggacgcggugcagacggugacgggcgggcugcgcucgcucuaccugcgcaaggugcugccgcuggaggaggcguaccgcuuccacgaguuccacucgccugcgcuggaggacgccgacuucgagaacaagcccaugauccugcuggugggccaguacagcaccggcaagaccaccuucaucagguaccgucaccgccccucgcccggcucccgccccgcuccgcccuccccacgugugcgccgcagucggccgccucccgccgcugccccucccggccggcgcgaccucggggaccccucccggagcucggcgcccggugcccucggccccgccccggcuggccagccccgcgcgcuggagggucccgcgaacccgcgcccugcgcacuccgagcccuccuuccuugcgguucggaaggcguugcucccgcuggccucguccggucgcccuggcgggaggguccaagggagagagggggcgcgagccauaaucagcauauucuugacgagggagugaugccuagggauggaaauggggggagaggcguaggguauccgaaugggacagaguccuaguuggagaguuuguuuaacuauucauuuguucaacuauuucuugaacaaaugaauggcagcaggagagcguaucgcccaggcccccuucccuugaggucuuuacgugccaccccacaguguuguggggaggggauaaagaggccgccuacguucaguucaugcaccgccuuuagccgcccguaggaagugagcugcguguagcagccgcaccagccuguggaacuaagggggagugucauauuacuauuuguuaguuuccauuucuuaggugggucauucccuccucgcuuacccuugacaacugaaaauauuugucaugcuuaccguguuucugaaagcacacaaucacugugcauacccugugguucaaaucauauaguuucaaaagaagugacuuuugcugggaaauuauuuagacagaaacagauugcuuuguugaucaccuguuuuauuucuaaagcagccagcauauuuaggcucacuguuuuugguaagaagaacuuauuuuucugacuuaagccguguaucaguugaaacaaagugcugaucauuuaagguuuugguccaggguuuuggaaauuguaacaaucucuucaucauuugaugugcaacagguguugagaaaacugcaucuauauuuggauacaugccauuucuguuaaguagcgaccucuuuuucuccacuccagugaccuaaauaguuccuacaaauagaguagcuaucacuacaggaaauauguuaaauccaggccuccagauacacugcgaaugaauuccacaaaacaaauauacuguguauugaaaugucguucuagauaauaaauugagugugaagaaaguaauuucaaaauugcuuuauuuggugcuuauggacaagacaaaaauagaauuaaauaugucaccgucacccagacacucaaaaugaaccauagcuguauuacaguaacuggcaccuugaaagaugacaaaugucacauuuaaggucucaguaauacugucuaguuuuuagguacuagggauaauaaaguguuauggccaagugguacaagagugggaagcgguacuguugaaacauacaaagaagaaaggcauauauuuuuguaauuuagugguggcauguccccacacccuaggcauuuccuccuguuugucuuugcugugagguccuuguugugcccaggugucaucagggagccccugcuagaugcugugccaaccuggagauaaugcagcccucucucugcucccauagacuggauagcuagccagccugauuaucaacucccaggaagaugaauacaacucacaggaacaugaauuuaucuuuuguauuuuuccagauuucucucucauuauauucucacucuucucucuguuucauuauuuggagaaauuuguggaauagcuaagcgcaguuuuaugaaggguucugagauuugauuccuggcagcuaccucauccaaauuggccaccucucagcaggugcuggagcugugggccacccuagggugagggaggaaucaccuuauuaggaagccauuuguucuugaggcuuuccuugagcuaaguggcuuuguuguuaggugauguacacaagguagaccagugagguuagaagaaaaucagugugggcaggaagcuuggugaggccacaggagaccugaauugcuuuucagauuggagcuaggaggaagugauuuagcacccgggaggaaauccccaaacaaaagggcagcuacccuggagacuugugaacuuggaauuaaauaucaccccagacacuguaaaugaaccauggauucaucuugagcggaaggguuggcccagggugcugagcauccuggauccugccuuaguuagagccugguuaguggucuggguuguuugcuucuagcgauugggcccuagaagcucauacuuggcugugggguguaccuaaucuacauagccauagauucuuaucucccuggcuuccugcacauuccaagaggucacugaugacacagaaccugugcugacauggugggaaucuucucuuauugcuguuggcucuucugccuuugacuggcaauaaagaauuggccagagaaggaggggagaugggcaugggggaaagugaccaugucaucuuagacucuguacuagccgaggaaggauggauauggagcucacccaggcuuguguccaaaacuugaggaaaacagauuucaaagauuccuccagaaaaucccuggccccaggugcugugaaggaagacauuuccacugaaaaaguaugaaguccauuugaaaugaaugcaaacuacacaauuuuuuuuuuuugagacaguuucgcuguuguugcccaggcuggagugccauggcaugaucucggcucaccgcaaccucccccucccggguucaagcaauucuucugucucagccucccgaguagcugggauuacaggcaugugccaccacgccuggcuaauuuuguauuuuuaguagagaugggguuuuuccauguuggucaggcuggucucaaacucccgaccucaggugauuugcccgccuuggccucccaaagugcugggauuacaggcgugagccaccgcgccccaucccaaacuacacauuuuuaagagcuccacuuucucccuucauaugcucuguucccucuccccagaaaacuuauucuaaugaggaaaaaagagggaagucacucaagaaacuauauaggcuuuaaaaggguagagagcagggaaauaaggcaagaaaagaaauaaacucccagacuggagagaaaaaaguaaaacucuuugcagaugacaugaucuucuauguagagaauccuaagaaaccacuuaaaaacuauuagaacaaugggggaaacuauaguucaacaaauggugcuaggacaacuggauagccgcaugcaaacgaaauagagaaugacuguuagugggcguggaguuucucuuugaugugaugaaaauguucugaaauuggauaaugauauugguugcacaacuuugugaauauacuaaaggagugcacccuguaaaagaauaaauuuucugguauaugaauuauaucucaauaaaaaaccaaaacaauucagucuuucaacacuaagcaucaugugauuuaauuuucaugauucugcaacuagcgccagccaaguaauuucugcaucuauguguaauaauuuaaaauagaaauggaugccagaaagaaaacaaaguagaaauaagcuagaagaacccaagggcaaaggaacuaaagaguaaagaugaggggccaggugcaguggcucacaccuguaauccuaacacuuugggagacugagguagguggaucguuugagcucaggaguucaagaccacccugggcaacauagugagaccccaucucuacaaaaaaaaaaaaaaaaaggaguaaagaugagggaaaagggagugaaaguagccaucccacaaucccuguaugaguauucuugucaauguauaaacauguucauuguucauaacacucaaguugguaaaaucaaaguaugauaaaaauuuuuaauaaaaugcuugauaccguaauuguguuuaaaaacuuuagauauuaacauuuaacuauaguauuuaauaggggaaaaaaggggcaggggugcaugugcaagggugcagacaagguuuaugggcgguaugaaggaucaagaagcuggagugggcugagaagguaaaagugccuuggacauuaaaaaagccuuuuaagguaugauuagaacaagaacaagaaucaggaagugaucggcccacucaugggcucuugcugcaauauuaacagaaagcagaacuacucagcuuccuccuuuuccucaaagaaaaugccccagagauggcagaagggagcccagcuguguucaagaggggauuaaaaccacaggcugaggagcucucccagggccugccacaggcgagguucaggaaaucucuggccggacacauggaugaaagaacuugcauuucugcucaaagaacuguauuugguggcuuuuaagaaauugugaagaauaugaaaaguauuggaacacuggaagcaggcagauguucucauuuucaaaaaagcagggaaauggauucugaauaggaacaaaggccugcuucauucccuugauaaguuucuagacucaguaauuaaggaaaagggaagugaaggcauucacuaauaggcagccugguucaucuauuuuuaaaaaaauaaaaucucacacagaaaaacuauggguccuauuuagugguucucacacucauccagauacuggggcuccugaaaaucaaucuucuguuccaaauauuauacccuuuacagaucucucuaaaauauugagauauuuaauuuuuacagaaaauuagacuauauuuucaauauacaauauaagaucacaccuacagaugcuaguguucauuuauucaaaugaucuugauuucaggguuggggccagccaucacagaagagagucaacaggccacagcucugagugacaagggcuguaacacuagaaacacaggguggcugggggcauaggagggacccccucauucaggcuugcggguuggaaaaggcugccucccugagaaugcagccuaaaagcugagcccugaggaaugagcagagaauuagcugcccaaagagggccagggagugaggguggggaggugucacccaugaggccucgguuucugggguaacuggggaguacagcuguucacugagauggggauccaagaagaggaaggauggggcauaaugauaaguuuagauuuagaccugucauguuugaguggacaccaagguggcgauguccaugagggguaagacaugggucuggagcucagggagauaucugggcuggucuguugacuugggagugucagcauuuaguagccagcaucugggaaguagaaguccuugcacaggacucuuaagugagaggaagcagagcuuguggagacccuccggggaaaguaccaaagagguggguaauugccugggaggguaguggcucagugcugucucagaucucuuuagguugcaagugacagaaauccaaccaaagcuagcuuagauaaaaagauaagaacguuuuccugaaacccaucagaccaggaugugcaagcuucaggcuuggcccaggacugcaggagacacaccaggacucuguuggcucuguggcccuccucauguuguguuccuucucaggggugggcaggcggccaccuccauuuccagccucgaauucugcuggcucagcagccccaguaaaagucucaggcuugagucucauugguuugacccugaccauaugcccaucccugaaccaauccuuaggggcaggggcaugaaauguggggaguggggaggucagccccaccaaccacguggccugagagcuggggaaggcagcuccugaggaugcugcuaccaagaaaaggggauacgaggcaaguaaagcaacgaugacccccacaaaagccagggagagaggugguggucaguagugucagaugcuuccaggaaaaggacugaaacagaaccaguagauuagccuuugggagccaggugaccuugccaagaggugugccugugagugguggugaaggaagccagauggcgcggguugaggaaugagugggaugugaggcgucaaauucucagcagcuaggccugggggaaggaggccuggccacaagcaucacagggguuuggguaaagacaagcacaaccucagcagaaugaaaaguggacagaagggaagccauggagagggagcagcuggcaucucagaagacaaagaggaggcaagacuuggagcaaaaguccugaagagcagggcaaggagcugcaggguaggcggggcuggguggggugguggggguaggcaggaggugaguagguggggcggggggugggcaggggagcgcuggcagcugcaguccgagcagggaagcgcugcaggccagcagcugggccaguugucacaucauccaccugacaagcagcaacagaguauuuggagaaauguaggagggggaaggcuuuuuccauccugacauuaucuucccuaacucacauucagaagcugacuuacaaaagguguucaauguccuuuucaaaaccucgaaccagaaggccgugguuccuucugcacguggcugugcaucagaaucacuuggaggccuuuugacacggauuccagggccccaccucagaccuccugagucgaaaucucugugggucaggcuccaaaaucuguuuuuguuuuucuaaaccaucucucacaguaauucuuaugugcccuccccuaggaaacauuugggaaccauugccagaugaagguucaguuaauggaggaauggaagagggcuagccucaacccagaaaagggaggcugacuuugcugaaccuuccauccguuccaaaccccaucuguucacauuucucucagugacuuagaugaagacauagaauucaugcuuacaaaacugaggauuguguaaauauaauuuaauaaaugggguucuuuuuugcuuaauaugauacgaugagcauuuucuuaugucauuauauagucuucaaaaauaacuucaaugacuacaucauaaucuauaguacagguuggacauuuagguuguuucuguuuuuaugcuguuauacauaauguugcaaugaacugaacauuuuuggccauaaaucuuuguauuucuaguuuuuuucuuagaauagccuaagcauaaauuagugccucaaaaaauauagauaauaggcugggcgcagcagcucacaccuguaaucccagcacuuugggaggccaagguggacaaaucacuugacuccaggaguucaagaucagccugggcaacauggugagccccaucucuaaaaaaaaauacaaaaauuagccggacaugguggugcaugccuguagucccaguuaccugggaggcugaggugggaggaucacuugagcccagguggucgaggcugcaguaagcugagauugcaccacugaacuccagucugggcaacugagugaggccuugucucaaaauauauauauauauuuuuuuuuuuuuucaggcuuauauauauuccuaaaucuauguaucuaucuuucuuuuuuaggacaguuauuccaaauuagacucccaccagaaauaugaggaucaguaauucaccaaacugccaguaaaacuaauuaaaauuaauuugauaggaaaaaaaaguguuuuagauagggucuugcucuguugcccaggcuggaguacagugaugccaucauagcucacugcagccucaaacuccugggcucaagcaauccucccaccucagccucuggaguagcugggacuacagguacauugcaccaccacacccagccaauuuauucauuuuuuguagaguugggaucucgcugugcugucuaggcuggucucaaacuccugagcucaagcgauccucacgccuuggccucccaaaguccaaagugcugggauuauaggcgugagccauggggcacucagccagaacagacuuauuuuaauuuguuuauuucuuacuagugacguugaacuuauaaaauauaguugucuuccauauuacuuugugaauugucugaauugucugugaacuuuguccaauuuucauuugaaguguuggucuuguccuuuuuuuuuuuuuuuuuuuuuuuuugagauggagucucacucugucacccaggcuggagugcaguggcgcgaucucagcucacugcaagcucugccucccagguucacgccauucuccugccucagccucuggaguagcugggacuacaggcgcccaccaccacucccggcuaauuuuuugcauuuuuagaagagacgggguuucacuguauuagccaggauggucucgaucuccugacuucaugauccaccugccucggccucccaaaaugcugggauuauaggcaugagccaccgagccuggcccuggucuuguucuuauaaauaaauguaaauguuuuucucaguaacagauaucaauccuuugucacaguuguaaaaguguuuuuccaguuugaaauuugccuuguaauuuuuguaauaguuuuuccaugcagauauauuuaauauuugugaucaaaucuaacaauuuuuccuuuuuuauaauaucuuuuauuuuuugguuagaaaauccuuguuuaucuuaagacucaggaaauguucacucauauucuuuuuuuuuuuuuuuuugaaacagacucucacucuguccacccacacuggagugcaguagcacguucucggcucacugcaaccuccaccuuccaguucaagcgguucuugugccucaaccucccaaguagcugggauuacaggcaugggccaccaugccuggcuaauuuuuguauuuuuuaguagagacaagguuuugccauguuaaccaggcuggucucgaacaccugaccucaagugaucugccugucucggccucccaaagggcugggauuacaggcgugagccaccgugcccugccucuuuuuuuuuuuuuuuuuuaguauuuauugaucauucuuggguguuucuccgagggggggauuuggcagggucauaggacaauaguggagggaaggucagcagauaaacaugugaacaagggucucugguuuuccuaggcagaggacccugcggccuuccgcaguguuugugucccuggguacuugagauuagggaguggugaugacucuuaaggaguaugcugccuucaggcaucuguuuaacaaagcacaucuugcacugcccuuaauccauuuaacccugaguggacacagcacauguuucagagagcacgggguuggggguaaagucauagauuaacagcaucccaaggcagaagaauuuuucuuaguacagaacaaaaugcagucuccuaugucuacuucuuucuacacagacacaguaacaaucugaucucucuuucuuuuccccacauuucccccuuuucuauucgacaaaaccgccauccucaucauggcccguucucaaugagcuguuggguacaccucccagacaggguggcggccgggcagaggggcuccucacuucccagacaggguggcugggcagaggcgccccccaccucccagacggggcggcggccgggugggggcugccccccgccucccucccggacggggcggcuggccgggcgcucuuuuuaaaauaggauuacuuuuuaaauauuuaacuuuuuaacccaccuggaaguaaaaucugucucaauuauauuguuguggguuuuuuuuuuuuugucuuuugucauuuucuaacacuauuauuaaaucuaccuuuuucugcugucacaugaggcuuccucauacgcuaaguuauuaaauacuauauugagucuguuaggaccuuugucucguguuauucuguuuguaaauucuuaugccaacaccauaccaucuuaaauauugucacuuugaaauacuuuuuaauaauuuuagcucaagacucuucugcgugcauuacucuuuauuuuucaaaugcuaucaauucucauuuucugucauucuuugagaagaacuuucuuaguuagguucuucaaaacaaacaaaaaaaaaucccacugggauccauuuguccuggaacugcauucugucucuaaguuacauuuuuguauuugcucuucccaagcagcagcucaccauugcuuuaacgcagaccuucuuggaaaagugauugauuuacucauacagguccuauggagcucuuauuaauguauuagguauuuuaugcccuguugcucuuaugaaugggcuuuuuauuucucuuauuuuuuuuggcaggguauugcugauauguaaggaagcuacugaguuguacauuuuuguuuuauaucuggucauuugacucaagaaguuauucugacagcuugucaguagauucucuuagguuuucuagauagauaacuguaucaguuaccuucaugauuacuuugucuccccuucuguuccauauuucauaauaccaggaaguaggcauucauaucaagcuucuaaucuuaaugguauugccuauguuauuucaccuuaagagauuaugucagcugguggcuucuuaucuauaaauuaauugcauuaagaaauuaucuauuacuaguuuuaaaaggauuucauuuaaaugauucuauuuggagaaaaaaacaaaauggauauggaguuuguuagaugccuuuuagccuuuuccuuuaaccuauguucuguggaaugcaguugugggagaucauucguaaguguucaaagaaaauaaaaggguuccauagucaaguaacuuugggauaugcuguguuccauaaccuccucaugacgauuuacaguacucccagaucaaagaguuuacaaccuaaagucuguugucauacuccuaaauuacaaguuacaacaucaaaaacacucaauaaauagucauugcaugacugaaagacuggaagaacaaauagaacuguaagaaacugauuugauucuagugaaauuccccucccuuucuuucacccuccucccaaaacagcauggaagguggaguggagcaacuuacagguaauggcaguggguagacagcagugugcuuucaagcacaucucagcccugaggaguauaaaucccauccauagcuggaaaaauagccugagauacgaaaaguuuuacccagcaaauuccaguuuauugguucaaugaccuaauguccauucccuuaguaggcacagcaguuucaaaggugacaucaucugaacaaacaguccuggugauaacaugucaaugauuuaacuaaaggaaaaaugaaaauaaaacuuaguuuucacauuuaaaauguaagugaggcuggcgcgguggcucacaccucuaaucccagcauuuuggaaggcugaggcgggcagaucaccugaggucaggaguuugagaccagccuggacaacaugguaaaaccccgucucuacuaaaaauacaaaaauuagcccaguguguggcggacgccuguaaucccagcuacuugggaggcugaggcaggagaaucacuugaacccaggaggcagagguugcagugagcugagaucaugccacugcacuccagccugggugacaaagcaagacuccaucucaaaaaaaaaaaaaaaaaaaaauguaagugaagaucagccuaacuuaguuuuucaguaauucaaaggagacuuuuuuaaguagaugagauguuuguucagggauguuuaucucagcauuauuuauaacagcaaaaaauagaaagcuauuuaaaugccuaacaggaaaugacaaaauaaauugauacauauucaacuuagaauaguaugcagccauuaaaaaucauguuuucaaagaauuuuuaaugguaugaggaaagacuaauggugaaaaaucaagaugcaaaauuguuuaacuuuuaucucaauuuuauaaaggaaaauuacauuuacugaaaaaugaugggauggaaauacaucaaaauguuaaaaguagucauuacccaguauuaauguggucuccuguaagcuauuuaacuuggcauaagcaguuuucuccucuauaaacuaggaauaaaaauaccugcucccauggcagugaggaugaaauaagcugaaugugugaaaugcauuauaaacuguacaguacggcuucagaguaaccugucauuuguuaguaucuagaagcagugauagugcaggucauacuguuuugcuaggaaauauuuauauaucuuggccuaucuuguaagacuuuggaaguaauaaaugcuugauucucccacuuacuuuuccuggugugaaacacaaggauagauuaaacaauagaaacugcuuuuuuuuuuuuuuuuuugagguggagucucacccagucuggaaugcaguggugcaauuuuggcucacugcaaccuccgccucccagguucaagcaauucuccugccucauccucccgaguagcugggauuacaggugcgcaccaccacgcccggcuaauuuuugugcuuuuaguagagacgggguuucaccguguuugccacaggguggccuugaacuccugaccucacaugauccauccaccucagccucucaaagugcugggauuacaggugugagccaccgugcccggccagaaacugcucuuaaaacaucuuuccaggcucaaaucaaaucagaguagaaguaguaacucuuccuuuucaucccucuccuagugaaauaguggaucaaguaaguauucugaagaaaaauauauuacaugaaacuuuccaaaacuuauuuuaaaaauguuucaggcaauagcaaugaauugaacccccaaacuccaugcacagaugccaagguaugcacgaacauauuuuaagaucucguuuaucaucacacaaaccauuucuuuuuuuuuuuuuuuuuuuuuuuuuuuugagacaaagucuugcucugucacccaggcuggagugcaguggcacgaucucggcucacugcaagcucagccucccggguucacgccauucuccugccucagccucccgaguagcugggacuacaggcgcccgccaccaugccuggcuaauuuuauuuuuguauuuuuaguagagacgggguuucaccguguuagccaggauggucucgaucuccugaccucgugauccgcccaccucggccucccaaagugcugggauuacaggcgugagccaccacgcccagcccacacaaaccauuucuuuagauuuggcuugauaauuuaaaaauaaugcucauacaacacucaaaauauaugugccguauuauuuuuaaaaucuuacauuuguguauuuguuaugauucacaggacacguuccuguaaacauucccaguggaacccgucggccucucaggcucugauuuagggugggugguguccucauaagacuaguaagaaauccuucaucuuaauaaaccgcuuaacccauuugagccuuaguuuccucaucuguaaaauagggauagaaauaguaccugcccauaagguaguuaggaugaaaugagacuauucauguaaagacuuuagcacauaacgaguccucaagcguuagguauauuuauuuaaaguguaaugcuuugcccacuacuccagcauuuguuugaauaaugugccacuuagauuuguuugguuuuuauucauucuuaagcucaucguugagaagauggugcuuggacauauugagaguaucucuguuuucaauaucuugagaguuuuuuuucuuccccuugucauaaaugacauucacuucuaugaagugaaaaaaaaaauucuagccuaagcaaugaaaaaaagaagacaccauccauauauacucuugcaucaaaguagcucugugagcuugggcugaaugcuggcaaccgggguaccccagagccacuuggaugagucugaacuggggaccucaucggaccaggacaaggggaugucaggucucccauccaucccaccaucccuuccgcccagcugcuuggaauccaaauguccauaccuuuuuauguggcuggcuuggcucgagaaccuuggagcaaucauugcuggaauuggcaggccucuccgagaacacaggaaagggggagcaaaguggagccaaggacaaaaaucaagucuccaaagcacaggaugccuguggaggggcuaaucagcucugaaucacgguggucuuccuguguccucuuguuccuuugaauuguuguuauugcagauaauacuagagucccugaaacucguagcuuugggaaagccucugaggcacucccaccgugagaaaugucuaacacaguugaucaggcugucuaucccguguggcugugugauugacccauuuaugcacauugcaccucagcaucagcucagacucuucccuuccagcuugcuguguguggauccaucacuucauucucccuuuuuccaugucagauacuuggugucuugguuguuccgaguucccucacugcacugacauguaccuguuuacccagcaguguaacagaugaaucugaguuucugcagucccccagugaaaaaucuucuucagggcaaucagcuuagagugucauauguaaagucagggaucugccagguccugcuuagagcaccagggagcugggggcaguguaggaccccagggugauggugcugugccugguguaagagcagaagucuggggccaggagaaaggggcugcagguucuggauccugcauggccacccugugaguuugaccagcaacaagccauguuccugcacuaacccucagucuugucgcuuguaaagauaagaggcugacucaaaucauuccuaccagacuccagguuucuaaaguacugaguauauagaccaugcccugcaggaaaugacagcccaagagaggagaggaaacaggcccucaaauaacaccagcacgagcuguuagaggucaacuccgcaaaauccccauuugaguuuauuuuuucuuuauuuauuuagagacagggucucacucugucaccuaggcuggagugcagugacauggucacagcucacugcagcuucaaccucccugggcucaagcgaccaucccaccccagccucuuaaguagcugggacuacagaugcacgccaccacaccuggcuaauuuuuguauguuuuguagagacgggguuucuccauguugcccaggcuagucucgaacuccuaggccaagcgauccucccacugcggccucccaaaaugcuggaauuacaggcacgagccaccgcucccagcaagacccccauuuuaaaggcuucuaacacauggugucaaauugcuuuuuagugaaguuagaccaacuuauucccccaccaacauauauaaggguguuuaucucacaggacccuugccagcauugaugauuccgaguuuucaaaaauuuguuaaugugcucugucuuuacugguauuucuuugauggugaaauugaacacugaauguuaacuuuguauuaucugugaaaguaucaccaaacaaauugauaaugcaagcaagcuuuauaauacaguaauucuuccuaauucuaguucuuccucugugucugagauccagagauugauuuaccaaggucacagucaaagggggacaccuuugacuucaaauuauuucacacuugaagcacacuuuaaaaaugauuuauuguuaaaggucuguccaguagggucgcuacuuagaaaacucuggcuucgauugcaauauaaacuugaauguaggaaacaucugcucuucuuuaaacaauuuuuucauuuauauuuuuccuugaaaccccuguuauuucaaaaguagugggauuugcuguacuuguacaggaaugaaacaucagaaaguaauucaggcacuccucgacagugaugucugacuucaacaccugugcugugugagugauuguccagcugggggacucacugcuuaacuacgauauccguaugcucaccucccuggcccggaaucugaagggccuccuccuggccaggcuuggugaaggugccgagaaggggccguguugccgcgagccacccaagguggagcuccacaccgagcucuuccccaaaaagcacacgcugcaguucucgucugguucaucccuuuaaucagugugugugaccuuuuguaggccgucuuggccagcccaccguugcuauuagcacugauucuggagcaaagugccugucaagcuucaaacccacucccgcaccucacauuuucgugaauugcgaacugugugugcugcggggagcugggcgacacuggcugcuguucucccaagccccucccuccccagcagucucuccucccucagucauaccagccuccagacauagccccauccaggccacagggcguaaaaaucaaacuggacgugaguggaggcaagagugugaucuggcuuugaauuccagccucgcugcugaaugucuucacccuugagaucccagaggggcuguaaaaccuaaauuccacauucccauggguauauggaguccacacgcucugcauccacuccauagaggcuggaguuucacagagugggcaucccucacaguaacuuuuaccagcauuucucagauuuguguggaauguguaagaauugaucaacacgaacauuucuaggcuauuagggauacagagguuuugauggagaaacucuugaagauauuuuaaaaauuaaagcugaacacauuuugaaacgguagcaccuccugagcccagcuuuacuccagggagaguagggagagcuggcccuuguugucaggguagccagaggaccgugcagggggacauuguggagagcucuuccccucagcugagaggaaauggggguccucgucccucaugccaagugacacacccugggaugaggcccugaacuuugcuuugcucuucaccccugagcaaaccacuaacuugaggccauuucugaagacagugcaaguucuggagucugaaugcuugcauuccauuuccacucgaacauccgcugugugaccuugggcaagccgcuuggccucucugaugccccaguuuucccaccuguaaauaaaacgaggguaaugucaucauccaccucagagcaugaggugaaacaauauagaaggcucagcgccauaucaggaauauagcaagcacucaguaaaugccgugugcuauuagcagauuuuuuucucuaaauuuagagauaaaagauaucaucagauuuacuguaaauuuaggagacauauuuuaaugguguaucuauucuggggugccacaacuucacagaaacguagaaacuuuggaugaagugaaaacuagcaaugacaucaauuaaagguuuagaauauagcccguuaagguugcuaaacaauuucaguuuuaggccaguugcgguggcucaugccuguaaucccaguacuuugggaggccaaggugaggggauagcuugagcccaggcauucaagaccagccugggcaacauggugaaacccuguuucuacaaaaaauuagcuaggcaugguggcaugugucuguagucccagcuacuugggaggcugaggcaggaggauuguuggagcccaggaggucgaggcagcagugagccgagauugcaccacugcacuccagccagccugggcaacagagcaagacccagucucaaaaaaaaaaauuuuuuuucaguuuuauuuacauagaaaacauaggucuaaaugguggcuuaauuucucauucuuuuaaagauggaaaaauuguauuuggcauuugauagaauucagcacuuucucucuuucccuggaaauagucacagauugugggcuuacauuagaaucagucaaaacuuuuuagaaacaaagaaguaguuuaggaccaaauagauuguuaguugcaggaauggggagcugcagaaggcugugcagguuuuuucccuugagccccuucaaggcuuauaagacgaagaucauccuccuggcaugguugggacaugagucugcccucaucagcucagacaccuugcagggcccauaaacaaguaauuguaguacacaugcugagcaccacgcuggcagcaggcacagggugcccagggaccacaaaagagguguccccacaugcaggucagggaggcuccccuaagggagcugagccugagcagagcuuccaggaugcccaggagccagcacgguacacuucccuugggguagcgucuguugcaucaacagaaaugcagaggaggauugcgugcuuuucuuggggguuauguuucuacguuuuuaaaugauuauguaaaaaaauugguaaucccaggcagcuuucuggccucuuacuuugugauaagaugcuaagcuuucucuucuucuucccucucccagauaccuacuggagcaggauuucccaggcaugaggauugguccggagcccaccacagacuccuucaucgccgugauguauggagagacugagggcagcaccccagggaaugcuuuagucguggaccccaaaaagccguuuagaaagcucagucgcuuuggaaacgcuuuccugaaucgguaaggaccagcaagcugccaucuucggucaggcuguuuaaaccuuuucuuugaauuacugccaguuacauauaaagguucaaaaacagaagaacaaagaaucucugcucuagaagucauacaaaauauguuuaucauauuaagauauuugaaagacuaucauaggaaauaaucauuuaugccuauucuggguaacuugagagggcagagcuaaggcccagaacuggacauuauaaggcugcacagggccagguguguggcucgugcuuguaauccagcacuuugggaggcugaggcaaaaggauuguucgaagccaggaguuugagaccagcuuggacaacgaaguaagacccugucucugcaaaaaauuuuaaaaguuaaaaaauaaaaaugcuuacaguauaaggaacaaauuucuaauaauuugagcugcacagaaauggauuaggcugccucaugaggcagugagcuccucgucacuggcaauguuaagcacugguuagacagacaccucucaggcauggugcgcugggcuucugcagucagagagcuuagcccagaggaccccuaaccuucaccggacacucggauuuuacccacugacuccagaacaggaccccucaccucccuggcugucccuuuugcuucucacucccagcuuugagcuguuuccuuauucaucagagcagggccagggaaacagagugaaaaacaugaaaagcugauuuucuuacguggucguuuuuuuuuuuuuuuuuuuuuuugcgggggggaagauagagucucauucugucucccaggcuggagugcaguggcaugaucuccgcucacugcaaccuccgccucccagguucaagcaauucuccugccucagccucccaaguagcugggauuacaggcacccaccaccacacccagcuaauuuucguauuuuuaguacagacaggguuucaccauguuggccaagcuggucucaaacuccugaccucaggugauccacccgccucgccuucccagagugcugggauuacagaugugagccaccacacccagccuacguggucacuauuuuauagauguaaaguuguggggucacugagguucugccucacuuggagauguguuuuauuuguacuccucccauaaccuuucauuagaguucccaguggaacugagggcugcuggccuggggaagacaggccagcugguaccccuggcuacaacucugcccuuucccacuggaucugccuuccuuccucccuccugcaccuccuauuugcuaccccuugcguuuguguaaugcuuuuuucuuguuuccuaucaucccucucccaccccucuauuucccucuuuccugggucuagcuuucguguggcugauuuggaggaguggguuguaggaggcacagagcuagggagggucauccgagccucuuuagggagaggaaguagcauuagagcugacaguccacaucuccuuucuagaaguuuuuaaaaauaggaacggauccucccagccggcugcuguccucccaaaggccgaagcgccucaucgcgcagcuccaggggcaccauucauguggccuggggaaugaaugaugugcuggaugcugugcacuggcucggcugagggccacccaggccccuccgcaggugccuucuguggaagauggaacucuccggggagcugaauucuccauuaggggcuuuuugaugauccuauugcaaaucaaagaaagcaaccagggaacuuggcagugggaugaacagaaaccugcaggugauguggaaggagucccagaggaguuccaucuuauuacugauggugauaggaacacuguccaggugauuuuuuuccaaccugcagggcugacuuuucuaggaggaguuuacucuucaacuccagagcugacuugguuggcaccagagugucucauugugggagaggggguuaagcccugggcgggagaaccccagagggucaacucuccagaucucucaggacagaguggcccaggguggaggggaaguagaccagaacaggaggccccagaaaguucaaggcacaggaucugucucuguggaaggcuucccugggguccucugguuucauugccacugcccuuugucuggggcucuuuuugcccaacaaaggcuuaacgaaauaagcugccaguuuuuucaaauucccacuuugugaagucugaauucacaagggagaaaccaggaagagugguuauuggcuugcuuuauuuuggcaaaugauuuacuuuccuaacaaaaaaaaaaaauguuuuuuucuucucaaaucccaagcacaugacagaugaguacagaaaagaaauuuuuaggaacgauuuugaauggcaaagcucuugucucagaauuuaaaacuugcugaaaauaauccaugccuuauaauaaaagcaagugucaguugaauucagaauaacauauagaaaaauaauagcaaauaauuauauggcauuuaugugucagauucuguucuagacuuguguauuagcuuuaaauccucacagaaccccugugacaugaugcuacuguuauccucaauggagggggaggaaucaaggcauaaagagguuacuuuaauuucugggggucacuccaccagugagaucagugcugggacuggaacccaggccagcugaccaauaguaugauguuuggacugggaaucacugcccagugcccccuauuuaacucuuaggguuaggguuaggguuaggguuaggguuaguaaggcuguuccuaauguagcccuccaguaaugaugaugaagaugacggugauuaugucccaagucaucacuuacguaauuucauguacauuauucuuuuggcguugauaacacagacaauacuguugccaaucuacaaaugagaaggccgaaagcaaagacaugacuugcucagggagaggccaucaggaagaggcagagaggggauuggaauccaguguuccccuucuccccugucccacacccuaugccucugcucagcaucggccaagaggaguuucuguccuucuagccaagugugugucaggcucacguguaagggacaugccucauguaaacucauagcuacuuaagaguaaacagccucauuaaguaguauccacaggacagugccacugcaucacacagcaguuauuuaagaaagagucaauuaguuagggcguucaaauauguguacauaauuauagcuuccgucugggaacagcacaggguuaguacuagaggcaaaccucuuuucacauagcauacuucucugggaacuaggucaaaauguaacaccuaguaaagaaaauugcuuguuuucugcggagaacuuucucucccaagcagccacaccagaaucucccugugacagaucguuauuaccuggccuucuccuuaaggagugcuggcuugggcaucugcccccaggggcaucuuuaaaagaguuaaguaccaggugauaccuggagggggacaacacccuccaccauuaagcaaaccagcaaagcccgagucacagccucccaggcuggcuucuaaggagcgacaaggggucuauggugcauuucugagaaaugaagauaaauuccuaaaaagguuuauauuagagaaauuccauacuugaacaauaaaaggaguuuagaacacacagaggucuauggaaauggcuuuagugagacauucugaaacucuagcagacugcugugcucacgacgaauuccucaguggcccaucugggagcagcucuggggaggugcuuguugacauuccagagguugcuaucaggaggcaguugccccucacagaggaggagacagccaagggcacccagagcauuggauccucugagacgccagggaagugccaggcauuggggucugacauuuccccuugcagucugcuuuugaauaagauguuauguuauuccucagucuccuuuucuaaaaaaugguaauguguauauuuucaaauucagauagcuguagacauuuuuugucuaggaucuaguauuauuuuaaauuguuaucuuccacagaagaaauucuuaaucucauguacuuccucauugccucuguuucuuucuaaaaaauaacuugaaucacuggcccugggaauugaaauuuugaaacuucccuuugagcugaaggaaugugaacagcccuuccagggcucagucauuuuagcugggccugaugauggugaugauaaacaaccacuguguuaugcuugaauggugauucccccaucauaaaauacgcagguguauuauugaccuucuacuccauuuguuacuucuguauuuguaauuaagcgaggcuucacucaguuuagcuuuugaguuuugauuuuauuuuauuauuauuauuuuuuugagauggagucuugcucugucacccaggcuggagugcagcugcgcaaucucggcucacugcaaccucugccucccggguugaagugauucuccucucucagccucccgaguagcugggauuacaggugcccaccuccaugcccagcuacuuuuuguauuuuuaguagagaugagguuucaccauguuggcgaggcuggucuugaauuccugaccucaggugauccaccugccucggccucccaaagugcugggauuacaggcaugagccaccaugccuggccaaauuuauguauauguauguguguguguauguguguauauauauauauauauauauauauauauauauauagucucacucuguugcccaggcuggagcgcggaggcacgaucacagcucacugcagccucaacuucugcuccagcaauccucccaccucagcuucccgauugcugggacgacaggcgugugucaccaugcccagcuaauuuuuguauuuuuuguaaagacaggguuuugccauauuggccaggcuggucuugaacuccugggcccaagcagucuacccgccuuggccucccagagugcugggauuacaggcaugagacacugugccuagccaaguuuugaauauuugauagucacuguguaccacugggaauuuuuaaaaacugacuuacuaaaguucacagcaucaguccaagcacgugcggcuucccccagccaauuuagcugcagaaauuaaggaaaacaggcuuuugccaagaaugacucuugauucaccagcaaaauaauuuuuuuuuaaucugagggaauaacuggguugucuugugcauguguauugugguucauuuaucuauaauaaacuugcugaagcuuuccccauuauucuuuaaccucaagauuuguuggccagccacgguggcucacaccuauaaucccagcacuuugggaggccgaggcaggccgaucacuugagcucaggaguuugagaccaaccugggcaacauagcgagagaccuugucccuaaaaaaauaacaauaauaaaaaagauuuguggugguucccugggugguaguucccuggucacuaaaccaucgugguuuuuuuuuuggaggcggagucuugcuccaucaccuaugcuggagugcaguggcgcaaucuuggcucacugcaaacucugccucccggguucaagcaauucucugccucagccucccgaguagcugugauuacaggugcucaccaccacacccggcuaauuuuuguauuuuuaguacagacaggguuucacuguguuggccaggcugauuugaacuccugaccucgugauccaccugccuuggccucccaaagugcugggauuacaggcgugagccaccgcgccuggccuaaaccauuguucuugacuagcagcugccuguacauuucugguccugacauuccagaaaugccuuucucccuggggucaggcagaccuuccuggcugggccauugcacugggcuuuccccuguggcagucaggaggggauuuauaaaaguacauauuuagguugaaccauaugaaauuggcagucuuaaauaaucuuuaaccuuuaaaagugguaauuaguuucaaucuaauagggcaaccaggggcuuugcuguaaucuggaugugaaauucaguuccuaguucuuccuaggcacuggaagauaagauuagccauuugugguaggaccauauaauaagaauuauuacaguucaguugucaaagucuuuuuuguggguuguguucuauuuacugugcaaauuuaggaaguuguauuaucucucugguuuuacccucaucaauaaagugggcuggggugaaaagaaguacuuugaaacaauucuauacucucuccgcuguaagcuuagguuuauuugaaccuaauggcaaaccuggaaguccgcaggccugguagaauugcucagagagguuuagagaccugugcaaggucaaggucucagaaugaguaagggagacgucuggagccuaaaucuccuaccuccuguuccccacccugacagacacuccacaccacuagguagagagcaaaccacacaaggaagccucuuaggggcaaguuccagggcuguggcacgucaccccuuuguuuuaggauguugcccugcacaugauaugccacacagcagugguuccagugugugccauggugauaguagcccaggagugaagaaccugggcucugcagucagcacugccaaguucaugucccagcuccaucacuucucagcauguuauggcaugugucugcucugugcccagucuccuccucuaaaugcagaggcucacagcccuaccuguaaggcugcaguaaggcuggaguuaaugugcauggaaaguacuucaaacugugccugacacccaguaagaggugaggaaauguuugugcuauuuuauuauuauuauaacugcuacagauauuacuguuuuguugagaaaucaaaaucaguauuaagguacugucugguucuucuaaaagucuaguuuuuaaaaugcugaucauuuaauuggaauuuuaguguuugggggaaauuuuaaguaaucuccuugcccccuccuucuguagauauguauguauguauguauuuaucugagacagggucucacucuguugcacaggcuguagugcacuggcaccaucaaagcucacugcagcuccgaccuccugggcucaagccauccucccaccucaggcuccugaguagcugggacuacaagcgcaugccaccaugcccggcuaauuuuauuuuuuguagagacgaagucucauuauggugcccaggcuggucuugaacuccuggguucaagagaucguccccacucagccuccaaagugcugggauuacagggagagucauggugccuggcuuugcucucuccuuuuacuguguggcaggacuccuagcagcuugccugagaccucauagccuggaccauuacuuuaucccccaucucugcuaccccuggcccuuccuuagacguggagaggauauggaguugagggggcagccuaggaucuucaguugcuccgucuucuucucuuacuucagaagacaacauuuaucaggucauccucgggugagggccaugugaggcuccuggguugaaccagcaugugucugcauauuuuacgugaaauguagagggcaaggcacagauccuccuuguguuaaucuccccaggaaggaguaggaaauccaucuugggacagcaaaucugugcuuggaagcauuucaauaagcugggccggccagggcccccuuacugggugucaggcaccguucaaagcacuuuccgugcacauuaacuccaggcucaccacaaccuuacagguagggcugugaaccucugcuuauaaaggaggagacugggcgcagaggagucacacgacauaccuugcccagucccacggcugugaguugauggggucgggacaugaacuuggcagugcugacugcagagcccagguucuucacuacugggcuacgacuaccacugcacugcuguuauacacacagcaaguacguuugccgugcgccucccuuucucagagaagaagcaugaggcaugauugcuagaacaccauuaggauuuuuucugaucccagcauaacuucguacgaaugcauucauaugcaguugucaccucgcagcaugagcguggcaccacagggucucaaugcuccuuucuguucucuugccugccccucaccccuggacacugucuuucagggagcagaguccagcugugcacccaaaaccccagcugcccacucuugaggugccccagccaaagcucucccuccgccuccaccugcugcuccucauccucucuuuuucagccauccugggcuccucgcuuugcccgcuuguaugccauguggugacgucagcacaucucacgguggcuugcucuguggcucccgugccuggccucugcugucaugucaggaggccugggagcuguggaaaggcugucacuuuauacacagggagugaacagugugcaaauuuugaaucccucuguuagccucaccugagaaucuaggggguggcuguuuuggaaaaauggauauugagugugagcuugugguuuggggaaaagaucagccuguccacgggaaugguuugcagaaaauuguuucacguaggugugauauguucagcuccgccagaugucucgggccaucugauggaaagaaugggacggcacugagagacaaucauuccugacaagaaacgagguucaccacggaugugcccagagcccuguucccaccccaauucuagagaauugaauaauggcauggugggguuuuuucugugaacuuacaaagaaugcuuggugagccucaugugcuuuauucccacaaaccucuccccguguuggguaguaggguuuauuuaaagguugggguacaggaggggacugugcacaagugucugcagacagguggaaauugggggcuucucuuccacuaacuugacccuuuacuuuuaauguuaugagguuuuuaacuuuguggguuaaauuccaccccacugacaucagaaacaguagguugcagucugcaaccagccgugcauuagcagcauggccucagaaugucauaacugcuuugugcuucaacuuuuccaccugcaaaaggauccuaaugucuuuuucuauaucuuccugggccgauuugaaaauguaggaaagacugugugaaaaaucguaucccaagccccuucagagaaagugauuuugaaaugucaguaacggccgcucauacccagggcugugguguccacaugugcacuguggaggcuggccaggccucccuguccugcauucccagcauuuuuacuuugugaguaauccccaccacuuccaucguacggaagaauugagcuuuuagcuuucugcccacacagacacagaugucagccauccauaguaaaggaaaaggagaggcauucuacacuuucugccuuaaacaugcacagugccucacaaagguccaucccagacccuggugcccaggguggaaguaacaaagcacuuccugccaucacuuuuggaguuacucagucugaaagcuaaaaggacaucgccagacccugucgggaagccaccauuuucaugugaggaacccaagacccagagcagggaggcccuuacccagagucccauagcagauuaucaggaaacgcugggcagaacuugaacccaggucugcugacccacaggcuagauuuuuccuccgcacucugcuuccguggaguggauacaagggcagugacuacagggaaagggaccaggaucaggaggaggagaugguaucaggcaaaugaggaacaagaggggccuaaagaugcucagccagggccuuccccaaccugguccccucaccuacucuccagcuccccuagacuccuaagcaccuggaggauguugggugucacaggugccugccccucccuggcccuaaagccauaggggacacugggcuggaugcuaaguuccuggggcaucagauggggaaacaggccccagucccuucagcuuucaugcuaggaaauaggcagggagcuuggggcucuccagcccagugggccagugcauccugaagaaggcaugggauucccagggggagaggcccaggaugcuugggcaggggccagcauggagccaggagaggugaggcccauggcuuuggaggcaggcugaccuugguuuaaggcaccgcucugagugacccugagcauuacuuaaccucucuuauguuaagcauaauuccuucaccucaugaggucaauaugaggaucaaaugagaggauauuuguaagauaccugcauguucaauaaauguuagcuaaaaucaaaaugaacagaaaggcaucagguggcagauggcagcaggugcuugugcaccucucauaccugucccaugggccagcaucuguucucuguggcuggauggaggugcuaucaaucuccuccaagcuccuacuucacaaacaacuucauuaggcauccucaguuucugucagucuccuucaggcccccacuuuacagaugucaguaagcccagagaggccaagaagccccaugguuggagcacucugugaugcccaguuucugaccccuccuuugauccgucucuuccagauucaugugcucacagcuccccaaucagguccugaagagcaucagcgucaucgacagccccggcauccuuucuggggagaagcagcgcaucagccgaggucagugccugucccugccccuccccaccaagugcuggcugaggcccucucugcugugagcagaggauuucugucccuauauuauucuauccguccuccaggacagcuguugggcagcugaaggggccccaagugucaaccaggaguucauagcaucaaagacucugcccccuccagaggcuuauauucugugagaaagacauuugucaaguuacacaugaguaaaugaagaugaggagugggguaaacaaugggagguaucgaggugugaggggaccuggcuuggccucggggguguugggagaggcuccuggaggaagcagcauuggaacuaggaucugaaggaguaggaauuaccuaagggaagcugugggguagggagagauuaugaagcauucagaggggaucugugaaggauagaaaaugcuugugccgaagcauaaguuucuccagccuucacaagacaaggcugaggcaauagcugcuucuaggccugugcuuuguagucaaaacagaugggucugcuggguagaguggcucacgccuguaaucccagcacuuuaggaggccgaggcagguggaucagcugaggucaggaguucgagaagagccuggccaacauggugaaaccccaucucuacuaaaaauacaaaaauuagcugggcaugguggugggcaccuauagucccagcuacucggaaggcugaggcacgagagcugaaccugggaggcggagguugcggagagcugagaucaugccauggcacucuagccugugggcaaaagagcgaaacuccgucucaaaaaaaaaaaaaaaaacaaaaaaccggugggccugcuaucucccuccguccuggaggaagggggcaucaggggcagaccagaggacagaguugacuuacggagaggaaaugccugaucgggagggucaggauggguuccugccaucacagguccagaggcagcucaagucuuuuccuugcccuggcccuugaaacaaaggcggguugcugggagggaggagauggagcagaugcaucgcugccaucacuucuggcugagaacucuucacaaccccuugaacagcaagucgguagcaccgugcugagaagucugggcaugccaggguugagcagaagccuguguggggucacggucgcagguuaugacaaggcagugaacaccccacagcucacaaagcagaagugcaguuacauaggccagugagggucccgugacaggggucaagaaagggauuccgaggccaauaagcccuccuuucucuuggcauuuugggaaugccaucucugcugcuccguggucccgcagagagcucggggcuaugcugagccgaggccucccagggugccugcugugccuucacuguuucagucagggacuugccagcuauggaaugccauuaaggucaccuuucccgggccuccaagaaccuugcaauuaugaaaaaaaaacaaaaaaaaaaacaccaaaaaacagguuaaugcuauucauaaauaucuuguuggcuuuauuuucuauuauaaaaguauagauguuuauggcaaaggauucagucaaugaauaagaauuuaaaaaaaacucacugucacauuuaacaauuauuaaugguuuucucucacuucuuagagacuuuuuccugcgcauaugcaaacacauuucuaauagaaaugggauuaccaugcacauuuucuacaccuugauuuuucuucauaacagucuaccuuggacaucauuccaugccaguauauucagauuauuucauuccuuuuaauagcuacuuggguuccaugaaagugacauaauauaguucauuuugcugauuuguggacaucaugaugguuaaucaguuuuuaugcuuacaaauagugcuguggauggucgucuuuuuaugugugucuuuacaccucagugccaaucaauuuuuuuuuuuaagagucaguugaggaccauuaauuuagccccagaaagguugcucugcagauaguauggauaauaaagcaggcccauguuccacagcuauucugagcugcccguguuucacugcuucuccauuucugacugaauaugcuggagaaauaugugguccugcuaacucuuucuuuuuaccucuaaauuuuaaggccuccggauuuuggcucccaccauaugcauuuguuuucauugguaggccuuuagccaguucuguucaccugagucuugcagcgucucuccuuugcuuaguaaucgugucuuucaaacuguagcucccuuacaauaguguugacacguggauuaaugcuuccagaaugcuuugaagaucaguucuuuguaucacuuuauaauaugaucugacucauauccuggucugacuuacuauggcauguacuuacucacauccuaugcacagaaauagcauauauguuccagccagucggcggucccugccacaccgacggacacagcaacagguggggaaggacccagagccacaagcgaugacagcacgacgggccacagcugugguucccaagcccggugccacacgguguuaggggcgcagcuggugguggaagucacucagcugacauuuucaacacacuaaccccaaagaaugcauacuguuguaaagcagcuucagcucaaacgauugcaaacagugccacguucucacguauacucacaccuacacccagcuucguaagaccagcuucauaagaccacagccccaccuuugccaagaauuaaugucaacaugggauaauagacuggguacaaacugugaccccacaagauguuuaaagcaucccccacugacuuuauuggcgggucuuugccucccuuaugggcauugugccugggaaggaggaaagguggccgcuuguguacugcccuccacugcuccuccuuuccccuuugugcgguugaugauuaacccucaaaagcugaguggcugggcgcgguggcucacgccuauaaucccagcccuuugggaggccgaggcacgaggaucccuugaguucaggaguuagagaccagcuuggccaacauagugagaccucaucccuauuuauuuaaaaaaaaaaauacauagcauuccaggggaguaaacgucaucuaaaucuccuguuuaggagccguauaaaugaaacccaugagggcaauugauuuuggagcaauuuuuaguauacuacuccguauggaaacuccuuaccccucaaguuuuccuuaguucaauuaugguuagcagaaaaucuuuuuuuuuuuuuuuuuuuuugagacggagucuugcugugucaccaaagcuggagugcaauggagugcucacugcagccucugccucgcaggaucaagugauucuccugccucagccuccugaguagcugggacuacaggugccugccaccaugccuggcuaauuuuuguauuuuuagaagugacgggguuucaccauauugauucuugagggcuuuccuuaacauuuccuuaacauugucuaggaagacuuaaagauguuuguauauaaauguuaaaaugauaaucaguaugguaaccauauuggccaaacuggucucaaacuccugaccucaggugugauccacccgccucggccucccaaagugcugggauuacaggugugagccaccaugccuggccauuggcagaaaaucuuuagggacaacagacuagguuaguuuaguuacuaaccuguagcuuuccuggcugacgugaaguguugaauucccaucaagcaaggauaaaaguguucugauauauuuauaauaauaauauucugaucaaguaauagcuuccuaaaaguccuacaaacuuuucuugauuucuuuucuuguauuuuaguagccaaugaaagaauguuuggauuccugcgguuuucuaaauugcuuucuugaaguguguggguaaaucugaguugguucacucuucagaacauccuuuguccuuggugauagcagccagguguuugacucugcgaugagaagaaagagcaccuuuauccacacgcauagcauuuuccuucccacucgaccucuuaucaugcuggccgcugaaauacuguuuccuagaauacuauugaguccaugcugaaccuaaacauaaucuaggauauauuucuagaguuagcaugaacacaaguguguucccagcuacuuaguacaaaccuccggauucugacuccaaucauaacauccuuugaaaaauuauaauguagcaacugguauucuuaucaaucuauuuagcauuuggcauuuucaaggugcuguuuuaaccacagauuauuccuaugguuucuugagaauaugagguuuugcguagccuucaauagacuugauuuugguaauaaaaauaguacagcuucucccuuuuaaaaauuuaaauaacucuagaaggaaaaagcucuaucuaaauuuucuaacagaucgacuuauucucucaggaacaacagcugucaaaugaaaauucgagagugucuuuuccugauguuuaagcucucgccucuuaaucccagccuauucauuauaaaccaaugaauagaacugggaagacaaugaaaaauaaaaggacagaaaaugcccugcugguaaaagcaguggacaguaauaguacaugaagccgggaggaucuaacugcacuucagguaacaugacgggcaauaacagaaacuucagaaucacugauuaccauuuuaacgucuauauacaaacaucuuuaaguccuccuaggcaauguuaaggagauguuaaggaaagcccucaagaaucaaaaaggcgccuggguagugauauaaacaggaacaggcuguuucaagggccugccaacacagcuaaggugcucaaacacaauacagguugaacaucuugaaacugaaaauucaaaauccaaaauccuccaaaauccaaaacuuuuugacgugaugccacaaguggaaaauucuacaccugaccucaugugacggggcacgauccaaacuuuguuucaugcacaaaauuauuuuaaauguucuguaaaauuaccuuuaggccaucuguguauggugucuaugaaacauaaaugaauuuaguguuuaggcuugggucccuuucccaagaucucucauuauauauguaugugcagauauuccccaaucagaaaaucugaaauccaaaacacuuccagucccaaccuuuucggauaagguuuacucaacccauaucucaaaagaaucgacagagcuaggaaauggggccuggacauccaagcugugacuaagaggggugcagaaaaaaaugaaaaaggcaccagcagaccacaaucagggaaguacaaaugcauccacuuuugaacuuugaagacaaaagaccggauuuugaagcuugcucgggaaaggagagagaacacuuagagauguccagauaagaaugacuuccccucucaggcuuugguaacaagaaggauuugagaggaaaacacacacauaugcaaaaaagaaaugagucuuuuuuccuaaaagaccaagaacccucaguucccuuccauugcucuaugugucuauccuucugaaaggcuguugaucagagccuggcuggagagaugggugagcucucuagccagccaaggcagggcgcuguaggccagcgugcagacaaacugagacgaagacaugacacucuuaccacagccucugccuagcaccgagucgagggagagagaacuguggcugcccuuccuguugauaucucuucuagacaacagaaagaguguaugaaagaacagagagagauaugugagcucagggcccuuggaggaacggaagcugugcauguggcuggaacauggguccauggcaggugggcgcauguggcaggagacucgaauuuguccugaaggccacauggaauacugagggguaggagguaugggaggacgugguggagaauucuguagaauagaacaugcagccacaggcguggaucaugaagccauuuuuuuauuuagaguuugcauucagugaccugacucugagcuuugucuggauuuggcagugacagaaaaguguccaucccuggaggcuggggcccagcccugaugauuuguuggcagauccuguuuuccagccagggcuaaggccagucugagguuggguugugagguccuggacaucacuagccacuugggccucuagcaggaaauccugauuucuuuuuguuucggggaaguuuugacaaacgcauccagacuccuuuuccgcuggugccacgggaaauuccacaccacaaguguuacugcuuccggcccugaugugagcauaucgccacugugacucacaacagcguucgccagccccggcagcuaguuugaguuuuuguuaauacaucaaaugcauuauugauugugagaaaugacuguuuuuaucuaaacuugaaaccuugacuuuuagaugaaaaacaaaaaauuuuauuugauggggagaaggacacuucacuuacuuugcauauagagcauuucauauuuauguuuaugauauaaaacauuucacgggauaucucagacauugggauacagagauuaaucagagaaaaacauuugcuccuuacucuuuugaguaauaauaauaauagcuaauacucucauagugcauuguuaagugcuuuccacauauuauuaacucauuugcuccucacaaaagcucugugagguaggagcaauuaucccauuuuauagaagagaagacugaggcacagagagcuuaagaaauuugcugacaaucauguagcaaguaugguagcuugucuucaaagauacugccuccucccaccaccacgccaagaccugugccucccagcauucgugccuugggagucuucucuucaugagucuggauugaccuucugacucacuuuugaucaguagaauucugcaaaagugauacuucaugauuuccuaaggcuaggucauaagaagcccugcagguuccaccuaaaucucuacaaguguucauucuguggaaagccgaaugccaucuaaaaaguccaacuacucuuaguaguugucauacugugacugagacggccauucugugagggaagcccaagcuagucacaaggagaggccaagaggcccaggcagccuccuuggcugguccagcugagaugugaguaaaggggccaucacagaaccagcucaguugagcugucagguaacuccagccccaaccacugucugacuaucaccuucugacagaccccaagcgagaacccaacugagcccagucaacccacagaaccuccagagaaaauagaaguuauuguuuaagccacuacauuuuaagguggcugaugaccaaaauagccaauaagugguugagugggauugaaaccaggcagucugguuccagagugcgugcuguuaaccacaagaggcguggaugcaaaccagggcaaaauacagcugccagucacacacacggagaaggcagcaaaccccaugagaaaauguaauugaugcuuucccccagcaacaucaaaucuccuauuuuuuuccuuuagcaauuuuugaugauaauuuugcuuggaaaagaguacacacuacccugcauucucacuccuaggauaguggaaaggggaaagagguuuucuuauguugaaugucugcugugcaccccacucugcugugcccccuggucaauuucuuaagcaccuacuaugugucaggugccaggugccuuagguuucacagcaacagugagaccucauggcugccuucaugaagcauauacuaggggagauagaggagccaaaacacaaaacaaaugcaauugaaacaaagacaugucccacagcaaggggugggcagucagggagggcucucugaggagguggcauuuaggcuggacguaaagaauggaggguuugccuggcagagaguugggggaagagcucuucagcaggaggagcugcauuggcaaaggcagagaguaggugagaccuggcagauucggggaaggcagaggcuagggagcagccaggaaguggugggugaugagaucaggaggcccccccgccaccugcugugagcuguaggcccuggggaagugcauagauuuuucucugagaguaccaggaagccacugaaggauugucuuuuucaaucuucuguugauuaccuagaauuauuaggaauguccgggucuuccuguacugggcaagaacagcccugggccugccacucaguucucugggcguguuugguugcugguuuuucucuuuccuucggccgugcaauugcuguccuuuccuucucugucauacauguggcauauauguucuaggccagccuuucccugcugcccccuccugcucuggaguccacacggcugcaaaugaugcucggaagacuagcacggugagccccaggguccacagacaguuaucaccuggggagcuguuaaaaugcugcuucagccaggcagaggggcucacacuuguaguccuagaacuugaggcugagucgagaggaucacuugagggcaggaguuccagaccagccugggcagcauagagagacccagucuccacaaaaaauaaaauaaauuaguuggguguggugguguguucucguaguccuaucuccuugggaggccgaggcaagagaaccuugagcccaguaguuugaggcugcagugagcuauaauugugccacuguacuccagccuggguaacagagcaaaacuccauuuauuuauuugaaaaaaaaaaaaaaaaacuuccuggcacaugguucaggggcaucugggcaggguccagaggguucugauacagggggccccauuuugaggaaucuggguuagggcugagccaccacuccugagccugagccugucccuccuacauacccugccauccccaaaacaagugaaagaaggggcuggcaaacuuggagaaccuaccgaaaccaaccugggcuuuguccugcaucucuguaugcccgagggugaaggcugcccucucagagaacggaggggagaacuugagugagagagacgaugggguggggcaggcucugugacuaaccagccuccuuccagggcagggcuuuggaaggaagcagaggugacugucccgcaggagucaccaagugacccugucggccucaugggcgucugacagggagggcgugaggccugaugcuggguccucugucugugucucacugcuugcaggagcacccccgccuagccuacuucggaagcuaggauuuuuaggaaccccuaaugaaaauaaagaaggaauuuuuuuaaguuuucagguacacuuugaaacguuuaauaaccuucccugguuuuauggggacauuccuguuacacagccucaaucccuguugcuagaggugguaaagcuucucucccuccuaaucacugugcaccaguggggaacccccagccuagaaggugggagggaaagauuauaaaugcaggauucuagguggaagagaggcaguggcaauccaugccgagaaacacuggccgggcacguuucucccugucccuggcucuuucccuugccagcugggcaaccugggcgaguuacuucaccucuuugagcuucauuuuccccugcucuaaaacaggggaagguacuuucucucguacagugggaucuuacgagaaucugaaugaucuguguucauaccuaagugcuccauagauaucagccguuccuguuaucuaugaagcucagagugagagggaaacagcaaaagguccuccccaggauacacguguggcuugaauucagguuucauguaccugugcccggcaggcaggcaggcaucucgaccauccaaacaagccugugguuggggaaacgcugaaaauaacaaggcuuucagggagcaucuguauuuuccuuagaaagacagagggagguggggagaugcaggcacacuccugugggcccuggaggaggcugaccugagcuugaaucccagcauggggcccugugagccucuuuccgcuuuuauaaagugagggaauuuuccuucccaggguuguuuugaagauaacauguguaaaccauuuaacauggaucaugauuaauaacuggugauaggggcggucaugauucauuuuauagaacugggguggucccagaauagacggacccagcucagagggcccucucggccaagcgcucagcauuucccaggggagggcagaggauggccgaguccugggacucagacaagggccuugcucuuccagagauccaaagcaggggcggugagggugcgugaaguauuugggccugaccguagagcuauggaaagccacgagagugcagacaagggcuggaggugggaaaccugcugaagagaaugacccgggagcaguguucccggguguggcugaggggcccggcuucuggcacuccuccaauucuuuuugccauaauccucuuucuuguaucuagggauauuucucacacaugcccugaugcaguuuccucaagaaaccuccauucaccuguaaucuuagucucuuucucaaaauugccuccuguuggaauccaaaucgagaugcaaagcacaaaucagaccauguaugcagcguuucaccuuucugaagcacccugcgguggguagguguguaugugcuugggacaaaaggcuacaaaaagauagugaagaaugucuguaccacccauaucccccaguuccucucccagagcagacccugccugcagacccuggggcuucucccagcucacccgcccacucacguggagcccuggcgggauucgcuccacugcccugugucuugauuuucccacuuauaguaaaucuuggagcuuguccaugucuguacuucggagcugccucccgcaguccaucauauagauagaccagaauuaauaggugccauccuuuuggugggugacauucaggcuguuccuaaucuuuugccguuacaaacagugccacaguggauuuacacaguuuagcauguacggugcaaguguauacaguuggcacgauaacgugcaaauauaucuugaaaauugcugaaaagggaggagcuuaaaaaaaaaaagaaauugcuggcugggcgcggcggcucacaccuguaaucccagcacuuugggaggcugaggugggcggaucacgaggucaggaguuggagaccagccugaccaacauggugaaacccugucucuacuaaaaauacaaaaauuagccaggcgugguggcgugcgccuguaaucccagcuacucaggaggcugaggcaggagaaucacuugaaccugggagguggagguugcagugagcugagauugcgccacugcauuccagccugggugacagagcuagacuccgucucaaaaaaaaaaaaaagaaauugcugaguagauuuuaaguguucuuaccacaacaaaacaaguaugugaaguaaugcauaugcuaauugcacugucaauuuagccauuucacauugaaugcauauuuaauuuuguuuuauuuuaauuuaauuuuacuuuauuuuauguuuuauuuuauuuugagacaggaucucgaagcuccgucacccaggcugaagugcaguggcacgaucacagcucacugcagccuugaccuccuggguucaagugauccugccaccucagccuccugaguagcugggacuguaggcaugcaccaccaugcccagcuaauguuuugcauuuuuuguagagaugggguuucaccuuguugcccaggcuggucucaaacuccuaggcucaagugauucaccugccucagccucccaaaguggugggauugcaggcaugagccacugcacccagccucaguguauacauauuucaaaacaacauguuggacaugauaaauauauacaauuuuucuuuaucaauguaaaaaaauaaaugaaauagagacuaauccaaaaaaugugcagauguaacucuaagaugcauuccuagagguggaauuuuggaaucaaaaggagcggcggucuuuuuauuauguuagcuggugccaaaaaugccacuguagaaggcaugccuguuuacaugcccaccaucucauuaugauucuaauuuucauuccucaugguuagugugguugagcaucuuuucauguauaccuuuuuaaaguauuuccuuuucuggagguauuugacuguuuugaaauacuguugguaacuacaugggcuacuuuuagcaaaaucagugagucauuuuuuuauaaggagccccguguggauucccaugguucccacugacugggucuuucuuuccaucugugacauaagcccagaaauaacugucucugaguaauaguuuggcuugaggagcugguuagcugauaacuuaauugcuagagcuggucugcagugccagcuguuguccacaggcaugcaggacacuugugcaaugccaagauguuugaaaagaggaacagggcagggcgagggguggggucuucaggucagaaguugcuuucuagcccuuuaugaccccaguugucaucccguugguuuaacauuucucuuuagaaaacuguagccugaagaaacauuaccuuugcccuucugaaccacagaaugacaagaugcauugucacggucaaagccuugcuuauaaauguuugaccucaucacauuuggguggagucuguuggcauuuugccucaagaaaauucagugcaaguaauguuugccacgccaacuccgucugauuuauagacauauuguaugagacuuucuagccugacuuauacacaaagcccacuugaaaaaugaggaauggacaauuuccaugugcgugacacgggauuccuggaucuguucauccuaauauauaauaauaucagaagguuagauggggugacuucuuaagcauccuuggaagucauacauuccacaacccuuccucagauaguuucuuucaguauagaguuguuuggaauuggaugacaauaaguuaaacuuuggggcaacuaauuacaccuauagaaacauucaaggaccuucaaauuggcccaaaugcuauauagcacaugaauccaguagaagggauguaauaaaaugaaacuuacuguuugauaauugugucauuuagaguuguucauucaguauuccuguagccaucugaagggucuacuguagccaucugaagggucaucuuaggcuggcacuguaacuaguucgugucuguacuauacagacgcugagcuaaaucgauuuuccugggaaucuggcuuuuuauuucaaagaagcuuacuguuuggaaccacccuauauagcuaaaauuuaagaucuagaaagaauccuuuuugaucaucugacucacagguauagaaacugaggcccagcagaaugaaauuguuaagccaggcuccaggacuuacaggauuuucuugguagguuuuuuuaccaacuucccucuccagcaaagagccuaaaaugacugauaauaccauguugcugucuuucuccagggcucagccuucuuuaaaugggccugcuucuucaucugguauuuaaucugagauggaaagugagaugcgaaacccaauuuucccuuucacuuggucacaugcccagaagcagcagcguucagugggccgaguacuggcguggaaccuuccucuguucccaugucuguggcguggcacgaaccugugauguggggcucucccgcccuugcccuggaggggccuucagggacauguggcucacccaucuguuauugucacauaucccccagaggaaggagggacaggcugugagguuagcuuguuuauuuuaugaggaaacaggcacagaaaaauuaauuuacagagucuuggacaaaaucccaaaggaaggaggagugggaagagcagagagcggauaaacagcacaacgccaucccuggacacgccuaguucuugcuuuuauuuaaauuuugguagguucuguggccacacccacuuuaggcuagguacugggagacaaccucugggguuuucugguaaccaguuacauucuccaagagguggccauuaccagcugaaagguucgaggugaacucacauccagccucuccaaaaggagcuugggaaccuguguucccuccgggcagucucccagaccggguuugguaucagccccucccugccacugcccugcaucuggucagcuggggaaaagggggcagggaggagagaaggccaguggagcagagccauucauucuguggcuuauuuugucaucagcaggucccauugcucccgcugauuggggacugccucuuccucggggguguaguugcugagauacugcuucccccucaggguggugcucggcacacccaccauagccucuggcagggaaaugcuggaauccagaccuucaccagaagcaccauuguagaagaaaaagaacaaccuccucaauaauaaugcaagugggccaauaauuuuuacaauaugcauauuuguuuucuugauauaaaaauaauauauauucauuguagaacacuuaggaaaccacaaaucaaaaaggagaaaauaaaguacacucaccucugauucuaccauccugguacacauauggugcagcgcagcgggugaaagcacaggcucuaggauccgagucccuggguuugaauccgggcuccccugagaaacagcugugugccuugggucggauacuuaaccucucugagucuuuuuuccuccccuguaaaauggggguaauaaaaguaccuacuucaugggauuguugcaaggauuacaagauuguagugauauggagcucacagggcagugcaggaauguaguaagagcuaaguaaauauuugcugcaguuguugauuuauagcuaucauuuugcucucugccacaaugacauuuucagaagacauuuucagaagcagacuuuucuaguugcgaaguaaacucagccaggaaacaaugcagagacuccuugcccugaaguggcuguuauuauuaacuaaagggacucuuuucgaaguguauuuauaauaccugagcgaucccagauaguugauguuuacuuugagaugauuuacacuuccccuaguuaguaacaacccuuuuuuagaaacgcauaccacuauuuaagcaacuaaacuugccagauugcuaaaaaucaguuacauuucuuguucaagugaauucacuugauuaaaccaauuuuacuguauuuuacugugauaagaacacuuaacgaaaucuacccucuuuacgcauuuuuaaguauccauuacaagcacaauguggcuauaggcacagugugguuccgcaaaucucuagaacuuauucaucuugccuaacugaaauuuuaugcugguugauuagcaaagccccauuuccuucuccccacagccucuggcagucaugguuccccucucugauuuuguguguuugacuauuuuacauaucuuauacaaguagaauuauguauguuuguccuucugugaugggcuuauuucacuuagcauguuuuuuuccucaagggccauccauguuguugcauauugcagaauuuuuuuuaaggcugaauaguauuccauuggauguguacaccacauuuucucuauccguucauucacugauggaugcuuuucuuauuucuacaucuuggcuguugccauaaagcguccaucaaugaaugaauggauaaagaaaugaugccaauaaugcugcagugaacaugggugugcagauaucucuucaaaguccugauuucaguucuuuuggacaaauacccaaagugggauugcuggaugauaugauaguuccauuuuuaguuuuuggaggaauaaaccaaauguauugaacaccuacugugcucaguaguaauuccuggguguauaguggugaauagaauaaggaguggagucucugcccucagaauuucugucuuauagucagcaaauguauauaccauuucagaguauaagugcuaugaaggaaauucauuaaagcuauaagacucuauccccgggaaccugauuugauaguguaaggcaucugcagugggccuuuggguuacagacacagugaagacuuggcccugcucucaggcugcuacagaccccaucaggaggaaacaggaaaggcgguucuguuccacugggugggggaaggccaccuggaggaaaguuccccagagggaugaguggcuguaguuggagaagaggaaagggcauuccagacagaaagaaaagccugagcaaggguguggagacagggaaguacaggaugcugcugcggaacagcagagcccagugugguuugugcaguggagaggguggggcuuaguaagagacugagcaaagguugagaauugcagcagaggcuagucauggagaauuuguucuggaaacauuuauucuagacauaaucagggacacucacaguuuuggagauaaucuuugaguucuaagaagggauggggaucgucugagggcuagauuagugagguuggaaccuggggacaagaaggaacucuuggugccugccucgugcuggaugcucacugcacgggugcuggagggacacaaaggugaacaugcagccaggagagccugggguugcacagacagagccacacagaaagugcugggggcagugguaggaaugcccacauggaacuggagcuacuaacuaugggaggggcgggcagggccucgaaaagaggagagguuugagcaguuuuaggcaguguuccgucaccaccacgggcaaguggcccugcccaccccaggagugggaggagggacauggcagggggagcucggcugcauuucugccugccuuccauugccuugcauccuuucauuaacacacaucuuucuuuguuuuuuuuauuuaaguagagacagggccucacucacccaggcuggucucaaacuccugagcucaaguaauccucuugccuuggccucccaaagugcugggauuacaggucugagccaccgcaccuggccauagacacacaucuuguuuaaaacucauaauuagaaacuuggcucugaaaagaaauguaagcauuauuuuucucuuguucuauuaaaaauagacugccaaauuugcuuccucagggacccccgugcuauauuuaccugagccagggagcaacuguucuaaccccuuaugccauucccugguggcucuuucucuggccaggauggaggaccacaguuuccacaggggcugugacgggaagcccuugauuggguagaaggggcuccuuccuuccugcccccuccuuuuguucccagaacauggagccaggaaugccaaucugggaucuuccgcaggacaaauucuuucuccuaguuccccaagcuguguagcuuuuggguccuuuggcaaagaaagaaacuauauuuugaaacaacuggacugauuacaucucuuuuuuguuccagacuaauacaaguuucacuggaaggucuuaaaggauugaaauuucuauuaauugcaugaauaaguguugaaaauauacugagcaccgugggaugauucuaugauuauguugaguccugcacccacaacacacacuaguacaugcaaacacacauagguccagaucguuccaugccccaggccacguugcauugugccuagcugaaaccaguucucacaaacuuggagcauucucacuccuguucugucaccaugagagguuuucaucaccuuggccagaaagcaggaugcagguuagccgcuucgagugguucuuaaggccgauuucuucuaaagcuuaaggcuucuacuauagcuucguucaccuccauauacagccagcuuagguauguagccccuugaugaacagauuucaacuuccugguccauucagcaguuuguggagauguguaucuuuaaacaaguuuagcagccuugggauuuuucuuucuuuucuuccuauuuacuuuugcuuuuuaagucaauuuuguugaaguauaacauaugauuaaaugcaccuuuuuuuuuuuuuuugagauacagucccucgcugucacccaggcuggaguacagcggcacagucucggcucacugcagccuccgccucuuggguugaagcgauucuccugccucagccucccaaguagcugggauuacagguaucugccaaaaauuagccuggcuaauuuuuguauuuuuaguagagacaggguuucgcgaaguuggccaggcuggucucgaacuccugaccucaggcgauccaccugccuugaccucccaaaaugcugggauuacaggcgugaaaaaugcaucuauucuaucuaauuguacaguuuggugaauuugacauauuugcauacucgugugacuauggccaucaucaagauauagaaacuuuccaucacccugagacgcucccuguuugucuguuccacucaccagccgggcucccgucauaggcagccacugccugcuuucugucacuucucccacaaauauuucuugcauccccccuguaugccaggcacuggauacaaagauuuuuuaaauaaccaguagauagcauuuuggacagcuuucuaggugccaaggugauucuaaaugcuucacguauauuaacucugcagcuccugaggccuguggauacuauuaucagcccuaggguagccccaagacacuguuauuacagaugaggaaacgaggcacagagaggugaaguaauuugcccaaggucgcagaauuaguaagugauggagccaggaaggucccaggcagucuggguccaaggcccacauuguccgccacuaucuugugugaccaugaugaagacacaguuccugugguuagagaauauauaaucuaaugaaagagaccagcccaucccucugauuuuaauacccugugugaaguggugccauaggcagcacaggcaagggaacucaggauggggagcaguugaggaaaccagaguaaccacagcucaaauuugcugaaaguuaacaaagucucaaugccuuauggauaaaagcauuuucucagguaaucacucaacaacccgaucuuacaggugaaaaaaacuggagcuuaacguuaaguaaugucuaacuuaaucaaaguuggcccagauauuuugaagaaugacuaggguuugggcuggcuuucuaggcucagucuagaccauagaggaaggguucaccagggccauagcccagcaugggcaaaagcagggagcuugggugaguuuuaaaaucugucuucagauaagcauguuucaguucuguuuccucgaccugugaugcaccaccuaaacaucuauugguaacuuuuuggaauaaaaggaacuaauacuacuuuaaauguguuugauuugcuuuguugcuugcuaaccaacaggaacauaaaccuaucuguacaauuuccccacccugguauucagucuagacagugauccucaaacugcaccaugcauugcaaucaccugggaagcuuccaagugcagauccccaggcucagccccagggauucugauucaguggcucuggggaggggccuaggagucuaaacuuuagcaagccccuuauuucauuccaacacaggaacaggcuuugaggaucaguggucucuagguccuucugaaucaccguuuuccuuuagcaggcagacuaaaugacauguugggaguuagauccgcugggauuuuuggguagcuagguauuugccgccugaguccuucaugacacaagaaucaagccgaccuauucagccuuaggaggagggagagacucugacacaugcuacaccacagauggaccuugaggacguugugcugagugaaagaagccgggcacaaaaggacacuucucugaaguaccuagaguagucaaauucauagagacaaaaaguagaaugguggucgccaggggcuagagagaggaggggagaauuagugcuuaauggguucagaguuucaguuggauggugguggugguuguacgacaaugugacuuauuuaaugccacugugcaguacacuuaaaaugcuuaaaguagcaaaauaauccuaacuuuguagggggaggugguaagcagaccaaccucucccagcuuugaucauuccuugcucucuuuuggacacugugauuucuacuccuuugauuguguugccugaugugugacagaccguccucuuacaccugcucagggacagaacaaacacagcucugccuaccuguacuucucgaacuauauuaagcucucauuguugcuuuaacacaagaaaauauggauauguaccuguuccuccagacaugaguauuggcgucacuuauaguaaacuuaaaucuggcagcucuguuccuaauaacuuuugauuucacuauagcauugaaauggcaucuuuuuuaaagaugcuuaaauuaacuguuaggaacucaaauuuaaguuaaaguuuaaacacaaguguugcaaucaaagguaaccauucaacccaggcggcccugggaggaagagagacugcaucugcacggcuggguuggcacaagcacggcaggguuggcgcgagcgcagcuagcagcagcagcuguguuucaguuuggguggcagguuucuuucggaaccgacaguaagagguauuccgaaaucuuaaaugggggugaggggaggauuguuuaccaauugugguuuuguuuguuuuguuuuguuuuguuuuugugacagggucucacucucucacccaggcuggaguauagugguggguccauggcucacugccucaaacuccuggccucaagugaucuuccugccucagccucccaaguagcugagcccacaugcauacgccaccacacccaguuaauuuguuuuuauuuuuuguagagacagggucucaccauauugccaggugguuucaaacuccuagccucaaacaauccucccgccucugccucccagagugcuggaauuacaggcauuagccaccgugcccagccuuaucaucacuuucaauagcaaaccaaagaagcugauucuaacuaauuuaagcagaaaagaaaauguuuuggagaauuugucacaggauuaaugggaaaguuggagaacuaggcuuagaaaagaguuaggaagccgccaccaccaugaguaaauucuuauuuucacugugucuucgugucauuuccccaagguucagcacuccucucugguggaaggaagugaaugucuaacucuagaucacaugcuuaugccccagcuugcuaaggaauggggcgagggacucucugccacaccuucagccuccacaacccauaaaggauaccuccugacccaacaggaaggguauucagcaaaagcaacucacauucacuccaugugcacagcguuuucuuugaucuguuucugaaccuucagauaccccaucugaucacuaggaagaccacgugggagaguggucaggucagcauggugaaucaaucaucucuccuggaaaagcaaguccccaugcagguccaucuauggguggcuccaaagcaucuucccggcacccagcaaacagccaguucauucauccgcuggggaccuacaauccugugagcuagggcugucugugcacacgucugucucaaauggcaguagcacuuaguguuacccuaggaggcaguuuguucuggccuuucagggacagaacucagagugaaaccuugacuaugugugacccugucaguaggucuuugauauuccucugaccuaaacuggcugcugacagcaaugaaaauaaacucuggcccacauuccgagaacugccuuugucuuccuuauccccaaggagucagggagugccgcagugagacagaacagagaaaugaaaagcaugaacuggaaguauccacgcguguggcggcauaaacaccacacucaggacagcggccugcuaguggggggaagggcucagggaggggugcacagggggcuucagcguuaccaacugucuuguuuucuuuaugaaaaauggaccugaauccaguuugcuuguucagcuauuccucuaacaccuguucuucaaaugcauggaaaccuuaguccgcagacccucuuuauuuucaccuaauagauuauucaccucagauacuuuuuccucugccuuggauucacaccuucuccacccccacagccaaccagggucucacaaucgauguugacauuuuuguauuugugcuauagucuguauccacagaugguugaguauuuuguauuuuaacauuuuacaugaauguuaucaugcuguauauguccuuuugaaacuaagcuuuuacucuuguucuuuucuggagauuuaccuguguugacaagugaagaucuaguuccuucucaccaccguaugguauuuuguuaucuaaagaaacgauacuugguuuuaaaacauaucugaaauagcaaacaaagcaaagugucaacauuuguuaaaauuaugugguagguacaucagcauucauuauaugacuuacagauguuuauguauguuugaaaguuuucaaaaucuaaaagaagaggggagacgaccccuagcaugggggucaggcaggugacaucucagcacuagcugggcuggauugagacucugcuucugcaacuagucagacugagauuaaaagucaacuuugugggcuuggccuccucuuguuugcuuuucgugggaaucugccucccuggggaaaggccugagagccuugaccuugggcugaagaguguuuaugcagcugcaugauuuguggagguggucagaauaggcuggacagaauuugcugugggccaggccauuuuaaaaaaagaaauuggcaagagaccauuuuacacaauggcugugauacguaauguuaaaaaaauauucacaauauaccugaguuauaaauaguccaaagauaaauauugaucacaacacuggcugggccaaccuuugaccuccucagcacucuacaaacuuggguuaauugaaggcgaugccucuucuguuaugcuuacuggauacccccaugggaugccagguggccucugguucucuuucuucuguauuuggggcuuucagaaaagugagacuuuucagaaguaagaucuuuugacccauggccuguguuuuuauaaaaccauugaucaauucugccaucaagcaaaaggucuguauuaggugaaauaaaacacucaugaggacuaaaugaaaucgcagauaugaaagucagcaauucccaaagugaccaugagccccauucucuuuccucccuccuccuguggaagggcuccccagguccuucccacccggauucauccagcccgugauuuucaugucaccaggccuccacugccuccagguuggagacagggcucucucccuggcagcugcuggagagcgagacuguuccugagccgcccauuaaacgugucuccugcagcaguggcuacacugacguguccuucucuccacccaggcuaugacuucugccagguccugcagugguuugccgagaggguggacaggaucauccugcucuuugacgcucacaagcuggacaucucagaugaauucucagaggccaucaaggccuuccggggccaggacgacaagauccgugucgugcugaacaaggccgaccaaguggacacgcagcagcugaugcgggucuacggggcccucauguggucccuaggcaaggucaucaacacgcccgagguacugcgcgucuacauuggcuccuucugggcgcagccccugcagaacacggacaaccgccggcucuucgaggcugaggcccaggaccucuuuagagacauccagagccucccccagaaggcagcggugcgcaagcucaacgaccucaucaagcgagcgaggcuggccaagguaagccaggagaugccuugcacagaggccaggggcugggacucugcugucuccucuccagaggcaagaugggugggaggaggcuucguuccagaaggcuuaaggaaugaacaugcgcuagguuaagaauacagccucgaggucagguggcccugcugacacccuagcuccuggcucugcacuccugggcagaugacuaacccuguucuccaaucuguaccauggagcuaauaagagcacuucacaagaacuuggggugacaguuggucagugugacagagcacuuggcauagugccuggugcacagggagggggaucaaucagugcacccacuacaugguagcuguuaggaugucaggacgauaggaauauaaccaaccaaaccugaaagagguggcauuggugagaccaacaggaugcugagaggccacugcuaguccccgugcaccaaaggccaguguuaccaccuggauccaggggagcccugggaagaaguauggcucagucuuacucuuggagugugcugguuuugggucacccccgcauccucauucugggcugcgggcuguuagccugcaugccugggcuccuggcucgccugccucauagcugagccuuucagcagccccaggagugugugcccaauggggcagugagaggugaccugcugacaucccucaagugacagagucaauucaugucuccaaagagagaaaagcauaucccuccuccaagagaaaauacagagaaaaaaauggcucuuuaaaaaauaugugcauguuucauaaaaucauuguccucuaaugcuggaagugccuuuagaguuuuaucuaguccuagugaaguucaaaccuggcugaucaucagaagcaacauacauucccaggcccugccccagagccucggauauaggggugugcgugcacacauggccuugugugaauaugcauguguguaaacaugcgcguguguguguguguguguguguguguaaagcucccugggugauuggcuaugugccagucaugguauggaugcugccaugagugcucugggaagggugacuacgugccuggccaggaggcagggagggcuucccugauggggacagccaagguggggacaauucuuccuccuucuugcugcucauuagcagccuguccucgugccagugugcucacugggcagccucuugccugggugaaaacaaacaccguccuggcugcugcugccccucacacaggaccucgauguccugugucccucucugucacgugugucccagugcgugugcaugcauuccucccauauggcucagcuaaccugcagugguguggugcuugugugagucauccuucuuuaucuguucuuccugguccaaguggcuuccuuuccagagcuacaagccauuuuugcuccaguucugcaaggcagaugugcuaacuaguuuguaaauccacuuacgugcagcucuccugaaaugauuuugcccucgcccuuguccugggccuaaugcuugguagcaggaaggcuguuuuuccacucggugaucccuugguuugugguguuuccuuucuccagcagguacaacugaacaaccuucaaggugugugacaccccacauuaguuuauaaccaaaguuggugacucaugucauagccuuugcagauuuugagauuuuuuaaaacuauuuuuaaaugcucauggacauucuucauuuaccaguuauugguaaaugaagacccagugacuggagaugcugcuguauucagucauauaaauaaauaaggaggccgggcacgguggcuuacgccuguaaucccagcacuuugggagucggaggcggguggaucacaaagucaggaguucaaggccagucuggccaacauauugaaaccccgucucuacuaaaaauacaaaaauuagccaggcaugguggcaggcaccuguaaucccagcuacucaggaggcugaggcaggagaaucgcuugaacccaggagguggagguugcagugagccaagaucgugccacugcacuccagccuaggcgacagagugagacucugucucaaauaaauaaauaaauaaauaaauaaauaaauaaauaaauaaggagcagaaagcucgcuggaaaugccaagcgccuuaacccguagagcuucccugccauccuugagccucgggcccucugaacgggccagcgcggccuggguuuggaggcacagaacgcugcucuguauucugacacugugaauaaugaaaacccuuguguggaugcagggagugggggacggucaaacuugcugagcuuacuugcaggaaaaaggcuugugguuuuuuucuuccuaagaauaguaucuggcuuguuccuuuucacaaaggaaaauguuugaaguauggguauuugcagccggagcuucucagugccaguugcucgugggcagugccaugcugaggaacggggacaggaagcgggcucacccggaggagaagccggacucagcacggcggccuuggccacuaacucaugacauugaccucacgccaccugcaguuucauguuccaccgcugaacuuguuucugcuuaaauggacagaugcuuaccugaguuuuucuuuuuggaguguuuauauuuuccaaaagugcuuuuauuuugguuuauuaaccuuucucuugauccaguuuuccuuuuucacaccaacuguuccaaagcucuguagucugcauuauguguguuuuuuuguuugauccuguugacaacuacacaguugggcauuuuuguccucauuucccaccugagggaacggaagcucagaaaggugaaguuauguccccgaggcuucacagccuguaagcugcaaaguauacguucaaaccucggucagugugacaccucaguccagaaagcagucaccugaaaucgggagugaacagcagcuacaguaccuccucccuguguccuuguuuucugcacugaucuguuaaucuauuuauuccauaaaagucuccauccacagaaacccuacaaaguuuagguuuaucaagcugacacuuugaaaacaugcaaaggguaaguuuucagaugucagcuaagagaugucaagucugaguuggguuguggaguauguuuauuuauagaacaccauaauuaaccaggauucauggcccauccagauaaagcaagugcgccguuuuaaucaaacucgaagugucauaaaggugacauuuuaauaauaugaaaaguagauagauacucuucccaaagagcucuugaaguuuauuucccuucuuuuucuguuuguauauuuuuuucacaucucuguauuuaaggaacagggaaacuuuagaguggguuuuugguuagccucaaagaucacuucuuacaaucucaguagacauccuucuuggaagacggcucacacucugagaugccaaucaggguucauuucaugauucuuuaaaggaagcuguuuugggaaagcccaaaaaaggguuuggaacaugucauuuacuuuuauucagcuauaauuaaaauagccaaauuaaagaaauuagacucauacaaaucccaaacaaugcaaguucacuaucagaccccacccuuuagaagcguauugcccaagaauaggaaaggcugucacccauuuggagaucuuugcucaacaaaaaugaggcaacauuugaggaagaaacaaguaaaacugagaaagaagaggagaggucagugauuuucaagguucacuguaguucuguggaauuuagcuuauucuuucaaauguagacucuucucagucacaugugaugugcacagccuggcuuucuugucuauaggcugggcacgguggcucacaccuguaaucccaacacuucaggaaaccaaggcgggcagaucacuugaggucaggaguucgagaccagccuggcuaacauggugaaaccccgucucuacuaaaugucaucaaaaugacaaaaugacaguuuuucucuaggcuaauaacucaaugagcagaaaggaaaguccucccuuuuaaauguauaugaauguauauguaguucacacuuacacucugacacagaucucauuguguccaaugaugugugugugugugugugugugugugucuccaagacugagacacauguacuaaagagugauacuggccacaucuacucugggcuuggaggguaacuucagcaagugcuggauacaaaaauuacaaaaaaaauuacaaaaaaauuacaaaaaauacaaaaauuagcugggcguggaggugggcgccuguaauccuggcuacucaggaggcugaggcaggagaaucacuugaacccaagaguuggagguugcagucaaccaggaucgugccacugcacuccagccugggcgacaaagcaagacuccauuucaaaaaaaaaaaaaaaaaauucuccuguaaagaaaugaggcauuuuuugugcaccaaauggauucaggcuaaagcgugugagaaucaugauauaauggaucaugaagauccugguauugccuaguccucggcagggcucuaaaaauaacucagucagcagcccugagcuacuguggaugugugugugucagugcuugagcccauaaauggaagccugucucuuugaagguugaccucagacaagugugcagcccccuccgguccccuuuaaggcugcacggaauuacacgugccauuggugccaguuuugaucugagcagaauaacaaacccuugcucaagucagcugcccuucucugccucucacagucucacacucuuguuaccccauggguucaucuuuugggucucaggcuuauuaacugaauuuuuuauauuaucauaaacccacuuuauaaacgugcugauacccuggcuuuaaauacucuaugcagguuuccagagcugggcuuccagccgcaggucuccagcagguugcguuaaguuugcagaugagcguggcacagugugucaccaugccuucccagcccgccuuccccaaacuacugccugauccucacauuccaugaagcuuuucauuccagcacuggucgcuuccagcauccagcacucgcugaaguuacccuccaagcccagaguagauguggccaguaucacucuuuaguacaugugucucagucuuggaggcacacacacacacacacaucauuggacacaaugagaucugugucagaguguacgugugaacuacauauacauucauauacauuuaaaaggaaggacuuuccuuucugcucauugaguuauuagccuagagaaaaauugucauuuugucauuuugauccauuugauuucccccagucauccccauuagaugccuuagggcuucugcaaguuuacacaaggcaaaggaugacuugaacaagauacgaauguucaaaagcccccaggggucaauguaaauuaaacacuuggaacccaaauucauuauauuacuauuuaaauagagagaguuuauuaauuauuugguaaggaguaaccagccgggagcccucucucucauuacuguaccuccagcuguuggucuuuggccauuaguugauaacaaguuaacauuugcuccucuuucuagugagcagagugcauucaaauacaugaccucuuuuauucucauaauaacucugugagaugaauguuguugucauuucuaauuuguggaugagcacgcugagguggagaugccaugccuggccccaaguugcucaguggguaggcaguggucacggggccugagccucaucuucaagcuccaggucuagucccccucuucucuuucguacuccuccucuucccaauuaguuuucucucauuauaaaggucagaagacccaaguguuuccaccuccuuccccagggacaaccaccaggucuggcccugggucuggcauguauuuggagacaccuuugacacauaauugcaggagugaucucuggaggcugacuguggauuuuagucauucaagcugucccgucuguuuaccagaagacuuuagaaaaugacaggaugccauccugccagcagcucgcagucuucacccgcauucccacguggugucccgacguuugugugccaucauuguguccguguuugauguguggggaaagggagaauaaaggacccuuccaaagccucucagugaauuaggcacgagcagaagucaaaccucagaucaaaguuuuccagacucauucuaugggacacaguucauuuugaauuccagauuuugaacaacuucaguaagauuauuaaugcauacccacagggcauacccacagggagucauuaguucuuuagggacaggaacgaggcacuuggaugcuagugccagcucuguaucuaccaacuagcuguaugaccuugagugagucacauggauguccuggaaccaggaauuaaaguagauauuggggggucacuuccagauucaguauuucaugaugcuaaggauuauaauuuaccuugugacuugaugaauuuuuuuuucuuuuuuugagauggauucuugcugugucacccaggcuggagugcaguggggcaaucucagcucacugugaccucugccucccggguucaagcuauucuccugcuucagccucccgaguagcugagacuauaggagcacaccaccacacccagcuaauuuuuguauuuuuaguagagacaggguuucaccacauuggccaggcuagucucaaacuccugaccuuaagugacccaccugccucagccucccaaagugcugggauuacaggcaugagccaucgugccuggccaacuugaugaacuucugaaagcaggucugugcacagaaguuggcccuggguuauuguuuagggcgcaccaggaagggcaggacgcggguggacaugcagaggcagcguaacaggagacuuccacaaaccucgcuaacagaacuuccuagaaguggaggcugggaccgagagcagcugcagugugagcaggucaccuaagggucaugacucagguggcaccaagcuggcggaaggaggagggaguugagaccuggcacaagaucagccccagguuuaucagggcugugaaggccuagugucggggccaccucggucaucagccagcaaacaccaugaggccugagacgagggaucaggugacacucagugggugaaggguguggcaggugcacaucagcugaguucagugcagguaaagcaggcccugggcaccagggaguguucaggaacagugugcccaaccucggggggugggcggcagggagugggugaggagucagccagaugagcgggaacuaagcccucccugagcuggggccuggcggcucagagguaccuuacuaguacguggugagggcucuugggaagcccuacagaggccuaggcagcugcuccagggcuaggccccagagcagggaaggggguggucucaauaagaagcccuuguguuugggagacugagcagcugugggggccuccugcuucccuugggguggcuccaggguggggugagccugagcacagaagagagagguauacauagguauacauagagaacauacucauaggcccaauccagaauuuccaggaagguggaggccaaggaaaugaugcaaggacagcuggugagcagcugguucucccugauggaacguggcagcuccuccaguccaagggugcucccucagcccuggcccuccccagcccacccacaccaagccaggcauucacugucggaggcaaaggaguugguaucuuaccacuugcucaucacagcgguuaaagcccaggauucuaaauaacggaucccaaacuucggguuucucaaguuaucucuaagaaucuuguaaaucauuucaauugucuucauuugaaaaauaaguacauaaacaaguuugcuggugacagaaagguuuagcgucaucucuccaagaccauccucucagcgguagccaggcugcacagugcaugcuucuguuaaacgacccuugugcagaugggaaguugacauugucugaccucagcaugucagaccuugcauuagguacuuagguuagcauccaaauccucacaaaauguuuuuggcuguguccagcauguguccacacacgggcccucagcugagcuauggaauguaucugcuuacccccuuuauuuaauuucaacuucuacaagauuacaguagaagucuguuuucuuuaauaggauuuuccguugcuacauagucauuuucuuuuuguaaucaccacucuguuuuucauccuuucuuauuuuaguuacuuacuugacuucacaauuacucugaaguucaagauauacaaaguagccgggcauggugguucaugccuguaaucccagcacuuugggaggccaagguggguggaucaccugaggucaggaguucgagaccagccuggccaacauggugaaaccccgucucuacuaaaaauacaaaaauuagccaggcgugguggugcacaccuguaaucccagcuacucgggaggcugaagcaggaaaaucgcuugaaccaggagguggagguugcagugagccaagaucacgcuguuccacuccagccugggcaacagagcgagauuccaucucaaaaauauauauauacaaagagaacuuuuguagugaacauuucuuaauauccugaaguuggaaaucaguagaagaguggaaauguugaggccagauucucgccccuccaaugacagccugcuggcuaccccaagccccagugaucaagguuucuggggcuucugggcuccucucccagggggaucuucugccauccagccugaucccaggcagcuggucuugugcagaaugacuuuaauuccaccuguagagaucucagagucuaaaccucccauaacagggggguuauggggauucucaucucaucguucacuggguacagauuuccauguugaucagccauugaugccagccuccaguuucauuuccuguugcucccaggcaccagccuggugaaacuuucuccuggguauucugguuaauugccagaacuaagagcucucccacccaggccccacccauaccacucacucccuacagacaccagaauugccacucagaggcacaacagaacaguagccguagaauuuccccaagucuggccacauuccggccacccuuggacagcuccacucccccuggacccuccccuccuccuguccuugggaccugguuuguguggguaccuguuauguguuaugauggaguuaagaugcaaucuuguuuguuccuucucugaugcaauucuaaaugacacuucccugccugaucuauaccccuccaggugcaugccuacaucaucagcuaccugaagaaggagaugccaaguguauuuggaaaggaaaacaagaagagagagcuuaucagcaggcuaccggaaaucuacauucagcuacagcgagaauaccagauuucugcaggggacuucccugaggucaaggcuaugcagguacugggagcccacuacaaugucacgggcagagggcagaggugcagugccacauugucuggcuguuugcuggagacaaaugagagucccaugguuuaggaucaaggacaacgcaucuuccuaauggugauccaugauaauaggcuaugaauaaagcagaaauugccugucuuccaaaaugcguaaacaaaggaaacacauggccaaagguaaaugaagcucccaugagaaagucaggugagcagcccucuuagacuguguccaaggaggcugguugauguugcggugacauuggaaucccagaacugugagggaaucacagcugggaguggccuucagggucaccuugggcggccuccuccagcccugcccugaccugccucacgccgugggauuaugugcucaggcagccuugcugcugcaggcucaagggcuccagcaggggcuguggggcucugcggacgcugcuggacugcgugggcacagggaggacugugcuuaaaggcuggugcugggcagccauuggccugcugucaaggccucucuugaguuguggcugggcagcuccagccaggcaacaaugggugcugcauucagccguccugcccugaccggcauaucuaccucucugcacugcuguuagacgagcguguccucacaagcgaggccacccaucuggcuucugggcugacaguccucacagagccaggcuggccgucuucuuaucugcugcaaggaccccucugcccugggggccacaguccucucuguaaagcaggagccacaaacucagaugccugcagccaccacccaguaacgcaaacaguggagcaggccaggcgaaagagaaacucugucacccucucuggcugccuuugguuuucccacguuugauagagaagaagguuccaagaaacaugugucagcaaggaagaaaaccaucccgaggugugcuaagaacaugucaggggucucauggcagggcagauuggacaaugcagaagccccgucuagcccaguggucacugccuugugggacuacagaccuggaaggcucaagagaagcuggaaaucuggauuuguaugucagaucaccugauuuucacauuuaggcucaaaaaaauacuauguaggacaaacaaagcccaccugcauaugggcugcacacagagaccaccaguuaccaucuuuugccuugagccacagagugacagcauugaagccagcauagauuaaaaacugcaagcagguacagcccgaggcaggaggagggaaaggugaaagcagagaggauacagggagaagggaaggucgggcagaagaggcaagggccagcaggugaugagaggggaacuuugauccuaagggguuuuuuaaugcaagcuuuauauaaauuauacacuaacucagagguggguuuuucuugcuguuuugaugacagcucuuuacaccuggauucagagugaaucagucuaauauauuugaucugacccaauaugcuuuagcuguauuuauuuuaaaauauauucagagggccgggugugauggcucaugccuguaaucucagcacuuugggaggcggaugcaggcagaucaccugaggucaggaguucaagaccagccuggccaacaugguaaaacccugucucuacuaaaaauacaaaaauuagccgggugugguggcuauaaucacagcuacuuuggaggcugaggcaggagaauuuguugaaccugggaggcagagguugcagugaacugagaucgcacugcuguacuccagccugggugacacaggcagaccccaucucaaaaaauaaauaaauauauacacacacacacacacacacacacacacacacacacacacacacacagagccugggcgcaguggcucacaccuguaaucccuacacuuugggaggccaaggcggacagaucacuugagcuuaggagucaagagaccagccugugcaacguagugaaaccccgucucugcagaaaauccaaaaaaauuggccaggugugguggugcaugucuguaguuccagcuacccgggaggcugagguaggaggauuacuugagcccuggaggugaagguugcagugagccaagaucgcaccacugcacuccagccaggacaacaguguaagaccccgucucaaaaaaauauauacacgcacacacaacagagaaaugucucuuuucuuccagcagugaaauggguauuccugugcucacaagcugaauuggguuuuucuggucaccaggugguauuggagggcuguuguggccuccaggagcagucucccugggcaacuuccccauucacaccccugguuaugcccuguaucccaugaccaaggaguaagacagcuguuuccuuguacccuucagauauuucagaagggaacuugguuucuugaccuaaaugaaaguuauaaagaaauacagagccugagcuguggcccaguuggggccucugugccucgcuggcuuccugaaguugcuacagugccuugccacagggagacgcugcucuugagcccuggggcuccacagaggccucccuugccaggccucuccugcugguccccugugagcccgauaauguagggagcaggcucugggaccagagcuacucaugacaaagcuagccugggcuggccaggucagaagacacccaggguccucugagcugggggaaggcaacaaggaaagcaugaucucaggagcagccauggcccacugagauggaggguacaaggagggccaagccuuugcugagaaucaccuggacucaggucuaugcccaguaccuuagcaccacggaaggugggugagcaagcaagugcaggauccagccagccacuccaagugcugacauaggagcaggcucugugcauggucugcagccagaccaggugugucaccccaaggggaacguggcagugcccaggcagggaugcccgcaaccccaaagccccagagggggugcuacagugugcuaauuagcucuuuuaguugugcaucauguuagcagcucagucacccucuugccccacucuggcccauggcuccgguccagcucgaccccaccacugcuucuguugaguggcacggcuacccugcaauggugagggcagagggccaguguuacagccuuucuggguaccugcguuuggugggucccaagcuuuuguccugcauccaagaagaauaaggucaugcugacaauugaagagugaugaggguggaggauuuuacugagcaacaaaacaacucucagugaagaggggaugggaagauuggguugucucuccugaagucaggucaucuccccaguguggcugagucugggguuuuuauaggcacaggauagaggagugcaugcugauugauuugugaguaugcaaaaaagguuaaaacaaaggcaccagucaaagguggacauaacaguguaaaaacaauuagggaaggguagguauauguaaaauaggugaagggugaggaucaaucaaagaaaagcagccaaauggaaagacagguucucaauccaguccauggauuugacuuguagcuuggccugcaggcuuuaaacugccuuuggcuugaagauaggguuucacuggagacccaccccuaucugccucagcauuuuucugccuccugcugcuaucacuguucuaggccccuggaauaaaucaacacaaaaaaaugaacaaaugaggcuggacauaguggcuuacgccuguaaucccagcacuuugggagucugaaaugggaggacugcuugaguccagggguuggagaacaaccugggcaacauagugggacccgauauccauuaaaauauuuuaaaauuagccaggugugguuggcucaugccuguguucccagccaguugagagggugaggugggaggauggcuuaagcccggaggucgaggcugcuaugagccaugaucacgccacugcacuccagccugggcgacagaggagacccugucaaaaaacagaaaaaaugaacaaauggggguaaaaauaauugacagcaaccccacuguaaggacacauguuucuuguuacaauaugagcacuguugugcuuccauguaauugaauuaucugaugucugauauuuaguaucucucucccacguaagucuguggcuccaugaggucagugacccaugcccuguucacugccauauccccagcaucuaggacguggugagugcucaauucacacaagccaagugaauuaguaaguuaguguaaggccauaucacagcaggcucucaggcccugacgcagccucgauucccacagggcuuauagaccagggguuccccgugccaaccccuagaagcugcaggaagaggccuccuugggaaguaggcugaggcccagucacaucaccccauuccuucggagaauccccaaggaacaaggcagccuggagccugucaggaaugcuuagugucaccugauacugcaagcuagcuugcugucaccggaagcuuugaggggcgcguguguggguuagggccugucccaucccugaggcuguuaaagucuaacauccucuguaacauaggccuugacagaggggggacauacgcuuagaagugaccacacugugaucuuugcacauaucagggucacgcagagagcucgcugaugccagcuuuagguuguuauucucccuguucucucauggagccagcuggucagagugacucuuagcuguagcagugagaggagaguguauucugaaggcccuucccugagcugggacaggcccugcaacccaccuguguggcugccugugcgugccuggcacgcucuggggagggaccgugacugacagcacaguguuaauacugcaggacaagaugagcacccgaagggccaccguuacugcugacucugcuccucugacuggaaggagaauuuggaccccucagcucaugaguuggcagcauuucaacagcagagggcagcagagucagccccaucugcucagacccucugguggauuugaaaacucuucugguuaauguuggcaauuaaugggcaagggacagccccaccagagacggggcugggaacugaccuuugccucuugagagggagcaauuccaggguccuggcuuaguggauacaacuguugaugggcaaauaccuuuaaguuccccaguguguauucaucccaauaagaacuguuuuggacucaccguggcagagggcagggaugaugaugguuuggugcugaugucaggagugacaugaugaugguuuaacuggugcccccgcaguccccggucaagccugggggggaccacagggaugagaauggaggguuuauuucuugccugccucccaggacaggaauaacugcugccuccuguccaccccugcaaauaugcggccacucccccugccaguuuuccagagcucugcagucggaauccacggccccugcaggcuggugggaaguuugggcaggcaucacccuccuuugucugcugggccagacacaggggcucugugugcgcucugagcgcaggcucauucuuaaggaaaugggguagguguucacgcacccggggaauccaaacucguugacccagcagcacugggauuuuugugggggacgccugcuccuccaccugcuuagcguucucuuuuccaucuccuuggcccauugagauguugguggcaggagcccgaagugcaggccgcauuguuuggugcugaugucaggagugacaugcuagugacugcguuugagagacccggccugcaguacccgcugcucugagcugagcaggggccacacgcuggguuugcaugguuugauggcugcugacuuuacuuccugagaauaugucagagucccuucccuagagaaaugucagcccguuuagcugauauuucucagcucuguccccccaccaacuaccacccaggaauccccuuccaaaugucagcccagaauuccugcccugccacccuagagaccaugauuuugauucucuauuggaaacaaccuguguguccagcuauaggggacaggguuaauuaagaauggcccagcucuacagucuaaguucaauauucuguaacuguuaagagaaagguuauguaaaaauuaauaccacagaaauauaugacauauuauuuguuaagagugugguauuguuucaguguguguguguguguguguguguguguguguguguguauguauguuaauggcuagaaaugcaugcccagauaugcuagcagagguuuuugccagaugaugagauuauaaauuauuuuaaauuuuuaguuuugcuuaccaguuuuuucuguuuuuuuuuuuuacaagaaagcaugauauuuaugauaacaccaaguuuuuuuuuuuuuuuccuagcagccugucacauugcuucuguccaaaacagcgaggucugacuuuuccuugcaaaucucccugccucaucuccagaaaauugcacaccugcauggccucucuuuggcccccucuagaacuguacauacagaaauacuucacauauaaaaccugccauaccuggaacauuucugcauuuauuuaauaaaacuacuguugaagacacuuuucaucagaucuuugaagccugucauguaaagcucuagguaacucucgcaguucagagccacagaaaguuugucucuugcaauaaacaaguguuuucucuccuuagacagugaggguccccaggggucccccugggcaacugagcucuucuccuuauacaggcgguaguuuuccuuaaccuuagccaucugaugugauuauucccuuccucucccuaacauauauauauacauauguauauauauacauacauauauauacacauacauauauauacacauacauauauauacacacauacauauauguauacacauacauauguauauauauauauaugggucuaaugaccaggcuggucuugaacuccugggcucaagcagucuucccaccuugaccucccaaagugcugggauuacaggugugagccacugagccuggccccucucucccuuuuaaugacuuggcuuuuuucuuucuaaugacuuuauagauuucauguuauccuuuucacuguguuaugucaaguccuuuuuuaaacaauuggaguauccuuccuccauuacaacauaagcucauuuaaagcaggaauuauggcuuuucauauuuauucuguauccccaagccccagaacaggggcuggugcagaguaaaugacaaauaaaaguuggucggguagguggauggauggaugaauuguuggcugaauggauggauggaggguugguugaauggauggaugguuaguuggaggauuaguuggacagguggguuguuggauggauggauggauggauggauggauggauggauggauggauggauggaguaaccaaggagaaccaagguaggaaggucaguuucuacggugccauccacagagccucuguggcauccuguagucugccccagccugguugggcagucacaguguuucccaggcccccucuagagccugugcuucugcugcucugucugcugacaggcugccucacucaacagguagagcuaagauauguccugaccuggccagugauacucaggcuuaccagcuacguuuauucccucgugcuccccagcccuacucccugcucuuacaaguuccagcuuuugcuuauuuguccauauuuuagaaaugacaguggauucaugaugauuauguuguauaugcaaggucuccguggcccugccucgauaccuuccugggguagcacaggugccccuggucaggccguacuugguggggcugguccuacgggguuccuguugaguagcgcccucagcucauucauaagagguuagagccacuaagaagcuguccuacacuacauuuuuuuacguguuccgaaaacaagguauuuaauuaguuguuuuauguaaacauaguccuucugucacagcucuguguuccagcacagagagcauuagucaagagccaggagacaggggcucugcuuugacucugccagacagccccucacagcucucuguaaaaugugguucuaaaugccugccccuccuuccucccaggauugcuaugaagaucggcugaaguguguagugaaaucccuugagaaauagaauacuaacucuagagcauuuuuaaaaaggcaggugaaagaagguuucucagaguccucggagguugcugucgcucaugcggccaccagcagagauuggcugccauaggaaaaacacuuguuucuuguuccaaaacaaccacuccuauaugugguacaucuggaugugggaagcucccaaagagugcacuccugaguagugggugggacgucugccuggggcagaauuagucucccuccaguggcccccaacuguuucccccugaagagaccacauguaacccauccugugguuuguccuucugcaggaacagcuugagaacuaugacuucaccaaauuccacucgcugaagcccaagcugaucgaggcaguggacaacaugcugagcaacaagaucucgccccucaugaaccucaucagccaggaggagacgagcacgcccacgcagcuggugcagggcggcgccuucgauggcaccaccgagggccccuucaaccagggcuacggggagggugccaaggagggcgccgacgaggaggagugggucguggccaaagacaagcccgucuacgacgagcucuucuacacucugucgcccaucaauggcaagauaucaggugucaacgccaagaaggagauggugaccuccaagcugcccaacagcguccugggcaagaucuggaagcuggccgacugcgacugcgacggcaugcuugaugaggaggaguucgcgcuggccaagcaccucaucaagaucaagcucgacggcuacgagcugcccagcagccugcccccccaccucgugccccccucgcacaggaagucccugcccaaggccgacugaggggugggcugcagaacggggugggaacugggggaccugggccucaggccugcuccaccacugacucaccgaaugaccuugggcaaggcacugcccucucugugccuugguuuccccaucuguagaauggggaggguggacacuggaaacuagaugacuucuuucaccuccaaaauucccuuaguuucuaugaaaauauuggggguagggggguggauuaggagauugaaggguugagaagaaagagaaauuguccaaagaguccucagaaccugccuggagaaaugcgcaugggggugggccugguaagucccaggaaccacaggaagugagcuaaggcucacccagagcagcugggucuccaggcugccugggcuuuuuguccucaugaacaacucuggagcagcugucugucccucagagggcaccuggaggcagcaaagauuaucuuauuuauuuuauuuuguuuucugcuauauuuagaguggcaaaaaaauagagcagaggguuucugcugucuccagacugucuaccaaagagaaggcgacagaugccuccuggguuuggaagggggaugcacuguggaucugccauccauucugcagucuccagcagagcaggcagucaggccccagcgugccuccaucccagugccccgaugaccaucuggucagcccucccaaccucccuuccagggggcuuaccagcaaagccauauucggcuaggaauuuggaauucacaaccuuuauuaaccccuggcaaaacuucccguuugcaugucaaaucacauugaagccugaaaauuagcuuuucuuacugguuuuuccaauaaguaauagcaaagcccacuuaucauacuuaaacuacaguaaagaaaagaggugguucucugcagugaucguuuaguguggcccucaaacauuaaauaucccgaggucuccuugguggguggcaggauuuaaauucaaucaaauccuguccuagugugugcagugucuucggcccuguggacacaggugaaugagggaccagcccugcccugggcuguugagaagagaucaguccacccagaguuagacauuguuuuuguagaaaacaggcauuuauuaugucuaggguuuuguguuuuuuuuuuuuccuuacaggauaaaagccuuuauacagaaacaaaauggaaccuuucauauaaaaccuuuucuuuaaaggcugugugguucguaucaugaaugcccaucacgaggcaggauucgggcacauaccuguacuucugcuccagagugugcgcuccccaaauccccugaguaaaccucucuggacugcugcucagacaccugcgucagguggaggugccucccccucugugggcaccagcuuggggagguaggugacuuuuccuugcaaaucucccugccucaucuccagaaaauugcauaccugcauggccucucugcauuauuuaugcaggaagagacacgaaacagcaauggccacaugguaugggggccugcuggcaccagaagugaaugaaaucagaaccgucccacugagucuuccaaaaggcacauaauuuuuuuuuucugucaccugccuuuggugacagggucaaaggcacagauugaagagaaaaucuugauuugggagaagcauuuauauccagaugccuacccuuacacucccuagcuuacuuucuacauaauuuaguuuuaagagcaggaaaugcauaacaugguuuuuagucuuaacaagcacuuaaauucauuagacgcauagaaaagaaccauuuauuauuuuauuauuuuuauuuuuauuuugagaggaagucucugucacccaggcuggagugcaguggcgcaaucucaguucacugcaaccuccgccucccagguucaagugauuccccugccucagccucccaaguagcugggacuacaggcacccgccaccacgcccggcuaauuuuuguauuuuaguagagaugggguuuuaccauguuggucaauauggucucgaucuccugaccucgugaucuacccaccucggccucccaaagugcuguaaccuaagcagacaguucugugaaugcgugaggaccaccugaagucugcagccacgguggaggucaccaaagggugaacugagagagaagagggaauucacuugcccaaagguuuacagaugcccaggcaaacugauuuuuccauccagaauuaucuuguucuuuaacucuccucaauugucauauauaaacaugaauuuauauacaugugugucacaugaguaugucguuuuaaaacaacguguacauauguaaguuuugucuggauacagaaagcugcuuuagagggcagcagguugaggucucugauuucuccguggaggaaaaccucucaggcacugugaucucccuaccucugcgcucucaggugggagaggcgucaggcagcggaguccuuucccugcuggcaccugguaauguucuuggagagaaaggaaaaaaaaaggaaaucauuuggccacuuuucuuaauauccucuuacaugcagucauucaucaagaaaaguugacuggaaaagaaaacacuagaaaauaugagggauggcgaccaagugaggacuuguaucuucccaggac

SEQ ID NO: 13354 - RNA, 3386 nt, Homo sapiens
cagggaacaacuagaacaaaggccuugagauguggcaguuuguggcaaauuguuuauuguggccagacuaaggauaugugguggagauuggcaggauaucagguaagagacagagcagggcuacacuguugaggcccucaugugaaaaaccaugguuucauagaaagcagccagugaggccuuuucuggacaugcaggggacuagcagcugaucucacacuuugcgcuguugacccuggggcccaaagaguaaaaucauguuaaauguuguuccuggguccacagauaaacaucugagguaacuuaaucuucaugacuaaaacuagauaugaggcccagguaaaaugauuauuuugauugcuuugcuaggaaagaaaucauugccauggguuaguacaaaaugcacaggggauuucccuuuucuaauuggagccuccuaaugugaguagcuuugaaagccauuucuuguauaaauacugcaucauaauauuucagacuugaaauggacagaguauaagagugcuuuggacugggugcaguggcucacaccaguaaucccagcacuuugggaggcuaaggcaggaggauugcuugaguccaggaguuugagaccagccugggcaacacagggagaccucaucuccacaaaaaauaaacaaaauuagccaggugugguggugcaugccuguaguccuagcuacucaggaggcugagguaggaggaucacuugagucucaaggagguuaaggcuguagugagcugagaucaugccccuuuuguugaugcacucuagccugggcaacagagugagaccgugccucaaaaaaaaaaaaaaaaaaaaaaaaaagaguguuuuggaagugaaagaucucuuuuacucaagucagccccaauuuuuuuuuuuuuuuuuuuugagacggagucucacucugucgcccaggcuggaguguaguggugcagcccuggcucacugcaacuucugaccuccugggucaagggauucuccugcuucaacccccugaguagcugggauuacaggcacccaccaccauacccagcugauuuuuguauuuuuaguagagacaggguuucacuguguuacccaggcuggucucaaacucuugaccucaagugaucugccugucucagccucccaaagugcugggaugacaggugugagccaccaugccgggccaagcucaaauguuuaaggaagaaaauauccaaguuuagaagaccaagugaccucuuaaaugcuuuguacugguuauaggugagaaugaaucauccuagugaaacugaagggacaucuucaaccaacaucugccauuugcuucuucuagauguuaacacaguuacuuuuuuugccucgauaguggcuaugcuagagaauuaugaucauugauccugauguuauaccuccucccaaacagaaaauaacauuuauguccaugaccuauugacauuucaacaaaucacuacgguuucaaaggcaaagggagcaucacuguuuacuugugaccuccagguaaguuuacccaagaugaaauuuggcuuuaugcuuuaaucaauacagucuuuccuacaucauuccuaccauuagaugggaagaaugacacugaugauccauacccaacagagacuccaaagauuauuuauuuauuuauuuuuuuccugagauggagucuuguucugucgcccaggcuagaguguaguggcacgaucucggcucacugcaaccccugccucucgggcucaagugauucucuugccucagccuccuguguagcugggacuacaggugugcaccaccacguccggcuauuuuuuguauuuuuuuaaauuagagaugggguuucaccauguuggccaggcuagucucgaacuccugaccuuaggugaccuuggccucccaaagugcugggauuacaggcaugagccacugcacccggcccaaagagaauauuuaauuguauuagagaaauuucucuguuggugcauagugugaaguugaagcguuugcauucccugugcguggguuaaugagaaucuaauacuauuggcaagaggcagcuaaccgaggacaaaaacucucguccuggacaaaccauuguugggaaagcaagacuguaacaauaucaugaagauaauuauaagacauuaaauggagucuuguucuaaacagaucacugaggucuuugucauuagggacuuuucauuguucagaaaagauaucgcucuuuauuuuugccaauuuaucauucuuuuauucuucagaaucugccucaccccucucucuacucaacuuaccauuuuuuagcauuuauguucuacauugacacugcaucauuuuaugcuuaggaauacucuuuuccuugcucuuuaaaggcuuaaaagugggcuugaugucacuggcacauggucacccuuaacccagcaugcauugacagccaggagcaagaaacauuuaagagcaaaaaggagggaggaguuauauaggggaaggacugccccaggauuuucuccucugaauugugaauguccaugugauuugcuggugcuguggucuuuggcuggcaacccuucgggaggaaguguuccucagucacuuguuucuuagcgcaucuuagagaaugguguucugcucagcuuuccuggcaggaugacuguguuacagggaauuuucagaguaguagcaauuucaagguagacaaucucuaauuuaguuaucacucaguuagagagagucauuguauuuucauuugcucugcaugucuccucccagcacacagagaccggugaggagguguuacggauguguguggcaguaaaaaagaagcugcagcucuauuucuggaaggacagggaauuucaugaauugcagguaaguccacuguuccuugguccaugguugggugggagcugcugcaguggcucgguucuagugaaguucaggacuccagucuugucauucuacgcaaaugaauacucugguaugaagugcaugagagcuuguugaugccuacuuguaauaugauucuacaguguuuuuauagauugguuuauuucaaaguggguuuucaccuuuuccaaauguacuuuguccaguucauggacuuguauuuuuauuaaggguaguuuccuggccuugugccuguagaauugugcccgaugagggugaggguuguuuugcagaauggagguugcagaauaacaggaaagucaugauuuuuuaaaaaaauauuuauuucauucagauccuugcucucuuuuuucagggggacuuuagugugccagaugugcccaaguccauggcguggugugaaaauucuaucuguguggguuucaagagagacuacuaccuaauaaggguaaaaucuuauuau

SEQ ID NO: 13355 - RNA, 643 nt, Homo sapiens
cagacacaccccugcagcuggagccaaucacggugcuggggguuuaaaugucccugccacgcagacggagagucugggaauucacuaguuaaccggauagauuucaguccugcccgaagcugggagguguucaugcaauaaacauuuacugagggcaaaccguaugccaggcacugugcuggaugaacgcugaagaaaagaaagcgaauacagugcuuucccugcucuucaucgccuuucaauaugucuagacuaagauauagauauguaaacaaauuauaguggauagaauacagugcauagcacauagaaaauuugaggcgccuuuggcugauaaugaacaaagcguuuuauucuuaggggugucuggaaggguucccggaggaagugacuugagucaugaaggauaaguaggaguucccccggaaauccggcagagaaagagcuagaguuuuccaggcucuggggaacagcuuaugucgagaacagcauaacgccuucuggaaauuucuaguaguucauccuuguuagaggcuuagugcuaaucguacauccccgaguguagaggaaagaaagcuuuagaaggccaacaaucgcuagaucuuggaaggccuuggaauuuuagaccacuuuguacuagggg

SEQ ID NO: 13356 - RNA, 6422 nt, Homo sapiens
ugaaguggccuagcacuagcccagcgccguuaggcgcggacgccgggucccacggguuggcagcggccauggcucggacgcaccuuccgcgaaggcgccaagagugagcgggaucgcagggcgaacgcacggcgcggcucgaugacgucacagggcguucccgcccgggacuaagccggggagcgcaucccggcuacugcggguccugggucuucaccugcggagccuuacggcagcugagcggugggaggcgaguccggggcucccugaucuuccguaggcucccagaggcgccuggccuccgcagagcugcaaaggcggcagggcuugguggucgggcuguguguucuuccguuucuuccuugucgcucuugggucgggccccaggagccagggaucggcgggaguugagagcuggggcaggagccccagccgggaggccgaccggguggacugggcggugacagcagcgcuuccuucccgcagggaccugagccgcggcgcuaggaugggaaacagugcgcuccgcgcucauguggaaacggcgcagaaaacuggugucuuucagcuuaaggaccgagggcugaccgaggugagacugggagggacacgaccagggaacuuaaagggagagggacggcgggggcggcgaacuuagucggugcgggauuccccacgcugugaacuccuuucuccaguuccccgcagacuugcagaagcugacgagcaaucucaggaccaucgacuuguccaacaacaagaucgaaagccuaccgccuuugcugauaggaaaguucacucugcugaagagccucucccugaacaacaacaaacugaguauggcucucgccagggaggcuuuugcuagugaucagcuguuaccaggggugguuuucucuuacaagcugauuuuuguuuuuguuaugaaaccgugcaggagggcucaaguugcgaaugccggaauccuugaagccuucuuucuacuucuuguaauuacaucuaaaauaagccuuauaaugauuggguguuauaaugauuguuacuggguuaauuuggacuugaaagagaagaacauuuuggggauguaauguaaacaaagcuaccuaacuuggaaugggggauggaugagaaggggaggaucuuccaaauaucacaaaauugcugucggauugugccuugggccccuuuacaaaaggagcccauuauacacacaaaugcucuccggcauuuugauggcacccucaccuucuaaagacuauguugguaaaaugcaauaucuaaaaauggcacaugugggaguuuuacauauauuaacaagaggcgaagcaggcugccauauagucuuuauaaacuucaucaaaguuguuuucagcucuaucacauucagguuuuaaaaaaauuuuucuuugccagcuguucugccugaugagauaugcaaucugaaaaaacuagagacgcuaagccuaaacaacaaucaccuuagagagcugccgucuaccuuugggcaacucucugcccucaagacccugagccucucugggaaccaacugggagcauuaccuccccaacuuuguagccuacggcaccuggaugugauggaucucucuaagaaccagauucgaaguauaccugacucagugggagagcugcaagucaucgaacucaaccucaaccagaaucaggucuagagcuuuaagguuuuuuuuccuacagcauauguguggcuuuaaggucuccugauaccuguuaaccucuuguuuccuaaacugccaucauagagcuaaguaucagaggcuaaaugagagguuucuucuauaggcugaacuaauuucaaggcccaaagugccauggaauuaguugagacacuggauguguuaguuguguagguguuuuggggagggugggguagguaacagggagagaucauuucaaaaguuaaacuacugucucacaaaucuugaagacuucuucagauccuccucaaauauaugccccuaaccagcuagccaggagcuaugucagggauauaauguggaaaugaggccuaaacugagguucucagagucgggagucagagguaauucaguuuuguuuuucguuuugugugggguuuugacaucuuuguuacaaagugugucuccuuuugcugaagaauauuaagugauaggcuuucuggagauagcccauuucacuguuguacagcuuuaauuauaauauuugaaauuuguuuccauuacuuuggaagcuuucaauuaauauuugucuggaaaaccaauccaaagauucuugucuaggcaugaaggcacaagugaugaaauauuaaacacugugagacuggauggccuuuaguuuucuagugucuguauuucuagaucugcaugguccauuaaaguggccagaagcugcaugugguuauuacuuuucuagauuguagugauuuuacaucaugaugaaauucagucugucuuugaggaauuggccucauguuuuuuuaccuuaaguggauauucuuguauguuauagagcuucuugggggaaaaaaaaaacugaaucaauuaagcagcaaguauuaguugaggauuugcuccacauucaccucugccaguaccuuuauucagugguucucuaaguuuaguaugcaucagaauuaaccagaaaagcuuguuuaaagagaucacuagcccccuacccucaguguuucugauccaguagggcugggaugaggucugagaacuugcauugcuaguuauugaacuuauuaaaguucccaugauuucuaauaagugauggucugagaugauacugggcagaaucaaauaauuuggugacuuuuaguauuuaaauggcaaaaggggugagucaaagacaauugcuugguauugagcuugagggccuaaaggaacaguagugcuauugagaauggacaugcugaguugucuguggugaaucuuguaaauggaaauaucuuacugaaaguuggaaacgugggagcagaauagagguaagaguauagauacagaucuugaggucauaacaaaagugauggacuuuaaugaaugagcuuucuagaagaaguuuagagagaagaugacauaugaaguauuacagacagcuacuugaaaaaugcccauaaaaacaagagaaguaaggaagaauccaaaagauaggaagaaaaaccaaaaaaggacaaaaauaagggguuuuaaggaagggauagauaguacaguuaaaugcaguagggacugaggacaauggauccuugaauuugguaguaaaguggucaguaucuauguacacauaaaacauuggcaguaaauguaccaaaauguuuauggugguuauuucugggugguggauuccagguaaacuuuuuucuuuaaaccugugauucucaaauuuucuauaaugaacauacagugcuuuuaucaucagaaaauuuuguucccaaaaagccaugggugaccuucauaaaagcauuuuuuuuaagugggggcguaguaacagaagcuagauaacagaggcuucuggagugaguaggcagugagaaaauggaggugguaaaagaggggaaaacuagaacaaauagucaaguaaagauuuuuguuuuguuuuaauguacuaaaaguaaccaguauagugcuuaugcuuuuuccuguuauucuuuugugguuuuucaauagauaucucagaucucagugaagauaucuugcuguccacgccuuaaaauucuucgccuggaagagaauugucuugagcucagcaugcuuccccagagcauccucagugauucccagaucugucugcuugcuguggaaggcaaucuuuuugaaauaaagaaacuucgagaacuggaaggcuaugauaagguaugaauuaauguacuucugcauuucuagucacuaccccagagaagacaauggugaaguaauccacagaaauguuuauagcucaugucaacaggauuuguucuuccccauuuuggaaguagauucaaagcauuggcugaaugguauuguaccaagaugacuuuuucucuauagacagcuuauuguaaagcaucuuugucuucaucuuugucuuuugauauauauauauauauagugugugugugugugugugugugugugagacagggucucacucugucgcccaggcuggagugcaguggcgcaaucucagcucacuggcgcagccuucaccuccugggcucaagcgauucucaucccucagccccccuaguagcugggaucacagucgugugccaguaugccuugcuaacuuuugcagggaugggguuuugccuuguucgccaagcuggucucaaacuccugggcugaagugaucugcccgccgcagccucccaaggugcugggauuacagguguaagccaccacacccggcccuaugugcuuuauuuauuuauuuuuuuuggaggcaaggucucacucugucaccuggcuggagugcaguggcaggaucucagcucaagugauccucccaucucaaccuccugauuagcugagacuacaggcgcuaccaugccucauuuuucuauuuuugguagauugcucaggcuggucugaaacuccuaggcucaagcgauccaccuaccuuggccucccaaaguguugagauugcaagugugagccucugcaccuggccaaaacuauguaauucauuuugcauuuacagcaguuauauuuuguaggaaaugaaaaaccacaugcaauaaaaaccaaaaugaaaaaaaaaauaguuaggcuuauauuuauuuacucaugccaaaauaccccuuauguauucuuucauguuuuuuaguacauggagagguucacagccaccaagaagaaguuugcgugaaguucuccaggacuauggaaaccuuacaggauacugacuuagaaccucuguuggaauguggcugagucaaagccuccuguuguuguuagggguaucuacaguaaggagaugauacuucaggagauuauauuucacucaaugaucuuuucucauuucagggcucuucucaaauaagcuaaaagaaaaaggaucaggagacaggaaaagucuuccguuuugagucaugaguagggcaauagacaagguucucuucaaaaccaucauuaguuuggcuuuaagaaaccaguagcuagcugcuauuuauauggugagggggugcugccugguaacagaauagcuccacaccacagcuugagauuuuguuuaguuucacugugugagcuuucauaaagucuguugccauuccaucucuguguuaacacuucauauuuuuaugaaauucagauaauuugugagaggcuggcauggaucuaaggauuuauuauuuuuauucuaguccaucaguucagucgcaguuuuuauacuaggacuuuaggauguacauaaaugugugacuguuugucuugauuaaaagugcacuuuggccugggcaugguggcucaugccuauaaucccagcacuuugggaggccaaggcggguggcucacuugaggcuaggaguucaagacuagcguggccaacaugaggaaacccugucucuacuaaaaauacaaaaauuagcuggguguguuggugcaugcuuauaaucccagcuacuugggaggcugaggcaggagaaucgcuugaacccaggagguggagguugcagugagccgagauuaugccacuguacuccagcgugggugacagagugagacucugucucaaauuaaaaaaauaaaaaauaauuuuuuuuuuuuaaaguacgcuuuguuggcugggcacggcgacucacgccuguaaucccagcacauugggaggccaaggcaggcagaucacgagguuaggaguucgagaccagccuggccaacauggugaaacccugucucuacugaaaauacaaaaauuagcugggcguggugguggguaccuguaaucccagcuacuugggaggcugaggcaggagaauugcuugaacccaggaggcagagguugcagugagccgagaucaugccauugcacuccgacucugggcaacagagcaagacucugucucgggggaaacaaaaaaaaagugugcuuugucaagagaagcaccagcagaccucuaagaacugcucucuaaggcugcgguagcaaauuaucuacuauugcaggugccuuauugguagagggcucugaagagccaaaacuguauaugcaacacuuguaagauaaaagggacuuuaauaaucaagauuuucuugaagauuuguuagaaauaaugucuuauuucugguaaccuuucccuuuuuguauuuauaacucuacuaaccaaauuaccuaucaauaaaccauuacuauaauauuuuaaaacaaccuauguuuaucaagcuuacucucugagugacagaauauacuaaauaaagaauuuuuuaaugaac

SEQ ID NO: 13357 - RNA, 3826 nt, Homo sapiens
cuggcuagaguucuaccaugcggaccacagaccaccaccacagcacggcaagccucccuaccuguugcuaggacgagagcugguugaaugaugucaauaguuucagaacagaauuucucuaagucuaccgcucugccuggaucucgaaaccugcucaggugaaugucggauaucugccgaaaacagguauugaacagagagaucugagccaggaagaggcagcauggggaggggcggcucagcggcucucucgggcagaaggaaaaggcaaagaggcaaugcauaacgaaccccccagguaaggacagggccagcacuagacagagccucgaguuacaaucugacugagguccccagccuggagcguggggcccaacacccgcaagggucccaccgcacggugcccgaucugcaccugccucccggcccggcuucccgccgcgucaccugcaggccccagaagauguugcugucuccgggcccuggcgcagggugcggccuccuggggggcgcggggcgcggcagcggcgagggcuggcccgccaggccguagugcuccaagagcauggccaccagcgcugcggccgccaaccccgcgaccacccugagagccagcacugcagccaugccgcccgcccgccggggcgcggcccucgcugaucccgcgcaggaccgcgcggcgcucccgggagccgcuuugccugcacuuccggacucuauugucgcagggccagagcuggaugcggggccggcgccggaugcggggcuggagccagacacugggccuagggugcugcgcccgucagccgccgcccagcaccugccccucucuggccgcgcaagugacugggcucguuuugcauaaguaauacgaucacagaaaagagaaccgaaacucugaacaccaaugacgguggccgagugguggcggggaaggagaccgggaccaguggccgggaggcgggggcuagaguccuggcuccgccuuggucagucacuccugaccucagugggucgaucuccuuaccuguaaaacggaguuaauaacaccuuccgugcgcacuuugcaggguuguuguaucaaagugagaauguaugagaacgccuuuuaaauugucucacaaaugugucagguggcuuccucuggccccuucugauuauuaacguaccuccauagguuuucuuuucuuucucuuccccuucccucuaccauuccccuuuccuucacuucucagacagggucucuaucccccaggcaggaaugcaguggcgcgaucauggcucacugcagccucgaccucccugaccuuaaguagcuggaauuacaggcucgcaccaccacgcccagcuaauuuuuuaaauauaguuuuuguagagacugggaucugucuguguugcccgggcuggccucggaacuccuagguucaagcgauccucccgccuccgccucccaaagugcugggacuacaggcugagccaccgcgcccggcagcauagguuuucuauagauguaauuccuauguuuugugaaaguuauuuuucccuuaaacugauuucacaugcaccugaguaaauaauauugcaacacgguaguauaccauucauuuaauaaguauuaaauacuuccuaugggccagacccaggagaauuagauucagcccuaccuuaauuuaucuaacaacucccuuauuguugauuuuuuaauuguuuauuauauauugcuguucugaguaauuuuuuucacgucuucccuuuauugaaaaaaauuuuagaaaauggcaguuaauaaaaggcacaaacaaaucaacagggauauacuaguggaaaacacaauauaaaacuaacaugucauuggcuucuuuaauugguuaagagcacaaaauguaacaggcaaaaggucuguuucaaacaaauuaaaaagcuauguguuuuuuaaauucuccccaaaucagauauauacacacccacaaaaauagugugugaaggaaaacugucauacacaagaagucguauccugaauucuucaaggaaauacauguggaaauaggaauuaacagagucagcaacagauuaauuuuuuauuaauugagucuuaaaaugcuacauagcccaaagcuauacuauauaaaguacuacuagguacaaaggaaagucuguacagcuuuuagcaaaacugcuuucccagaaaagcaaauuaaaauaaugcaaucagcagacccaggagacuacagcuagacaucagagcuacaacuucucauaucucucucagaaaauccuauuuauccagaacagacuaaaauuucaggacaaaacagggauuuuuaaacuuuuuuuacuuuauccauuuuaaauucuuuuuaucucccccaccccacaaaccaguaauucagcaagauccaacagaaagagggcuacuuuuagaauuggcuauuuuauuuuucuuuuuuuuuuuuuuuuuuuuugagacggagucucgcucugucgcccaggcuggagcgcaguggcacgaucucgacucacugcaagcuccaccucccagguucaggccauucuccugccucagccuccccaguagcugggacuauaggcacgugccaccauaccuggauaauuuuuuguauuuuuuaguagagacgggguuucaccguguuagccaggauggucuugaucuccugaccuugugaucugcccgccucggccucccaaagugcugggauuauaggcgugaacuaccgcacccggccuuauuuuucuuucuacggcgagacugucauggagcuuggauauuucaggcucaugugcauccaugaccagugucccacuguggucaaaaaacuuagcaauggacuuggugaauucggcuucccgcugcugcuuuguucucccacugaugaaggucagcuuagagguguauuugucaucaaaccuuuuaagacuggaggacaguugccaaauaucaucaggauccauuccuauaggaucuuuccugugggccacaagaaagaugcuccucuccuuauaugagguauaaauggucaaaauccccaucaucauaaaauaggauaugacgcacaaagccaaaauggguuuggacuauggaaaggggugcauauaaucccaaaucaaagccacuauggcaaagaaacaggagauuguacagaugguaaggcgaccaucaaugagaccaaaauucuccacauauuuguauuuuuccagaaguaacuuuuuggcagaaucauccaaagaguuuuucacagcuaauccaucccacuugucaauuuuuacaggcuuaucaucugucuuccacuuauccaacaagcugcuauggccacugccugugccgcaccuggaaccaccgccagccccacuacugccuccacuaccacugguucucccacccugaucagcugcuugcugcugccaucuuauccgcuucugccuguucugaguaaauguauacacguguguguguguguauauauauauauauauauauauguuguuuuuuuuuuuuuuuuuuuuuuuuuugagacagagucucgcucugccacccaggccagagugcaguggcgccaucucugcucacugcaagcuccaccucccggguucaugccauucuccugccucagccuccugaguagcugggacuacaggcacccgccaccaugcccggcuaauuuuuuguauuuuuaguagagacggguuuucaccauguuagccaggauggucucaaucuccugaccucgugauccacccgccuuggccucccaaagugcugggauuacaggcauaagccacugcgccuggcugagugaauauuuuuaca

SEQ ID NO: 13358 - RNA, 23011 nt, Homo sapiens
gacguaguagccucggugaaugagcggugcgcggcgcgccgcgcccggaaccagcaacgcggcaaagggguccugcacguacccgcgcgcggccagggaacgcuugcugagggcgcugcugucguugguguucuguaccgcgccugcccgacgcucacggcuccgggggcccauggccagaagagacucaggaauggcagucugucacgguugugagccgccccuugguuagcacacaccucacggaccucgguagggggaaaaaaaccacccaugcuccuggacuuccccuuccgccggcacuugugcgucacuuccgggaagagcgcaucucgccaaccagaauugaggaggguguagccagugcuaaguucgcuugcggcugaccuuucuuuggaaugucgugaguuccauuugucccagaauacgguccgcuaccgcugugacaugaguguuagggaaggcggguugucacguuucuacaagccuuccagucaaaagggaaaccuugccuaaguccuuguaguugagaaaucucuaagaggugagucuguggggacugacgacuuggcuuccuuggaccgccaaggaagggucugguaggagccaagaagggucggcaccacggaccuucaguaggcaaggauuaguuagcuuccuugggugcuaauaguugcugauuuauuuaaugcucucacaguugcaaaagagaaccccauuuaaaacuugaaaacaagucacuaaggccagggugcaaacugaagaaaccgaccuuuacaaauaauuuauagacaccuaacaagaagacguuuccccacagauaguagacuguugauucccuuguauucccagcccuauguuagacugacggugaauaaaccacucagccucucuuucucaucacaccgccuuggagaauucuguggauuuuaaaguaguguugaauauguccccagaaaggggagucacugaagagaggugauuguucccugugauauguucugagcuuuguuuuuaaggaguaaauccagguuagacuucagaauaaucauaaaguuucuaaauugggugucugggagucauccauaggaaaccacuuccagagacauuuaggaaauuuaucauuuguucacugggauuuggugacugacuggcugaaauagaaaaggaaaucagauaacuuuaugguuaacuacaggugguacugcauaaugguuaagagugugaguuuuggaguccagcagauuuggauacuggagucaagaaaaaguuucguauuuuccaauguuuucuuguggaacaaaaugaaauaagaaagaaaagguuuggaucaggauaaagauucgguaauugaaaagugacauuuagauuugguguuuaaaagcucauuaauggccuuagggagagcaguuucuguggagcaauaagggcagaauccauguuucagugaauaggaggugaguuaaaggagguauccagucuaaauuauuauacuuucgaggagcuuaacucagaaggaaaaaagggucagggcaguggcuaaagaauauugugggauaaaagagucuuuuguuuuguuuucagguggaagcaaauacugcacaugcguguugguccugugagggaaaccagcuaguggagagggagagguugaaggaacagaaaaaugagaagacaacucacugguagaguaacuuggaauagauagaaaugggauccugggcacguauuaguuguggggauaggagaaugaauccuuuaucugugacuccugaugggguaaaaaaaagauuauggauaaucauaagcucaggugugagguagggcagagagaaaaagaaggaauuugcaccugauggcuucuguuuucucuguaaaguuggugacagaguugucaguuuaguguaaggcauucagaucugauggaacauuugagcaguuugagaauugcuucugaagggauuagaagaagggcucaccuaugccugcugggucaguggauccucaccucuaaaaugagauuaaguacugcuucgugagguaucucaggguugauugaggggcaaauagaaaaaaaaaaaaaguugaaggacuuugaaaaauacguagcaccauagaaacaaauuuauuuaaugacagguuccuaaaauguagguguuaugucaaaaauacuacuuguuuugcaaagaccagaucaagaaaaguaauuaaagaagaaagagaauggaguaaaauuucugauuucgaugccuuaugauuuaggccgggggaggaggggccauuguuuaaaucucaguuuauucuuauauaaaauggggauaauaauaucucagggguuguugugaggauuuaaacaaaauaacuaucuaagacaccacagugccuggcucaugguaagugcauaauaaacaguaacaaauuuuuuuuuauucugaguucccuuuugggggaguaggugggagcaugaaaaaaguucccugggagacaggauacuugcuucuggcccugcucuaauauugaugaaguauuacuaacguggaucuuaucccaguguuuguugccuuccgucccagagcaaaaccaguccagaaaaguuaaauuugucauggcaugcuguuguugguauccauguuuuaggcaaggaacaacaauuuuuuuuaauguguaaagauuaugauugcuuaguugcuuuuuaauuuccauagguuaacauuguagccagugggucaguaaauuuacucacagcuaguuaaaggucagucuggaggaugguuugaauggggcacaaauuaaggucaggauccuggaguaaaauugaaaaucuggccgggcgcaguggcucgcuccuguaaucccagcucaggcugguggaucacuugagcccaggaguuugagaccagccugggcaacauggugagaccccgucucuacaaaaaaaauuuuauauaaaauuagaugggcauuguggugcaugccugugaucucugcugcuuaggaggcugaagugggaggaucgcuugagucuggaagcuugagacugcagcaagcugugaucgugacacugcacuccagccugggcaacaaaguaagauccugucucaaaagaaaaaaaaaaaaagguauguuuuuccauuuuaauuaaaucauuuauguuuuucgguagagauauuaaaugccauugauuaaauaguccaucuuuuucauuuuuuacuauuuauuaagcacuuacuauggcauuacuuugaaaugccauguuuaucucauacuaaguaggccuuucuauggauuucuauggcuauguuuaguccuauacaaacuacuuucuuuauuguacauuuuaauaucuugguaacuuauuuaaccccacucaguaucaauuuauugauuuucaauacaguaauauuucacaaaguuauuucaaggauuaaagauaacauuauuaaaagcgcuugucacauaccuguuagguuccaaauacauggaaacuguuauucuuaaacaucauccucauuaauacgugagaacccagagagucaagguggcuaguuugaaaaucacuaaauuucacuuggaauuuuaucuucacuuauaaaccacuuucagaagugaagggaaauuaugauugauuuaucaccuacagugugcuaggcacugugcuaaguguuagagugguggaauaauucaaaggaccuguccucaaggaacuuacagucuggugagagagaaagacaaguauaucagugauugagauaucagugugauuaaaugcugaguuaaaggcagugacuggcucaugugggaacauagaugaggggaauuuaaaauacuuuauuaaucgucacugcuacuuugcauuuuuaaucccauuuuuguaaauaaagaaacugaagccaugaaggugagugacuaaggccacacagcuucuaaccuguagagcugguaaaaggacaaaccuagguccaucuaaugccagcaccucuguucuucuuuuauauauuuuaaacaauucaaaauuuaaaauuuuauuuuuggccgggcaugguggcucaugccuguaauccuagcacuuugggaggcugaggcggguggaucacuugaggucaggaguucgagaccagccuggccaacauggugagacccugucucuauuaaaaauacaaaaauuggccaggugugguggcauguaccuguaaucccagcuacuugggaagcugaggcaggagaaucacuugaacccaggagauagaggcugcagugagcugagaccaugccaguguacuccagccugggugacagagggagacugucucaaaaaaauuauauauauauauauauauauauauauauauuuuauccaaaguaggccuuauaaaauuuugaauuuuugaagucguuguauagaaggugccaauaguuaaggaauauacucuacuaaaugucagguuuuaguacaccucuuauaagcuugaggucuuuuccuguuuccaguuuauguuguuuacuaaucguuuucccaccuuagacacacuuaaguuaguuuuagaggagcuuuugccuuuuaaagaaaaaauuaacaaaauccuguuucuuugcuuuuacaucugaaaauauuaacauuuguuaaaauaggugaagcugaacccagaucuacacauacagcuaaucuuaccaaaauguguggaaguaaagcaaucugaaggaaauucaguaccauacaauuuacugacugaaauacaucauauugcucauacuaagaauaagaguggagaagaaucauuuuuuuccugcuaaaaugauagaggcagaagagcaacagccuugcaagacagacuucuauucugaauugccaaaaguggugagaauucaacuacagaaaucuugagugguugcuaauuauaaugacuuugauguugcuucuuuucaucaaaguaaauuuuggcugggcgcaguggcucaugccugaaauucuggcgcuuugggaggccaaggcggguggauucaccugaggucaggaguuugagacuagacuggccaacauggcaaaaccccaucucuacuaaaaauacaaaaauucgcugggcuugguggcaugccuguagucccagcuacucaggaggcggaggcaggagaaucgcuugaacccaggaaucggagguuacagugagcugagaucgcaccaguguacuccagccugggugacagagggagacuccaucucaaaaaaagaaaaaguaaauuuuguaggcaaaauuuguaaacuuuauuauguagcuaaaucuaguaagcaguuugccuauugcaaacuaccaacauuaaguacuugguaagaugcuaugaaucuauuggauauuugauaaguuuuacugguuguaucucuuaggaacuucaugcccacuugaauggauccauuaguucucauaccaugaagaaauuaauagcccagaagccagaucuuaaaauccacgaucagaugacugugauugacaagggaaagaaaagaacuuuggaagaguaaguguggggagguuguggacauacuccuuuuuuucucuaucaguauuuugagauuguaaguaguauguaagaauucagauuuugguaaacagaaauaggguuggcaugugguguggagcauauaucuuaacauacaacauuuuuuuccagcuguuagacuguugacaguauuucuagugauuucuguuguuugugaaguuauauugggauauucuuucuuuucuuuuuuugagacaggaucucacuuuguugccuagacuggagugcaguggcgugaccacagaucacugcugccuugaccucuggggcucaagcaguccuccuaucuuagcaucccaaguagcugggaccacaggugcacgccaccaugacuggcuaauguuuuuuuaauuuuuuuagagaugggggucucccuauguugcccaggcuggucucaaacuccuggccucaagcuauccacucgccuuggcuucuuaaaguucugggauuacaggcaugagccauuauacccagcaugugauagucuuuagauuugaaaauauaggcauauugaauuuccccaugucagguguggguuggagaagggguacuauuauuucccacuuaaaaauaucaguaauguuuuauuuucuaucauuugauuaucuuuccagaucaauguaauuuuugaaacaucuauucuguaguucuuuguaaauauaaauauauauuuacuauuagccuaaaauuuaauucauucaguuagugaguuucuuugaugacuagauuauguuaaaacuuuucauucauguugcagauguuuccagauguuucaaacuauucaucagcuuacuaguagcccugaagauauucuaaugguaagacaugaaggaauuuuuagaaugguuuaaaaauuaugaaguaauuuccuuccauuauugcacauggccuuucauuuuugcucucauuaagagugaugaaaaauguuuucucuauuauggcaacucuucaaaaccuauguaagucauuugccuaagagcuaguacagaaaaacuguguuucuuguaaaagauaugaggaaagaaccaugaagagcaucuucuauaggauagaggaugauauggaagagaaaauuugguccuguuuuucauauauaacauacauauaugaaauauuagggcugggcgugguggcucacgccuguaaucccagcacucugggaggccgaggugggcggaucacaaggucaggaguuggagaccauccuggcuaacacggugaaacccugucucuacuaaaaauacaaaaaaaaaaaaaauuagccgggcaugguggcgggugccuguagucccagcuacucgggaggcugagguaggagaaugaugugaacccgggagguggagcuugcggagagccgagaucgcgccaccgcacuccagccugggcaacagagcgagacuccgucucaaaaaaaaaaaaaaaaaaaaagagaaguauuagaccacagauggggauauccuuaauaaggcauugucuguauuacauaggagacuuacuguauggguggacauuauagagaaggaagaaguucaagaagagcuuagagaguaagugauuaaucccuagggaaauugugcuuucccucugagggcacaaaggauaccacuguguucucuuaucugaagcuccaugauacuagagucugacauggaagauugucuucuguaucauugaucugacuaggauggcauuuuaaaauguucucuuucuaaauggagagaagcaaaauugugucagugaucuuaaccaguagaaaaaaaaugcaaagaaaguauaaccuguuucuggagagguaacuuuugacugaucaagcaaaaauuuuccucuuugguaaagacugaucuucaugauaagugguaaguaaauuaagcaccuuuuagaggagagguaacucuaauaguuucauucaacaaaaguugacugagugcccacaauguuccaggcacugugcuaaagucugagagagauugacacaguuucugccccugagaaauuuauaauuagguuggagagacagacccauaagcagauacugcaacauagugugguaagcucugcauuagacacacacauaaggauuuauagggaaccaaaagggcauucucuaagcagcgucucaaaagauaccauugaacauagcuaagaauauccaccacaggggcccuggucucacuuuguugaugaguguuauagagcaaaaugauuaaauugaaacuuugacaguuuaauacucuauggguauauuaauggcaugcuuguugcuacauucauuucaaaaugaaaguugaaaagcuuuauuaaaugaagugagaagauucugugcauuugaccuagugcuacuaggugguucagagggugacaauggggugccccauaugauaaaugaaacgucuaugaggauaaacuaagagauuguaaauguagaacugagugugagggagaucacuuaaaacucuagucaaggugaccuggguauaaucucaaagagaggauuggaguguggcugaaaaaaugauacuuguuauuacauguaccagacauuauucuuaggacuacuuucagaaguagguauuuuuauuguucccuuuuuguagaugaaaaaauaggcuuaaagagguuaaguguaacuugcuuaagaucacacacacagaguaaguggcaguacuaucugguugcagagcucaugcucuuucccauucaagcuuauacagucuuagagagguuugaguaaguaggaacuuaacuaauugugauguacuuugucuggaaaaagaauuugaauagauauucucaguccagcgcauaggagaggaaagcccaaagagcuguucucaguaccuaccgcacuaccugcugcacaucacagaaagggcuaaaucuggcaaacacagauguagaccccagggaaauguucuuggauguggguuagggaugguucuguaggcuucacuguggccuagauaaaucuuccucccuuuguucuugcuccauacuuguuaguuuuucauuguucauuugguuuuacagguaccuagccacucagaaagagggagccuuggauaguagucacugaaaaggacuacuauuucaaacccucacuucaaccguauuccucguugucaaacagcuuucugcauuagucucaugugagcugggguagcugagugugggucuguucuguucuggggcagugacaagauccagauuccucaaccuauuaauacaaaggugaggccacaauuucauggugucagugacagcaagagggaguuccuggaguagcagugccguggggccaaugccauucaugauggcauggaggcugcaguaucaugcuccuuggaggaggcagcagugguaucuugcuugguccuggaguuucaugugauuuagaaugcagauguauuaucuuuggcuguguauucucagaaucugggucuuuagaccucuugaugaaacugagcuacccauuccacuuacauuauaauaaguucauuuuugucuuuaguggaaaaagaaaaaagaagaggccuacaacuuggauugcuaugaauucaccaagguagugccauacuguuaggcacuguauguaugaacagccagccccucuugcuuugccaggacacugcacucacaugcuuguguguguguagucaaagcagauuaagauuaggauaccaacuguaaggacuaauuacggcaguuugucacagcuucgccaaccuagccuuuuuuucuucuagauuuuuuaggauugaaggcagaaaggaaaaacauccuucaggaaauccuucaggaacuuuuggauuauugagauuugcacuaaauuggauacaguuuuacucauauuuaucaccuacuuucuuugcccuaaguacuucucgagaaaauuuaacccugccagaauuuauugaaaaauguaacuuauuccuaaauaacuugaauaaaaaccuuaagccaugacuucaaauagcacaucaguaauaccuaaucauuuuagcuguuuauuucuguaugugcauuuccuagcagucuacacauacagaugguuccagcugguuuuaguuuugcaccauuucucuauuuuaucaaucugcuauuauaaauacuaggaaauaaauguuuaaaagggggaaaagaagcaaaggguguagcugaugugcagauugggauugaaugugggaaugaggggugaugggagugauuggaaauauugcagcccugcauagucuccaucagggaugugacaaaguggauaaucucuaccacgugagaaacuuccaacauuacuugcaaaucagauuuaaugaauaaaauaaagcuguagcacuuggcacauucauugggacccuuacccaaacauuaucaauauuguguacguuaucuuuauuaucaggucacaaaagaugucauaaaagaauuugcagaugacggcgucaaguaccuggaacuaaggagcacacccagaagagaaaaugcuacugguagaauuuauacuucucagcaaauguacuguccuuuuccuaugugcuuugaucacucacauguuugugagugggaauaugaagcacuaacuuuuauacuauuguguuguucuguauuucauugaaccuuuagucaacaguccaaguccucucucugauguacauuaaugauguucauuuuguuuguuuuagagacagggucuugcugucuugcccaggcuggagugcaguggugcaaacauagcucacuguaaccacaaacuccugggcccaacaaucaccucagccucuaaaagugcugggauuacaggugugagccaccgugcccauccugauguacauuauuaaugagugaguuauucuuaaguaaaaaguaguaaaauuccagucaggcauuaucuguuuaaggaaggaaacaaaggccugcagcaguuucuuuuguucuuccuuguuuaguuguuuucacucugagaaaaggauaccugcuccuuauguuugcauuguuacaagcagaggcugauucuugcuuccugcaucaugggcacuugugagacaaugccauugaguggaugcagaaucauguuuuaugguaguuacuaaaauguagguuauucauucgcuucucagggaauaguuucuuaggccaggagcaagcugugaugugguaaaaccucucuggauagagaugagaucuggcuaugaucuggaggaauuuccugagauccuccuucuauaagagcagcaucaggagacauuggggcccucuuagcaccuuguuuaugacccaaagagaccuaggucaucuuguuuccugauauauguagcucaguaaucauuuggggguaaaauuuuugaaacuuauuguaaaguauaaguguuuacauaagauaaggagaaggcucucaucuugcauuuuugaaccauagaaucaguuccacguuguacuggugagaguagugaaagggaaggagagaagagccaacucauagggcucuuucaauggaguuuuaaaagaaggauauuaaccuaaauaugcaacaguagaggaaugguuaaauaaaggcuaauggaauauuaggcaaccauuaaaaauacuggugaagacacuuuaaugacauggggaaauacucggacucauguuaaaugacugaacuggguacauauauaccuaguaguaucuucucuauuuaaaaauguguauaugggcagagugcaguggcucaugccuguaauuccagcgcuuugggaggcugaggcaggaggaucacuugacgccagaaguucgagaccagccugggcagcaucauaagaccccccccaccucuaugggcuccaagggcugcagugaaccaugaucgugccacugcccuccagccugagcaacagagagagaccuuaaaaaaggucucuugaaauaauacauaaaaauaaauguguauauguguacuuggaaaacaguaguuaucucuggguggugggguuauuuuuauuuauuuauuuuuuuugagacggagucuugcucgucacccagacuggagugcaguggugggaucuuggcccacugcaaccuccgccuccaagguucaagugauucuccugccucagccucccgaguagcagggauuauaggcacaugccaccacacuuggcucauuuucauauuuuuaguagagacaggauuucaccauguuggccaggguggucucgaacuccugaccucaggugaucggcccgccucggccuccgaaacugaugggauuacaggcaugagccaccacacccuauuuuuauuuuuauuuauaauuuuauauauuuuaccagagacuuuccaccaaacauaagcauuuuauaauccggguaaaaggguauuuuauuuuacccaauguagccuaaagaaaaagaaaaaaagguauuuuacaggagguugcucuggagagugcucuugcagauccccucagagagcagagcacucagacuuggaagaacaugccugguucccuggaugagaaacacuaagcccgagcaggauugaggggaaaggaauccaaguuaggacuuuuuuucuggacuaggaggagagaaaauaucccuuuuaaaaaaaaaaaaaaaaaaaaggacaaguguaguggcucauaccuguaaucccagcacuuugggaggccaaggcgggcgugucacuuucagcccaggaguuugagaccagcuugggcaacauagcaaaaccccgucucuacuaaauauccaaaaacuagcugggcguggugguaccuuccuguagucucagcuacucaggaggcugagguggcaggauggcuugagcucaggagacaaagguugcagugaggcaagaucaugccacugcacuccagccugggugacagccagacccugucucaaaaaaaaaaaaagccuuuauuuuuuuucauuucauuucucuaacacuucauuucccccuaauuuuauuaaaauauaauuugcauuuacuaaaauauacccauaagggccauguuuucacucaucuuuaacuaugcccuugucauagcauaaagugaaaauguaauuguucauauaggauugcugaaggugagggaugaaauaguugaugaucucuuuacauguauuuucuauguguccuuucuaggaaugacuaaaaagacuuauguggaaucuauacuugaagguauaaaacaguccaaacaagaaaacuuggacauugauguuagguaagaagauuguaccuuaguaguuaacauuuacaaaaccagaaugugaauuuuuacuguuuugaucauggguguaauggauuuuuuaaaauuaaucauucauugauuuauacaauagaaaaauaaaaucaaggacccuguuguuuaaagugagaacacaauucugaguuuauucauaaggcaauaaaauucugaguauuuuuacaugaguaaaguaugguguuccuuugccauuaagcuaaaaugaacuucuuacuguggccuacaaggucccacaugaucuggcugccucuguuacuucagcagcucaucuagaccacuccuccucccuuacacgugggccugcugucuguuccuaaaauaagcaaaaaagacuguuccccuucagcaccuuuguuuaguauuccccagaacacauuucuaccagauuccugcccagcuggcuggcuucuucucauuauucagaucucaauuggcuguuacuuccucagaggggccuuccuuuaccacucugucuaaagugcccuacuaauccucuagucacccaucuauuuccuuuauggcauuauuuguaacaagauuaggaauuaucuuguguuaguuuguauauaugcccacccacuaggguguaaguguagugaagccaaggaccuuguuuuuugauucaccacuacaucuuuaguacuuaccacaaaguagguacauaguaugggcucaguaaagcccuaaaugaagaaagaaaaaaagcuagcuguauaguuucaggcuauaagacucuaaaaauuaagcuuaaguaauaaccccaauaaaaaaccaagcagaagacaauagaaugcagagaagaagacauacaaagagcugguagacauauagaaauacagagaaaacuacuuaauucauuaaucauauauuacaauacuguuucaguaggcuaaaaaaaguaauagccaguguuuguaaguuacacacugcugguaagcauauguaauuaauaaaaccucuuuaaauccugcacugguacacagguaaggggggaaaaaccucucuaaagagcaauauaugucaagauuuauaaaaaaguuuuucccucugacacaguaauucugugcuagaaaugcaucccaggaaauagauugauuuaugcauaagauuccuuauuauaauguuauuuauaacaaaaauuagaaaauagcuuaaaauauccagcauucagaggauaauuacauuaugguaugcucauaugauuuauacuauuuucuaacauuauuuuaauggcaugggaaguugcuaagugaaaaaaaaagauacagcauuuuauauguaguugaucuaaauuuuguaaauaaauaaaugaacaaaugcuaaaggaauuuauuucgucaauaaauaguaaacucauaacugcuuuaaaaaauuauagggguucucuggguauucaagaaauauuaacaggccaagcacaguggcucaugccuguaaucccagaacuuugggaggccaacaugggcagaucaccugaggucaggaguuggagaccacccuggccaacaugaugaaacuccaucucuacuaaaaauacaaaaauuagccaggugugguggcaggcaccuguaaucucagcuacucagaaggcugaggcagaauugcuugaacccgggagguggagguugcagugagcugagaucgugccauuucacuccagccugggugacaagaaugaaauucugucucaaaaaaaaaaaaaaaagaaauauuaacagagauucucuggguauucaagucuuauagaauuccagcugauauuugaggaaugaacuuuuaucagauauuugauacauuuuagaaagagaauauuucuaauuuuguaacccccuaaugaaauaauggaucucacccuccuaagaacacaccaccaccaguuuacucuugccaaaaaauggaaccugaucugccucuggacuagacaggaaauguaagaaauaggacaacauguuaaaggcugggcauggugguucacgccuguaaucccagcacuuugggaggcugaggcgggcggaucaugaggucaggagaucgagaccaucuuggcuaacacggugaaacuccgucucuacuaaaaauacaaaaaauuagccgggcgugguggcacgugccuauaaccccagcuacucgggugacugaggcaggagaaucgcuuggacccgggaggcagagauuguagugagcccgagauugcaccauugcacuccagccugggcgacagagugagauuccaucucaaaaaaaaaaaaaaaaaauaggacaacauguuaacaacacaggauacaaucaacaaaauccagaccauggaaaacuuuguaggacaaacaacuugguuucuucaacaaauaaguuacaagaaaagcagggugggaggugggaggagaggaaagagugguuguagauuaagagaggcuuagaagauacauugacuuacacaaaguguggaccuuguuuggauccugaaucaaacaaacugaagaaacaaauacaggaacaaaaaaaccucgaaagacaacuguaaaucugaacagugacuggaugcuugaugcuauuuaggaauucaugucucaguccguaugacaaaguaaaaugucauguugucuagauucagucaggcuauacuuuuccuagugagauguauuacacguagucugccaucucugucuggcuguacucagaauugucuuuuucaucugugucauauuaguuuucaacucugucuuucuuacauuaaagguauuugauagcaguugacagaagagguggcccuuuaguagccaaggagacuguaaaacuugccgaggaguucuuccuuucuacugaggguacaguucuuggccuugaccucaguggagacccuacuguaaguuauuuuuccuacguacauuuuaauucuaaaagguagaaucagugggauaaggacuagcuucgggcaucuugcauugcauucuccagaguguccaacagacacuccauucuguggaugaaggccuguucugcccuggaugaccagaaugccuagagcagcucucauccaagguucugugaaacaauuaaguacccuaaaagaaaaaaaaagaguugccugacuauaugacuauuuucuccauucuucuaaagauggugcacaacuagucccagacuauaugcacuauaauguaauucauuacauacaauggauggaugucuuaggguauuagggcuuaacugucucauagauaguugagaaauguugacuugagcuucuugaaugucagauucaagcagaaaucuugauauucggggcuggauaauuuguuguggggcugccccaugcauuguaggauguuuagcagcauccuuggccucuacccacuagaugccaguagcacucucccagauaugacaaccaaaaaugucuccagacauugccaaguguccccuggggggcagaauugcuccugguugaaaacagcugaauaagagagucccaugaaauugauucuuauggcuuuguccaaaccuggaguauucugcccuucuuuuuauccaccuguuuaacggaaguguuuugaguaaucaugagaguuccugagucaagugagugaguucuccuuagcucuggauaucuagguguccuuccaggcauaaaauuuggugacuacuauauccagcuuagcugauugaccucaguuuacugauacuagacaagauucucgagggcaggaacugugccuuugccagcuuuguauucagugaaguggcucgcacauuguaggugcuuuauaaacaagaugugcaaaugaauuaaucuaccauuauuuuuuucugccauuauguuguuuauuggaauggaguacucaguuccucaguuuucccagaauucucaugcauccuuauuuuaacuuuuaucuuuaagguaggacaagcaaaagacuucuuggaaccucuuuuagaagcuaagaaagcaggucugaaguuagcauugcaucuuucagagguaaauaauauugucuuaggcuagaagggacagauuguaauagaaaauaauagggucauuuguaagugacuaggaauaaaccgggauuggaaaaacauuuuuuaaaaagggaaaguagaaauauuuuuacaucuaaauuuaaaaauacaugacuugcuucagucucuacuguuacuguuuuuauccuuuugugguuccugggaguggcuguugacucaaaugccagcugugucauuaaaagcaguuuaaugacgucuugcuagagaaaaugcaugaauuuccaacaucagucuugucauuggcaagcugacucuaagaaaagcaccaauuuaucucaccuguccucauaguagaagggaccugauuguaucacauccacuggcaguaaaggaagcagcucgucauuuuucaaagcccagcaaagagguccagugccccucaucagccccaagcucacuguuagcaugaacguaguaacagauaauugcugggaaguagucacuuucuuaagcacauccuuaugaggcaaaccccuuuugagggacuuugcugcaauuuuccccauuuuauaaauggauguauuuuuuaccucaguacuucuagcuauuuaauuauuucuuaaaugcagaaaauaauacuuagucuacuuaccucacaguuauuguauuaaagggguaauguauaaagguugaguaacaucaugauuuaaagauuagggaaaaaaaucagaaccccuugccaguacuuguaucuuucaugucuauaagcagaaggucaguaaucuaguggcaggacuuaaaaucuagaaucuauguuuccacacucuuaacucaaaagaccuuucauccacaggacauccuauggcugaccuaacugaugugugauagaaaccauuggucauuauaagggaauagcaugugugacagugaccaguuaucucuggccuugugugcaacaucagaacuuguucuuuaccuuaguuucuguugcuuuuaucauccaguccauuggauauaaaagauuucauuuaaaaauguucugagcauuuguguuuugggcuaucuaggagauaaagagcacagccagacauuuucauggugauugugguauguacauagccagccuugucagaaucaaacaugaugagcacacuaugugaggaaaguaacugggcccuggagucagauugaguuagguuucacgcuuaucucuaccauucacuagcucuaugaccuuggacaacuuuuuuuaaaaaaucccuuauauuuuuaacuauaagaguuauguauaccugaaaaaaauccaagugucaagaaggaaaauaauuaaaaauuaaaagcccaauuucuauuuguuuugcuccccagaguuaauacuauuaacaguuuuguguuuauaguuuuucagaacuuuuuauaauauauaugaacacaugucuauaacggaacacacauauacauauggaguugugaaguuuuauuuuuugaaaauuacuuaauuuuucucagcuuuaauuucuucaucuuaauacuuuuuaagauucuugugaggccuuaaaucauuugugugaaaaggcacaaaguagguucuuaauaaguguuuauuauuaucauugaaaugaaucuagaagaauauugaggaaagaaugagaagauaaaaggcaaagagcuaggaaggcagaaguaguucaguuuuccaaaaggucugcauuaaguacuacuuagaggggcaggguaccuagcuauagaaaaaaauacucuuaagaaccacugaaagaggccauugauccccuuuccuccccuuucuuuagauuccaaaccaaaaaaaagaaacacaaauacuccuggaucugcuuccugacagaaucgggcauggaacauuucucaacuccggugagggaggaucccuggaucugguggacuuugugaggcaacaucggauaccacuggguaaggcuuggaguuucaggucuuccagaugacucucugucucucccccaauccccagguugccuggggauuacagagaaguacuguucuaaaaguacgaaugucaucuagcuauuaaaagauggagugugugcuuucugagccuuauuuaaaacagaaagcuuuagcuuccauuagaauauaagcucuaugagagcagggccccugcuugucuuauucguuguuacauucuccaaugcuuggaacucaauaagaauuuuuuaaaggaauaaagggucaucuagaauuuuaaaaugacuuuaacaaaauugacauguguuaugaaaauauguaacauuauuuaaaaauuaaacauggaaaaucccaaguauauuuucacaugucuguugaucauuacacacuugauugucuauguguuuaugaagugccuacuuuguugucauugcugucgauagagcaguacacaaaacaggcaagauuucuuucccaagaaacucauauucuagcagagggaagacaguaaacaaauauacaagaaaguaucaguguucugugaagaaaauuaaacaggcugauauaguagugauuguauaaccacuuuugauuggaugguuaggaaaggccuuucuaaagaaggaaaaagugguuggcugcaaacuauuuuacagaaugaucaauuugcuauauuuaccaauuuauaaaaaugcuugugugaguauguuuuaacuauagaguuuucagcaauucauaaugggcuagauuugcuaaggaaaauuuuaaauauccacaaaaguggagagaaugggaaccacuggcauagugaucuuacuuggugugguggccuagcucugcucccaacagagggggcagcuuggguuugucauccguuaaacugagugagccuguguugaggcugccuuacucaagugagcagauaccaucaaucaagucaguaagguauuuuacucuggcuggggagccugguaauauuuccaggaaggaauuuguuaauaauaggagucacucuuuuuuuuggggggcgggggacggagucgcucugucacccaggcuggagugcaguggcgcgauagcucacugcaagcuccacauccuggguucacgacauucuccuuccccagccuccugaguagcugggacaacaggcgccugccaccacgcccagcuaauuuuuuuuuuuuuuuuuguauuuuuuuaguagagaugggguuucacuguguuagccaggauggucucgaucuccugaccucaucauccacccaccuuggccucccaaauugcugggauuacaggcgugagucaccaugcccggccaauaguaggagucauucuuaagauggacuuaacuuaccuagaagcagaaggaggugaauggaugauuaucuggguaaaagcguuuagggguucuuagaagccauggcaaagucucugcucauucuuagcucuuuauaaugcucucacaccuggugcuacaguuuucuuaccuuuguuuuggcuuccaccauuagaccaggagggauugcaguagcuuuucaaaaaacccuucugcuccuaucauugauaauucucugcuuuuuucaucaugacauuccucuuuccucucuauuuuggucaaagaaggagaagugcauggcuguaaaagggauauuaauuccuugccugguaccucuguugccauaaguugcaccacaugcuuccuguacaacuacaguaauugaacuacaaauuuucacacguaaggaaaggucgacuuuguaaacuaauaaacuacuuuaaauuagcaaaauuuggaaauauuucucgugucuacuuggugaacacugaaugaguucacuuauuugcuuuuaauaagagguuuuuuuccccuuuucaucuagaacucuguuugaccucaaacgucaaaagucagacaguuccaucuuaugaccagcaccauuucggauucugguacagcauugcccauccuucugugaucuguguaagguguuccgugugaaguauuuugcuccuuuuugcucccugaguugcauuaauucagauguucacuaucuagcugacugccuugcaugccugaggauaaugcccaaguagaggaguuagaagggaccgggguguggcugaguaugguggcgcacaccuguaaucccagcuacucgggagacuaaggcaggagaaucacuugaacccaggaggaggagguugcagugagcagagaucaugccauugcacuccaucuugggcaacaagagugaaacuccaucucacaaagcaaaaaaaaaaagggacugggacaugagaggcuacagagggccagggugacucugguuuggcucucuagcaaaagguacuugagaggacuuaaaaacaaacaaaaaaacugaugcucugcacccaucccaugagauucuguuuuauuugaucuggggugaguccugggcagagauaggcuuuaaaagcuccuuagguaauuuuaauauccagccagaguugaaacacugcucugguaucuuuucuuaaguauaaauaaaucuguuuaguuacagcuaugcauagauaaauuuguaggcccuuguuuagacucuugaaagaagcauaguaaauaggaaaauagacucuaaacaaaaagaugguuguuuuugaaaaauccuuccuuuuucauuuugaaacauucuuguuuacguuggcagacugaugauaaggguguuuuugcaacacaccuuucucaagaguaccagcuggcagcugaaacauuuaauuugacccagucucaggugugggaucugucuuaugaauccaucaacuacaucuuugcuucugacagcaccagaucugaacugaggaagaaauggaaucaccugaagcccagaguguuacauauuuaagcuauaaugaggugaacuacuucugaguauguguuucaaucaaguuccugccauaucccacuuaguaaaacaguccaccacuccuuugaagcauagcaaccaaguuccuugggcucuaucaccagcaccuuacacauggcagguacucaguaaauacgugucuucaacugacucacaagcucucaggugcuuacugggugggacuugacuguuguugcuaauuaaauccccauuccaccagugauuauugugacucagcaguccuucccuauuagugaucauaaaauuucagggaaaucgaaguuucucaucaggaaauguuuuggaauuacuaguauaaaguuaggaaaguggggaaauuagguuacugccgagaccuuuaagccuucuaaacagcuuuauauuuuauugugcauacuuuaaucagacucccuucacucgcuuuaaguuuuuaaaaguauuccccagccggaugugauggcucaugccuguaaucccagcacuuugggaagccaaagugggcagauugcuugauccuaggaguucaguagcagccuaggcaacauggagaaacccugucucuacaaaaacaaaaaaacaaaaaaccggaaauuagucaggcacggugguacacaccuguagucccagccaccagggaggcuaaggugggaggagaccugaucccagggauguuugaggcugcagugagcugugaugcuacagcacuccagccugggcaacagagugaaacccuguuucaagaaaaagaaaaguauucuccaagaucccaagaccauugacaccaggccacauuguauaccagggauuuaugugaaugccuagggaugaccguagugacagauaaagcuaggugcugagaucugguuuugcccucuuuaugauugucccaucgguacuagaaagugaagucauugcuccaauuuuggaagaggagagaauaacuggcugaggggugagaaagacagaaauagcugcagcucucuuuuuuuuuuuuuucaacaaaggcucucacucuguuccccaggcuggagugcagugacaugaucacagaucacugcagcuuucaguuuuaaaacagcuuuuauuacauuuucuuuguggaagcuguauuucuaccuuaguacucacuuucugcuuggucugaaagauaccucuaguaguggcaacauuguguuaaguagaguucauugggucucuuguaacccuaccccuacauaauggaccacuggugcaggcuuacauaaacacacauacuguggccacuucagcugaagacaagggacaaacuaagauaguucugaaagguaaaaaaacaaacaaacaaacaaaaaacaaaaacaaaauuauuagauaccaaguu

SEQ ID NO: 13359 - RNA, 6380 nt, Homo sapiens
aacccuggauuucuuaguuucuucugaguccuagaagaaggguuggaauagaauaauacauuuacaggauuuagguugguuuucuuucuguccagucucaucugaauuucgucugucucuugugguccagaaguuccacagagcaacgcagcugcauguggugacagguagagcaguuaaagcugccaauaggaacucguccauauuccacacaccugguauaguguuaugcccuccaugggcacuuaccugcaauaagcagaagccacugccacauucccguguauugggaaaauggacuacugugugcgaacaggcccuuuacccuaauggcagggaagauggauuaucuuuggccaguggagcugccaaucuagacauacacauucaacugaauacaauuaaaagcaguucuuuaaaugcaaauauaauuacucaucuuuauaauacaauaguauuaacugcccauaugcucauaguaugaugagcccuguauagcacaaggucaacagguccucuccuuguccuuacaaucuaaagcagaugacacugacauggacaaacaagugcacaugcauaguugcggcaguuuuagagaaaucuagaaagcuagguagcaacacuaugcauaaauguugugguccaaugcauuaguuugcuuuaacaaaaaucugggagguauuuuuucucuuuauucaggaaggcuucaugaagcaggaaguggucaaaggagggaagguuacugguuaaauuaugauaggaagaacuuuccauaacuaguugcaaaauugagugcuggguggguugaggaaugggaaaaagggggagcaagguguuuuguguagauggaacaaagggcaaaggauagacuguaaggaaggccagauaaagcuuggaguagcaugagaacuugaggaauaguaugauaugggcugugcagcaggcagagagaaucaccuuagcugaaacauggguguuaggagcagaccaugaggugguagaaccaucaucuauaguaaaucagguacuacgcuauaacuauugauaaggaaacagcugacugccacugaaagaauaagcaguuuuaggggacuagcuccuaugggagauaaaggucagaaaucguaguaucugaugaagauauuuugaugagcaggugagaagaaagauaaacauggccagauggccaaggacugggauaaguagccguuucacauucaauuagaauucuguggcuggaauaagaucagggagagcaguaggaagauauaguauucuauaauucauagcuuguuguguuagagauuaauuaggauucugcuguugaaucuuaguacaaaaaaaucuaauauuuauuaggaauuaagggaagaugguacuucuguuauguugccuaagcagacaggaagcuacaagaaacaccagucugaagcagugccucaggaucucagaugauuuaggaagugugcuguaaugucaaaaaaaaaaaaaaguauugucuuuaguauaucuauguauagucucgugggaaaagcauugguugugguaucaacagauauucugguuccagaugucuuguaaguuaaccugccuccauuucccuuucuguaaagcaaaauaauguuuacaccuaaucugucucucagggauaccauauuaauaaaaaucaugucuauaaagugccugguguuucuugaaguguuuauguguguguguguauauauauacacaaauuacgaucaaguuauggagggcaggaaaagaccaaucuuucuuuuuuuaacuccuuguguggguuuacuagaaguaugcuuaucugaaucuuuauauucuagaaagaggaauaagucagauugugguaaaagggaaauuagaaugcaaauccuuccuuuguaccucuauccauauccacaauaaauuaggacccaagauaacugggcaugcagagucuuauuuuuuaaauuuuuauuuauuuuuuagagauaggaucucacucuguugcccaggcuggagugcaguggugccaucauaggucacugcagcuucaaauuccugggcucaagugauccccagccuccccaauagaugagacuacaggcaugagccacuauacucagcuaauuuuuuaaaguuuuguauugaugaggggucuacguuguccaggcuggucuugaacucccagcuucaagugauccuccugccucagccccccaaagugcuaggauuacaggcaugagccacagugaccaacucagcugagucuuacuuuaaaagacccaaaacuggcuggguacaguggcuuaugccuguaaucccagcacuuugggaggccgaggcggguggaucaugaggucaggaguucgagaccagccuggccaagauggugaaaccuuaucucuucuaaaaaauacaaaaauuagccaggcgcgguggcaggcacccguaaucccugcuacucgggaggcugaggcaggagaaucacuugaacccaggaggcggagucugcagugagccgagaucaugccacggcacucuagccugggcaacagagcaagacuccgucucaaaaaaaaaaaaaaaaaacagacccagaaccaacccuccaaacuccagaugaaaagaaugugcaguacaugcugcccaaccugccauuccucaggauggaagcagcaaaaaauaccuucaaacauucugagaaagaaaccaagcccacuguugggggagcaacagcaucucugcaccucuaacuucuuaacaucuaaagccuuugugagacagaugggguggcaugugcagcaaaggaggcaaaaaauguguauuagcagaagcuggauaauccuguucacaucaguuguuuccuuagugccauuacuuuucuuuuuccccauacuaucacuuuuccuaaguuuguucucuauggccaaugcauagaauguaacauauguuuuugccauuucucauuuauuguaaucugaguguagacucugagucuugucaauguaguauagcacuauuuuacacuacuuuuuuuuuuuuuuuuuuugagacggagucucgcucugucacccaggcuggagugcaguggcacgaucucagcucacugcaagcuccauuucccagguucacgccauucugcugccucagccucccgaguagcugggacuacaggcacccgccaccaugcccggcuacuuuuuuguauuuuuaguagagacgggguuucaccguguuggugaggauggucgcuaucuccugaccucgugauccgccugccucggccucccaaagugcugggauuacaggcgugagccaccggguggcgcccagccuguauagcacuauuuuuacggugaccagguaagaaagggaagaugaguuaagauuguaaagauagaucaguucuuuccccauuauucaauucagaauccaaaaugaagacuuuacuccuauacacugaaauagcuauguaaugacaugcaugucucaaaauuuugacauauaaaauguuauguagaauucucugaaaccauggugcuuuaaguaccagguguguguguguguguauuuuuuaagagcuuaaauuauuccuuuccuaccgcacccaagacgguacucuuuuagaaacaaaacuuuggaacaacuagaagucagguuaaagacuagaaauagaaguccaauguaccuuagagcucaaaaaggcucuggagagcagaacuucgcugcggucaaaauaaaagaacauuaaaaaaaaaaaaaaacacauugauucccaggugacucaguucaacuuguauaacccaauagauaaaucagggaaguaauuuuaaagucuuccauaauuagugagcuccucaaauuauguaaguauaauuuaauauacaaauauuuuauugacaucuuucuuaaauauaguacagaaaccaaagacacucacaucauucuacacagugaggucuauauuccaauaacucaugcugugagucaccgagcaccugaauauuucuuaggccucacauaucucuggaugcccaaaguuggcauuugagaguuguuaacagauaaaugcagaagcaacacuuacagagacugggccaaauucuaaugaacuuaguggucuugauguggaacuaguguaggcaaaaugaagcugcauuccaggucagucccauaacacuucaccucuggguucauuugagguacagauaagacacaagcuauauauggucuuagcaacagagagaguggaaauagcagcuauguuggugaccagguaagguaagccugggauggggcuuugaagaugcaaaugguacgcauguacaggguuaccugguauuaacaguaggggacagguguauuuuccaaaacgcuagaucacugaaggaauccaggaaauaagguuucagagggucuauuccaaucuauauacacuguauaaaguuuuuuuaacuuuuaaucuugauauaauuucaaacuuacagaaaaaguuccaagaguacaaggaacuccuguauaccuggauucaccaacuauuuauauuuugcccauuugcuuuucauucucuauguaugugaauguguguguauauacacuuuuuuuuuuuuuugaaacagggucucacucugucgcccagacuggaguacaguggucugaucauggcucacuacagccuugacuuccugggcccaagccauccuccuaccucagcuuguugaguagcugggaacacuggcaugugccaccacaccuggcuaggauguuuuuuuuuuguagcaauggggucucccuauguucuccagucuguuuuguuguuuuuuugagacagacucacucuguugcccagacuggagugcagugguacaaucucagcucacugcagccucgaacucccaggcucaagugauccuuccacuucagucuccugaauagcugggacuacaggcaugggccaccacgcuuaguuuuuuaaaaaauauuuuuuugcagacgggguuucccuauguugcccagacuagucuggaacuccaggauccucuugccucagccucccaaagugcuaggauuacaggugugagccaugacaccuggcccauguguuuauuuuuuuuuaauucaauauuucaccauuaaaucugauguuagcuguaguuuuucauaaaugcucuuuaucagccaauccacauaaauuuuagaaccucaaacaaaaaaaacuuaugccaucccuacccucacuuaagacuagcaugacuuuuauagugugaaaagaauuucaugauaaggcuaauaaauuaaaaucauacacuucaauagcuuuuguauagauauuaaacaaaaaaaggacuauaaaacuuuauaaccauauuuucauugaauauauuaucaugaacacuuucagucauuaaaaucuguucugcaacauuuuuagugacugcaauagauccacauuuuaugaauaaacuuugauguuuuuacugugcaauuucuguaugaguagauaaggguagaaaauaauauaaugcuauauauaaugccacacaaagcuacacacacguaucuaagaacuucaaaaaccacagaacuucccucuccccuguuccuuaaaacaaagucugagcggaaaaaacaaacuuuuuuccucugcucucacaccacaauaaagacagaaaacuucucugaccaaauguguggaguuuuuuccccaccaucaagcaagcaaucaauuuugcagcagauaccagcuagguguccuccaguuucccaugcuauccccuagagauggcauuugaucccacagauugagggcccagucccacaagacugcugcccacuuccagugccaaguucaaaccccaggugguuuuaccugugcuucugaccaaaccuauaaaucaggguucccaugaccccuccuugaguuuaauuugcuaguaaagcucacagaacucagggaaacacuuagguucacugguuuauuauaaaggacaguacaaaggauagagaugaagaaauggauagagcaaggcaugugggaagggacagggagcuccuauacccucuacccucuucagguacagcacccucuagggaccuccauauguucaguuaccuggaaaugcuccaaaaucuguucuucuggaguuuuauggaggcuucauuaugaagguaugauuaccacuggucacuggugaucaacuuaaccuucagcccuucucccaagaguuugggggaggacugaaagucccaacucuaaucaugcauuugucuuuccagugaccagccccuaggggcugccagccagcagucaacucauuagauacaaaaagccaucacucuggagacucuaaggauuuuaggagcaguaugccaggaaacagggucaa

SEQ ID NO: 13360 - RNA, 39330 nt, Homo sapiens
ccccaggcaaaaaucacguccagaaucucgggucuuuguuuuccccgcguaguaguagccgcucagcaaggauuagggagcuaccugucggaaaaccucgcgcaaggagagaagcugguuuuggcuccaaagcgaggaccaugggggcuuggggagagucacauugggcaggagagacggaauccgaggagcaguaguaacgggcuuccugaggacgggcucgggugucggccagaggcuccaggugcugccgguucgcggacgcagagcucucagcccaaggagcagcggcugcgggauucuggccucuuuugucuccgcucccuccggccggguaacccggagccgucgugcggucccuccagaggccucugacccggcuaaggcgcccugagggcgcccuccagcccaccccugggagcgucucccucucgagcugccccucaacccccucgcauccuugccuccgggccagccucacccacucgggguccgacccugaccccggccccggccccggccccggccccggcucuccagccucccaaguacagcucccaaaccggaaguccgagcgggcggcucggggcaccgagggcgcaugcgcgagggcagcgaccgcgacucagucuccgcagagcccgggcgggaguagcugguggaccccguugagcugccgaacuuccgggacucccccgcgaccccuucccagcuucccguccgcuccgccgcagcgauugucucgguggguugauucggcacaaaccgcccgacccaggggccggugcgcguguggaaggggaagcacuccccucguggucgccuggaggugcgcuggaggagggggugacauaaccagggacucgagguccgccgugggaaugauccacgaacugcucuuggcucugagcggguacccuggguccauuuucaccuggaacaagcggaguggccugcagguacuguccggcgcagagcgcgggaaccagggagcgcaggaggggggaccugagccagcgccugggggaguaggcugagggaccuagcgagcggggcuuccagggcugggggcguaucccuggacaggugacuggagggcagccccuuagggucaaggcugaugcgacaccuagagaggccgggccuaggcuagaaaacggagggcagaccucgaagagccccaccuguggcggggcgaggaaagggccugagguccaggugucugacaguugcuggggaaugauauagaagugugggaggcacuuucuccuauuuauuuucacacgugcauuguuugaguuuugaaguacugggccaaauacacagcucccaaacacaugguaagcgcucaguaaaguuuguugaaggaaauaaaugaaaucgagagcgugugguguuucccucauuacuccuuuaccagaaaauuucugcacuagguaaagcacuugguagggggccuuuguguaaccaggaauguaugauguuccguaugcauuaucuuauuuaauccucacaaccaccuuauccauuuuacagauuaagcuagguuuagaauaguuaaauaacuaucggggucauagcuaguaauuaacagagcuuaguuuugaagccaggucugucuggcuucaguauuugaacuacuuuuaccugcuucugcuuccaguaauguuaucuaaugcucucaauaauuuaguccacuuagguauuguuucuaccaguuaacaaaugagcaaacugaagcucagaaaacuuuaugcuggccaguccuaguaguggcaagacugaaaucuagguccgucugaucaccaagacaugccgauucuuaggagacuguggaagagcagaaaaaguacauucuuagucuauaaaaccuauaaaucaaacaguuuccuuucguuauuauuuaugaacauguauuuggaguuugggaguuuaggugaauuuuugaaaaaaacaggugaagauuugugugguggaguuugaauuguuaucuuucaccuguaggucuuugaagacuaauucgauguuucacuuuucuccauagaucuuaguacaaugccaggcauauaggaggacaguauuuaggaaguaugugggugccugaugguccaaaauaagaagagauaacacaguacaggaaagauagcuagggagggggugggggagacaaccacaaguaauucaucuuuucccuuccuuucuuucuuaugaaaaauucucaaucauguauuuucuaccauuucauccucaaggucucagcuuuaaagucacuuugucagaaaaacuuucucugagcacaucuuuaagcauccuccccugaugccauuauucuccaucaacuuguuuauuucccuuguaggauuugucacaauucauaauguauuguuguuaccuguuuuuagccuuucucccgcauagauugccccugggagcgaagaccaguggucuucuucauucaucuacccagagcaccuagcacaguuucugccacauagcagguguuuagguauugauggaagaaaagaagacaaagauggcaaauauuacauaauuucugcagagcagugucuuuuacauuugaguaaagggaaaaguugucaugagugccaaguguuaaugaaaauuauuuuauuauauugaauauguauauacauaagcuagguauaaacucaagcauaauacucuuaaacaacuauaaaaucaaauauuuuuauaaauuaaaaguaaacaaaacuaccaaaucaauaaguucaaaugaccauuauucuaaugcaggauuucucagccuguuccuauaacuguguuauauagaaugguaucaguaacuucgaguuauuauuugcuguuucagaauaauuagauauugaacuuuucgaaaacucugccaacaagaaacgcucaaaugccaauuuuaauaguaguaucacuugauaacugguagagcugucuuguuaauaauauaaaauugcuuauguguauugagcacuagcuaugugguugggauaugugcuuuacacauguauuaacuuauuuaauccucacaauuauuuucuucaguuuauagguaugaaaacaggcacagacagguauaguaacuugccuaagcuuucaagcaaguaagaggcaacucagggauucaaacccaggcaguugggcuccagagaccagguucuuuuuuuuuuuuuuuuuuuccgagauggagucucgcucugucgcccaggcuggagugcaguggugcaaucucggcucacugcaagcuccaccuccuggguucacgccauucuccugccucagccucccgagcagcugggacuacaggcgccugccgccacacccggcuaauuuuuuuguaguuuuuuuaguaaagaugggguuucaccguguuagccaggauggucucgaucuccugaccucgugauccgcccaccucggccucccaaagugcugggauuacaggcgugagccacugcgcccggcaagagaccagguucuuaagcaccguguugugcaaccucuuaaguuacuaacuugaagaugugauuagcauugugucauuaaaaucuacauuaauuggauuccuaaucaauuuucuauggacuugguaacagaaaaauucuucuucgccuauuuguuaccacauuuacugucauauaaaauggcauccacauauaauccauauuauauauccauccauauaauaugcuaaguuccuuuggagcaguaauuguaucugauuuuguucacucuuuuaucucaaaguauuagcacaguaccugggauauaguaauggaaauguaaaaugguacagccauuguggaaaaugguauggcaguucuucaaaaaauuaaauaaaggccaggcacagcggcugacacuugugaucucagcacuuugggagggugaggcuggaggaucaguuaaugccaggaguuugaggcuagccugcgcaacagagcaagacuccaucucuacaaaaaaaaaauuuuuaauuagcugggcauggugacacaugccuguaguccuagcuacucugguggcugaggugggagaauugguugaaccuagggguucaagguuacagugagcuaugaacccaccacuguauuccagucugggugacagagugaaaccuugucucuaaaaaaaaaaauuaaauauaaaauucccauacaaucuagcaguucuacuucaggguauaucccaaaagaagugaaagcaggaacccaacagauauuuguacacccguguucaccaagcauuauucacaaucgcugagagguggaagcaagugucagugcagggacgaauagguaauugagaugugguauauacacacaagggaauauuguucagccuuaaaaaggaaggaaauucuggcaugugcuacaacauggaugagcugaaauaagccagucacaaaaggacaaauaaugauuccacuuuuuuugagacagagucucgcucuguugcccaggcuggagggcaguggugcaaucucagcucgcugcaaccgccgccucccggguuuaagcaguucucaugccucagccucccaaguagcuggcauuacaggcgcccaccaccacgccuggcuaauuuucguauuuuuaguagagacaggguuucaucauguuggccaggcuggucuugaacuccugaccucaggugauccaccugccucggccucccgaaaugcugggauuacaggcgugagcaauuguacccgaccugagugauuccacuuauaugagguagcuagaguagucaaagucagaggcaguagagugguguuuggcaggggcuggauacggaguuucauuuggggcaaacaaaaaaguucuggagauggaugguggugcugguugcacaacagugugaauguucuucauaccacugaacuauauacuuaaaauagcuaaaaugguagauuuuauuauacguauuuuaccacaguauuuuuaaaaaguugguugaaggaauauauuuucccacuacuuuuuucuaccugaacugcugugaaaccuuuguauauagcauauuaggcuaucauuuggcuuucauuuaaauuaaaaauacaaauguaaauauggacacuaaauauauauggccaguuauaaggugcauuuacagauaauagguaugcuuaauuuuagauuuuuacuggaaugaaaacaaugaaaacuucuauagggaauuuguaaauccuaagaauaugucugagaaacccauggagucugcagacccccauuugagcaauauugcuaaagagacuuuguugcaaccaggucaaaacccccauauccuuagagaccaucccuagaagauugcuuaagaagcagguaauagcggcugcuucuggggugguugacuuauuuuuaauguacaccauuuuauauuguuuaaauuauuuagcauguguuaccuauuuuaagaagcaaauaauugggucagggauagggaaccccuuugaagugcuuuggaaauacauuguuauccagaacuuaacaccuuuaaguggacaucuugagaaagaaaacgauaaauguguaguaugaagcguuugaagcaccugaaaguuggggcagcgacuggcgguguuuucggcaguguuccucuuccugcagguaucgcaggacuucccuuuccuccaccccagugagaccaguguccugaaucgacucugccggcucggcacagacuauauucgcuucacugaguucauugaacaguacacgggccaugugcaacagcagguggguccuguucucuguggguguacaccucuagagggcaggagcuaugucaagcuuucaccucuagagggcaggagcuaugucaagcuuucagugaauuuaucgguaauucaugugaaauaaguuauggauuucucaucacuagaaauauucaagugaaggcaaggccucuaauugguuuguuuguauaacuuuuaaaagaaacaagccugauaaugucuuucucagguuucagggccugagcugagaaguuggcuucuguuuguuugauuucaggaucaccauccaucucaacagggccaagguggguuacauggaaucuaccugcgggccuucugcacagggcuggauucuguuuugcagccuuaucgccaagcacugcuugauuuggaacaagagguaagaaggaggagauauaggaaacaccucugggacaguagauuagggcauguucuugaaucugaaaugcccuuugauaagaucagguaguuaagagugagcaguugccugcauggcuggaagguacaguguucucucagugauugcccaaccugugaucagaguggcuuacagaucauggcaaagacucuuuagugaguuuauaagagcccuggcuugguuucuuuauggcccgaaaaucaggauuaauaaccugauuaaauuaucaguucucgauagccuaaaauuaacacuuaagcccaucaugagauucucuucucauuuucauagaucaaauagauuugagauauuuuguguggagcucuaaucacaaaguuuuuuauugcaguuccugggugauccccaucucuccauaucacaugucaacuacuuccuagaccagguaugcugcccaaauaaccaaaugccuugcaaucuguugauaguguuagaauaaucuaauuuaugguacuguuuuugagaacuuuuuuucuucuggauucagagccuaacauuuuauauuuugugcauuuuguauguuuuacuagaucaaaacuguuuaaagauuuccaaauauaguuaaaacuuaaugucugauauuaacgcuaauguuacugcucuauauggacaucaguauuaacaaguaugccagccucagaaauagaaacugcuucccgacugggcauggugguacacaccucuaaucccagcacuuugggaggccgaggugguuggaucacuugaggucagguguuggagaccagccuggccaaaauggugaaacccugucucuacuaaacauacaaaaauuagucgguugugguggcgugcaccuguagucccagcuacuugggaggcuaacguucugaauccagggguggagguugcagugagcugggauccuaccacuauacuccagccugggugacagagugagacccugucucaaaaaaaaaaaaaaaaagaaaaaagaaaaaaaagaaacugccucucucugccauccucuuccuaucugcagcgaaccuccacaucaaauugccuuaggaugcuggaucuugacuguucugugguauugccauuuuaucuuaaguugaacuauuuagaaacaaaagcauuucccaaguugauuuuuuuucccuuacauuugauuacauacccuucuaauuauucucuacuuugcaguuccagcuucuuuuucccucugugaugguuguaguagaacaaauuaaaagucaaaaggugagaacuuuccuuauuccuuuugcuuugcuaagcacugagggaauauuacuaauuaauuuugcuuuacauuauuuuucgaagacccuaguuuuuaguaguuuuuauuuauucauucauuuaacaauaucugcuugguuaucauguuaagugucaggaaugcaaaaguaugacucugccuuuaaacaccuccugguccagaagguagaggaaauguucauagauguucccaagaauguuguugggguaagaaaaaaagugcuguggauguuugcaggugagaggaaccugcaguaagguuuuagaacuguugggugugaagcagaaaguuaauucuuaggaagaagguaauagguuuaugguuagugugcuggcaguuuucugagaauuuugagaucagugagugaaagccagauguuuaauaaauaugccuauucuuaucacaaguuuuuaucagguguauugagaaguuaggagaaugucuuucugggcagaguuaauaagucugaggaauaaaugcuuugagauuucauauuagaagaaucugcuguccuauugaauugguccacaauuggaccaaguggacaaauggauuaaacaucuuuagcucaagucgucauuuuuuuuaagcucuuuauuugugccuuagcuuauuagggguguucauuuucauuaauguaacuaguaaaccaguuaaucugccacauugcugcaucauuuuuaacuguguaaguguagaaacagugcucugcuauguucaugcugugccagcaaagccaguggugggugcucauuggcccuucaaagcugauuguccucaucaaauaacaacauccagcuuuuacugucacuggcuguguacuaggcacugugcuaagugcuuuaaauacauuaucacacacaauccacuaaagggcuaaguugguuaaggggugugcccagugucacacagauaguaguaaauggguuuauaucccagcucuaucuggcuccaaagagugugcucuuaaccacuagauuaaacuaucucccaaaauaaaaggagacauucuaggcaaauagaguuaaugaggacagcauaagggagccaggccuagcugcacgucucaguuggccuucaacuuccgcuggcuauaggaaggagaguggaaaauagggggauugcagauggcugaaucuuccucccugccagaauagugguagagaaacuaguguaccaaggcucuucagaguuuuuaaaaucagguggucaaaauucuagguuuggguugagaauggagauugauugcagacaggcacaaaggcgcuuuuuggaguaguggaaauguuauaaaacuggauugugguaaugguugcccaguguuugaaauuuacuaaaaauuguuuauuaguaugcuuaaaaugggugaauuucauuguaaauuauaccucaaagugguaaaaauaaaagucuggggaccgggcaugguggcucacgccuguaaucccagcacuucgggaggccgaggcgggcggaccacgaggucaggagauugaguccauccuggcuaacacagugaaacccugucucuacuaaaaauacaaaaaaaauuagccaggcgugguggcgggugccugugucgcacuacucgggaggcugaggcaggagaauggugugaacccaggaggcagagcuuguagugagccaagauugcaccacugcacuccagcgugggcgacagagcaagacuccgucucaaaaaaaaaaaaaaaaaaaaaagucugaagaacauagaggcagaggauuuuugaaaaaguauauaccuuagaaguagacugaauugggccuuaacuugaaauaaaaagcuuuccuuggcuuugguguuccaacucuaaaugauucugguugcuuuaagugcagugguucucacacuuuacugugcauuagaaucaccuggagggcuuguggaaacacugagugcuggguucuaaccaagaguuugcaugucugaugagucuccaggucaugcugcugaugggagagaggucccucuuugagaaccacuauguguaaaucuuaggagaaaguuuauccccagucucuccuagauugugcccucuugguugaauauggaauaagaaugugucuugcauggacucuuagaauggaauccaguuugacaaggccguauuuuccacagauucaugguugucaaauccuggaaacagucuacaaacacagcugugggggguugccuccuguucgaagugcacuggaaaaguaagucauggcuuaacugggaauuggugguggagguggguggucaaauuauuugacuucucacauguuuuauuuucaggucauuucagguuucccucuugggaagguuauaaccaggauagaaaaagcuccaugagcagaggagcccauguaaccuuuauuauggcucaggccuugcaaaaagggcuauagaguguugagugacaaagccaggauuuaggugccuggaugaccuugaggcaaucuuuuuaaauguuuagauccuguuauccuugcaggaauuccauuacaugugccagauguugcuugcugugucuaaacauguguauuugaguagcugguauuuucaaauugaagguccuuaaaaauguuuaugcuuuauaaucccauaaugccacucuugggaauuuuauccuaacaaaacuauuuaauagaagaaaauaacuauaugcacaaacguguucauugcaauguugucuacuauaucaggaaauuagaaaauuaccaacaguagaaaaaaauuuaaaugaugauauauucacuugauagacuauaaagccacuaaaaguguagguacuauaacauguaaacuauuuuauauaaauauguacugacaaaugauacaaaauuguauuuaucuugugauuacaacaauaugaaaacauguagaguauaaucaaagacugccuguuugagcuuuccauuuauccauuuuccuuauuuuaaaaaaacugugacauucauugaaaaauuauaauagaugaucccugaggccacucacaacucuguuuuguucuuuuuuucuuauuuuauuuuaauuuuuuguagagagaaggcuuugcuauguugcccaggcuggucucgaacuccuaggcucaaccgauauucacaucuuggccucccaaaguguugagauuacaggugugagccaccgcacccggccacucacaacucuuaaucuccacucuaaccacugcaugaguaaauccuccagaacauuccuuagggacuuaauucucuauuauacuuuuguguauagaauauaaaaucuaauguagaugauacuauauauacauguuuguucuguguuugcagggaccaaacuuuacagaccacauacucagaaaugcauaaauguaaauagcuucacauuugaucuuuuuaaagagagauuccauucaguuaaauaacacagucaaguucuuguaauuucuuuuucucccaaccuuuuauuuugaaaaauuuuaaaccuacaaaaaaguugaaagaaacguauaauaaaacacuuguaggcugggcucgguggcucacgcuuguaaucccagcacuuuggaaggcugaggcagagggaucgcuugagcccaggaguucgagaccagccugggcaacauagcgagacccugucuguaccaaaaauaaaaaaauuagccagguguggugccugccuguagucccagcuacgggaagcugaggcagaaggauugcuuuagcccaggagguugaugcugcagugagcugagaucucgccacuguaauccagccuggaugacagaaugagacccugucucaaaacaaaaaacaaaaaaaaccaaccaaacgcuaguguauccuuuaguuucaccauuuguuaacauuugccacguuugauuucucuuuuucuccuucuauacguauaugugaaaugcacaaauuuuuuugcagagucauuugaaaguagucacagauacccuaacacuuaaauacuucagcuuguaucacuuuagaaaaaaggcauucuuggcugggcaugguggcacacaccuguauuccuagcacuuugagaggccaagguggguggauagcuugagccuaggagaccagcccaggcaacauagugagaccccgucucuacaaauacaaaaaaaguaggcaugcugugugcgccugugggcccagcuacuuaggaggcugaggugggaggguggcuugaguccaggaggucgaaacugcagugagccaugaucgugcuacagcacuccagccugggcaacagagugagacccugucucaaaaaaaaaagaaaaaagaaaaaaagaaaaauaaaagaaaaagggauucucuuauagaacaucaauuccauauuacacccaagaaaguuaacauuaauucaguaauacuauauccaaauuuuucuaguugucccucagaauuccuucauagcuguucuuuuuuugcaauccaggauccgaucaguguucacauacuacauuuuguucucaugucuuuuuagucuccuuuaauuuagaaccgucccccuugccuuuuguuguucuugguguuuuggaugacgcugacauuuuaagaguccugaccagcuguccuguauaauguuucacaaucuggauuuauuguuucccuaugauuagauucagauuaaacauuuuuuggcaagaauacuauguaggugauauuauuucccauuacaucauauuagaagguacagaaaguaacuuuaucccaucacggauguuaugaaguuggaucacuuggcuuagguguuuucaucacguccugcuccauuauagagguacauuuuccccuuuuuaauuaauaugcuaucuggugggugauccuuugagaccaucugaauauccuauuccccaacaaccauucugcauuuuguuuuaguuucugaauuuugcuagauaaugguuuuucauguauaccuggcacucacguauugaauauucucucccuaagugauuccaacaaaaauaaaacaaauuuaauacuguguuagccaaaaagagacuccauuaagucgauuuuuaaaauuuuuuauuauuuuuauuuuuuauugcuauaaaacaguuguacauauuuaggacccaucaguuuugaaaauuacauaaaagaagggaagaaaaugucuucccuaaaauaauaucagcacauauacugaacauuuuagauuucauuguguaggcugcaaauauggaaauucagugaguuaguucacccacauuuaaauuaaaauagcacaauuauuuuuaacuuaauugguuauuucuguuaugacucaucaaauucucaggccucuguuuauccuguaacaguuuaaagcaugacuucugagccucuuacuuucuacucugcccagaauccuggccguuugucauggggucauguauaaacagcucucagccuggaugcuccauggacuccucuuggaccagcaugaagaauucuuuaucaaacaggggccaucuucugguaaugucagugcccagccagaagaggacgaggaggaucugggcauugggggacugacaggaaaacaacugagagaacugcaggacuuggugagagcccaaaaaguagccuagcacucuccugccaggagucagaaaagcaugcacacaaaugaucuucuggugaucccuucuuagcucauagcugagcaccuuccaucaauccuuucgauguaaacauucggcuuuaucuuaacuagugugagacuauaaaauagaaaauauguuugugauauucuuuuuguuuccucuuucccaauauaugcauuugagagauuauaagucuuacuuauguagcuacucuaauggagcagcuagcuacauuuuagauuuuaaauacaguuuggaguuuuguuuuuuuuuuuaaagacagauucucacccaucgcccaggcuggagugcgauggcgcaaucuuggcucacugcagccacugccucccagguucaagcaauucuccugccuuagccucccaaguaccuggaaccaggcaugugccaccaugccuagcuaauuuucauauuuuuuauuuucauauuuuuaguagagacaggguuuugucauguuggccaggcuggucucgaacgccugaccucaggugauccacccgccucggccuguaaguguugggauuacaggcaugagccaccgugccuggccaguuugguguuuugauuagacuccucaaaguucuacauuguccauauucauccauucauccauccauccauucauucauuuauccuguggcaauauuucauugaaugccuguuaugugcuaggcauuguucuaggugcuacaaauaaaaaguaguagugucugucccuaaggagcucauaguuuaggggaagagauauagaaaaguaaacaguuacauuacagugugcuaagggcucugaaaagacuaaauauggguauucuuggaacauggucaugggauagggucuuggagugacuagggaaggcuuuucaguggaagguaugucuaaauugcaaagaguuugggaggagccaucaagagacauccaggcagaaggaaugauauguguaaagguacaggggccauuaaggacaugguucauuuggggaaacaguaguaauucaauugaaaugaucaaauaaaggcugaaguaaaauguuacaagagauggugugagggagaggugguacuugaaacuguguaaguugguacuugaugaaacuugaguuaagcagaggcaagaucacaaaggugcauguaaacaguggaaaugaguuuguacuugaaccugaaaagaguugggggcuauugaauuuuaagcaaguggguaccacagucagacuucaugauaaaucacucuggaugcuguguggggaaucauuuuuuaaaaaucaagauuagaggcaggucgaucaguuaagagaguguuggggagacuuaggugaaaauaauaguccccuaaaccaaagauacuaacauugaauaugaaaaaagagcaaagaggugugagagauguuuagaggguggaaucaguaggcuuagugagugcuuggaaaugagucaagagggaagaaucauugaugauacccagguuucugccuucagcagcugggcaaguagugacgauagggguguauacugcugguaugcggggaagaagaugggucuaauggggggcauguugaguuugaggaacuugugggaaauguucagugggcugagccuggggcucaugagagcacuccagcuuacuuuaaaucuacauauggaaucaucagcauggggcuuggagguuuuuaaucuggggcccuuggguggcuucaggagguucaugaaauguuauaugucuguacauuugucuggaagauccauagcuuuuaugauugcagagaggucugugaccuaaaaauuaaaacuaucuguuacacugaucagucacagaagacgaugugauuguauaggaaguguaggcugagaggaaaagacagucugggacagugcccugaggagcaccagcagagaagacauagagagaagaccuggaaaacaaaaaagaccaccucuuucaucguacaaguaaggaagcuggucgacugugcaaguuuuuacucaguaguaaaggcagagugagggcccaaaucccaguauuuaagccacucuuauuuccaccaugccacucugcugccugaagaugaaauacaucucuccaaaaugggugguuugagaacugugcaacaccagauuugaagucccugcgucuuuauuuuaaaucauggguugggagaguuacuagguauuuucuuguuuuccuuuucuugcuucacacugcaucucgauguguacucuuuccuugacuagcgccugauugaggaagagaacaugcuggcaccaucucugaagcaguuuucccuacgaguggagauuuugccauccuacauuccagugaggguugcugaaaaaauccuauuuguuggagaaucuguccagauguuugagaaucaaaaugugaaccugacuagaaaagguagaaaucuccuuguccaauguaccacacccucaaaaucucuucuuccuuaauacuauguggccccacagcaugccuggucagagcgaguggucgauaauauuccuauccugagauuguagcagaaucaugacguuugucugagaagcaggugaaguugcugccccacugagauuagcccuccccagaaaacccuaacuguccuggguauucuccguccuccuuugacggugucuuccuauuuugcaggauccauuuugaaaaaccaggaagacacuuuugcugcagagcugcaccgucucaagcagcagccacucuucagcuugguggacuuugaacaggugguggaucgcauucgcagcacuguggcugagguuuguguuucaucguauauauauauauauauauauauauauauauauuuuuuuuuuuuuuuuuuuuuuucuuaggcaaaauuggacuaguuuccuagaaauugaguuacuuggucgggcgcaguggcucacgcaugcagucucaacacuuugggaggccaaggcaaguggaucaucugaggucaggaguucaagaccagcccggccaacauggugaaaccccgucucuacugaaaauacaaaaauuagucgggugugguggcaugcaccuguagucccagcuacuuacgaggcugaggcaggagaaucgcuugaacccgggaggcggagguugcagucagccgagaucacaccauugcacuccaaccugggcaacagagcaagacucugucuccaaaaaaaaaaaaaaaaaaaaaaaagacacugaguuacuugacuuuuguuuuuaucuugaugucuugaugaguuaagaaccgagcuuggaaagaaauguugcagagaguugaaggcagaaaguagaaaagaaaagccucuguuuucauuaacagaggcagaacugccuucccauuuuccuaucuaacuaaaagacaggugguuuuuaguugguuaguuaguugaauaaaggggggaucuugguuuaaauucugaaaaucagcauuuuggaucugucucuaucguuugcaauaacuccuaggaaucaacuaauucugacuaaauuuugugucuuguaguuuaguauggcucauaacuuauacuuucauuucuauacacaaucaucuuaugaggaaagcagaacaaauauuauuuucucauucuuauaaaugaagcaaacacucagcaagcugacuugucuggcuugccugguguggcacagugaguagccauagugaggucagugccaggccuccgacuccuggugcacagucuucuucauuuugaauugugcuggugccaccgacuuaaauugugaccaguaauuuuucaaaggagcauauauguucuguggcuuauauuaacauuugucucauggauaugugauaacacgaaaugagacauuuagucagcuguguuguuaacuauauuccuggcuuucaacauuggcuaagcauagaaucgcaugagaaaauuuuauuuuuuauuuuuuaucuuuuuauggagucuugcugugucacccagguuggagugcaauggugugaucucggcucacugcaaccucugccuccuggguucaagcgauucucccgccucagccucccaaguagcugggauuacaggcacacaucaccaugcccagcuaauuuuuguauuuuuaguagagaugggguuucaccauguuggccaggcuggucucaaacucgugagcucaagugauccucccaccucagccucccaaaguccugggauuauagaugugagccacugcgccuggcccgcaugaggaaauuuuaaaaccugcacuugcaccaaguccuuacuuccagagcuucugauucauaggucaggagaggguagguaccuuuauuuuauuuuauuuuugagacagggucuugcuuugucacccaggcugaagugcaguggagcagucgcggcucacuacaaacuccgccucccggguugaagcaauucacgugccucagccuccugaguagcugggacugcaggccugcaccagcaugccuggcaaacuuuuuuguauuuuaauagagauggggguuucaccauguuggccaggcuggucuugaacguuugggcucaagugauccuccugccuuggccucccaaagugcuaagauuacaggugugagccaccacgcccggcagguacuucuauuuaagcaagccaguccacccaccaaagacaaaccucuacagggguuuuugaaacagacaggacuaaaaagcagugcacuucguucagugucuggaacugcuaagagcaucaaaucuccauggguuagaagcacaguaaucuauuauaaauaugguuucccuuucuagucacugucucaaaaacuccuggucaucagagguagagcugugauauagacacagaauguucgaucuuaaaauggcugugaaguaucauuugauuugaaucuuucugggcaaguaaauaucuaaaugacccauguuccuguccuuucaaaauuuuaagacauugcuucaaccccgucuauaggccaaggcaguuucuagucuagagggguugguaucaguuccuuucauuuuugaaaauugaaucuaguucuguugcuuuaucauuuuuauuauaaaucuuuggaaaguauaauuaauggaagaaaguaaaauuguacugacugaauuauaaacaauagaaaaauuguuuuuucuugugaaaguuugcuagaaauuauauuuccaauuuguaaaaaugauaagcaaacuaaagcacagacucuuugaaguuucuuagaauuguaguuaauagacuuuggaagcauuauugcaacaauaacagccuacagcaaugaaaagcugugcccugaaggaaaaggggggaguguuuuguaaauauguguuauauuuaucccuuuugggauucuuucucuccuuuaaaaauuuuuuucuuuaaaguguguauacuaugugaaucuauuucuguaaaguucaaaaacaggcaaagugaaucuggcgcuagaggucaggacuauauuugccuuugagucaaugggaggggcaugaguggggcuucuagggugcuggcaacacucaguucguuccauuucuugaucugggugcugguaauacagguguucaauuuguaaaaaucuucaagcugugaacuuacgacuuguacuuuucuguauguauuuugguacuucaacaaaagguuuuaaaaauucugagguacuuaauaguuuucauuuuaauuaugucuuuaguuuuuacugcuuacauagagaaauggugguauuacuuuuugugguuaaucuuauaacuugcaacguguugaacucuuuuuaguuguaauagucugauucuaucaguuguucuaaguagaugaucauacuaucugcaaaugagagaacuuuccuucuauuuuuauuuuuauuuuuugagauggagucuugcuguguugcccaggcuggucuugaacuccucggcucaggugguccuucugugagccaccauacccaguccagagcuuuuuaucauaaguagauguugaauuuuaucaacugcucuuucugugucaauuaagguucaguuucuugcucuggguuauuuuucuccuuuagucuauuuauaugauaaauuucugguuagauuuugagauacugauucuuccugagauaaacacuacuugauuggauguuuuacaucuguauucacuaguuguauuagucuguucucaugcugcuaauaaagacauacccaagacuggguaauuuauaaaggaaagugguuuaaugaacucacaguuccacauggcuggggaggccucacagucauggcugaaggcgaaugaggagcauagucagguuuuacguggcagcaggcaagagagcuucuguaggggcacuccccuuuauaaaauacuauaaaaauauauaaaauauauaauuuauuauaaaguaaaucaccccuuuauaagagugauuuauucccucucagaagaacagcaugagaaagaccacccccaugauucaaucaccucccaccggguuccucccacaacacgugggaguuauggaagcuacaauucaagaugagguuuggguggggacacagccaaaucaugucacuaugaaauaagacuguacccuucuuuuccuguauuuugcuuaugugguuuuggaauaaagauucuacaguccucauaaaaugggcuaguuagguuuuguucuuuuucuauuuuuuagaacaguuuauauaagacaggaauucuuacugaaaguuugaauuuaccugaaaaauaaucuaagcuagauauuuuuaggagggaaaacuuaccuaguucaguguauuuaaaaccuauugacauaaaacagguauuucuuguauuaauuuugguauuuucuaggaauuuaccuauuucaucuagauuuaauuuaaaaaaaucuagucauuuauguuuuauuuauuuagaauuucuuuuuauuguuuagucuuauuagucuuuucaaagaacaagcuuuuguuuuuaaucuuuuuucuuuuuucuuuuuuuuuuuuuugagacagagucucacuguggcccaggcuggaguguauugaugcaaucuuagcucacugcagccuccaccucccagguucaagggauucucccaccucagcuccugaguagcugggauuacaggcgugcaccacaacgcccagcuaauuuuuguauuuuuaguacagaugggguuucaccauguuggccaggcuggucucgaacuccugaccucaagugauccaccugccucggcuucucaaagugcugggauuauaggcgugagccacugggccuggcuuuuucuuuaauuuaaaaaaaauuuguagagacagcuucucgcucugucacccaagcuggagagcaguggugcaaugaugagucacugcagcgcgaucuccaggcucaaucaauuuucccaucucagccucccaaguagcugggacuagaggugcaugccaccaugcccagcuaauucuuuucuuuuuuuuuucuuuucuuuucuucuuuuuuuuuuugagacacagucuuauucuucuuacucuucuuacugugucgcccgggcuagagugcagugguauaauccuaguucacugcagccuccaauuccugggcucaagcaaucuucccuucugccucagccuuccaaaguacagggauuauaggcaugagccucagcaccuggccuuucauuuucuuuuuuucccccagagacagggucuuguucuaucucccaggcuggagugcagugaugucaucauagcucaccauaaucuugaacucuuaggguaaagcaauccuccucccucagccuccugaguagcuaguauuacaggugcaaaucaccaugcccugcuauauuuuaaacucuuuuguagagacggagucucaguauguugcccaggcuggucuagaacucuuggcuucaagcagucaucccauuucagccucccaaagugcugggauuacagaugugagccacaacaccucagcacugcaguuuugaccugcuucauuucugaccugggccaauucacccauucuuaggcaaccugguggucccccacucccagguggucaccguauugaugccgaauuuauuguggacaccugauugguguagcacacuacagcccagaauuccuagacucaagugaaacuucugccccagccucccaaguaacugggccuguaggcaugcaccacugcgcccaccaggcuuuuucuuuuuuuaauuuuauuuuuuaaauauauauuuuggggucaggcacaguggcuaaugccuguaauuccagcacuuugggaggccaaggcaggcagaucacuugaugucaggaguuugagaccagccuggccaacauggcgaaacccugucucuacuaaaauaaacuacaaaaauuagccaggugcaguggugcgugccuauagucccagcuacucgggaggcugaagcaggggaauugcuugaaccucggaggcagagguugcagcaagcugagauggugccacugcauuccagccuggacaauagaguaagacuccgucucaaaauaaaauaaaauagagauacacacacacacacacacacacacacacacacacacacacacacauauuuuuuuuuguuugaauucuguguuucauugauaucugccuuuuucuuuauuaguuucuuccuucguguuuuuuuuuuuacucuuucccagguugaaagcuugacuccuuuauuuuuaaccuguguuuucugagaaauauauauaaaacuuuacauauuguuuugacugugucucacaaguuuuuggcauguaguguuuucauuauauucuauauaauucuaauuaauuuuguuuaugauuuuuuaaccaaggaauuuguuuuaauuuuauugcauuauaguuggagaacauagucugaauuauauuguuucuuuggaaucuauugcagguuucuuuauggacuaauacaggucugguuuuuguuuguuuguuuguuuuguuuuguuuuguuuugagacggaguuuugcucugucacccaggcuggagugcaguggcgugaucucggcucacugcaaccucugccucccggguucaagcgauucuccugccucagccuccugaguagcugggguuacaggcaugugccacuacgcccggcuaauuuuuguauuuuuaguugagaugggguuucgccauguugugcuggcugaucccgaacugcugagcucaagugaucugcccgcuucggccuuccaaagugcugggauuacaggcaugagccacuacaccuggccuaauauauucuuuacuuagauucuauuuuguuaguuacuaagaucacuauccagcuuccuuucaaaucauauuuaccugauacacucuuccauccuuuaucugcaaccuuucugugugcuuucaucccacucuuccuacccugacaguccccaagcagccacugaucugaucuacucccugucacucuagguuagucugcacuuucuagaguugauaaaaaugaaaucauacaguaugcacucuuuuggaggaggagaccaggcuucuuuuacucagcauaauuauuuugagaugaacccauguugcauuuaucaaugguuuauuccuuuauauuacuuacuaguauucuauuguuuauaccaguguguuuauccauucauccuugauaaauauuuggguggcuucccaaugucuuuuuuuuuuuuuuuuaagacggagucuugcucugucuccagguuggagugcaguggcgcggucucugcuuacugcaaccuccgucucccggguucaagcgauuccccugccucagccucccgagcagcugggauuacaggcacccgccaccacgcccagccaguuuuuuguauuuuuaguagagaugggguuucaccauguuggccaggaugguuucgaucucuuuuuuuuuuaauuuuauuauuauuauacuuuaaguuuuaggguacaugugcacaaugugcagguuuguuacauauguauacaugugccauguuggugugcugcacccauuaacucguuauuuagcauuagguauaucuccuaaugcuaucccuccccgguccccccacccuacaacaguccccggugugugauguuccccuuccuguguccguguguucucauuguucaauucccaccuaugagugagaacaugcgguguuugguuuuuuguccuugugagaguuugcugagaaugaugguuuccaguuucauccaugucccuacaaaggacaugaacucaccauuuuuuauggcugcauaguauuccaugguguauaugugccacauuuacgauuaacaaaaugugguuucgaucucuugaccuugugcucugcccaccuuggccucccaaaaugcugggauuccccacugucuuuuucauuugcaugccuguaaugacuaaugagguugaacauuuuuucaugugccucuuugccuauuuuauacuggguuuuuguuuucuuguugucgaauuuugagaguccuuuauguauucugaauuuaaguucuuuaacagauaugugacuuacaaauauuuucucacuauuuuuuuuuuuuuuuuuugagacagagucuugcccuguugcccaggcuggagugcaguggugcaaucucggcucacugcaagcucugccuccuggguucaagugauucuucugugucugccucccaaguagcugggacuacaggcgccugccaccaugccuggcuaauuuuuguacuuuuaguagaaaugggguuucagcguguuagccaggauggucucgaacuccuaaccuugugauccgcccaccucagccuccuuaaguccugggauuuacaggcaugagccaccacgccugggcuauuuucucacaauuuaugacuugucccagaaguuguuaauuuugaugaaauccaguuuaccuuuuguuuuucuuuuauggaucauguuuuugguguuaugucuaagaacucugccuaacucaaggauacuaagauuuucucuucucuuuucuuccagaaauuuuauaguuuucaguuuuauacccaggucuaugauugauaugcuuggaccuguguccccgccaaaauuucuugaguuguaggggcguggugggagaugauugguucguggagcaguuucucaugaaugguuuagcgccauuccccuugguacuguccucacgauaguaaguucucaugagaucuggcuguuuaaaugugugcagcaccucccccuugcucucucuugcuccuauuccugccaugugagacgccuuugccuucugccaugauuguaaguuuccugaggccucccuagaagccaagcugaagccaccgugcuuccugugcagccugcagaacugugagcaacucaaccucuuuucuucauuaauuacccagucuaagguauucuuuacagcagugugagaauggaauaauacauugauuguuuugaguaaauuuuucuauguggggcaagguauagucuucuuuuaauacauugcuggauuuguauggaaccauucuuugcaggaguucucacuguaaugaaauuugucccuguuuuguugguuguuuucauagcaucucuggaaguugaugguagaagaauccgauuuacugggucagcugaagguaauggcuuagcuguuguaauucuuacggugaugcugguaggcagugacuugcauucucugauguuuccugagagcacugguugccuauacccagacuuccagagucaacucauuuguucuuauccaagugagcaaacuauaccuaaugccacaaaucuacgauaauacaaagauuugggaguguacuuuuuucuggcauauauauauaauuauguugcuauugaauaaauaaugccaaauacacaccagucauccugcuaugcggaacuaaguaugccucuuugaaaugccaaaugccuguaucuuuuguagcuugggcucaaauugaugaaauuagaaauuacuguauacauguaauuccucaggacagugaggagcuccugccuugcuuuacugaauuguaaauugaaauucuuuccucagaucauuaaagacuuuuaccuucugggacguggagaacuguuucaggccuucauugacacagcucaacacauguugaaaacaccacccacugcaguaacugagcaugguaauugucaguggcccugagaaugaucaacugauugacauugcaggguauuucuuggcugcugcugacccuuuuaaggccugcuccacauaagagcagccugaugaguuacagagcaguggcuuccagagauggaaggcucuugcagguaggcuucaugcuggggucauugggaacagugucuuggccugugacccuuccuggaagaguugguucaggccuucaaaccagguauuuuuucucauuggauuauagccauauauacuuuaugggccauauugggacuuagugcugcuuguaguuuugcaguagaauucuuuaggugugaaugauggaaacucacccgaacuagccuaguuaggaaagggaaauggauuugcuauuguaucuaaaaccccagugggaaaacuucgauucauucucucucucucucauucacucauucaccacaucuuguuugugucucuugugaacacuuugaugaccuucuggaaacaugaucacagcaucucccaggaauaugccucacaguguccucuacggaaggaacugaacccagucccucuuguugcaaguuagagaauucuagggaauuaucuagguuuugauuggcccagcccacaucacaucccuaucccuguaucagucaaagaggucagacacuaggcuaugccuaguucagugaagagucuaccccuugacccacugauguccauucccauucauacugcaugaguagaguuggguaaggauccaaaaaaagaaacugugagaaagaaaauacauacacacaggcugaucauuuuucuaacucaguaaaaccauagauguccacuguacuuauauaguacaaauauaaguacuugugguugcaaauaucagaaaauccaauucaaacucacuuaagcaaagcaaaaggaaagaaauaauguauugauucucauaacugaaaagcucagacguaugaugguuuucggcuaaguuugauccagugacagguguggcaccuuuaggacuuggucucuuuccaucuucuaccucuuucuucucagacaggccugcucuguaugguagcaagauagucucuagccaaguuuacauccuacuaagccccuguuuaucuugaaaaaagagcuggacucuuuuagagucugaauagagccucuggauuggccuggcuuggucauguuaauaucccuaaacaauauagcauaacaaaguagaguauuacauuccauuugaucaugccuacaucacccagcuaccccuagaaucagguguugucuagcacuaacccacuggaaauaugugaacuguacugaauagggaugauucuccaaggaaaaucaagaggcaguuugucagcaagaagagaaggauggauggguguuagacaaaugaaacagauguccacuguguccugcuguuagcauugagcauguugggggagaaguggaaagcuggaggagucuggguuuguuauguagccaagcgucccugucagccugcguguucuuucuugcagaugugaauguggccuuucaacagucagcacacaagguauugcuagaugaugacaaccuucucccucuguugcacuugacaaucgaguaucacggaaaggagcacaaagguuugccauuccucccugccaccuuagaguuccugcuggucaucauccauuuucccaucucugcuuccaucccccgccacagaaaccauaugauuuuggaucuuagaaaucagcuaguacaguacuauaauucuauagagaagaaaaggaaaguccagaaguccagagaggcuaagugagaugcccaggccauguuuugggggaguugguuuuuuugguguuuuuuuuugucaugcugcuggaauggugccuguuuauuuccagcccccagauuuuaaggcugaggaaagaaucucuagaagaccucccaagagaaccucacauagaaguuuccuugcccccuucuuaguguccccuguaagcuucugacaucgcagacuccauugagcucuguugcuuuucuuuuggagacagagucucacucuguugaccaggcuggagugcaguggcacaaucuuggcucacuacaaccucugccuuccagguucaaacaauucucaugccucagccccccugaguagcugggacuacaagugcgugccaccaugcccagcuaauuuauguauuuuuaguagagaugggguuucacuguauugcccagacuggucuugaacuccugugagcucuaguuucauuaauguuauucacuuguugagucucugguucuagauuaaccaaguuguuaucuuuucuuuuuuucuuuucuuuuaucacagcagaugcuacucaggcaagagaagggccuucucgggaaacuucuccccgggaagccccugcaucuggcugggcagcccuaggucuuuccuacaaaguacaguggccacuacauauucucuucaccccagcuguccuggaaaagugaguauuucugaguuucucacagguaaauaugacccaccuuacuuguaagggaagaaacuagcaggaacagaauuagugggaaagcaaggugugguggcacacaccuguaaucccagcuaguccagagccugagcaggaggaucccuuaagcccaggauuucaaauccauccugggcaacauaguaagacccccaucucauaaaaaaaaaaaaaaaaauuaaugggagcaagagagccacccaacuaguuuuuaacaaucuguaaaucaaaaauuguaaacccuuaugccuucaggggcuagacugaucacauuaauaagugaagccacagauaugagacacggaguuggaaucagugggagggcauaucuacuucaaaccaucauuuuuuuaaauugccaaauaauaagcaguuuguuggcugccaguuugugagcucuggaaaauaaggucuuaggcaccaugucgagauaauggcccuugaugauuccaucacaccugacaaggucucucccucacuuuuguaauauuuuuuguugauuuacuugggaaaguccuccagccuacaugucugcuauggauguuagccacuggggagaagacaaaauccuguguccucauuauucaccuucaguaaccagcaacauuauacuacuuuuaucugucccucccccacuuuuuugcuagagcuguauaaagcaaaucacagucauuucauucugccaauaaacaauugaaaaaggcauauuucaacagaacuacaaugccauuaucacauccaguaaaauuaacaguagucccuuauaaucccuuauaauauccagucuacauugaaauuucuccaguuaucuaaaaauuaucuuuauguuuggguuuguucaaaucaguuuccaaacaaggucuaucauuucauuauguuuguuccuuuagaaauagacaauuuuaaaaaccaaacagaaugggacugucuucugcaagccuaccuacaaacagguaaauaaauccuauucuaccaggaaucagcuguucuucccgugugucuuuuaaguauggagucucagcauuaagcaguuagcaccugaacuugcagggaggcaggagcgggagucugucucagagggaagcuauuuuacuuucuuucggcucucagcgacagagaaucagauucaucauaauccuugauucauaacacacuauuuuuuuugagacagggucuugcucuguugcccaggcagcacacugcagccuugaacccuggguucaagcaaucuuccugccucaaccucccaagcagcugggacuauaggugggcaccaccacaccuggcuaauuuuuuuaauuuuuaguagagauggcaucucacuauguugcucaggcuggucuugaaccccugagcuuaaguaauucuccugccuuggccucccaaagugccgggauuauaggcaugagccaacacaccuggccugcuuuaagaauuauagaaaaggcuauauguaaucuuuugugauuuaccuuuuucauucaaaaaucauguuuuugaauaugagaagcaacacgagucaaccauucaaaaagauuauaaggguauaaucuaauauccaguccacacugaaauuucccaaguuaucuaaaaaaugcagagauggggucucaucuuguuguauagcuggaguucauucgacugcuauauaauauuccauuguauaaauaaauuauaauuuauuugucuacaucucuagucacucuuuccuuacugccuguuugugagaggaguggguggcacaaaguccuagagucugucgugugggggaagugcaggggaugaaauuuuugucuugaauauccuguuauuucuguccuagguacaauguuguuuuuaaguacuuacugagugugcgccgggugcaagcugagcugcagcacugcugggcccuacaaaugcagcgcaagcaccucaagucgaaccagacugaugcaaucaaguggcgccuaagaaaucacauggcauuuuugguggauaaucuucaguacuaucuccaggucugugcuaagagaugaguagaaggaagggguacggaaaaacgucuaggagguuggcagggaguauugaauagggacuacaaguuucuauuugauaaaauggugggguuugggaaaauucaggaguuauaucaccaagcauguuucuuaaaauaaaaaaagcauuuuauuuuauuuuauuuuauuauuuuuuagagacagggucuuucucuguuucccaggcuggaaugcagugguacagucauagcucacugaagccucaagcuccuggacucaagugaucccccugccucagccucucaaguagcuaugacuacagauacaugccaccacacccagcugguuuguuuuuauuuuuuguagagauggauucucacuuuguugcccaggcuggucucaaacuccuggcuucagcgaggugucaugggucacgucuguaaucucagcacuuugggaggcugagaugggcggaucacuugaggucaggaguuugagaccagccuggccagcauggugaaacaccaucucuacuaaaaauacaaaaaaauuagccaagcgugguggcgccuguuuguagucccagcuaccugggaggcugaggcaggagaaucgcuugaaccugggagguggagguugcagugagccaagaucaugccauugcacuccagccugggcaacagagugagacuccgucuccaaaaaaaaaaaacuccaggcuucaaaugauccuccugccuuugccucccaaagugcugggauuauaggcaugaaccaccgccacaccagccucuuaaaggcauuuuaaagaauccucaucaacaaucuauuauuuauuguugacuugccccuuauuuuuauuguuugcuauaacuucuggaauccuguaggugaccaagucagucaguagacggaauguggccaugaguggauuaggauggggcaggggaggcugggcgcaguggcucacaccuguaaucccagcacuuugggaggcugagccaaacagaucaccugaggucaggaguucgagaccaaccuggccaacauagugaaaccccuucucuacuaaaaauacaaaaauuagccaugcgugguagcgggcaccuguaaucuuagcuacucaggaggcugaggcaggagaauugcuugaacccugguauguggaaguugcagugagccaggaucgcaccacugcacuccagccuggguggcagagcaagacuccgucucaaaaaaaaaaaaaggaaaaagagaaaaggauggggcaggggagaguggucagccaggacguuggagggaggggguucagaauuaugcaaauaacuuccuacaaggcugggcaauauaagggugucuuuggucagccuuaaugugacuugguuagaaggaagaugaguggaggcaaagcauuuucauuucaaucugucaggcaucuuaaugucuucgagugcuuagaauaugcaaagugcuaaaauuuuuuguaaugucuaucagguagauguguuggagucucaguucucccagcugcuucaucagaucaauucuacccgagacuuugaaagcauccgauuggcucaugaccacuuccugagcaauuugcuggcucaauccuuuauccuauugaaaccuguaaguaaggcucauugguuuccucagacugcuucuaccacugaccauucccuuaggcaguuugaguugacaggauacgaaaccaucauuaagcaauuauucaaguccauuuuaaaacauuuuuuaagaauguguaaagcggcggggcaugguggcucaugccuguaaucccagcacuuugggaggccgaggugggcggaucacaaggucaggaguucaagaccagccuggccaacauggugaaaacccgucucuacuaaaaauacagaagaaaaaaaaaauaauaggugugguggcucgcgccuguaaucccagcuacuugggaggccugaggcaggagaauugcuuggacccaggaggcagagguugcagugagccaagaucauuccacugcacuccagccugggcaacagagcaagauucugucuugggggagcagauaaaaaaaaaaagaauguguaaagcaaaacuaaaaaggcauguuaaacgggaccuaagaugucuuugaauuucugaaauacaggguguggugagcagcuacagaugaaagaauuaugugcuuaaacccucaggaguuaaagaaacucaaaauucuugcugacaauacagaaaaaccaaugaaaagcauauagaguucaccuucuuagaaaucuuuuggaccaggauggaucagucauuugaaaguucuuuucauagacaacuagaguaguguuucucucucgaucuauguauguguuucuguaaguacauauaugucuccuucguggcaguuauuuucaacuuuggcugcacauuggaaucaucgggacucuuuaaaaaaaucuaggugacagagcacuuaaauuagaaucccuguaauagugggacccagguacuaauuuuuuuuaaagcucacaagcuaguuccaauuccaggauaaagaacaggaagacugaaaugaucucugguaguuucuaauggaacgguuaugccuccucugacaugagcugguuguuauuccucagugugcuacagcacagcuguuacagacuuuuuaaaaauguucugguguuuagggcuauuucugcuguaccaggaagaguaagauauauauuaauagaugccacuccagagggcuggcugaaaacaaccaagaacuacugugauggguagaugcuguccuuauguggcauagauguauccauagggaaaagcagaauaacagagcaggucaucaucauuaaauauuuauugagugcuuacuguaugcaaggcacuggggauacaaagagguauaauucauggcucugcccuuaaggagcucacaaucuaguuggaaaaacaagacauauauauauauauacauacaaaaaucaguaacaacacagaggccugaacaauugccaaguggacaacaguacagauaauaaagaagcaagaaacgaggguucacuaaaggcuauaguggggaagggagugcuucacugagagagugggacuugaacugguauuaaaaacaagagcaucccgggcaaagggaacaacacucacagcucagaggcaggaagacacucugcgggucuaagaaaugaagaguuaaauguggcuagauuggagguuuggugcagggcuaagagaguaauacucgcuuagccaggaaaggaugcauuuguuuuacgcauuuugugcgucugaggggcuggcaggccuugcacguggcagugucuauccugucagauuugggaggucagcuauuaauuagaucagcuauuaaucagacuguucuccuaacacuuuaacuucauggauguaccuuccuuccuuuccuaaugccaacucuguuucccggguagguguuucacugccugaaugaaauccuagaucucugucacaguuuuuguucgcuggucagucagaaccuaggcccacuggaugagcguggagccgcccagcugagcauucucgugaaggugcgucugccuggaaguaugcagccuugccgaaaggacagaggugguuuugccaauggagaauucaugaucuuuccucugagucaguaaagcauuuccucaauacacacacguacagagauaagauacaaagauaaaaauguugguaucaguugauuuugaagcagguaauacugugccaccucacagugcucaaaaauaguucaguccugaauaguuuauucagcccaucaaauaagcauuggguuguucuaacuuccucacauccuccccccuccuuacuuccuugaacuaacccccaucucacugagauaauuaucugcuuguaaucaaaacggguucuccccaaccccaguacuugacaaaauacauuaacuggaaaccagcuacuaaauuccuacugaugaaagaguacuuucauaggaagucaugcauguauggauuugguacaagucauuuuaggaacuaauagaaauaggaaugugggaaggccaggugguucuguagaauuuugaacaaggcuuuuccaagaaacuccucccuccgcccccauccuccauauggagaguuggugagcugaaguggaaugacagcugaguccuucucucugcagggcuuuagccgccagucuucacuccuguucaagauucucuccaguguucggaaucaucagaucaacucagauuuggcucaacuacuguuacgacuagauuauaacaaauacuauacccaggcugguggaacucugggcagguaggagcaacccuuggguaacucaguagacuuuuuaagguggcuuuuuaaugaguuguagaauucuagaacuggaagaagacuuuaguccaaauacccucauuuuauaaguaaggcuuagagauagaggugugaccaucuuuaauaauuuuaauggagguuauuuucuaguagaagucaucaucaucauaaaauacuaaaaaaccugacagugagauagguguuaaguccuuugcuagguuauguauugcuaugcugggaggcagugggccuuccacucccaauucugauaugaacuagcugugcagccgugggcaccccgccuugcuggucccuagcuuccgcaucugugaaaggaggcgaccaccccuucuaacucuaaacuuuaaaaaaaacugauaccgagauucagugguagcuggcuucccagaggucugucauucccauucagaaaaucacuucauuguccuuucucucuaaaaugucugcaagcagauuuuuuucuaagcuauuguagcagaagagucaaaagaaacucuucaguuuuaagaugacauuauuuagaucacagguuauccugauucauauuucuuugaagguagucuugggaaagcaugacacuuaauaaggcucuuuuucucuuuuguaguuucgggaugugaaaauuucuggcucauaaauugaaauaacagccacguucccaagguuguaacagaagauucaaaacaucccauucuagccacacacaaauaaauaucugcggcuuagugauaggacucuaccuuuucuccuagaagcaguuacugaacauccaggaguacaacuccuucccaucauucccauguggaagggucucucccaucaaggagaacauguggcaucucugauccuuuacauugagaacauuuguuggauauguucauuuauucaauagucauuuauugagcaccuacuacguaccuugguacuguucaagcugugggagauacagcgguaaacaaacaauauagagcagaaaguuaaauauuuuaugguucauaugugaaaaaguaauuauguuuauaaauagacuaacugcuggauguuaccaccaaguaagaaagcaacagguaagauaggcuuucucucucccuauaccaaguaauuuauaccuacacagauugggcaauucuagcuaaugaaaauauacuuaaaaguauuucuuaggccgggcaugguggcucacaccuguaaucccagcacuuugggaggccgaggcgggcggaucaccugaagucaggaguuugagaccagccugaccaacaugaugaaaccucgauucuacuaaaaauacaaaaauuagccaggugugguggcaugugccuguaaucccagcuacucaggaggcugagacaggagaauugcuugaaccugggaagcagacgcugcagugagcugagauugugccauugcauuccagcccgggcaacaagagcgaaauuccgucucaaaaaaaaaaaaaaaaaaaaaaaaaguauuauucuccaagaaaaagguccuuaagaaaaaauugagaucaaguuguuagauuuuuaaauacugaagauugcaggcccaauuacccaucuuacacaaaccauagggguugaaguuaucuuaauauggcccagccaucacugguaaucaauauucauaucaguguaaguaaaaagaaauauucacugaacaacgcccuccaaacugaaaaagaaugcaguguucuggcaucagguuauagucacugcaucugguuuucaucacuacauauucuacacacacugggaagcucugacaacuuauucccugcuauuaucaacuaaagaucacccuuucuacugcugucucuggagcaggagcuggcaaacuauggccugcugucuguuuuuguacaguuuuacugaaacacagccaugcccauuuguuuacucauugucuaugguugcuuucaugcccucacagcaaaggcgaguaguugugauggaucaaauggcccacaaagccugaaauauuuacucuuugacccuuuacagaaaaaaaccuuguugaccccugcuuuagagaaugagaagccaugcagggaucagugaugccagaggaagggaaggaacugcuuccagcuauugugacaauaauaauaauaauaauauugggucuuugacuagaacguguaacauuuccagguguucucacuugugcuucccauguuuaucuuacggaaggucauuccaucaagcuuauggucacugucccuucauggcaguugguccuuucguucucccuuuagcucuaagaguuggggaguacccacaggugagcugugaucucagcucagagagagagcaugaggucuuuuuuaacugucaggaaacagagcugugcccaauuccacucaacuuuuggcacaacuguuaaucugggccuucaccuaccuuaaacugaguuucugcaagcauagcauuuuagacacccuggaauaaccuuuugggaaugaugccacagaauaaaguucacucuuaacuuuucaauuuccuuggccagcuguccuccguaagugaauaagccuguugaaagacucagagaaaguacuaugucuugucauuuguucugagauuaagcucaaaaaaacagaugaagaaaucccaguuacuacaaccaaagagauucaacauuuauuuuaucauaaaaguucagcaaauaaaacuauauacaagauccaugcaaggaauccaguuacacacaagacacauuuaaaaccugguuaaaacacaaucuccacgauagcagggaauaaaaccaguaagaccaaguaucuuuagugagaaacauaaucguguuuauauuuuggaugcugcuugaauccaauucucuccccaacaaugaggcacuggaucacccacucuugugacaccacaggcagcugcaaugcuucagcacacuucagcaccgaggcugggcaugagggguccgucaccaccacaucaaauaccccuaaagcaauaucugcaaggagcaagggaaagugaagaaggaaaggacacucaacuuagcccuccauuagaaagagagauuugauucuaaccaauacaucccacucugcacaaaccaaagcccuauuaugucaaacacacugcuacugaucaugaccaaaggcagaguuauaaucacuaugugcugaccuuguagaaauauuuaacaaauauacguccagugcuucacuuauguugacucaccucuugaaggugguacuuuucuucucuaagaaacauggauacggucaaccuauuaggccugagccuuggaccacaaggccuaacaccuacaggucuaaggagaucccuggaacaaagacacuacacacacucuuucagguaccuuuguuaugggcacuugaauggugcugcuucacagaggcugcaccaccagucaugaggaucucagaccagagcuccaggaaguucugcuguuggucugauaccaagaguaccuucagauucuggaaaggauuuucacgggguugccuaugaaggagacaggaaaggaccuuagcaugacaaguaauauccaacaaacugccuuucugcaaagggacucauguacaucugaaugcuuucaaaaauaaaugccccaucagacauagugucucaagccuguaaucccagcacuuugggaggcugucgugguuggaucucuugggccugggaguucgagaccagccugggcaauguggugagaccccaucucuacaaaagacaacaaaaaaauuagcugggugugguggcgagugccuguagucccagcagcuugggaggcugagguagggggaucacuucagccugggagguugaggcugcaguaagucgucacugcgccacuguacuccagccuaggugacagagcaagacuucaucuuaaaaaacuaagcccuauauuagggucccccuucucuuccuucuuucuaugaaugaucuguauuccuugcauuccuggcuuucuaauuuccauguuuguucuggggcugagaauaauccaaaucaugcuccugagccuauauauuuuuaaugcuugcuuaaaacuuaguucucugacuuuacagguugagaauauugaaccuauauacaaaucuucacacauuugcaaaagguuccuagccaauguaaccuagggaaauaaacuagauaaacuccugaagucauuucaaacccacucaaauuuaucccacagacauuccaauuucuagaaagcuuuacucucucaccuagauucucuucccuccaaagcuugcuguccuccugccuauacaauucuggaugggcuucaaauacuuaccaguccagaauucuuugcuccucaaggcuguacccagcuggcaacagauaauuacgguaguucuggagcugguuggcauggcaacuaucauggacccagacaugagacacacaaggaaucccacuggcaaggcacaggaaguacuuccggguucgacaaugcugauccgcaauuagaagacacugguaagcuguguuacacugcaagaaaagaagcagagccaauggguuuggugacuucuguggaaagcuccuaagcagcagccauaaugagccaugaagagcagaucugaagacucccaacuacuacccaaaaugugauuuagucuauccugcccaaggccacucuucucacuggaaggcccaaguaauuuccauagauguucucucugccucaccugcagcauacugaggaccuaaauccucaacggacaaccaaaaccuaugaacucagccuuucaggcuaaaaaucagcaacccuaauagggguuucuacuacuaaacauaaacaucaaucuucuuuugucccagcaacagaaccauagccauuaacuaacccaagguccuaccuucucuucccuauacacaacaaaaauucuauuucaugcaaaaacauuuuggcaguuucucaguuccugaaaucucuggcuacuuuauccagguuccccaaccccucccaggccucuucucaacacagcaaguuggcucuuaucauugccacuauauuagguuacacaaagaaacuccucaccugggcuucauugaaaucuucaaggauauagccagcuccugcucgaagcugggauucuguauacugcuuguugaaaggaggaauuuccaaaaauucuauauuaaaaaaaaaaaccaagauaauaauuacugagugguuuucuuauuugcuaccuuau

SEQ ID NO: 13361 - RNA, 24478 nt, Homo sapiens
cccuacuacaguagaugguaacucccaauuuggcuucagugaucaacccucccuaaauucacacguggcugaagaacaucaaggccuugggcugcuccaggagaccccugggaguggagcacaagagcucuccauagaaggggagcaagagcuuuuugaaccaaaucaguccccacaggugccaccuauggaaaccagccagccauacgaggaggucagccagccaugucaggaggucccugacaucagccagccaugccaggacauuucugaggcgcucagccagccaugucagaaggucccugacaucagccagcaaugccaggagaaccaugacaaugguaaccacacaugccaggaggucccucacaucagccagccaugccagaaguccagccaacugugccagaaagucucugaggaaguuugccagcuaugucuggagaacuccgaggaggucagccagccaugccagggggucucuguggagguuggcaagcugguccauaaguuccauguagggguugguagcuugguccaggaaacccuuguagaaguuggcagcccagcugaagagaucccugaggaggucauccagccauaccaggaguucucuguggagguuggcaggcuggcccaggagacuucugcgaucaaucuguuaucucagggcaucccugagauugauaaaccaucccaagaguucccugaggagauugaucugcaggcccaggaggucccugaggagauaaauuagaaguccuggguggucccugaagugauugaucagcugccuggagaggguauuccucaagcccagcauccaucuggugauccaaacccucagagccagucucuagcccaugaccagcacucaccccuuccaccagcaacaugugauuaauuuucucauuagugguaucacacuauaccagccauuugagccagcaaccuuuucuguuggcuaacucacuggccagcucucaccagcggugucuggggaaguaguucucuuuguaugaagcauaccugugccagagcugugguugaggaggagccaguuuuagguucgaagaagccauuggcuccucacuuagccauuagacuugaauaggauuuccuugggguggguuggucugucauuacccagccuucucugagcauccuaggaaaucacagauuguuaaaggaaaugccgcuucacugcugaagacaccaucuggcgacagcaaaugcaaaagaggggacucuagggucuucacuuuucuggggaaauguucacgacuucucaagguacgcuuagaccauaugugcauucaggggacucuugucuuugccagcacuccucaggugagcccgggauggcuaucugaaaugucuggaaaauagagucccuuccccaaacaucugacauggccacuaaaucuuuagacuugccuuauagauccuuccauaucauccccaagugccccuucugccucaguccuguuccucugggcaauagcucuagggaaaaguagguauuagacugcugugcaaaauucagagcaacuacuuaaaaugcucuagaggauucuuagccagucugugaaagugggccuccucugugguggggcuguuuggcuuaggagaugcuguaguaguagagauaaucagguucuauuuuaagcaaucagcagagaucaauauuguacagauacaagcaaagguuuaauaaauauauauauauauauuuauuucuguaguugugccagggacagacuggccaaagaccaaacacugcaggguccccaagaaauuuguccuuauaucauugugucugagggccagauaugauuaugaagcuuuuuccaaagauccagggaugggaaugggaguggguaggagggguaaugcggucauuggagucgggggcuggaacauuaugagugcucaauaaauauaaacuaaugagaaugguggugauggaugauggugauguccuugugaauucaagaaugaauauaggcugggcacgguggcuuacaccuguaaucccagcacuuugggaggccaaggcgggcagaucauuugaggucaggaguuggagaccaaccuggccaacauggugaaaccuugucucuacuaaaaacacaaaaauuagccaggcauggugguggacaccuguaaucccagcuauucgggaggcugagacaggagaaucacuugaacccuggaggcagagguugcagugagccaaaaucacgccacugcccuccagccugggcaaaaaugcaagacucugucucaaaaaaaaaaaaaaaggaauacgacuaugagucaauugugucuguaacugauuaaucugaaucggucaaaagccauuauaguugagcaggaaugggcuguaaaaauacagagaucaggcauccaaaaauagacuauaaaaauauagagaucagcugggcgugguggcucacaucugucuguaauccuagcacuuugggaggccgagguggguggaucaugaggucaagagauugagacuauccuggccaacauggugaaaccccaucucuacuaaaaauauaaaaauuagcugggcaugguggcacaugccuguaaucccagcuacucgggaggcugaagcaggagaauugcuugaauccaggagguggagguugcagugagccaagaucgcgccacugcacuccagccuggugacagaaugagacucugucuccaaaaaaaaaaaaaaaaaagagagaucaggcaucccaagaggagccuauggcaguuaacccacuaucucaaaagguauuuauuuauuuauuuagagacagagucucgcucugucacccaggcuacagugcaguggugcgaucucagcucacugcaacugccgccuccuggguucaagcgauucuccugccuuagccuccugaguagcugggauuacagaugcccgucaccacacccagcuaauuuuuuuuguauuuuuaguagagacgggguuucgccguguuggccaggcuggucucgaacuccugaccucaggugaucugcccgccucggccucccaaagugcugggauuacaggugugagccaccacgcccgguccccaaaaggucuuuauugaguaaguagaguguuggaugggggacuggaaagagguucccucucugugaagcaccagaggguacaugccuucucaccaaguucuuggaaucauccuguuaauuuuucacucugauggagugucaggaggaguuuauauaaaggggcuaugcccuuucucugcuccuuugacaucuuuaccaugagagagcccagaacagugggagggcuagaauaugccccuccccaaauauacacauucauaaccuggccacuucugacauacuuaggacuauaaaggguuuccauggaggaggaaagucgaccguuuuacuccauggaaauccugacugcacaaggagaguuguuuccaaccucauuaggcucuggaucucuuaggguccuucagcuuuuuaccccuuuagcccaagaggcuguccaggguagcugauccugguuauuugguccucaacucuugaccccacggaaugcauauccccuucccaggaggccuucugccccucuucccucccccagaccagauguauguauccacccuaggcuccuauucuucauacucaggcacaaguguuuccaguaaucaaaagcauuggagucuuccaagauaaauucaauacugguugaagcagagagguagaagccagggcccaguaacuaagcauguauggagucagaaaaagccuaagcagcacuacacuaucugcaaugaacuugguuuauuguuagaguuggagguggcuccguuacagcagcugggaacuauagcagggaagcguggggaggagcagaacacagcagcacggggaggguggagcuaggaagaacacaaggugggcucauuuugguuucccagucguuuggcagagaaggcaagcccacaugacuaccagcuucuggguuucucagucuggcaguagucuggcagggcugcucacuggcuugcuuggggcgagguccucuccuggggugguauuuucagcccguuuucauuucacucuguaggaguuaagcuguggcucagcuucucccuuuuuccuuccuccaucucauuuuccccaaguccucuggccuggcuuccaccucccagauccucuguccaagagcggguuuggagaggcagccaguguucccauuucagcugcaggauggcauaguggaauguugggggagucacacauugcuggggugucaaauguugggaugucaggcaguggcuuauuuuuaacccauuaaacaccaagccacagcagaugaccacaugcagagaagccaagcaggggaugagaagggaucaggauaauugaaauggggugaguaaaaacuucaaagagucagggaguuuggaagaauucuggcauuggggcuugggcucuccuugccguuuugugcugucuggacacagcccugggaugugaaugguauaaagcagggucugggggauaagcuccuuucuccucucaccagucuauuggucuaaagagcuucaaguuuuaaauugagacauucagauacugagggaagcaguagaacaguauagcagugggauacccccaggacccugcuagaacucagacccuggugguugaggagaugggggaugggaaauggaggaaagggugcagcucugggcaccucacugacgguauccugccccaggucacauaaauuacuauuggaaaucccucccaggaugccaaauaaauagauugagauaaagaggucccuggaguuggggauauaaucucccucuacgagggaggagguugcucucugagacccauccucaguccccauucaauaccagcauuugacagugcuaggagaggguucucaggcaucagaugcuauccuauucuaauuuguccccucccccauccucucccuguuaacuuugguuugagacaccucacaggaauggaugauggggagggacaaccccucccauuuagcccagcccaaguccccacaacaagacaucucccuccccucccccuagcucccaucucccucaaccccaaaggacucagcaguagccauucucuaaaggagcugggggaguggauccuuggggaagggagggcggcucuuucagaacucaaucuugcaggcagggaaggacucauccugcaucaccacggugcugcugcuagccaggaccaggacauucaguuguugcugcugcucaugaguuuguugguaccacucacgagucaccuccgugucaugaguagggaucagagucaccuagaagggagauaagauaugucugaugugagaacauaaagggaagguaggugagggggaaggggcaccucauggucucagaagcagcucugcugcccuuagaaaaggcccauccuuuaauaaauagggacuguguuccacuacugccucugagugagcguugaccagacuacuuccuugguguccuuugcuacucaccugaagauucuccccccacugggccuugcccuccagcagggcauccagcacagcccggcuuggcucgccauuggcagggucauucccacugaccacauaguaggaugcacgcacucgacggaagaagucaaggucagcagucuugccacugcaaugauucgggauguaggcgagauccacauauacaggggcaccagagcugcccuuggaacucaaggccacuguagagacaagccaggauucauuguagaggaaaaguagaacccuuuuggcaaccuuccccucugucccacuccugaagucugaccagcccacacccagcccuaacccacacucucugccaaguuucaugauauacuuacuugguccugccuugaguccauugacuaggccuuuggacauggggcuguguccauccuuuuccucugcuggggugaccuggcuuguggugcugcguggucgagguggggcccgggaugcucgaucugcaggcccuuuaccaggggugggugagcguuuuccccgaagauccagacgccgugcaggggacgcuggcuuggccuugccuggggcccugcgcccuacucgccccugaaccuuuuccuucucccguagccucucuacucucccagacucugagcugagccccucggggucagccaugcacacaucagggcggggaggggaugggcgggggucuggcugugggagaggaggugggucauggccaggccugggguggugaguaccacugacacccccagcuuuguccacagguaggaagucuccaucuucaucugagucgagggcugccucagcugugauggacggacacuccucaguuucuggcgggacaucagaaucugacugugaggagccugagucacuggcugauguagggggugucucaucagucacagggcaugggcccccaguggucccuggccccccuacccggcgccgccccccucuuccuacuagccgaacuuccucaguugagaggucccuaucaucuauggaugggggcagagguggguucaggaaggauggggagagcuccccacgauggggccgaggcucaguggcacaucccuggggcccagcuucgaccucaggagaggcacugcugggugggcccccggagcccccugcaggacacacuggcugcucaggggagagcaaugugucaggccgggagcuccucucagcuccuucaggccaggccccacguucccaggcagggcaagccgcagccucuucauuuucagccuuggcuggggcagggccugggggguuagggcugguuucaguugggccauuggcugcacaauccucagagggaaccuggaaggggcuuggcuucuccguggcugccucugagcacuccagguggcacggcaggaugccaucacccaugucuccaggcaggcuuggagcuggagcuagggccaaguccagugaagcugggggugcugggcucagaggagugaggucccagaggcugugggcagcugguuccauuccuggguccagcucuccagacuccuguucugcagccucaaggcuuggagagaagcgcuccgccacacuugaaaucacaggcgugguagccucagaggaggagcccucagacagggcuggugaggcaggucguggcagauuggagaggagaggggccccaggagaacugggugaugggagcuggggcagugaggaauccaggcugggggccuuggucacuuccagguauucaucaugccggguucuggugggggguccuggagccagagccagagcucgauccccagagaaggcaagggagccacagggugccgagcgggguucagcuggagagggcagcugugggggagcuggcugcaaugaggagaagccaaaggcugaagcagggaaguccagacugggucgggcaggccccaggugugaguccaagggagggcuaacaugugccucaguuucuggccauaaugugggggaccccauaggaauggggugaggaggacuuggggauugggccucuuuuucuggcuguucccgagcccccuucuccaguucugagucacuagugcugucaucccagugacuccggccugauuccuugggggauggggaccuccuaucugggcugcagcucaggauguuaccauuaagaggggggcuugggccuuugcucaggauaggagcacgggggggaacugcagguggggugaggcugggcuccauacuuggcccuggcucuggccuuggggguacaguggguccugccagggcugcauagcugaagguuggagugucagacuggaggcucuugggugagauaggagaugaaagcuccuucucugcagauguguuucggccggcagcugccuccuugguugagaggcaugggggccaauccccagcugcuccaaguggaggcucucuaguggggcaugcagggccaagcccaguaagcaucaucugcucauagaugucugcauacugaaagcuucucucaucaggauagggugugggcucucucugcuccggcucagucugcucaggcuccgugguggcauggcuuuugcuggccucugguaccuuugagcugugugagcuuuugucaggagccucagcccuaccuucuucuucccuuuccccuucagccuugcgguaguccuuccccaggggggaguauggcccaccuuccaacucagcugcccccuccugcacugcagccaccacacugucauacucggcugugccccaagagaagggugcaggaguaugggauuccggggcagguguggggggaccaggagcuggggagaggggugcaggggggaggggucuguccuugggcacccagggugggaugucagccagccaugagggaguaguggguucauucuucauguguggcaugagcuuagggucugggauaggacucucuuguccuggggcugaaggaacccuuuguccaaccaucucagguggggaagcuggaggggagaugaucucaaagggagagcgggucaguuuguccucuuccucugguggcaacccaacuggugauucagcaagccagcgcuccaccucuagccccuucuguggugaggauuccuggaaauccuugaagucugaggcccaggggcuccggguugcguguucccgcagggguacuucuugcucaucaucugggcccucaucuaggaaagugcuuucccguuccucaguguagugugggcgggcccccuggccauccagcucgugagggaaccagaccuuccgcucacagcuuagcucccuccaguauguguccuguuccaaggccacauccucucugccccuccaauaccuauuguccugcucaggagauguguccucccaugccggggcaagcucuuucuguucuccagccggcuccucucugguaggagauguuucuugccacuccuggaccacauccugcccccuccaguacuuuucuuccugcucucuggcccugcccuccugcacuaggcucucuuccaggcccagagcuuuggucuucuccagaagagcuucuaacuucucuuccauggccuugaccuuuucuggggauuuuuccucuagcaucuuugguuuccugguuuuauccuccugcacuaggcucuccugcuccugaguuuggugguucucuuccagagccugaauguuuuguuccagggcuucauccuucugucccaaagcccaguauuuuuguucuaaggccugauccuucuuuucugagacuuuauccuuuuguuccugggccugguguuucuguucaggggcuuugucugucuguucuaggucucuguccuucauuucagcgaccguguccuccggagccuuauguucaacacuucugacuuuuugaucuaaggcuuugucuuucucuucugggaucuucuccuucuguucuaggacccuguccuuuuguuccaagucuuuaucuuuugguuccagggccuuguccuucuguuccagggcuguauccuuuuguucuaaggcuuugucuuucucuucuggaaucuuauccuucuguuccagggccuugucuuuuucuucuaagucuuugucuuuugguuccagggccuuguccuucuguucuagggcugugucuuuuugcucuaagucucugcccuuuuguucuaaagccuuauccugcuguuucacagccucauucuuuacaugcagagccucaucuuucugauagauggcuguauccuucggcucuaccaccuccuugugcuccagaguuuugucuuucugcuguaaaacuucauccuuuggcucagguuccuucuucuguucugagguucugucuuucaacccuggaacuuuaucuucccacuuuauggcaauguccuccaaggcagggccuggcaaagacucaggacucuuggagaaggagcuaucaggugucagaauguguucaucagggcuugugaucgccccagguaaguacuucccauuuccugaagguguagagugagagaaugagcuggcaggugacuuccugucaaggcugucaucugugaugucugucugugcagaguaucgaguugucccaucugugggaggugacgcuguggcugcauggggcucuggaacagacaugggagcuguguggugagagguauccucggccugcaucagaugccccauuucuuccuucccaagguuuaguuccccaaacuggagggugccaaggcuuucuggagagagcugcuuagaagagacauccagggaggucuccuugcugggacucucuucugacagagaaagugacugggugucuucuggagauaccucuggccaacggucuuuguguagguacuguucugucaggccacagggagacuuggggguaggcucuugguuggcagugucuggggagggcacgcugaggacagagagggauucugcaucuucaggagagaggcuucggucaggauaucugagcaccucaucuuucugagguuugccagguucuugggguaaaguccucaaaccuccgggaagggcuucugcucccagaauugggccugugggcucuccugccuccauaaucucaaagacuauugcuuuauccugugcuggcaacaguugaaugguacagccuguaagccccucaucaauguugacaggugcuuccugggccugggggcuccugggaggaggaacuuucucuuccuucucuagugugcccucuucaggcccuggcuugacugucuccucagcagcaucuucuuugcccacaccuggugugcgcuuagugucuccccaggagucugccuccugaaagucuuggggcucagacuuuucuuccacuggggacugaugaaaggguguguggguggcacugggugggccagaugguggaggagaagccaucuucacugugcugucaucugggcuaaggcaccgcuccucugcuucuccaagggcugguucuccuggauguagggcaugcccaggggcacuaaacacuggaguuccauauugacugcaaaguuucucagacaucucuacguuugcugucuccuccucuuccucuuccacagcucucucuccagacaagccuuucccuaugaucucuccucucuucucugacuccccagucacagagaaguccucacaggguggugauuugaagcccuugucuucuuccagugaggaggugggugagaugguaccagcugauggcacauaguccaagcccugcguagcuucaguacgggaggaagggaugcuugugacugugucaagcagcagggagcucuugccugucuccucugucuggggagcuguaagugaggccacagauugguccucagccacugauguggcaaaggaagaaaguuugucacacucagugauugaaguggccgaggacacauguuccucuucagccaaaggggcagccacuauguuagugggguaggugaguucagucucuggcguuccauagacuuugccagagguagcaggaacagcacuaucggcagguuggcuggcuucgaaugggccagcaccuucaggcccgggcaggucauauguacuuguaugaaaucuggguggagcugggcgcuccuccggcucaucauggaucuccucaucugagauggucugcucagucucugaguagccagggauugucucauccuggauguaagagacaugcucaguggcuccugcagguguggucaggcugcuuaggaauaacgaggucuccuucucaggggccuugcccuggagucccaauucccgacccccaaaagccucccggcuccuuggaguuaccuucaaggguuccugcauauguuuuugguaaaaacccucagcuuuugucgcguccucuuccuccucaucugaaggguguaccuccuccauuucuucuaacucagccuuuucuaucacauccuccuuuacuucagguucacuuuccucucuggcuucuguucugucugggagccucucugcuucccucugcuucuuuuccucccagguaucuuucucuuccucuguuucagccccagagucuaggccucuguccuugcugccuuguuccucagggaccucugggacaagcucuuucuccuucaucacauguucuucuugucccagcccuggaacagagggugguguucccuggauagcuguacuugggggucccuccucugcagugucuagagggaauggcuuaucuccuaguccugugucccuuuguucagccagcaaagcccucuccucacgcuucaucuccucaaaguccugugugagguccucuggugaggauaggaccagcucccugugcccacugaugguugggagugguacaguucccuucugggcugggggugucuggggcucagaagacagcuccuucuccccacggauagcacggcuccugucuauuuugacucuuccagggaccuuggcuuuauagagggucuuacguaccucaggaguaaagggcuuuaggucuggcuuggaaaucuucuugagcucagguuugguaucuuuccucuucuccuccuucuuggcauccuucuucuccuccuuccuuccuucauccuucuugagcucuuuccucuccuuuuugaucucuuuuuucuccuugucuuuuuuuucuuccagcuuugauaucuuuucuuuaaggugcuuuuucccuaccuugucuuugaucagcuuucgcuucucugccuucagugccucacuugacucugucuucacccucucaggcuuggcaggcuucucugggggcuucucagaugacucuuuugccuucuucucugucuuggcuaacuccuuggccagcucugaacgugccuccuuggcucccucuucuaccaccuccucccguuuggccaacuugcucacggccgucuugguaguggcuuugaggcucuccuugcuaucagcccgcuguuugauuuugcugggcuugagguugguaggcacagccccagaagccagguccuucugcguggccacaggguaacgcaggaaguccagaugccgaagcuuuucuaggcccuccaagaucuuguuuuggggagcauuuccuggaaaaagcacacgcacaaucuucucagugggauuggcugguagccagaccaccagagcagugauagagguaagguagggcacggagaucucagccuccuucccauugggcagcacgaugccugucuuggcuuuacuauugccugcccacuuuugcaugaggaacugcaucuccuugcuguccuugacaggguugaggacauacauguccagccggcccacacccauuuuguggaagagggucaguggcucaaugguauugcugaccacacgauauagaggcucagccuggaugcccaggcgguuuaagugcugcagagugaggcaggccuccucaaugcuacgcuuggcuuuccgggaggcaucaggaagccgcagcuucucaggcacguugaaaaagacaacuccaagcucaggagagauaagguucuucacccagucgcuguaacugcuagagcccugggacugcuccuccucuagcucugccacuuugcgcugcaguaguccauugaugccuggcagguugucugccccaaugugugugaguagcaccgagucaaugcgguccaagugccguaccagcuuccaaaaacaggacuugcgaucagagccaccauccaccaggauguugaaaccauugacagcaaagagggcagaguccccacgaccaccugggaagauguagcaacaaggcuuggagagcuugaggaagcccccugagguggggggcucuaguaggucaaauggggauggcacguccacagucucagagacauacucggagaacucagccacgccguccauggugggcagagugggcucaggguuuagccggaggugcagggucucuugggaacuggauaaucccagguggcuccaaucaccuuccccuaagcaggacacgguaaggaaggccuguaucccagggucucuauugcugagcaauugggaaaucuagaagaauaggagauagaaaccugaucaggucacuagaguuguuuuggucugacuuagauucaguacccuaaucuucaccucuuuccaagguggacucuuaccuuucugccagggccccccauggucaugcaauaugagacuuucccuuagaucccucccacagcucuagugcuacccuuucucccagacacucuggcauggaacuuaccucgggguugugaaggaccugggcaaaguuuucauaugaguaggugccacucuguaggaugaggucucccccaggcucuaaacuuugcccacucaagauuaguaguuuauaagcugaugagcugcuaagaagaugaugaaccuggaauggaagaaggggaguggucacagauauaggaaauccagggaaaggcaaugaauggccccucaguaccucaagaacaugcucccaacuuaugucccucauaacaccuccagagugggcuggagacaauacgucagcuuagauggcagagagaggaauucuuggccuaauagugguagcacuggcaaggguggguauagcacuugcaccaggccuguuuggcaaggcacaggcccuggccuuaccucagagcugaugcugucugcacugggauuuaccaggaugauggucucuaggaucucacucugguggcaaaggguccucuggccugagggagagauguaggaauuuauauugagaauagguauagaaauuguggugcaggagaggaaagaaugugcuaucaggaaauggggcuuagacgaaagagaagguauccuuaggcccugccaccuuggauacugcugaguaaggucuaggaacuggcucauccagcccuucccuuagaggguuuccaccuccccucucccacacuggcuguccucuccuucccuucaucuaccacacccucugcugccugugcccccaucccucugccuggaacuauggccucagacugcccuauugacaagaagcuuuuguccuucucgagcacuaagcuccuggugcugccuggggauggggggcucagcuggagagagggccccugggaugaugacccucacuucccuuucuccuuccuggcuugccucugcccugggcuuuccugcccgcagagugucuagaaauaaggaaauaggagcuucugugugguacagacuccccacccuucuugccauccaaggccagaauuccuguuccagaagacccggagaagccugugcuaucuaaauuuuugggguuuuaugauucaaagaauggacauaggacuauaacuucauuuucuguccucugguuccucagaggccaagcccgcacuaauacacaugcacacaaucauauuguuccugcucggaaguuuucacaacacccucuccaaccugaucuucaugucccaaaguuucagagaggccagauucacuaccccacaaccuauucauugugaacaguuucuucucucaucuuugccccgcuccuaggggccucuaccacgggcauggggagugaaagguucuugaacaagaaacacauuaauaaggaaggagagauucaggguguuccccaggccauggagaaagauaaggcauccccaaauccccuauuucccuucuccagccucacaugaaacaccaaacaauucagcaaagaaagaaaguggcaaaugagacagaagaugcugaagaagaaugcugccauccccugcacccgcccuuccuugccaaauccccuuuccaauugcaguacauaguggcauuaaccucacagagcauccaacagauggcagugggcugucuggaggauacuggugggaggguccauaauuugucccuuagacccucuucugugacccagcucucucuucuuucuggugcuuggacaagagaagccuggggccagggccuuuguuaagaggcagagccauggugccaggaucaggcagaucuggcagcacagggcugcagaugcagcugugggggaaaugaacgauggugucagaagaccaaaccccauacagcguggguugggccaaaggggaauucaaggguucccuucuauuuacuugagaauugagggaacauuugagauaaauucagaggacaagagccaccucagauguaggcaagggcagggcuuggggcaggugagggauaucaagguucgggaagcugccagccuuaagucguucagauuuagaaagacaagagcucccuccacacaaauaaggucauaaauuugagguaggagggucagaaagacaaauaucuauagcacacacugauuugcuuucuaucuaccccucccugcccccaaccauuccucacgguccccauuuaucaccacaagacuucuaugaucccaguuccuguccuggcauaagguccuguuccucacucuaucccugggagugguucugacuugaaauuacaugguuuauauccugugccucucuuuuucaggccugggagaaagccguuucuucugcuccccuggcucucucacugaagggaacugacucguuuuuuccuuuuucuuuagagaggaccaucuugugaggcagggacacacagugcucagccagugcuggaguugcgggggggggugggcugcggugcagaggcugagcaggcaggagggcaggugucuccgcagugaggcagaaggggagggggaccguuugggcagcugcaguuugccgcagugugugagugugcgcgcugagcuccggcuccagcuccgcccccaccccccaccccagcaugacaagucauuuucuuggcugcuucugcaugggggguggggauggggggaugcagagagagagaagaaacuggcuccucuguucaagagcccccaucuugggaagagaagcagagaugagguggggguagggcugagacugggaaccugugggguugacacgacuggaaaugcagggcagccgcuggggagggaguucuccgucuccagaguggccucggcagggccagaaagggggguuuagagucccauucuaaagcuagccgcagggaauagggugggggagcccacugcaaaccgguuggucuguaaggaggcgcgugccacgucuuagugacccuuuccucccuucuuuuccauagugucccccaccuucccuuacuuggcaaaaacucacugcccugcucacccccagcauaggagcagcugagcaauccagcagcugacacccaggggcccuccuauuaggcacauucccauaacaucccccuuucucucagauucuucugccucugaccagaaacauagcccccaaacuccuccagcauccugggcugucaggcagagccaguggcaccacccucugcugcugucccaggcugauuucucccauccccgcccagcuggagagguggacugucacagccccugguggccucugguucuggguccaggcugggcccacagccaguaacguucaucuucucucuccauuuccccauccugccuacugccacugggcuaguucuagaugugccagauuagguaccagcacccuuuccaugacccccaucccaccucccuaucacaguguacccccacaugccaagcccuuugguucgguucuuacccugggguguaggaggaagccucucauggaggcggcagcuccggccucagccggcagcuucagggaagagucugcagcacuuagggugggaguggggcgggcggugggggggggaggggggugcuugaugaggagggcggcgccagggcggggaagaggggcugguccgugacgaggcacuggagacuuaacuguuucuuugccuucacgacgucugagcuccagugcuuuugcuuggcucuguggggcugagggauugucuagcagcucaaggagccucugcaauguccuauggcccauaggaccuuucucucccaacccugcuuaguuaggaaauauucuuuuggcaucagccaaaagaccaaagccccaugcuagggcacagagcgaggcuauaggaggcaugggcugcgugggcucucccccuucucuuagaaaccaucugcugccucucuccucagauggauccagggagugaccuucagucccuggaggagcaggagacaaaggcugggggcccaaaagcaugggguagguguggggaacugcuuaagacaaagguuggggaugcagagaugugcugccuucuucugaaccucagcacuacagaaaccaaggagggcagaaauaagucuuauuuuaggguuagaggguaguuugaaauuccggaguggacacauggucccuagccuguugggguggggcacagggacccugagagcuacaugaaguuucaugggaaugcagcauaacacaguaaccacacaggcacugauucuugggauucuugagucauuggauaugaagagacaagucccugaagggacagggagcuuucugccuuacagugaaggaguuaacaaggaccaagaaggaucaccagggccuccggcccaagcaagguuguaggccaauuauuaaauguaacagaaguacucuuuagauuaaaaaaacccuauaaugacuuuguagggugauuggguucuugcucucuccuugucucuuugcuguuucuauauuauauuauuuggaucuuucuaauguugauccuguuucccuuagucucuaccuccaucucagauuuaguaaagcgcucuaggacucaaaggaagaaucuggagagugguagcacuuccuuccaacccgaggaugcucaugcucuuacauaguccuucccugcccucuucccauccacccuccccaguuuggccagcuccuaaggccuuccucacaaucacagccacccacucacacccaaacacuagccccacccuugccccaggcugccaagaguuacuuuugaaggucagagaagccaaaauagucugugcucucagcaucccccauccccccuuaauugcagccagaggagaggaggagcugagucacuaguacucuuggggguugaggggacaaaaggggagcaauccuugcuuagauccggggaugcaaaucugcgacaauggcaacaaccccguuuggguagaagcggccaucugcagagauacacagggaaaaccaggcugaguucugagcaucacaaaagggaaauaccccucuucugcaacuucaucguucuuauuuccucccaccucaagccuucuaucuccucccugcuuucuagggcuuucuggaguguguuaggagggaaacuuaaguagacauuuaguuuacgaacaaaauaacauuucccagaccaauacagagcccacccauauucucagcugccacccccaagggccacacccugggcauggugccaacucacaguggaguuuuccuucagccuucacccucugaacagcuacccaccacaaccaacucuccaccugcuguauuccuaggcucugcugcaaugaaauggugagaugccaaagaagaaagagaggcuugagcugagcuacaaaguaagauaugaaacccuggauuugagacuugauccaccauuuuacuaaucaugcugcuaaacaagagacuuaaccucucucagagccuacuucauaaacuaugaaaugaguauaauauuaguaccauccuccgauaaugcugugagguuugaauuguauaaaagaugaaaaaaaagcuucuucauuccuagacuuccaaaucugcaauguacaaaugccacuggaagucuuucucccuuuuguggaagauuucugagaggucaucuaggugaucaaggaaaucauaaaucaggaucucagaccagaucaacucuggaguacucuuagcucccagguaaacccagaacuaaagaugccugcaguaugagauuugaaguccuauucauguccuugcuuucccauuucagacagcaaugcagaccccgguuccagggguuaaugagcugcuguauuaauucaggguaacuguuguauugguagaaguaauagagcuaucacuuccuaaguccgucaguggaaauggagagucagaccgaaggccuccagacuggucccucagccuguauuuuuauuuauuuauuuauugagauggagucuagcucugucgcccaggcuggacugcaaugucaugaucucagcucacugcaaccucugucuccuggguucaagcaauucuccugccucccgaguagcugggauuacaggugugcaccaccacccucggcuaauuuuuguauuuuuaguagaagaggguuucaacauguuguccaggcuggucucaaacuccuaaccucaagugauccacccaccucggccucccaaagugcugggauuacaggcauaagccaccaugcccggcccuguguuuuuuagagucuuagaauauuaguuaugaauuauaagcccccuucuauuuccuauagguauccaauaguaaaagaaucagagaguuauugaaacucaguuuuccacuguccuaauuguuucugaauuuguauuagaaugcucggaagauccagauuuuuuguagggguuagaaagucaccacuggagagacuaccuggugcaaaaaucaccuuugaaagcuuuuaccagacuugaccacuagaaggagcugggccacugacucuuuaucagagggucccuucuuuucuguguguggguaugucaauguggagggggcagugccuaggaauaagugcacucuccuugucacuguaggauacauuuuugucugcuuucucagcauuuuggcccagggcuugaggauaggugauaggaaugguggcccagccugugggguagucaagccauaaggcacuagcauauccccuugagcucaucccagcugccugguccccuuugcguccucacuaacagaaggcuggagggaggggcagugucugcagcugcucugggcugacuguuguuuguggggacagcugaaagaggagccagcagggguggggcuguggcugucuugagcuguguggguuuuuccaggaaauucucuacuauucuccugugacauagacagaccaugauaaaaauguccaaaccuaaaaauaugcaguaugccaaaguaagcucugaucuaggguacauggcccuaagcuccuugaggacaccacagacaaacucuuugauggaaagggccuaguagguguuuauauaucaaugcucauuucuaagaagugccugagaauaacuauguucucucuguaagugucuucccaaguaucgcugcaucuuaaucugaagaauggcuaaguacuuugguuuaacuucuuuucauuucuuacauuauuccagaaagcagccuacucucaagucucuguagccaaaaggacaagguuagagcauucagugugaauuauuaacaucagcagauaauccccaaacuucuguucagucauuaauuucauccucugucaucccuguaucuggccuuucaccaaagcuccuaggaguacuaagugguaaaacugccgauuuucaucauuagggauaaauggaggaagccaugacaugaguaauucuaaacagaaacauucucaaaagagugaguagccugcuuuacaggaagccagucacaucaggaagaugucagccucacauauauuaauauaaaauugcuguauauauuccuaggcuaauggagcuuuagucauauuagccuuauuuucuccaacuuccuagcagcaucuauaaguaucagugaucaggaagugaucaaagauuuggcaguuaggagcaguggaaaaggaggagagauaauuaaggaaaggugacuacuauacugaguaauugagaauuaucuguauaagacaugaauucaaucauucaguugcaguggcuguugaccuggauggauuuuauauuccacuaagcugauggauuggugugucaacauuuuccaguaacaugacuagaugccuagcuccuuuuucuuuuuuuuuuuuuccugagauggaguuucacuuuuguugcccaggcuggagugcaauggcacgaucuuggcucacugcaaccucugccucccggguucaagcgauucuccugccucagccuccugaguagcugggauuacaggcaugcaccaccacgcccagcuaguuuuguauuuuuuaguagaggcgggguuucuccguuggucaggcuggccucgaacucccgaccucaggugaucuccccgccucagccucccaaaguguugggauuacaggugugagcacugugcccggccuuaguucuuuuauaauagcauguagagcuuuccguagucaccucacagacaucugucauggaaugguagugccuaacaucuuauuuucucaaaucucuaacccacccauuccucccacccagcagaaugggaaacugcauuaugugagcuuugaucugggccaaaucucagaguacaacuugaucuuguagcaguaaauucaggagccccuccuuccacucuggauuugauggugcccaucaucauguaaguaccaagauucugcucugcccuggagaucuguuggcuaagccgaagcaggaaccagaaacccugaaaccugugcagccuaaauaaaaaugcuaaacaagggucaaggaagaugaaugggggauucuggggugucuguaaagggaagcagggagacccgggguaugcagaaaggggaacacaaaugaagagagugaauuuuugcgugagagaugauugaucacuaagaggagucccucauuucuuuagugcaugucaacagcuauccacaaacaacccucuucucaaggagaaguuauguucuccagucucccuccaguaucaaaccaugucugcaaaguauauuugguauguggggacagcuauggaauuccaugauuuuccuccucuauaaaguuccucccuucuccuccacucaaaccucccgcaaggccacuucucccagggagacuggaccucugugaccagcucuuacccaaaggacugaaauaaaacauuaguccuaaccuuugaccucugaggagaagugagcuaggugccggguaaugaagagucucaacuguugguucaagucaaaggaugacaggucaauguuccaggagagaaucccugugggagaaaaacaaagaagguucuggauaagguugcagguuguaggguggugagacugcaggaacacuuucaaguucacagaacagguaaggagagggaggguauauggauaguugccaugaucagccucagugaugucucaaagaaagguggcuaguaauggugucuuucucccaguuuacagcuuuucuaggcuuugccugagccagagggagaaggacagaguuuagacuaaacucggucauuaaugagucuauagguaggaauuuucuuguaagguuccccaguugugguggaagugacaccuaagggccuauucccagauacugagggcuaccuuccccacauuuacagcuaaguaggauucuagguucgccuucuguguucccuuccuuguccccagcccuccacagcuugcuuccacccgcagguggcuccgcagcacugcaccacagccacaggcacagcacuggggaaggaggugaggacuuaggagcugguagccacgaaggucacuuagugguuggcuacuggcauucagagauuugagauuuguacggggcguucagaaagcuccccgugcugguucagggaccauaaagaagauacagcaagauagggacguggauucuccagggauggugaggacuuucaggacaccugguccaaaacacugcgguggagggugugaccagaggggccccaggggcugcauagagcuccgcugccucagggagacugcggaacgccauggagugugcaguaaggaugggcaagcgagauguuaguagagcgagaggauacggacacauggcauggaagaugcaggugacaagggcgcagaucucaggaagugcacacuagggauggagaugcagacguaugcauugguaguugaaugcagaaggcggagaagcacaggguagagaugccugaagcacagccagaacaguggcucaccuuguucaaggugggcccgcacggcccucagcugacucucuguaccgauaucgccgaucacaauuagcaaagagugcuucugcaggucccagcgugcagccgccaccgcggcuccggccucgcacagcagcuccgcgggguucugagccagcggugcgccgggacuucggagccccagccccggaguugucuccauggcaacgccgugaggccgcgcaggcucggccucggucuccauggaaacacccgcggaguguuaguccggcagcuuccg

SEQ ID NO: 13362 - RNA, 5280 nt, Homo sapiens
gaaacauauaaacuuguacaaaggacacagaagcagucaguuuuaauuuuuuagccauguugguaaaaguucauuuucaguacauggguaacacccaggcccuuucccauuauauccagguaugcuacaaguucuuuuaacucuuaucagaaguuauuauuacuguuuccuuagagaggcuaccaggcuaaaauucacuuaguuugguuugucuaauguccucauuauuuuauccugaagaugaugucauuucucaggacuugaaaaugacuuggcugaacuaaagguaaaaaagccaagccucugucacuuuuccuagacuccuaggcacagcuauggagucuuugcacagugcccauacccuaaaaauuaauaaugaaaaccaaaccucaagaaccuagagcagcucucuacuugccaccauggacuccaguggucagcauaagaaaagcagauaguugcauucuauuuaguuuauagcugcuuuguuccuuuguguuucacuaagcagaggcucaaaaauucccuugauaacuucagcugccccuguucuuuuccucaaacuccaggaugagaccuuuaaugugggacaauuucuggugaagguacucacagcgacgcuuuucuucucuguaacuuggguacugcugcagagaaaaagcauccaugucaaaaaguaaaaauucucauucuaccuugcuuccguucccagaccuugucuuaccuuccugaacuuuuuauauuccuggauuaucuugucuuccaggaccugaaacagaaauuacuagcacugaguucaacauuaagaaaugagagaggggcggccaggcaugguggcucacgccuguaaucccagcacuuugggcggcugaggcaggcagauaacgaggucaggagaucuugaccauccuggcuaacacagugaaacccgucucuacuaaaaaaauacaaaaaaauuagcugggcgugguggcaggcgcuuguagucucagcugcucgggaggcugcggcaggagaauggggcaggagaauggcgugaacccgggaggcggagcuugcagugagccaagaucacgcuacugcacuccagccugggcaaccaagugagacugucucaaaaagaaaaaaaaaagagagaggggccaggcgcaguggcucacaccuguaaucccagcgcuuugggagacugagguggguggaucacuugaagucaggaguucaagaccagccuggccaacaugguaaaacccugucucuacuaaaaauacaaaaaguggcugggcaugguggcacauaccuauaaucccagcuauucggaaagcugaggcaugagaaucgcuuuagccuaagagguggagguugcagcgagccaagauugcgccacugcacuccagcuugagagacggagcuagacuguccccccaaaaaaagaagggaaguaacuucccuucucauucuaccaaaugauacagacuaauuuuucccuucaaacagguuuccuugucacuuugcuuagucacuuuauaaacacagguguauggaugguuagcaggggguuaauggccaguagagcuggaaagccaggcuggguccuguccuuaccuuguauucuggaguuccucgccgaacucuuuuaaucucugcucccagcucuaugaaccuuuggcuugcagucccaacacgggcaugcaggaugcgguauucagcauaaucugucucaaaguccugcucauaggcauguugcuguucugcacuguggauggcccuguauugccugccaggagcagagaguugucaccuucaauuucauugccccugaaaagcccccagcuuccaggaaguguaucuuaauauaugaacaagucuugaugaaauuggaaaaagcaaggaacucacaggagguagucugguauaucuucaggacuuggggauucagaaucuaggaaggaagcaagaaaacacaagugauuauaagucuuuuccacuggcauuuuuacccuccucucauuaacucaccuucuugaacugaggaacuguguucuaaucugggguccauguccucaucuucuugcucccaaucuucucccucuuguaaauccugauuggucaggccuuguagggggcuuggcacuaaaggcagaguucugaaccucuuuucuuccaguucuacaguggcuacaggcacugaacguuucuguugaggaaaauaucugugugacauaaacagccaagagcuuccuaaauauguucuucucucaagaauuucuccuaggcugggcacaguggcucauaccuguaauccugaccguuucagaggcucagguggggggaucgcuugagcccaagauuucaagacuagucuggguaacauagugagacccuaucucuacaaaaaaauaaaaaaaugagccugguguaguggcacacaccagcugaggagggagaaucgagccuaggaguucaaggcuguggugagccgugaucauaccacaacacuccagccugaggugacugagugagaauaagaaaaaaaaaaaggauggccugagcccaggagucuccagccuggggaacagagagaccuugucucuaaaaaaauuccucccauauaacgagcuuccaauuucuaaauuuuagcuugacuaaaagugcuuuucaaaauagucuuugccacuguuuaauuauauuaauguuacaaaaaaaaagcccuugccauucuaacuuaccuuguccagacguuuccggcuggcagaggaaggcagugccugaacagguucucuguuuggaacaugggucuggcuucuaggauauuuuaagggaaugggacagaugaagaccaggguaggagguggaacuggaucuuuuauuacaacauuuaagaguggagauuagaaaggaagacaaugccaaagcuucccauguuagucccaccccauccaaaguaccucacuucccacugugccaugugcucccuugaggauccugggagugacuguccuugguugcuugccaguggaucugacacugacaccugguggggaaaguggcaggagcacuugguucccuggaguacugggauaccuuggacuucaggcuuugccccaccuuaucacaacucccugcaauuucuggccucacccaccuccucuagugccaucuguggcugugauacugcaucuccuucagaauagccuccuguguucugccaacucucaggaugucuggcaucuucagucagguugugucccugaacugaugauggggcugggauagaauccauggcugcccaaauaaugaggcgcucccugagugagcccaggcaguggaggcuguuaggcccagaccuggaaaaggaugguggaaaaaaauaggaggguggagaccucuuaagcaccucuccacauuucccucccccacuuuccacaaacccuuucuugccggcuaccuguucccccucaccugaggaagcguuggcacacaagguccaagcuaccaccagcgcccuccugacaacacugggacacuaugaaggagaagaggcaggaccaaccagggccugggagucucagauacuggggguggaaggagacgguaagccccaugaagucagccccucccccuccugccgccgccacucguccgggagccaguccguaaguaagacuaagacgggucccacagggcuuguuagcacaccaggugcagcugggccugaguuccccaggaggccgaaacagcacaguccccucaaaccacagcccccugggacaaccccagcagccuccucgccccacuuggaguucaguuaucggaacuaccucagaccgugacuacucgcagccuccggccccgaccgcaccuuccaccuccagcccacguuuaugcucccucgcccucaccucgcucacacacccugagcucgcacuuaccccucgguggccuuggaaagcaaucaccggccguaccugcggggagagcgaagaugugaccguugagcgcaggugaagcaguguccccaggauccggcguccggagcccgggaucaccugccuagcgggcuucacuuggagagguggggaggccagagcuugcggaagccgcucccucuccccugcaccuucuccagggucgccggcugaggcccaaggucccuaggggcagugacuagagaagaagggggccggccguaccuguugccgcugacacucuugcagcgcccgcagggcagcgucguugagccugagcaguaagaggcuaguccgggcagcuugcgugaagcagagccggagcuguccucucagaggcuccuggagcuccuccauggcgacgaguucgagugcaagcagcacgggggccacaggcgagggccaccaccgccaccuccucuguucaggguuugguuggcacacccgguaacccacgucugccccacccuccgccaggaacccgcccccggccccaccucccgccagcgccaccccaagcuuucccagccgcgugggcggcgcuucgcucuccccggccaaccgcccggaccucggcgcuuucuucuaggauccgcaugaaucgcuuugggcuaucggaagagcuauccccaguucucgggagaaagaguccgcgaccagcgucugaccucucacucagaguccccaguccugccuuaguuuccccagcgacccugaauuuggaguugcugucucuaagugaaagcugaaccugcaaccccuugaggguuucagccgcagaggggcgggagaaagggccugguugguaggcgggcucagcgguucgcgcccaguuagccccgagcuucggagacccgagagaccagaggauggcugacacgaaggggcacccgagacagcgccugggcuuuuucccgcccgcgguuccaccgcucugaaaccgauuucuaacagagagguaauuggggcccugcgguugugguggcagcagugaaaguuggcugucaccgacuggagcgcccccaguuggugggcagggauacgggcgcggguaguggcaggaaaguugcagggcagagagccagaacccaguccuaggucucaccucguggccuaaacacgcgucagaguggugagaccgcucccugaggagggccaggagcugccaugaagucgccaggcauuccagagggccagauccuggugcacugagaccccagcaccaaccucuggccagcccuuggugucuccacuuguuccuguuugauuauguuucccaagagccccgauguuguccuguuuccuaaacaggauc

SEQ ID NO: 13363 - RNA, 5280 nt, Homo sapiens
gauccuguuuaggaaacaggacaacaucggggcucuugggaaacauaaucaaacaggaacaaguggagacaccaagggcuggccagagguuggugcuggggucucagugcaccaggaucuggcccucuggaaugccuggcgacuucauggcagcuccuggcccuccucagggagcggucucaccacucugacgcguguuuaggccacgaggugagaccuaggacuggguucuggcucucugcccugcaacuuuccugccacuacccgcgcccguaucccugcccaccaacugggggcgcuccagucggugacagccaacuuucacugcugccaccacaaccgcagggccccaauuaccucucuguuagaaaucgguuucagagcgguggaaccgcgggcgggaaaaagcccaggcgcugucucgggugccccuucgugucagccauccucuggucucucgggucuccgaagcucggggcuaacugggcgcgaaccgcugagcccgccuaccaaccaggcccuuucucccgccccucugcggcugaaacccucaagggguugcagguucagcuuucacuuagagacagcaacuccaaauucagggucgcuggggaaacuaaggcaggacuggggacucugagugagaggucagacgcuggucgcggacucuuucucccgagaacuggggauagcucuuccgauagcccaaagcgauucaugcggauccuagaagaaagcgccgagguccgggcgguuggccggggagagcgaagcgccgcccacgcggcugggaaagcuugggguggcgcuggcgggagguggggccgggggcggguuccuggcggaggguggggcagacguggguuaccgggugugccaaccaaacccugaacagaggagguggcggugguggcccucgccuguggcccccgugcugcuugcacucgaacucgucgccauggaggagcuccaggagccucugagaggacagcuccggcucugcuucacgcaagcugcccggacuagccucuuacugcucaggcucaacgacgcugcccugcgggcgcugcaagagugucagcggcaacagguacggccggcccccuucuucucuagucacugccccuagggaccuugggccucagccggcgacccuggagaaggugcaggggagagggagcggcuuccgcaagcucuggccuccccaccucuccaagugaagcccgcuaggcaggugaucccgggcuccggacgccggauccuggggacacugcuucaccugcgcucaacggucacaucuucgcucuccccgcagguacggccggugauugcuuuccaaggccaccgagggguaagugcgagcucagggugugugagcgaggugagggcgagggagcauaaacgugggcuggagguggaaggugcggucggggccggaggcugcgaguagucacggucugagguaguuccgauaacugaacuccaaguggggcgaggaggcugcugggguugucccagggggcugugguuugaggggacugugcuguuucggccuccuggggaacucaggcccagcugcaccuggugugcuaacaagcccugugggacccgucuuagucuuacuuacggacuggcucccggacgaguggcggcggcaggagggggaggggcugacuucauggggcuuaccgucuccuuccacccccaguaucugagacucccaggcccugguugguccugccucuucuccuucauagugucccaguguugucaggagggcgcuggugguagcuuggaccuugugugccaacgcuuccucaggugagggggaacagguagccggcaagaaaggguuuguggaaagugggggagggaaauguggagaggugcuuaagaggucuccacccuccuauuuuuuuccaccauccuuuuccaggucugggccuaacagccuccacugccugggcucacucagggagcgccucauuauuugggcagccauggauucuaucccagccccaucaucaguucagggacacaaccugacugaagaugccagacauccugagaguuggcagaacacaggaggcuauucugaaggagaugcaguaucacagccacagauggcacuagaggaggugggugaggccagaaauugcagggaguugugauaagguggggcaaagccugaaguccaagguaucccaguacuccagggaaccaagugcuccugccacuuuccccaccaggugucagugucagauccacuggcaagcaaccaaggacagucacucccaggauccucaagggagcacauggcacagugggaagugagguacuuuggauggggugggacuaacaugggaagcuuuggcauugucuuccuuucuaaucuccacucuuaaauguuguaauaaaagauccaguuccaccuccuacccuggucuucaucugucccauucccuuaaaauauccuagaagccagacccauguuccaaacagagaaccuguucaggcacugccuuccucugccagccggaaacgucuggacaagguaaguuagaauggcaagggcuuuuuuuuuguaacauuaauauaauuaaacaguggcaaagacuauuuugaaaagcacuuuuagucaagcuaaaauuuagaaauuggaagcucguuauaugggaggaauuuuuuuagagacaaggucucucuguuccccaggcuggagacuccugggcucaggccauccuuuuuuuuuuucuuauucucacucagucaccucaggcuggaguguugugguaugaucacggcucaccacagccuugaacuccuaggcucgauucucccuccucagcuggugugugccacuacaccaggcucauuuuuuuauuuuuuuguagagauagggucucacuauguuacccagacuagucuugaaaucuugggcucaagcgauccccccaccugagccucugaaacggucaggauuacagguaugagccacugugcccagccuaggagaaauucuugagagaagaacauauuuaggaagcucuuggcuguuuaugucacacagauauuuuccucaacagaaacguucagugccuguagccacuguagaacuggaagaaaagagguucagaacucugccuuuagugccaagcccccuacaaggccugaccaaucaggauuuacaagagggagaagauugggagcaagaagaugaggacauggaccccagauuagaacacaguuccucaguucaagaaggugaguuaaugagaggaggguaaaaaugccaguggaaaagacuuauaaucacuuguguuuucuugcuuccuuccuagauucugaauccccaaguccugaagauauaccagacuaccuccugugaguuccuugcuuuuuccaauuucaucaagacuuguucauauauuaagauacacuuccuggaagcugggggcuuuucaggggcaaugaaauugaaggugacaacucucugcuccuggcaggcaauacagggccauccacagugcagaacagcaacaugccuaugagcaggacuuugagacagauuaugcugaauaccgcauccugcaugcccguguugggacugcaagccaaagguucauagagcugggagcagagauuaaaagaguucggcgaggaacuccagaauacaagguaaggacaggacccagccuggcuuuccagcucuacuggccauuaacccccugcuaaccauccauacaccuguguuuauaaagugacuaagcaaagugacaaggaaaccuguuugaagggaaaaauuagucuguaucauuugguagaaugagaagggaaguuacuucccuucuuuuuuuggggggacagucuagcuccgucucucaagcuggagugcaguggcgcaaucuuggcucgcugcaaccuccaccucuuaggcuaaagcgauucucaugccucagcuuuccgaauagcugggauuauagguaugugccaccaugcccagccacuuuuuguauuuuuaguagagacaggguuuuaccauguuggccaggcuggucuugaacuccugacuucaagugauccacccaccucagucucccaaagcgcugggauuacaggugugagccacugcgccuggccccucucucuuuuuuuuuucuuuuugagacagucucacuugguugcccaggcuggagugcaguagcgugaucuuggcucacugcaagcuccgccucccggguucacgccauucuccugccccauucuccugccgcagccucccgagcagcugagacuacaagcgccugccaccacgcccagcuaauuuuuuuguauuuuuuuaguagagacggguuucacuguguuagccaggauggucaagaucuccugaccucguuaucugccugccucagccgcccaaagugcugggauuacaggcgugagccaccaugccuggccgccccucucucauuucuuaauguugaacucagugcuaguaauuucuguuucagguccuggaagacaagauaauccaggaauauaaaaaguucaggaagguaagacaaggucugggaacggaagcaagguagaaugagaauuuuuacuuuuugacauggaugcuuuuucucugcagcaguacccaaguuacagagaagaaaagcgucgcugugaguaccuucaccagaaauugucccacauuaaaggucucauccuggaguuugaggaaaagaacaggggcagcugaaguuaucaagggaauuuuugagccucugcuuagugaaacacaaaggaacaaagcagcuauaaacuaaauagaaugcaacuaucugcuuuucuuaugcugaccacuggaguccaugguggcaaguagagagcugcucuagguucuugagguuugguuuucauuauuaauuuuuaggguaugggcacugugcaaagacuccauagcugugccuaggagucuaggaaaagugacagaggcuuggcuuuuuuaccuuuaguucagccaagucauuuucaaguccugagaaaugacaucaucuucaggauaaaauaaugaggacauuagacaaaccaaacuaagugaauuuuagccugguagccucucuaaggaaacaguaauaauaacuucugauaagaguuaaaagaacuuguagcauaccuggauauaaugggaaagggccuggguguuacccauguacugaaaaugaacuuuuaccaacauggcuaaaaaauuaaaacugacugcuucuguguccuuuguacaaguuuauauguuuc

SEQ ID NO: 13364 - RNA, 4424 nt, Homo sapiens
aaggauggucaggacaaugucugggaccauuauuuaaaguuuagagcaagacuagagugagaaaagcuccccacaaacagggacaaauucuaagaauaguacuuugucagaugaucuguaugagaugaaggggguggggggaaugacuugagaauuuaaaauauguccaaagaccuuagggcucucacaugaauagaauucuaaaucuuugguggaaaagggcacagggaguaugguacccuuuugaggauuaccaguauggaccaauugguaguaaaugcccccagauaaucccuauuuaacuaaaccagcuuaagaacucuauucuuucucagcaaugaggccuccuaccuggcugagguauuuggaccccuguggauugucaagguuuacagcuaugaguuucaggugaggauaaagagcuccauauccccaacacccucccucccccacacaaagacacacacacauccuaccaaccucuacccagaaugcucagauuauagcugcuguuaccuuuuauugaguacccacaaugugcuaggcaacugugcuagauacuuuuacauaaucucauuuaauuuaacccucacaacaacccugugagguagguauuugcuccauuuuacaaauggagaaaucgaggcacaaaagauuaaacaucuuaccaaagucugcacagccacuuauaugcuggagcuagaauuugaacccaggugugccuccacuuuuuaauacuagaccaaucuuuucacgggggaaguuuccuagauuaacacccucacaucuuuuaagaccauuccaaaaccugcguucuguuuugcagaagcccucacuguguuucugcugcccugaaacaguggaggcagacaaaggugagugccaagugaggaaccauaagaagugguagaucucuguggagugccauaagaacccucaagagccuuaacaaagguaguugggggagaggggaagagguguuucagcagcucugcucccagcagccauuuccucucuccagggcaaagggguggggcugcgaggccagcugaccaagaaaccccuccagcuccuccaguccaaguccagcaucuuuccuacaacuauucugccuuccacuucgucuucuuccuugccucacucuaugucaugguuacccuuaccaacugguucagguaagauggagugggccuuagauacucuccugaagagcuagcuauuuuaaggaaagagcaauucaaggccauuccagacacacaugggucugccauuauauuuggugaggagguagaacaggucuaaaagcuaaggcccuucauauucucuaaccagagccuuugguuacacagcuaugagggagcagaacuggaaaagaccuucaucaaggguagcugggccaccuucugggucaagguugccucaugcugggccugcguacuccucuaucuggggcuguuacuggcaccacucuguuggccccccacccagaaaccccagccccuuaucuugaggcgccgccgccaccgcaucauauccccagauaacaaauauccuccagucuaaguccuuuucacaaacugggguuccccugacauuguacuccuagaguuggcucaaggggagcuguccagcccagcucaauaccucaaggacacacagggaguuaucuccguuugggcugaagucaauacuaugaacuggaagaaguggucaaacacagucuaaugugcugggcagagugucugacucacuggagcuacuguuacaucugcaucccagcucaagagccuaacacccaaaucagcagcucaaagaaccaccgcugaucccagcagacaguguggcaccagcccuuuccuggcucuugggcuggaaguggggguggggaaagaccaacagggacugaagacucggcucugcccuuggagaaaggaaaauaaggaguucagcccugggcacacggauauaagaagcccagaaccacagaacaaaccagggcauagaagaaaggagcacagaggcuaccccagguuuuaauccugauuuugaggucaagggaagcgggaagacaaaaccacccucauuccaugaggaaugacagaagagaaagugaacgcuugacagcagcugaccacgggaagucggugagcagcaggauuuuuuggccaacuuucaagcagacgaacaaacugaggaagaaugaggaaaagaggcauaaacacagaucuugcagcauucacucuuaggccaacuccauccuagagaugguguucaaggguggggaacaaaaaucacagaaaagaagucucuaugguucuuagaggauuccucuacugcauauccggaguacuuguuugguugucauuguauaauaaaggcuucuucugugauguuucacuuauuaagucuacauacccacaaucugaaucuaaagaguucucccuuuuuuggugggaaagggcagucauucuuccaaccccauccccccaaguccccagucaaaccaggcgcucaaggaauuacaaagcuacuuuuaauacuuuggggugagccccacaggaauaaaaaacacugggaagggguaacccccucacccccgggaguggcccagggggagagaggcuaccugaggggaaggaagcacaaaagggacccgcugcagacucagggcaaagggaaugccaucggugcugggaccugugagcacuacaggaggaaacgcgagcguggugggacuggcuccaggcacacaggcgaagggcaagaggguuggacacgaagccacaaagcuacuuggguuccuccuucuucucguuugccuuuuucugcuucugcugcaugaucuccgagucccuggggguagagaugauggggcacugggagguaccagagggcaaaaaggacaagaugcagggggaugaagggcacaaaggauaagauggaaguggaugggacuaaguucagcguuuggcugcuguacucccacccuaggagaacaagaggaagagagcugaggcucaaaaggcgaccagucuccaucuggcuguugcccaaggggucagaagucuggugacacaggcccaagggucucuauucuguauugaggaccacacccagcaacaccagugaggagguugggagaagggaggagaaccgaacagcaaggagggccaaaaguacugggcugccguaaccacaacuguauuugaaaugugaagcucccugcccuugcccuuaaggucagacccagggacgcucagaaaucagacugagggcaggcgcccgcccccguccuuuccuguaaggcugugagcuaacaauuuggaggguggggaggaaauaaaacccuagaggaagcaaugcacucugcuccucacgacuaguccacauucaagcccugagguagcucucuuuccuucuauaacccuuggucuaacccaggucuccaccgucccuuucccuccccucccuggggcuaccucugcuugcgggcggcagcagaaagcccgucaucucggcgcuuucccuuaaccgagucgcucugcuuuuucauauucuucuggcgggcgagcucacgcugguuaccgccuaaggaaagaaaauuaaaggugagacgcgggggccgcucugcccacacaccggcgacccuucuaccccagcgcggccagcagcaggauccaacaccacuucaaucuccgggccccgacaacggcccaucgaggcccaggcugcuugggguaggggggaguggcgaaucugccacgggccaggucaaaauacggacuagagaagggaggucccaaggggccagcuggaggcguguuuuggggcggcguggggcccaaacagcuggcaagguguguguggacgguuugggucuccgugggggaugggcuggcuuguggagugggggcucugggccuaucacaggggcgcuggccuucuccuuacaccgcggaagauccgggagggccuaugccuaacccgggaggguggucccgugaaguagccgugggcaaagggcucgauuuccgggcaccgagugugaggguggccacagagcgcgcccagagaaacgccuugcuagggaagcuacggaaggucaaagccggcgccucgccggugguguuuagggugaacggaaagaaaagggcaaggagaagggggcucggugcucacgggucauggcgacggcagcggcuccaaccugccuccguuacguccccucguucugucggacguugcaggucccgccccuucuggcaacguagcacagucguuccuuuccuccccgccccuucgcgcccgggagccggcucccauuggacaagaaaaagcacguggauccacgggucgugcuugagccgggguggguaaguggcggagggucgcaggcggagcgcucagcguggggcggggcuucc

SEQ ID NO: 13365 - RNA, 6349 nt, Homo sapiens
auaagugaaacaucacagaagaagccuuuauuauacaaugacaaccaaacaaguacuccggauaugcaguagaggaauccucuaagaaccauagagacuucuuuucugugauuuuuguuccccacccuugaacaccaucucuaggauggaguuggccuaagagugaaugcugcaagaucuguguuuaugccucuuuuccucauucuuccucaguuuguucgucugcuugaaaguuggccaaaaaauccugcugcucaccgacuucccguggucagcugcugucaagcguucacuuucucuucugucauuccucauggaaugagggugguuuugucuucccgcuucccuugaccucaaaaucaggauuaaaaccugggguagccucugugcuccuuucuucuaugcccugguuuguucugugguucugggcuucuuauauccgugugcccagggcugaacuccuuauuuuccuuucuccaagggcagagccgagucuucagucccuguuggucuuuccccacccccacuuccagcccaagagccaggaaagggcuggugccacacugucugcugggaucagcggugguucuuugagcugcugauuuggguguuaggcucuugagcugggaugcagauguaacaguagcuccagugagucagacacucugcccagcacauuagacuguguuugaccacuucuuccaguucauaguauugacuucagcccaaacggagauaacucccuguguguccuugagguauugagcugggcuggacagcuccccuugagccaacucuaggaguacaaugucaggggaaccccaguuugugaaaaggacuuagacuggaggauauuuguuaucuggggauaugaugcgguggcggcggcgccucaagauaaggggcugggguuucuggguggggggccaacagaguggugccaguaacagccccagauagaggaguacgcaggcccagcaugaggcaaccuugacccagaagguggcccagcuacccuugaugaaggucuuuuccaguucugcucccucauagcuguguaaccaaaggcucugguuagagaauaugaagggccuuagcuuuuagaccuguucuaccuccucaccaaauauaauggcagacccaugugugucuggaauggccuugaauugcucuuuccuuaaaauagcuagcucuucaggagaguaucuaaggcccacuccaucuuaccugaaccaguugguaaggguaaccaugacauagagugaggcaaggaagaagacgaaguggaaggcagaauaguuguaggaaagaugcuggacuuggacuggaggagcuggagggguuucuuggucagcuggccucgcagccccaccccuuugcccuggagagaggaaauggcugcugggagcagagcugcugaaacaccucuuccccucucccccaacuaccuuuguuaaggcucuugaggguucuuauggcacuccacagagaucuaccacuucuuaugguuccucacuuggcacucaccuuugucugccuccacuguuucagggcagcagaaacacagugagggcuucugcaaaacagaacgcagguuuuggaauggucuuaaaagaugugaggguguuaaucuaggaaacuucccccgugaaaagauuggucuaguauuaaaaaguggaggcacaccuggguucaaauucuagcuccagcauauaaguggcugugcagacuuugguaagauguuuaaucuuuugugccucgauuucuccauuuguaaaauggagcaaauaccuaccucacaggguuguugugaggguuaaauuaaaugagauuauguaaaaguaucuagcacaguugccuagcacauuguggguacucaauaaaagguaacagcagcuauaaucugagcauucuggguagagguugguaggaugugugugugucuuugugugggggagggaggguguuggggauauggagcucuuuauccucaccugaaacucauagcuguaaaccuugacaauccacagggguccaaauaccucagccagguaggaggccucauugcugagaaagaauagaguucuuaagcugguuuaguuaaauagggauuaucugggggcauuuacuaccaauugguccauacugguaauccucaaaaggguaccauacucccugugcccuuuuccaccaaagauuuagaauucuauucaugugagagcccuaaggucuuuggacauauuuuaaauucucaagucauuccccccacccccuucaucucauacagaucaucugacaaaguacuauucuuagaauuugucccuguuuguggggagcuuuucucacucuagucuugcucuaaacuuuaaauaauggucccagacauuguccugaccauccuucccugucuugggcacccuccuuucauaccuccacccuugacaccuuuacgcaccaagcaaaaagcacacaagcauacaugaugcuagcacucagcauugcuagagagauaucugguguuugggguuccauuuuacucaggccaggcaggcacagggugugauucuguccuugaaggauuacugggaagggacaacagaagagauggguauuaacaaugagcuagguauuuggcaggggcaaaaaaaggucuuagcauggagaauccagguccugucccuuaccucucucuggaggacggcuggacagugcagagaaagucagauacaugauauagcagcugaugacagaagcuuguaggaggccagagcgggguugcucuggggaguaaguauaauugcuuuagucuacaggcugguaauuuccuccauuucuacccccacuuguacuucugucuccccauccuuugguggggauagggaagcagagauucuuuuaucaaauaauugagauuagggagguaaugaaacuugcuaugcuuuuaaggcccccaaaaccuggaaugcuguaggacauguacccacugaggcggaugcaaggagcgauggagaggaaggagaugaggccacagaagcaaaggugcagacugaggagcaucuuguuaagcaggcagccagcuggguguguauaauaguggaauaggagcacagcucccacaccugccaugcuguagaauccuaggguggccagcaggacagccaggaaccagcuacagucuugagcugcaccugucugccuaaggguggaaagugggcaauggcuuggagcuccagcauuuuuuuuuuuuuugaguugggagucuugcucuguugcccaggcuggagugcaaugguguggucucagcucacugcaaccuccgccucuuggguucaagugauucuccuaccucagccuccugaguagcugggauuacaggcaccuaccaccauguccagcuaacuuuuauauuuuuacuagagaugggguuucaccauguuggccaggcuggucucaaacuccugaccucaugauccacccaccucggccucccaaagugcugggauuacaggcaugagccaccgugcccagcuggagcuccaacucuuuuacccauuaccaacuacuccccugcucucagaagacuggugugacuagccauccuacuuggcccacgcagucaucacauuccuaagcuuuuuugauacugcucagugggaagcugugggaccagugcucugccgugccuuuugcccagcccuuuccauguaguaauacuagaaaccuccccaggaaaagccuuuaggguuaugugccccuuaccaguucuuguuccaggaaugggcaaaagcuguaauaagcaccaacugcaguaggaugaaugcaaagccuccacagaugccaauguaaugccaugcugcaagaugggcaccaguggaaaaaugucaaauuguuacuuuuuuuuuuuuuugagacagagucuugcucugucacccaggcuagagugcaguggugugauuucagcucacugcaaccucugccucccggguucaagugauucuucugccuccaccuccugagcagcugggauuacaggugcgugccaccaugcccggcuaauauuuuguauuuuuaguagagaugggguuucaccauguuagccaggauugucuugaucucuugaccucgugauccgcccgccucagccucccaaagugcugggauuacaggcgugagccacugcacccggccauuacuccucuucuuacccacuuguuaucuuagaaaacuuagccuacuccugccaagagugugggagggagaguaccugggaagagaugcucaucaggaaugcagaaggcaauagcacagagaccuaacaggaacagcagcuugaggagccagaagcugguuaggagggagaaagaaaaacagacucaggagaaaaggcaaaggacagugaagagugccuauggggaaaggcaaaagagaaaccaaaaauauaggaaagaggacagacgagacaacuaaggaggaaccaaucccaaaugagaggggguugggacaggccuacugcaccuuauuccaaauucuaacucaaagauacuuaauagcaucugggcaauguuuuacaguuuauaaaggauuguguuaccaagauaaccccacuguuaccuccauuuuagaugcuagaagcacaaagucuggcucaagguuacacagcaaguacacgagaagcagggacuuaaaccuguuuucugucuuuuuacagugcuauuacuucaucccggaauuuccuuuacccagccuaugucuacuuucccuccucuguccccuccccacccagaaaguacacacaaaccuauuaugcagcugugcccgcgggcuggugggggaguggagguggaccagcaacacagccugcagcagguggaagguggcgguuccugcacauacucgguacacagccccagagccacugagcacuggacagucagagaggccaaacaggugggcacacaaccccgagggcaucuggaucugggagugugugugagagaaauggcaggacaagucauaaugcauggaaagguaccuacuugucacggguaugaccacucauuugucuccugcccccaaccgaaaccuuuucuaucuuaggguuuuuccuuuuaucucuucccaccugacaacccgacccccucucacuuacccugugugucuugccccacacccuuuccacuacuguccuugacagcaggaggcagcagauugcugaggcccccacauggaggaggauguagaacaggcggcugcaaguggaugcggugagagagggccaccuagaguggcagcagcuggcacaaggagcaggcccacagcagcacaccugggaguagagcagaugcaaggcagcgagguggagacuugcugaggaaaggcauacguuaauguaugugugagguuaacccaggagguugaauuccaaaauuuccccuuccccuuucuuccuuuuacucagguucuguuucaagcugauuccagccauuugggauugccgcccacugacaacuuaguagggcuuucauuauaagcaggcuugagauaucugaccuuucucucgaccuaaacaccuggggcuggaaacauggcgggagagauuuacagauuauaccuggggcaacgaaccagaacgacauuagaggagaaaagaggccugucguuuuuauuggcuucugcacgucuuccuccccagcuucggccacucuccccuucgcacccucucaccugacagaagggacuuuucacuaggacacugcugccuccgcugugcugcugugccaggcccagggaggugccggggcuggggccggccuuggcacccaccauccuugucccagggauuaggcuuagguccaccagauggaaggcagaugagagcagcaguugcuucuguccucagcccauuggacugccacuguguuggggcugagcacccggucccgggcagaauggagacguccggaagagaacacugaccuccagguugcgguaaaugcaaaugcccugugaaggagcuuuguccuuagggccucaacacugcggccacucaggcuguucucuccagauuagggggcaguuugucuaucuggcccccuguggauuagcauucuuuauugguuuaggauuagacgucauucagguugaacggaguucccugaggugggugggugcguguuuauguguugaggggacuauuccuaguuuaugaggugguuaaggauaucgguggggugggcuggagcggugucggguuaggucugagagaaggccucgcacaaaacacuguacaaacccgaaaggaagucugagagacgaaccgccuuccucccugaagcuucuagaacuggag

SEQ ID NO: 13366 - RNA, 1883 nt, Homo sapiens
acaugagguauucuucuacacugauuuuucauacaggugugcuagauuuuaaugggucacuuaaauucaguuagucuccaacauauaaauucuccacaacauaggauauaguauacacucuacuugacccaagaugauaaaacugaaaaagacaaaaaaaaauuuuauugccauaaauuaauccaguagguauauuugagaaagcacgcaucaguugguuagggcaauaagcgccucuaccacguugcccauguguucccgcaaacugcguucugcugcugcucgagauaucuccaucucagucaucugcagaaaaaaaucauguuacauagguucccaggcauuaaugugccaccaaauauacugacuccgcuuguuucaggaaacaacccaaauuaagcagaauagccuccccuccgcauacacuaguuaggcacuaccacucacuauuagcuccagaucuuccuucuugauagugacuuuugccaguucuuucucccugcaaaaauauuuaaauauauuaguccucauucucaaccaacaccauaaacucccaggaagggucauucccagaagugcccuguaaauaaaucuugauaaacccuugauugaaaauaaaaacucccacuaauacuccuuuccccuggagucuuggcagcagguguugccaggaggccuucugcuaacaagaguaaaguuguggcgccuagaucugcaggaauuggugauaaauuugaagaacgguauaaaggcuuaauaaugguuuuuauuuuugucuggggaccggggagggaagaacuguuaaaguuggcugccccugaagacuuaccgcuccuguuuggcuuucugcucccgggaccuucugucuccaaucacagacauggccuaugggaaaggcaggucuaguuacugcaccgcuacccacaauucccaauaaucuaaaaggccaacaaaacaagcgguucaugcauggauucacgaugacaaguguuaccagguagcaaggacuauguuuaauuccauucuaugcaccugagguccccuuaagcccacuaucaagcuccuuuaggcaagcggcgcgcuccggugaccgcuguuucccucggcucuacccuauugccuccuccugccaacgggaucagaaccccgucuuggagcgcuggcuuccagcuacagccucagagccccccucugcucucagcccgccccgacaugcucuuggccaaccuuaccgucuccagauuggaacucuggaucuccuucuccucugcauagucggugacccgcuccaaguccgccgcaccgcugucauguuuccguggcuucuccggaggccgcucugguccacuggucucagucuccaacuccagcuccacaucccccucggucgccauaucuauuucaccacgccgccgcauaagccccaccucacgccgacuuccggcaacugacacagcuuccgcccggggaggaggcggggcuggcccugggccacaccuucuuucugcuccaguucuagaagcuucagggaggaaggcgguucgucucucagacuuccuuucggguuuguacaguguuuugugcgaggccuucucucagaccuaacccgacaccgcuccagcccaccccaccgauauccuuaaccaccucauaaacuaggaauaguccccucaacacauaaacacgcacccacccaccucagggaacuccguucaaccugaaugacgucuaauccuaaaccaauaaagaaugcuaauccacagggggccagauagacaaacugcccccuaaucuggagagaacagccugaguggccgcaguguugaggcccuaaggacaaagcuccuucacagggcauuugcauuuaccgcaaccuggagguc

SEQ ID NO: 13367 - RNA, 5125 nt, Homo sapiens
uuaauggcuacaugguauucucuuccccuuauuuuggacaucuggauuguuucucauuguuugcuauuaaauaucccuguuacauucaucuuagcacuuuucucugcuuaucucuuuagggacagauuccuagaaauggaauuguuagaucagcuuaugcggguguauuuuuaagguuucucccuuuagaaaaaguuuugccuuucacacuuccaacaggaaagcacacaugccuguuuccucauacuugggacagcauaaaacuuguauuuauucucauuuuugcuccucuucuucuugggaguuuuuaaggaaugcagaacaaggugacucagcuaguccugucugccuugcagucccugacugacaccuugcuuuuucccuuuuauucugggcagagugguacccugaaaacagcccugcuggacuacaucaaacgcugccguccuggagacagugaaaagcacaauaugauugcccugugcuucagcaugugccgggagauuggcgagaaccacgaggcagcugcccgcauccaacugaaauugauugagucucagcccuggggugagugaggucacagccacacuaccagaacagugcugcuagcuagguaaaauuccuuuuuuuuuuuuuuuuuugagacagagucucgcucuguccccaggcuggagugcaguggcacgaucucagcucccugcaaccuccgccucccagguucaagugauucucccgccucagccucccaaguagcugggauuacaagcaccugccaccacacccggcuaauuuuuuguauuuuuaauagagaugggguuugacuauguuggccaggcuggucuugaacuccugaccuggugaacugcccacguuggccucccaaagugcugggauuacaggugugagccaccaugcccggcccucgauaaaauucuuacagcaaaggacaagagcccaugagaugggcuauuagaaucuugagguagguggcccggcacaguggcucaugccuguaauccuagcacuuugggaggccaagguagguggauugccugagcucaggaguucaacaccagccugggcaacauggugcaauccugucucuacuaaaauacaaaaaaaaaauagccagguguggcggcaugcaccuguaaucccaacuacuugggaggcugaagcagguggaucacuugaacccgggaggcggagguugcagugagccaagaucgcgcccauugcacuccagcguaggugacagagugugacuccaucucaaaaaaagaauguugagguggguaugucgcucagcaggacccccacuugggcagacagauggaauggagacuuugaaggcaugugcaauuuaggauuguacucuuggaucuauagccuauauauccaggguaucauccaccaggaaccaacaugcacguugauaccauguaagccuuccuugauguuuuggagaaaugaggcauuagaaggggcacugaauccuacugcggagugaaguuacaauaagcguaugcauuucuggcccaauaaccuuuaucugagugagguguuccugccugccugugaacauggcugggauguuucuauucuagccacgaucacaaugagugggaugagaacagugagcuuugggagucagacucggcaaaucuucuuuauuuccccuacagaggacagccucaaggaugggcaccagcugaaacaacugcugcugaaggcccugacucugauguuggaugcagcagagaguuaugccaagguaacccaaaggcuuuuuucagacuggccuugggacuugcugucugcaguaaaauuauuuucuuuuguccuugggcucuuuccaggugaagcgggagggcaucauaggccaaccaggaacagaaggggugaauaccguugugaggguucacacaggaggugacaacuaggucuuucucuacugugccucuccacccuuguuccucaggacuccugugugcgacaggcccagcacugucagcggcucaccaaguugauaacucugcagauucacuuucugaacacuggccagaacacaaugcucaucaacuugggccgccacaagcugauggacuguauucuggcccuaccucgguucuaccaggugagcaagaaagcaaacuguagccagcacugcuagcauccucucuccuucugucccacucauggaacccagagguaaggucucagggcuagugacagaaccaggacaguacaguucugauuuaacucucugauaccaacauagaacggcaauuugauguauuucucucuaguauauuguugggcagagguuagagaaugguaagacagugcugucucccuuuccugugcuguuaggccagcagagaggcagacaccuuuggcccuuuaaccccaggcugcagacugguacuggcccauggccugcuaggaaccaggccgcacagcaagugagcacugggcaagcaagcauuacugccugcacaccaucuccugucagaucagugacaggacuauauuuuuauaggagcaugaacccuguugugaacugcacaugcaagggcuucuuaugaaaaucuaaugccugaugaucugagguggaacauuuucaucccgaaaccauccccucccagucuguggaaaaauuguccuccagggaaccugucacugaugccaaaaagguuggggaccacugccuuaagacaguugagguucagaguaauacucuugcuggugguccugcaagaaccuccuagccccagcaguuacagaauggcacacucagguuaguacagcaagucagggagauugguucuagcccuuuaaagaaguggauuaucagggaaucagcccuuucacuguuccucauacugcuaaugggaauaauauauucuuagcaguuucaauucauugugaggaagauuaaaaacacugaaagaagcuaggcaugguggcauauaccuguagucccagauaugcaggaggcugaggcgggaggaucuugagcccaggaauuucugguccagccugggcaacauagugagacccugucuuuuuuaaaaaaggguuuaagauaauuuggggauuuaugagagggaaaaugccaaacacacaccugacuuuucaccaccucugauacauagagccuuuuaacauaauugguaaugaucauauucacuacaugagugaguauacaguauuguuuucuacaacaguuuguuuuugauuuuacaucagaugggcucugaugguguccuucuucaccucuccuuuuaaggcuucuauuguggcugaggccuacgauuuuguuccagauugggcugaaauuuuauaccagcaagugauucuuaaaggagacuuuaauuacuuggaagaauuuaagcagcaaagguuauuaaaguccaguauauuugaagagauuuccaaaaaguaaguauuaaaaguugacuguaaacauugcuccuugccucugcuuugaggugagacaaguguaagaauuuuauggcuaaguacaccaugccuuuagauuaccucuacuuaaaauggcaaagcaguaucaagaauccuuagaaggaagucuuuuaacagauuuaugcaaagagaucaacaagaacaguuugcucauagugcuuuguacuuuaaaaugggaggauagcuacucagugccaaaaaccuaaaacacuggccaggcccaguggcucaugccuguaaucccagcacuaugggaggccgaggcgggaggaucacuugaggucaggaguuugagaccagccuugccaacauggugaaacccugucucuacuaaaaauacaaaaauuagcugggugugguagcuggcaccuguagucccagcuacucgggaggcugaggcaggagaaucacuugaaccuggggacagaggcugcaguaagcugagaucgugccacuauacuccagccuggcaacagagugugacucuugucucaaaaaaagaaacgaaaaacacuaaaacaucagaggugccuuuuggaguacuaaacuuacucuauaagguaagcauuaacauacucauuuuuaaagaaauauuuuaucaagcaccccuaauacuagucugagauaacccagacuccagcacccucuccucuauagguaauaguaagugguacuucagagcugacagcccucacucaaaauacaguauccuaaggugggcacaguggugcacacuuguaguccuaguuacucgggaggcugcaagagaagcagcugagcccaggaguucacacucugaaaaaccacuguacuccagccugggcaacacagugagaccuccaucuuuuauuuaagagagaaaaaaaagggcagccacagugacucacgccuguaaucccagcacuuugggaggccaaggcaggcagguaacuugaggcccggaguucaacaccagccuagccaacauagcagaacgcugucucuacuaaaauuagaaaaauuagccaggguggugacacacucauguaaucccaccuacucgggaggcugaggcacaagaaucacuugaacccagcagguggagguugcagugagccaagacugcuccucugcacuccagccugggcaacagaguaagacugucucaaacaaaacaaaacaaaaaacaguaucuuaaccuguacauuauguuucuuuaucuagauauaaacaacaucagccuacugacauggucauggaaaaccugaagaaauuacucacauauugugaagauguuuaccuguauuacaaguuggcauacgaacacaaguuuuaugaaauuguaaaugugcuucugaaggacccucagacagguugcugucuaaaggacaugcuagcagguuagaugauuucauaggugucuguuuucuuguacuguuagcagauucugacagaugugaugagaagaagaaugcauuggagaucuuugcuaaaguugaacaaucccgguacuguaccauaucaguccuuuguggguaguagguagcaaguaagaaacuuuucaggaggaaauuccuauuuaaaauagauugauuuuagaugauuguucauccacaccauuuuauauagauacuaguauuaagaucaaaagcuuccucuu

SEQ ID NO: 13368 - RNA, 3025 nt, Homo sapiens
acucccaguguaaucauaaaacaauaaaaagcaacagcauguauuuuguacauguauuuuguaaaaaauaaagcauguauuuuguuuuauuuaaacaaaauacauuacugcaauccagaaacuugagagaaccacauacaggauguauauaagcacaacauccaaauccuuaacacugggaacuagagaaugcugucagagagguugggaauccccgggggguagggcaccuguucccugugaugaaguaagcagcucccgugucaccucuucugccacgaguucagccacaguaucuggcuuaaggcccugugugcugaugaaggccugggcucguuugcaucggucaggcugcugagaggccaagauuuuccggagcauggcuucaccauccugagcagcaacaucuguguaggaacagcccaacuccugagaggaagacaaagccagucaaggccacuuuuagaagccaggaaaaagcaaaagagcccuuucugaaaucugauguggacagacuccacuguauucugagcuuacagacuccucacccucagcaggaaccuuagaaaaagcaaguacuguuuucuaacccuuucuaucauuucaccaaagccaaauccagguaaaagaaaggcuuguauucagaaagcaucagguuauucucuuguuggacacuuauuuuuuuggcggcaggguugggagggguggcagaguuucacucuuguugcccaggcugaagugcaauggcacaaucuuggcucaccacaaccgcugccuacuggguucaagcaauucuccugccucagccucucgagcagcugggguuacaggcaugugccaccacacccagcuaauuuuaguauuuuugguagagaugggguuucuccauguuggucaggcuggucucaaacuccugcccucaaguaauccacccgccucggccucccgaauugcugggauuauaggcaugagccaccaugcccagccugauuuuuaaaaauauuaugaaauguaagaacaccgacuaaaauacgagagccuuuauuauucccagagcagcagcaaaacccucaauuuccaaagaagucuuugagucuucuccaagacgagggcuuuaggguuuggcuuuauuucucuugugcucuucuacuuccagucuacuguuuuucucccccaagcagcgcaaagguacagacgauuucugcuuccucuggcucuugucuuuauagucaucacauuccauauggaaugcuccacacaaucauaaugcaaaacccaagauauuaagucuagaagagacccucauggucaaaucaucauuuauagaugacgaaacaggggcccacagcccuagcuuucugguuugcugagcugcagccaggagucagaucgcccuggcaccuggccugguguccuccccaccauuccccaaagauaaaauuaugagggccaacauccugauaagagcucuacucccaggucaugauuaucaucuaaaaggcugacuuggcaauguccaaaaucaaccucaaacuucucauuucccucccucucagaaagaggagccccaccccuuggcacauaccuuggcaagaucauacagacagaggaccugucgacaguaguucuucccauggaggcauuugcuugucagcacuuccagguuaguuaccacuucauuacuggagggcacugucacaaacuucugacuauccagacuugaagcuggaagcaaauacaagucugaggggcucuaagcugggagguucuggccucucccuagcucucuauggcucuaccucucugcuugaagcucccugcacugcacucccauuacucugacuggggauaggaccacugcugacagggccccaccucaacuucuuucauugcccucuuccaggaaaucccacccugggauacuucaaagaccucauaugcuacaaagaucaaggccaccuaaugagugcucuagagaucagcaccaaagaugcuugccagagucuucucuauauguccucccuccuguaucaaauaagucaccaaguauagcugacuaucuccauaacaucucuccaguuguggccuuaguuccagccuucaucacucugcauucugaggagcuguuaucugucuccugcugccagccccucacccccagucggucuccaacauacuuuuuuuuuuuuuuuuuuugagauggagucuugcucugucacccaggcuggagugcaguggugcgaucucagcucacugcaaccucugccuccagggcucaauagauucucgugccucagccucucgaguagcugggauuacaggcgugcaccaccacaccuggcuaauuuuugcauuuuuaguugagaugaaguuuugccauguugaucaggcuggucucaaacuccuggccucaacugaugcauuugccucgacuuccaaaagugcugggauuacaggcaugggccacugcacccaccugcaaauaugcuuuaauuuauaguaaaauuaaaaucuauuccugauuuuuuuuaaaacgaagcucuuggacgggugcgguggcucacgccuauaaucccagcacuuugggaggcugaggcgggcggaucacuugaggucaggaguucgagaccagccugaccaacauggagaaacccuguuucuacuaaaaauuuaaaguuagcugggugugguggcgcaugccuguaaucccagcuacucaggaggcugaggcaggagaauugcuugaacccgggaggcggagguugcggugagccgagauugugccauugcacuccagccugggcaacaagaaugaaacuccaucucaaaaaaaaaaaaaaaaaaaaaaaaagcucuuagcuuaaaauaggagaagauauuaauuugauaaaggguuucuauuaggaaaaaaaaguaaggaauauuuauaucacacuuuguaauggcaaaaacaaaacagaaaaauuuaaauguauaucaauaaagcauuauucaagcuuaguacaucuguacaguggaauacucu

SEQ ID NO: 13369 - RNA, 1359 nt, Homo sapiens
agaacacucacagaauuuuuauuuauaaucauucaaaauuagaaacaacccaaacguccaucaacagaagaauaaacaaacugugguacaucucuacaauagaauacuacucagcaaugaaaaggaacaaacugcugauacacacaacagcauggaugaauuacaaaggcauuauggugaguaaaagaggccagucucaaaagaguauauuuaguaggaccaaaacuggauuugguagaaaucacaucagugguugcuucuaggagcuaggggagacgaaguggaaggggguacaaggggaguuucuggggugauggaaauguugaaacauucuaugucuugaccuggguggugguaaaacauguacaugauuauuuauuauaccucgauguaaaauauuuuacagcucagcuuuuuaggaaagagcccgaugaaaaaggaaaagaaaaguuaaagagcugaguauggaggggauguuucagccuggcucuugcguaaggugaccagcugucccaaucugccugggacugaugggguuuccuggggcaagagacuuucagugcuaaaacagggagaguccugggcaaacuaggacagcuggucacccaacucuuguggaagaggggaauugagaucgaguacugaauaucuggcagagaggcuggaauccuucagccccagagcccagggaccacuccaguagaugcagagaggggccugcccaggggucagggcaguggguaucacuggugacaucaagaauaucagggcuggggaggcaucuuuguuuccuggugcccuccucaaaguugcugacacuuuggggacgggaagggguagaaguagggcugcuccuuuuggagcuggagggaauagaccuggagacagaguugaggcagucgggcuguccagguucuaagcaucacagcuucugcacugggcucugaggagauucucagccagaggaucccagccuccuccucccucaaaugucaguccaagcaaauaccaaagcaacgcaucgauuuuguggaagucaauuagagauguggggagcuaucggagacaagcacuauuguaccuuuucaccuccacacuugucacaagcagggacugucuccuccccacuuugcuugccacgccugccauggcuugagcuggggugaggaguggucuuuaucuucuuugggagauccugacugguugcgcacuugcuaagggcaggaagucuggagggcugcaggaauggugccguugauaaacagguggacuuauaaucaucaugcacugcaauuguagaacauagucuccugccuuuucucauuuguauaauugucugggucaauauucucccaauau

SEQ ID NO: 13370 - RNA, 31111 nt, Homo sapiens
ugcccuagcgcaugcgcgcaaucugcuuccggccugcgagcucgguguuccgcuuuuugugggccggguggguuuccuaaucugguuucgucugccugguucaucugugugcgauggcuccggacucggaucccuucccugaagggccgcucuuaaagcugcuacccuuagacgcuagagaccggggcacccagcgcugccgccugggcccggccgcccuccacgcccugggcgcgcgcuugggcucggcagugaagaucucgcuacccgacggcggcuccugccucugcacugccuggccucggcgggacggagcggacggcuuugugcagcuggacccgcugugcgcgagccccggggcggcggucggggcgucgagaucccggaggagucucagccugaaucgccuccuccuagugcccuguccgccccugcggcgcgucgccguguggccgguguugcgagagcgggcaggcgcgcccggugcccggaauacagccgcggugcuggaggcggcacaggagcugcugagaaaccgaccgaucucccugggccacgugguggucgcuccgccaggcgcuccuggccugguggcugccuugcacaucgucggcgggacgcccagucccgaucccgcugggcuggucaccccucguacccgcgucagccuuggcggggagccuccgucggaagcccagccgcagcccgaggugccccugggaggucuuucggaggcggccgacucgcugcgggagcuccuccgccucccgcuccgcuacccgcgcgcccugaccgcgcugggcuuagcggugccucgcggggugcuccuggcggggccccccggagugggcaagacccagcuggugcgggccguggcgcgcgaggcgggcgcggagcugcuggcagucagcgccccggcgcugcaggguucccggccuggggagaccgaggagaacgugcggcgggucuuccagcgcgcccgggaacuggccagccgcggacccagccuccucuuccuggacgagauggacgccuuguguccccagcggggcagucgagcacccgagagccgcguaguggcccagguguugacgcugcuggacggcgccaguggggaccgcgaggucgugguugugggagccacuaaccggccggacgcucuagacccagcgcugcguaggcccgggagauuugaccgagaggugaaugggcuuggcggguuugcccacugucgguggaaccucggccgcuucuggcgccauuuggcugccccggaggcguuugccucuuagguuugagcaucggugagguuggaguuggggcucuuugcaaugcagagaacacguucucugccgauauaugaucugugagucaggaccuguauuuccccagagucaaauugucaggaccugugagucaggaucugagagucaggaccuguuuccccagagucuaauuguuuugggaagcgagguguccauuacagauuaauuuuguugugcagguccuauaaucaguaauguuaauucuuaagagaauuuuggucaccuacaagcguguuaaacucauuuuuuggaaugagaauuuaaagaaggauagccucaagaaguaaguguguugaaauaaaaagggagaagguggggaagaacuaaauggaagcaggcauuaacucuucuggauuuauucauuccuugucauaacaccagcauccuauuccacaauugaggagguacccacaacugcucccugaguugucagggagguugaauauucagagcuguccuauuuuaagcuuugguccuaaauugacuugaauucuaaagaacaguuugaaauuuagugacugauauuucuauuuugugauaggauucaaaagagaaaugauaauuacacacuuuuagcucaguuaguucaggacuugaguggauuucuuccuugcacuaucuaguaccuguguccuuaagggcagggaccuagcuaucuauaccuggcuucuagaacuuuguguguucuuaaaaauaacaaaaacuuguuaaaugacauagaauuuucauugugcaacuuucuagccaguguuacuccucuggaauauuaggauuuucguauauucagaaucuaaaguauacguaaagugcacgguacuaguuccaaagugguucacuaaauugucguacauguuugucaggauaaaaaacauauuauuauuuuggccgggcgcgguggcucacgccugcaaucucaauacuuugggaggcugagguggguggaucaccugaggucaggaguucgagaccagccuggccaagauggugaaaccccgucucugcuaaaaauacaaaaaauaagccgggcaugguggcacaugccuguaguucuagcuacucuggaggcugaggcaccagaaucacuugaaccaggagguggagguugcagugagcugagauggugcccgcugcacuccagacugggcagcagagugaaacugugucucaaaaaaaaaaaaaaaagaaaaaaaaaauauauauauguauacacacacauauauaaaauuuuuuuggaaguaauucuuuuuuaauugaucuauuuuuauugauacauaauugugcauguuuugggguacaugugauauuuugguacaugcauacaauuuguaauuaucaaaucagggugcuuaggauauccaucaccucaaacauuuaucauuucuuaucugaguguugggaauauuucagauucucucuaguagcuauuuugaaauauacgagaaauuauuguuaacuauagucacccuacuacacuaucaaacauuacacauauuccuucuaccuaacuguauguuuguacccaugagccaaccugucuucauccccucacccccaacccuucccagugucugguugcuaucauucugcugucuaccuccauccaugagaucaacuuuaaaaauaauauauuuuaaacuauauacuucuucuucuuuuuuuuguuuugcuuugcauauagguggucauugggacucccacacuuaaacaaagaaaggaaauucugcaagugauuaccucgaagaugcccaucuccagucauguugauuugggccuucuugcagaaaugacaguuggcuauguuggugccgaccugacagcacucuguagggaggcugccaugcaugcccuccuucauagugagaagguaagaaguguuaauuuaugaacaucuauguuaaucuauuauuguaacagauuaauuuggggguuaaaaaaaagcggugaguacauuuuccuuagaacauuugauagcuuccacagcuguugcuuauacauuuuacaucucaacucuauauaaauaguauaugauugaggguggggauaaagggcugaguccucugggucuacugagugaauuuguucccuacucuuauaguaacucccuagugcugaagcccagagcagccaagaaauaguguggccccagaagaaucaaagaguuuuuuuaauuugaauuuuuuuauuuugaggcaauuucagacuuagaaguuacaaaaauaguacaaagaguuuccauauacccuucuccuagauucuccaaauguaacauuugccacauuugcuuuaucauucucucuucauguguauuuccuuauauauauacauauauauaaugaaauauuugagcauauacuacauccaugaugccccuuuacccgcgaaaacguaaguguauauuucugaaaaacaaggaccuuaaccacaguaugaugaucaagcugagaaaauuaacgcagacauaauacuuguacuuaaccuaaauaggccuuaaucuagaaucauacuucaggcuuucuucuaugaaaacauaacuuuuuaagagucaguuauucuguggaauauucgucaguuuggguuugacuaauguuucuucaugauucaauucagguuuugcauuuugggcaggaauauaauagaaaugauccugugucuuucucauugcaucuguuaggcagcacaugauauguuucuguucuaucacuggugaaguuaacuuugauuucuugguuaagguggugucugugagauuucuccauugucaagauaccguuuuucccuuuguuauuaauaaguaucuagugggagaaauaagcuuuucuaaccuaggagaagauugggcacuuggaauuguauuuaaauuuguccuugaucugcaggucuguaauucaugacuauuuccuaacaauauuuaagauauuagauuaaauauaauacuuuucaacuuuguugguuguaaaauccaguauuuuguauauaauaaauaguccugaauccuuaaacccauucaggaaaaaacugauuucagcaggcuaaggauucugaaacagaguuuucaaucucauuuguaacaucaaaauugucuuuucaucuuaaacugcaaaagaaugauuuauuauccuaaauuuugaaaaaccuuuuuaccuaaauaauuuauaccuugccucacuuccuuuccuuuauuucuacaguuacaccgaagguggggaggaguuaugugaucuucuaguugaucuuuuaagucuucaucuuguagguuuagaccaaaacuacuugaaguuuuaaaguucuguguguaaagaugugagaauagaugucuuuugagggagacaauaaguaagcaggagaugggaagggagauuuacauucaggauuuccucugcuuugaaguuccagguuugaccauaagcaccucucacuuagguggaccagucagcugcugucgucccaggguggagcccacugcuacuucaggaggggccugcucagguguaguuaccacaggugauggcugaguucagaaacaacccaggggaaguggaaggaagaaaggcaaaaagcaugaagggacagacaacugggaagguacuggcuccaucuuuuauucuuucccccaccagcugaggggcugcugcuaccucucccuguaccagggcagauaagggauaccuuacacuuuguuaaacuuuuugugaaguauuccuauuaaaggauuagaacuguaguuuaacacucagacacacacagaggggaaagaauguauaagcccaaagaaucaaguaaaauaauguguacacacaugaucuugaacuauaaaugagauuuucaaauauuaguucguguuaccuaaagauuaguuaauauuuggacaucagacaccuaacauacuaucagccaguuaaaaaggcuuuuuuuuaaguauauaauaggguuauucaugagaaaugaagauagaaaauuauaaagaacugccuaccugaaaucucacuuuccagagaugacaauuguuaacacuuuugggagaauacuuuacagaauagcucuauacauacagauucacuuaacaucuguuuacaaauaagaaaagacaguuuguuuuugaaaacgggaauuuguggacaacuagauguuuagaauuggauauaagagggcaaauacuuuaauaaauacaguacagauauuuuuaauaaaauuuucaggacuuuuuaacuaacaaaaaaaaauguguuucacuagaaugaucaaggagaauguaaagagucuccaaaauauaaccugagagugaagacgacuucucuaggcauaacauaaaccuuaauagccaaaaaagagauuauuugcugaguugaccauuuggggguggcaaaacaauacuauaaaguagucagacuaggaaaaauacuuuuaguccaauuuccuugauagggaaugaacaaaucuuacaaaucaguaagaaaagaccaacaguccaagagaaaauggguaaugggguaugaacagguaguugacaauaaaaggaaugacaauaaacaugaaagauguucaaccuugauuucuucuaaaauuauugucuuuauuuugaaauaauuaaaacuuauaggaaaguugcaagauaguuacaaagaacuuccacuaaacccuuuauccaaauucaccaauuuuuaacuuuuugccaaauaagcuuuaucauucucuuuugcucuccuugcucccucuccucuucucuuucucucucucucugucaucuccauauauauguauuuauaugcacauaguauuuauuuauuuuggacuauuugagagaauggguugcauauaucaugacacuuuaucccuuaacauuuuaaugucuauuuccuaagaacagaaauguucccauaugucaccacaguauggugauguauaguguuguguccuuagagccucacauguagaggcacagaguguacauugguuccucauuggugaugcuaacuuuuaucaacuaguucaggcagugcgcaguuucuccacuguggaacugcuauuuuucccuuugccacuaaugagaaaucuguggggagacacuuugagauauccugcuccucaucaaacuuucaggcugggcacaguggcuuacaccuguagucccagcugcucaggaggcugagauagaaugaucacuugagcccagguguucgaggcucaaugagcuguugccucaaugccacugcacuccagccugggcagcagagcaagacccugucucauaaaugaauaaacuuuuacuccccucaacauagcauccaauucuugcucauaacagccuuuacuaucaugauugcaagacgggcgauuuuuuuaauuccaauauucccucuaccucauuuugaauugaagaaauuuaguuaacacaguaaugaaugaguacugguucuuccugucauauuggcagacauuuaagaguuuggaaaugggccacgugcgguggcucacaccuauaaucccagcacuuugggaggcugagaugggugggucaguugaggucaggaguucaagaccagccuggccaacauggggaaaccccgucucugcuaaaaauacaaaaauuagucaggugugguggcucaugccuauaaaucccagcuacucgguaggcugaggcacgagaaucauuugaacccaggaggcggaggcugcagggagccaagaucacagcacugcacuccaaccugggugacagagugagaccccgccaaaaaaaaaaaaaaaaagaguuugauaaugucuguacuggagagguguggagagaacacagcuucauauuaucggagaagaauaaauuguugcagcuuccuuagaggacaauuugguaauagcugucaaaauuguauauguguguacuuguaaacccaguaauucuacuuugaggaaauuauuacauaaaauacuugaacaugaguuugaacaugguggcucaugccuguaaucccagcacuuugggaggcugaggugggaggaucgcucgagcccaugaguuccagaccagccugggcaacauagggagaccgcaucucuacaaaaaaaaaauauauauauuuuuuuaauuagccaggcugguggcacauaccuguaguucuagcuacuccggagggugaggugcaaggauuacuugagccugggagacugcagugagcuaugauaacaucacugcauuccagccuggguaacagagugagacccugucucaaaauaaacaaauacuugaacaugagcacaaagacuuuuucaguugcagcuuuguuuuuaauaucuaaagacuggggaugaccuaacguuugucagaaagguguaguugggguaaauucaguaguguauuauggaauugucaaaaagaaugacguagaacuguguuaguugacaugaaaagcucucuaagauaggugaaagaagaaaaguacaggcugauauaguaugguuccauuuguguaucuguuuaaaaggauauauguaugcuuacuagcauaacauacuggaaaaauacacaaacucuugacaucuuucggggaagaauuacuggcaggaauuggcagggagacauuuaauucuuuguacuauguauauaaauuguuuuuauaaugauaacaaaauaacuuuacaaauccaaaagaagauuuuaaaaacaaauugugcuauaaaaaaagaccaaccuaauuuuugguuugauuuugcuuuuuuggguguauuucuucagaaccaggacaauccugugauugaugaaauagacuuccuugaagcuuuuaaaaauauucagcccucaucguuucgaagcgucauuggauuaauggauaucaagccuguugacugggaggagauugguggccuugaagauguaaaacugaaguuaaaacagguaagacagauaaucuacuuaauccaguaggauauuacagauuaacauucugugcauuuaugaugacaacauacugcgcugaaacugcucuugcuccuaucacuaaugugauccuaacaucuaaauccaaugauugcuuuucaguccuuauuuaauuggacuucuguggaugucuaaacugguuuuuauaauuucccaccucgacccucucuuuguuuuugcuuuaaagaguuuauaaccuaaggcugggugugguggcuuaugucuauaaucccagcacuuugggaggccaagggaggaggauugcuugaguucaggaguucaaaaccagccugggcaacauagcaagcccuugucgcuauuuaaaaaaaaauaaguuuauaaucuaaggcugggcgcaguggcucauaccuauaaucucagcauuuuaggagguugagguggguggaucaccugaggucaggaguucaagaccagccuggccaacauggugaaaccccgucucuacuaaaaauacaaaaauuagcugggcaugcuggcaggugcccauaaucccagcuacucggaaggcugaggcaggagaaucacuugaacccgggaggcagagguugcagugagccaagaucccaccacugcacgacagccugggcaacagagaaaccguguccggggggaaaaaaguguauaaccuauagucuuagcacuuuagaaggccgagacaggaggaucucuugaggccaagaguucaagaccagacugggcaacaaaguaagacuccccaucucuauuuaaaaaaauuauuuugacacauguuugcucugucacccaggcuggaguauugugucacaaacacagcucacugcacccuugaacuccugggcucaagcaguccuucugccucagugccccaccaaguagcugggacuacaggugcauaccaccacgccuggcuaauuuuuaaauuuuuuguagagauagagucccacugugcuacucaagcuggccuugaacuccugggcuuaaacaguccuccaacucggccuccuaaaauggugggauuauagucaugagccaccaugccuggccuacaaaaaauuuuuuuaaauuagccaggugugguagcacgugcuuaugguccuagcuacucaggaggaucacuugaggcuugaccccaggacacccaggagaucgaggcugcagugagcuaugauugcaccacugcacugcagcuugggcaacagagcgagauccugugucuuuaaaaaaaaauuaaaaaacaauuuugacugggcaugguggcuuacaccuguaaucccagcacuuugggaggccgaggcaggcagaucaccugaggucaggaauuagaaaccaaccuggcuggcauggagaaaccccauuucuacuaaaaaugcaaaaaauuagccaggcgugguggcgcaugccuguaaucccagcuacucaggaggcugaggcaggagaaucgcuugaacccgggagguggagguugcagugagccaagaccacgccauuguacuccagcuugagcaacaaaagugaaacuccaucucaaaaaaacaaaaacaauuuauaggccgggcgugguggcucacaccaguaaucccagcacuuugggaggccgaggcaggaggaucacgaggucaggaguucaagaccagccuggccaacauggugaaacccugucucuacuaaaaauacaaaaaucagccaggugugguggcgcaagccuguaaucccaacuacugggaaggcugaggcaggagaaucgcuucaaccuaagaggcugagguugcagugagcugagguugcaccacugcacucuagccugggacagagugagacuccgucucaaaaaaaaaaaaaauuauaaucuaaaacgggggucaacagauuucuguagagagagccacauagucaauguuuuaagcuuugugauccacagucucugucauaaccacucaccucugccguuguagcaccaaagcagcuguagaccauauguaaauuaguaauuguauucugauaaaaguauagacacugaaauuauauaauuuucacaugucagaaaauauucuuuugauuuuuuuucaagcauuuacaaauguaaaaacuauucuuaguuugggcuguaccaaauaaagguggaaggccuuaguuugccuggaucucugaucuaaaagacguuaaauggaugcaguacagggacugguaaaagcacaaaauugaaaugaacaauauggcuaccugauaguggauuucacaguggaagcugugggacgcaacucuucagauccucucaccugcguuacaguuucagaaauugauuuugccaauucgccuacaugugauccugcccuaaugaacuagguuucucuaaccacacacauaacagacugauauauaaguaauaauuauaauuuauucaucuuaaccaggagaucuaucuccagugaacccuagaauuuuugaguccauggauaagagcauuuauaauaugcgccaauauuuuuuaugcauugucucauuuaauguucacaagaugcaugagagaaauuaaccacaccuuccuguuggaagcacucuguuuccuuagcuuugagacauuaagcuuuucugccuuucuggccacccucuccccucccuuaaauguuagugcucaagaggcucccagaguccuccucuuguuggagcugugggugauuuuaugaugaucuugauguccacagcaucccugaaaacuguugacucagaaaucuguauaucuagaguagacauuucuucugaucaucagaacuacuucacugccugccuacuggauaaccccagggaugucaaacucagcauguaaaaaguucagcuagucagcucugcccccacacuuggauucccuaccucaguuaauacagccagccaccccauccccuaagucagaaaucugucuucuaaaggcauagcaucagaacuuugucccuauguaaaguacaauucuguuuuauguuucaaauauccaucccuuccacaccaucuucacugcuugugacacuccagccuuauuauuuuuguaggcugaaucauugcaagaaacuuguagcuggucucccugccucuaguuuaauuuccuuccaguccauucuccauacugcuuccucagugcagacuaaagcuuucaaggccuauugugaucugacuccuaccuccacuucaacaccguugcuccuugcuggugcucuugaauuacauugucuggggucaguauugguucugccaccucauuagcaguaagaccuaggcaaauuacuuaacuuuuuuuaggcccgaguuuuuuugcaucuguaaaauaaugauuaaagugguuaaaaaccauuuaccuuaaagguaaugaggacucauucauuauucgguuuacuguuacugagugccuccuuuggguaggugucauucuagcugcuggggauuuugaggugagcuuugcuuacguucuagcagagcagaaugacaaacccaacguggaaaaauaauaauagugaauacuugcuuuaaaaguaaaggaugggcaguagcauagagagugaguaggaggaggggguuccgcuuuaaccagguaguuaggaaagacuaacuccaaggaauugacaccugcgcugagaccugagugaugagggauagccacacgaagaucuuggggaacguucaggcagagagaaaagcaaggaaaggcucugagaugggaacaaacuaaguguuuaggagacagucagauuauauaaggccuugucagcuguggcgaguaaggaguuuggauuuggauuuuauucuaguucuaauaguaaaucauugaaggauuuuaaacaggaagugguaucaccugauucaaaugauaagaucucugcaguguggagaauggacuguuuccagcucauaauaggaggcugagaauuguuaaaugaagaaaugaauuuacuggaugauaugacauuuuauuauuauacuaaaacaacucuucucuuuuuguguacuuucagagcauugaguggccucugaaauucccuugggaauuuguuagaaugggccugacacaaccaaagggaguucuccucuaugggcccccuggaugugcuaaaaccacucuggugagggcccuggccacaagcugucacugcucuuucguuucagugaguggagcugaucuguuuucaccguuuguuggagauucagaaaaaguguugucucagguuuguuuauuuccccauauguuuaaauuuacuuuugaauuuuuauuucauuucuuauggacaaaccuuuuuaaaaauauuacuaguguuuuuuccaguuaaaaaauuuauacguuuauugaaaaauuuagaaaauauaggaaaguguaaauaugaaauccuucauaauccuccuaccuacuguuaacauuuuggugaauuuccuuugucuuuuuuucuguuuuaaauaaaaucaaagguagguuuuauauaucuauagcuuuauccugcuuuuuuaaacuuaauauuacuacuuuugaaauuuauaguauucuuugaaaauaugguuuuuaacucuuacauaauacuccauuguuucuuguuuuauuuacucauuccccaauucauagacauucagaaucuuuuuuauaucuauuuuaaaaauuauaaauaguggccaggcaugguggcuuaugcauguaaucccagcacuuugggaggccaaggcgggugaauaacuuuaggccaggaguucaagaccagccuggccaacguggcaaaaccccgucucuacuaaaaauacaaaaaaauuaaguggacgugguagcgcacccuauaaucucagcuacucgagagacugaggcacaagaauugcuugagccugggaggcagaaguugcagugagcugaaaucgcaucacuacacuccaaacugagcaacagagcaagacugucucaaaaaaaaaaaaaaaaacaggauuauaaauaguaauaucacaugacuaauguauaacauauagcuuuuuaauauuuuuuuccuaacaaaagauauuucgacaagcaagagcaagcacuccagcaauuuuguuuuuggaugaaauugauucaaucuugggagcucgcucagccagcaagacaggaugugauguucaagaacgaguucuuucuguucuccugaaugaauuagaugguguuggacuuaagacaauagagagaagaggaaguaaaucaagucaacaggguaaauacaaggagcugaaaaaaugaagagguauuuauuagccagaaugcaccuaaaauccaggccaacauuaaauauaaugcauauaugcuauagcuuuaccuaugcugaauucaucucauagaaggauuuauauaauuucaguuugacuuuguuaggacuuuuagagcuaauaaaaauugugauuuggcuaggaaaggugagguacauuuuauaauaaauuaucuuaaauauaagaaugugaauuuuauuuuuccuaagaaugagaaauauaauuuuacuuauugcuaauagagaaggcaguuuauucuuguuugcauguccuaaaaaccaguauucauuucuuucuaaaaauguuuauguagacugggcacaguggcacacgccuguaaucccagcacuuugggaggccaaggcagaaggguugcuugaggccaggaguuugagacuagccuggccaacauagcaaggccccauaucugaaugaaugaaugaaugaaugaaaaacaaaggagauuauuauuuccaauagucuuaguaauggaacauuuccaguuuucuugaggaaugaguuucuuugguuuuaaugaauuaaaauggccuuuggaaguccccucccucuuucugagucucuucuccagaugaguuugguauccuuaaauugucccugauacuuuuucuuuuauuccucucucguucucauucuuuuccuauuuuaaaaauugucauauggaauuguugcauacacuccuuaggaauaugucacacuagaauuaggagguauccacgagguuaucuaaucaaaucauuucaaaaugcaggaauuccuucuauagcaucugacagguauucacccagcaucugcuaaaauacuugcaaauauagggaacuuuguacuuugagggauuacgucacuggagagcugccugauuauucaacaaaugauuuugaaugcuuaguauauguaaagccuuucucugucugcuuuuagacauuucuuuauccaggauuugcgcaccugcaacuuagauugucauuucaaagaaaaauaaaaggucgaguaaaucuuccucuuuagggauaugagagucaagacuuucuguagccauauaucuccaccgguuggucauaaguaucugucuuuuuaaguagccuguuuaagguguaagccuucauuggaggcucaggugcacucaagucaccagaugaguguucuccccuuugggauaaggcuuuucauagguucucauauggagaauguuucucuuagcuacucccuuagccaugcacacaaaguagcucuuugguuaaugauuuguuucugggauaucuugauaucaagaagcuggucuggaaagcggauauaagcauucuggucccaagaaaaggauaucccuauuugaauuuaaauagaccuucugauuuauaauuuuuagaaaacuuauuaacaacugauugacauuacuuuguguuguguguuugcccucagaguuucaagaaguuuuuaaccgaagugucaugauuauugcagcaacaaauagaccugauguguuagauacugcuuuguuacgaccuggaagauuagauaagaucaucuauaucccaccuccagaucacaagguagucauuuacacauuuacucugugugagcucagcagaauugaauuccaacuuggauauagguguccaugguguucuacuuacccuggguuccgccuucuuccuugccugguggccuuucaugacaucauaauuuugaucuuccuuuguuggauacucugaucuuguucacagagaaacauaagccuaaauauauggugguuauuuuuuguguuguggcagacucuaaauacugagucuacucagcguuauuuugcaacuagaguggaggaauccuaaaguguuaaaagggcuuugaagauugagucagcauccuuaucauacagugcagaagucugaaauuacagagauuaugcaguguaucguggucaaccaguaaauuuguuguccguaaaguacggugcagaaaucugagauuacagagauuaugcaguguaucauggucaaccaguacauuuuuugucguuaacauccagagccacugacagggagggugaaaggcacagagugaauuuuuuuguuccuugggcuuuuaucaaguuuugaagggauagaaaaauaaaauuuaauaucuauuauaccuuuaaguuguaucugauaauucauguauuugcuucuuaagccaugucugauaguauuauuuguacccaagagagagauuuagccgggcgugguggcucacaucuguaaucccagcacuuugggaggccaaggcggguagaucaccagaggucaggaguucgagacuagccuggccaacauggugaaaccccaucucuacuaaaaauacaaaaauuagcuggaugugguggcaggcgccuguaaucccagcuacuugggaggcugagacaggagaaucacuugaacccgggagguggagguuguagugagccaagaucgugccaguguacuccagccugggugacagagcgagacuccaucucaaaaaaaaaaaaaaaaaaaagauucauaaguuuuuuaugaugucguuauuuuuaccauugucauauaagccauugaugacuuagucuuucuaaccccuauauauauuuucucgguaaugugaaaggaaacucaagcuaaaaauauuuuaauaaaucauugugucaaacauaaauguuauaagauuuaaaauacuguuuuuuauuuuguuccagggcaggcuuucuauuuuaaaagucuguacaaaaaccaugccaauagggccugaugucuccuuagaaaaccucgcagcagaaaccuguuuuuuuucuggagcugaucuuagaaaccucugcacagaaguaaguuaauuauugaagaaauuugugguucaaaacauuucugcaucuuuucaaaucuucauucacucagcaguauuuacuaaaagccugugugguaccaugugaugugaaacagacagauguggccccaucccucacacagcuuauuguaagugugggguggugaggaggguggugcagagaggcaaaucuuaauacugaguuggcaauugaaaauauguagugaguugcggaaguagaggguacugugggagcaccuaggaaagacaccagcccagauuuggcacaucagagaaggcuuucugagaaaggagauguauaaacugaaauuggaaggacaaaucgggaguuagccagcuaagaagggaagggggaauguuugagguggagagaauaaaaugugcaaaggauugaagauaagagauggugugacauuauugaaucuuagaguggagaauggcaagaaauaaagcgaaagaagugggcuaggcgugguggcucgugccugugaucccagcauuuugggaggccaaggcgagaggauugcuuuagcccaggaguuuaagaucagccuggguaauacagugagaccccaucucuagaaaaaauaaaaaauuagucaaaugugguguuagucccagcuacgugggggacuaguagucccagcuacuugggagggggagaugggaggauugcuugagccugggaagcgaagguugcaguaagaugagaucgugccgcugcacuccagccugggugacagagugagacucugucucuuaggaaaaaaaaaaagcugaaggaguagacaauggccaggacacacggguccuuguaaaccacucuaagauacccuuuuucguaaacuuuuacuaaauauaacauucagaaaaaugcacggaucauaaggguacaguucauugaauuaaagugaucacauuuuuauaaucacuacuuaugucaagaaauagaacauuauaaacaccccagaaucuuccuuugggcccuuucccaaccucugucaccuaccuucuuccaaaagagaacuauuggcugggcuuagugacucaugccuguaaucccagcauuuuguuggggccaaggcaggaggaucaucugagcccaggaguugagaccaaccugggcaacauggggagacccugucucuacaaaaacuuuuaaaaaauugucccagcuacucaggaggcugaggugggaggaucacuugagccuggaggucaaggcuguagugagccaugauugugucacuguacuucugccugggugacagagcaagacucugucccccccccccaaaaaaaaaaaaaaaaacaaaaaacaaaacaaaagggaaccacucuccugacuaacaacaguggggauuaguuuugucugcuuuugaacuuuauaugaauggaagcauguggcauauguuauuuucugucugguucuuuaaccuaaaaagaaauuuauccauaguuuuguguguagcauaguuuauaauauucuaguauaugaauauucuacauuuguuuauccauucuuuuauuuuggaauaucuggguuucuacuuuuuugcuauuaugaguuaugcugcugugaacagccuuguacaugucucuuaguucccgugucuauuuaugucuauuuguaaacauaguuagcuacaaggagaauugcugggucauaggguauguguuugaucuauuccuuuauaaucagugcuggcugaagacucuucccuacuuaacgaucaggaagauauucucucaucuuuaaaaauacauauggguucauaaaauacauauuaaucugcaacuugccuuuucuuucuucucauuuaaugcuuucuuuuuucccauuaauguaaagagguuauggucugcaaaguggauuucuaaucaccuuauuuaacuuuuuagcauaauguuuuuagugacaugaaaauuagaauccuaugaagugaggcugagauuuuccauucagaguuuaaaguauuaccauauauuguuaaaaaaaaaagaaaagaagccaggcgcuguggcucacaccuguaaucccagcacuuugggaggcugaagcagguggaucaugaggucaggaguucaagaugagcccggccaacauggugaaacccugucucuacuaaaaauacaaaaauuaguugggcgugguggcagccuucuguaaucccagcuacuugggaggcugaggcaggagaauugcuugaaaccagaagacggagguugcagugaguccagaucgugccacugcacuccagccugggcaauaagagcaaaacuccaucucaaagaaaaaaaagcaaaagaaauuguuuucuauugcuugucucuuaauaggcugcuuugcuggcucugcaagaaaauggacuagacgcaacuacagugaaacaagagcacuuucuaaaaucacuuaagacuguaaaaccgucguuaaguugcaaggacuuggcuuuauaugaaaacuuauuuaagaaagaaggauuuucuaacguggaagguauuuaaaaaucaccuuaaacucuuguucaguucacauuaauugaaaugugaacuugccugucguuugcaacuucacacuuuuagaauuuguguuuauauuuccuguaagugaauaaauaaaacaaaacaaaacaaaaaaaacuugugccugauaagcuaaggcucauuuauuuuuaaaaggcauauuaaauaaaauacuguaauuuaggaagaaaguguguguguguugauuuuguuguaaggggugguugguuuugggugauugcuuuuuuauuaaacccugaaauaauuucauacuuacagaaaaguugcaaaaauaguacaaagaauuuuuaugugcucaaacccagauucacuaaucuuuaacauuuugccacauuugcuuucucugucuuccccaccccuuguacauauacacauacacacauuuuuuuuugagugguuugagaauagauuauauacauaaugucccuuuccccccuuaauacuugaguguguauuuguuacaaauaagguuauuauaugaccaaauucagcaaauuuaauacugacacaguauuuuaaucuaucauccagugaauuucauguauggucacaauaacguccuauaugguaauuuuccccauuacaggauccagucuaggaucacacauuucauuuagucaccaugucucuuuagccucuuaacuugaaacagugucucaaucuuucuugacccugacauuuuugaagaguauagaccaauuauuuuauugagcaguucauuccuggacuuguaguugauguuuuaucaugguagauucagguuauguauuaccagucgagcacuacauaggggcauuguauucucagaguaucacagcugaaggcacaugacaucuguaccuucuugauaauguuaauuuugaucauuuguuggcaguauugucugguuucuccacuauacugcuauuuuucguuuuguaguuguaaguaguuaaaaguuuuuaaagagacagguuacauguacauuucuauuuucauuuauuacagaauaauuuagaauacuagaaaauacagaaacaaaaaaaaacccuuuaguguuuaaccuuccaguccuucaugcauguauagauaauuuuuaaaaccagaaaggaaugauacugcauaacucuuguucuucucaccuaacaauaucugguaaacaucuuacuaggccauucuccacccacaaggugcuaaguugggugcuggaacguccagugaacaaggcaggcaucagacaaauugucagugaauuaauuacaauggucagacgugcuucaaaagaaguagaggguacgaugagagacuacugcaugaaauguaugaagucauaaaacguuaagcaguuauuggaaaguuuccuauuucugagugcagccaggacuacugggaauaauuaaagaaaaaacgugauuuguagguauaaaauauucaauuaaaauaacacacugaccuuugcuuuugaguaauaugaaaauaccuagaaaacuuacuggaauucuuacuauacauuuucuuuguugguuauuaaucuuauugaacaaggcagccauccugcaccugacaaacccuggccugaaccccuuaacucagacaucuagcugugggccccuguucuuuuccagaaaguuucuaguaggcugguaauuuagcaaccaugcuuguucaaggcugagcugauuugaagaugucuuuuuaaguuguaauuaaagucaguccuccucaucuguggguuccacaugggcagauucagccaaccauguggguugaaaauacuugaaaaaacaaacaaaaacaauacaacaauaaaaaauaggccaggcgugaugucucacaccuauaaucccagcacuuuggaaggccgaggcgggcagaucaccuaaggucaggaguucaagaccaaccuggucaccaugguaaaaacccaucucuacuaaaaauacaaaaaauuagcuggggcaugguggugugggucuguaaucccaucuacucugggacucagguaggccccagaauugcuugaacccaggaggcagagguugcagugagccaaaaucacaccacugcacucuagccugggcgaccaagcaagacuguuucaaauaaauaaauacaaauuuuaaaaaaucacaaauaaaauacaauaguguaacaauuacuugcauagcauuuauauuauacuagguauuaugaguaauuuagagauuuuuuuaaaguauaaccaggaggacguguguaggcaaccugcauauacuauaccauuuuauaucagggacuugaguauucguggauuuuggugucugagagggguccuggaaccgauucccugcagauauagagggaugacuguaacuucucaacagaacauugaaagcuuccugagcauaaagacuaugugucucuucucacugaaaugcucaauagaugacaaaaugagaucaagaauuucuuugauccuguucgaaucugauuuuagaauggcucuggacaacuuccaaaagcuguauucuugaucugugagaaaauuaaaacaccagcuucugaacaccuucuuucugguauacugggaaguguaaacaguuuucccuauaaacugaacucaaacugcuuucugggccacauuauugcuuaaggcugacuaaccuuaaacaacauagaacaucccuggaaccuccaaaauucagcaaauccagugcuauaagccuggucauaaggcagccacugaaggaugaggucaggauuaacacauccaucaucaggaacagggagaaagaaugucaacaaaaaauauuuaauaaugaaauuucuauuuuucucagaaaagccugagcuggacugauuaaauuccuggccaggcaugguggcucacgccuguaaucccagcacuuugggaggccgaggcggguggaucaccucaccugacucaggcuggucaggaguuugagaccacccuggccaacauggugaaaccccgucucuacuaaaaaaaaaaaaacaguugggcguaauggcucacgccuguaauccuggcaacucgggaggcugaggcaagaggauugcuugaacccgggaggcagagguuucaguaagccaagaucgcaccacuguacuccagccugggcgacagaucgagacuccauccuaaaaaaaaaaaaaaaaaaaaaaaucuaaauuccugggguaugaaccaagcagccaugucuccaugccccugcaagccugaguggcaguagcuagagaaaggcucuacaaguugcugguaacuggagguggguggggaagaccccccaagggauuaugggcuccggggcagccacagagggugaugcuggugaguguccugagugggcugcuuugggggcugccagggucugaagggcugggagcugugccuguuucucauccuggucacccaggcaguacuggccuggcggugccuucugggcacccuggccaguacacagggcuugggggcagggaggacccuaauuucaugucuauccucugguugcugguggugaggcuaugaauuccauuacauuuuggagugggaaguguucuuauugcuaaagaacugaaugacaaacuucuuuucuggggucuugccuucacaaccucaggcaaaagggcagaaaaucugaagguucuuaagucacauacaguugacccuugaacaacacaaguuuaaacuccuuggguccucuuauaauuaauuauuuuuuagauggagucucacucugucgcccgggcuagagugcaguggcacgaucucgacucacugcaaacucugccucccggguucaaacgauucuccugccucagccuccugaguagcugggauuacaggcaccugccaccacacucggcuaauuuuucuauuuuuaguagagacgggguuucaccauguuggccaggccggucucgaacuccugaccucaggugaucagccucuuggccucccaaagugcugggauuugcuuggguccacuuauaugugaauuuucuuccaccucugccacacugaagcagugaaccaaccccuccucuucuuccuccuucucagccuacucaauuugaagagauggagaccuuucugaugacucacuucugcuuaaugaauagaaauauauuuucucagccaggcccgguggcucaugccuguaaucccagcuacuugggaagcugaggcaggagaaucacuugaacuuaggaggcggagguuguagugagcugacaucgucccacugcacuccagcccaggcgacagagcaagacuccgucucaaaaaaaaaaagugauauuuucuuuuuaugauuuucuucauuuuuauuuucucuugcuugcuuuauuguaagaacuuuaccuauauaaaaagcaaaauauguguuagucaacuguuuagauuaucaguaaggcuucuggucaacacuggauuauuaguaguuaaauauugggggagucaaaaguuauaugcagauuucugacuauguggagagcagggguguguaaguuccccuaauccccaaguuguucaagggucaacuguacuuguuuuggugacaguuuuuuauuguuaguuuuuuaagaaacaggguuuugggccgggcgcaguggcucacgucuauaaucccagcacuuugggaggccgaggcagguggaucacuugaggucaggaguuugaaaccagccuggccaacauggugaaaccccgucuuuacuaaaaguacaaaaaaaaaauagccagguguggugacacaugccuguuagucccagcuacuugagaggcugaggcaggagaauggcuugaacccgggagguggagguugccgugagcugagaucaccccacugcacuccagccuggacaacagagcaagacuccaucucaaaaaagaaagaaagaaagaaagaaacaggguuuugcucuguugcccaggcuggagugcaguggcacaaucauaacucacuguaaccucaagcuccugugcucaagcaauccucucgccucagccucccaaguagcuaggacuacaggcccacaucaccauacccagcuaauuauuaaaauuuuuuguagacugggugcaguggcucaugccuguaaucccagcacuuugggaggccgagguagguggaucaccugaggucaggaguucgaaaccagccuggccaacaugguaaaacccuuucuguacuaaaaauacaaaaaauuaguugggcaugaugggccugugaucccagcuacucaggaggcugaggcaggagaauugcuugaaccugggaggcggagguugcagugggcugagauugcaccauugcacuccagccugggcaacaagagugaaacucugucucaaaaaaaaaaauaaaauuuguagagucuggcuauguuaucuaggcuggucucaaauuccuggccuugagugauccucccaccucugccuccgaaagugcuggaauugcaggccugagccacggcaccuggccaacagaauuuauugaguaaauaauucaaaauugcugcauuugccguaauauuauuaauuguaaaauauaaaugagucacccaaagcacaguguuauaauucuugaaucagggaaagaccaaacuacauauugacuuugauaucucaaaagcuugauauacccaggcauuaugaaaaggaagaaaaguguggcuuucuggguuuaauuuuuauugcugcaaauaggaauaagaucuuaaagguuauaugggcaaauuauaucuguaacuaacuacguauaauuugugaauuuuaaaaauguuuuauuuuaaacauuuccaaacauacauaaaaggaagaguacaacaaacccacacauaccuaucaccuacguuaaauaauuauuauuuuguaaaauauuccuaauuuguuuuuuaguugaaguguuuuuguuucuguuuuuuuuuugagauggaguuuugcucuuguugcccacgcuggagugcgauggcgcuaucuugacucacugcaaacuccaccucccagguuuaagugguucuccuuccucagcccccggaguagcugggauuacgcaauuacaggcgcccaccaccacaccuggcuaauuuucgguauuuuuuaguagagauguuggccaggcuggucucgaacuccugaccuuacgugauccacccaccuuggccucccaaaguucugggauuacaggcgugagccaccgcaccuggccuaguugaaauauuuuaaaguaaaucccagacaucauaauauuucucccuuaaauauuuccacauacaagcucugaaaaagggagaggccauuuaaaaaauauaaucgccggccaggcgcgguggcucacaccuguaaucccagcacuuugggaggccaaggcgggcugaucacgaggucaagagauugagaccauccuggccaacacggugaaacccccucucuacuaaaaauacaaaaauuagcugggcaugguggcgggcgcccauggucucagcuacucgggaagcugaggcaggagaauuguuugaaccugggaggcagagguugcagugagccgagauauauauauauugcaguuauugcaguuauauauauauugcaguuauauauauauauaaacugcaauacuauuaucacaccuaagaaacuuaacaauaucccuuuaauaucaucuaaugucuggauccuauuuaaguuucccacuugcccccaaaaugucuuuuuacaguugauuugucuuuuuguauauucaaauaaauaccccaccuuugguaaguuuucucagacccccuuaguuagaauuaaucaccugucuuggcaacagaucaugccuugcauuagaguuauuuagaguuacuaaauugcaagcaccuugaaguaagugauuugugucuuacuacucuuuuuaauucugcuaugcccccauccucagaauaaugccuagacuacuaaaaaacugcauuacauuuugaaaagaaaugauacuggcaaagcacggcucuguguuuaaggucauuaauaggcaauggcuacacauuuuuaauuucaauuuugggcucaugaaauacuaauguaaaauuuauuucuucuucuucucucucucuucguccuguuucucuuucucucucccucccuuccuuccauccuagaaaaacuucuguuucuuaauaacaugagguuuuuuuguagaaucuucugacagaaguagccuuagaagucuuucauuaaaaggcuucucugauucuagguaauacaaaccaaggagaauuaauguugaauuuucuuugaaguauauaacguagauccauccaauuagcaaaugucucuaguuacaguucugggguuaaacaguaagaacgcuugccagaguaagggagugggaaacuacauuuaugaucagccuuacauaaaacaaaucuuugaggcugggcguggugguucacacccauaaucccagcacuuuaggaggcugaggggggcggaucaccugaggucaggaguucaaaacuagccuggccaacguugcaaaaccugucucuacuaaaaauacaaaaauuagcggggcgugguggcacaugccuguauucccagaugcccaggagacugaggcaugagagucgcuuuagcccaugaagcagagguugcagugagccgagaucacaccacugcacuccagccagggugacagagcgagacucuggcucaaaaaacaaaacaaacaaaaaaccaaaucuuugcauauaguaacuauuuguugagugccuacuacaagcaggacagaaugcuuuacauauauucuaacauuuuuuccaacucucuccccugccagguuugcccccauuuugcagauauauaaacugaaacucaugaagguuaaguaguuuacuuaaagucagcuauuaauaauaaguauagcaggggcaggcucugaacucagguccauuugacuacaaaacccagguuuagaaugaaaaugggguugaaacacagcagggucuagccaauuucagggaacguuaagauguugccuuuuaacuuuaacuuacagcuugaacuucaaacuguuuguuuuaaaauaacugguccuuuacuuauugcaguauuuaacagaggggugcagacagaaccaugguguugggcaccagacagaccugcguucugauggcaucgccgccacuuaccagugacgugaccagagccucucugagucuuaauaagacuuugcacccaccuugccgaggggaaucuggcucagugucuggcacacacacagccccuggcucugugaaauuguuaccauugcagccgccugcaaacugcaaagugagguugcuggcuuagaggagaguuaggagggaacccaaagacuaaaccagccggcagggucguuugcagaaagaccuucuccugacagccuccccagcuuauucuuuuguuuguucucccucgaccucggguuuuuguuuuauuguguuuauuuguuuguuuuuguuuuuuuggguuuuuuuuuuagcagaaaaagucaggacgcccugggaguuauucugaaauaaacuuuacaauuuaauuuuaaugaucuccauaggugcacagaccacauuuuggagcuuuuaaugugauuggauuaauucuaauuuacccgccugcaccugggagccucuccugggacccuccggucugcagcucauuuuuccggacccccuuuuauuguuuauuugcuuauuuaaauauuuuguuuuauucuauuuuauuuaaaacagggucucgcucuguugcccaggcuggaauacagugguguaaucuuggcucacugcgaccucaaaggccuggacucaagcgauucuccugccucgcccuccucaguagcugggacugcaggcaugcagcaccacgcccgcuaauuuuuuuuaguagagacgugguuucgucacguuggccaggcuggacucgagugauccuccugccucagccucccaaaguguugggauuacaguccuaagccaccgcgccaggcccggauacccuuuuagaaggguuggcuuucccucaggccucggcuaucugcgcuccccucuuaggggguuccaccuccuacuccccaaaccuccaaacuccucacaagcaccuaggggggccaagagcgaccggggucggcagguaaggaagaccgcggcgagcggcagggggcgccagcgcccgcguucgggcgcuucacgucagccgcagaauguccugcagggggcgcccgggagucgcgugcccaacggggaaagcgagucaggucccucgcgcuccccgccccacgcgcgugaccagagcgcgcuggcccggcccacccggggcgguuguggucgcuauauauaagguggggaggccgccggcccguucgguuccgggcguuaccaucguccgugcgcaccgcccggcguccaggugagucucccaucugcagagacgcggacgcgccggcccgcaguuggccugcggagcgcgguggacgguuuggcgcccaccaggcgaucaauacuuuggauuuuuaauuucuagauuuggcaauucuucgcugaagucaucaugagcuuuuuccaacuccugaugaaaaggaaggaaguaaguuuuaaaaacaauugaaaaucuugacuaaaguuuucauuuuuaaagaugaaaagauggcacagauuuugaacaaaguauaaaauaaauacaguuguuuugcuguguuucaaauguuucauauugaaguguccaaauguguccccuccaccuguuauuuguuagcucauucccuuggugguguucaugacuguggcggcggguggagccucaucuuucgcuguguauucucuuuggaaaaccgaugugauguaaguaggucucaauuuauaaaaacguuuuuggcaguguuuggaugacuuuuaguuuaugaaauguauaaguuuccuauuuuuuucccauggaugagaaugccaaauugugaacugggagucaggguuaaaaagcaucuuuuaucagaaaacucuuaugauauugucuaccaaugggucagaaaaugaaaauuagaaaaaaaaaagaaaaaauuuaaaaaaacccaugauauuaaucaaauuaguuuauuucuuguguuuauucuuuuacccauuggcccuucuccacucucuggcagugaaguaaagcuuguuuuuuuuuuuuuaaguuuugaaauuuaaaguucuucagugguuuugggagauauauaucaugaaacaaucauuuuaauuaaaauuuuaaauuuuagcuuauuagauuuuuacuaaugugguagaauugauagauucaguugucuacgaugaaccuaaucucaacuuuggguagaagaaaguaaaaaacaaaaacauguauccuggaauaugaggaaaagauaaacuugaaacuguuggaggcuggugcagggcuggagagggcaguccucuaaccgcuggcagaggagccuagagcccuggaguucaccaccugcagaguucaaccugccccucccacagacugagauaagaacauuauugcauguccuuggcuuggcaguuucacucccaugguuauuugguuugugggauccuuccccaaugcagcccaaucaagagaauacagaccuccuacccuuuaggggaacugauguuuaauguuugagccacaccaugaaacucccuuagagaauuuucaaucaauuuuaguugcuacugaugguuccugaucauuagcagacacaugccuuaguaugagacugguuuugucccuaacauguuuauaaacccaguaucaguguugguuuaaauucacaucuuuuaauguuuaauuggcuuucuuuaauuuuagccuugaucgaaaaaaaaauccagaaccuugggaaacuguggacccuacuguaccucaaaagguauuguuaaauuaaaaacaaaugauuuauauuuugcccaaaccuuagcaccuuugugagcaaaauagauuuaguaccuuacccuuauuguguaacuuagaucaauugugccuucaucgaguaauuaaaaugaggaaauuuuaagagccuacucuaugccaggagcauuguccauccacucaugagaagcauauacacuuuuggaacuauggcucacauaauaccuggcaaacuuaaaaaucuggauaccggccaggcacggugucucacaccuguaaugccaacacuuugggaggccgaggcggguggaucacuugaagucaggaguucgagaccagcuuggccaacauggugaaauuccaucuuuacuaaaaauacaaaaauuagcuggguguaguagaacgcaccuguaaacccagcuacuggagaggcugaggcacgaaaauugcuugaacaugggaggcggaggcugcagugaguugcaguugugccacugcacuccagccugggcaacacagcaagacugucuuaaaaaaaaaucuggauacugcuaagugaaaguagggcacauguguuugaucuuucccucugaucucauaacacuuaggagcccaagggcuuuguaaaaagauggacugauagaaaccagcucacauuacuauuuugugcauguuuuagauauggaaagagguagguacaaacacaauggugaugcuuuuucuaaaggggaguguggacaaauccgaaagagggacaugcaaaugaaagucaaauuuuuaacaaaagguuuuuuuuuuuuccuuuuuucucuucagcuuauaacaaucaaccaacaauggaaacccauugaagaguugcaaaauguccaaagggugaccaaaugacgagcccucgccucuuucuucugaagaguacucuauaaaucuaguggaaacauuucugcacaaacuagauucuggacaccagugugcggaaaugcuucugcuacauuuuuaggguuugucuacauuuuuugggcucuggauaaggaauuaaaggagugcagcaauaacugcacugucuaaaaguuugugcuuauuuucuuguaaauuugaauauugcauauugaaauuuuuguuuaugaucuaugaauguuuuucuuaaaauuuacaaagcuuuguaaauuagauuuucuuuaauaaaaugccauuugugcaagauuucucaaagauuagguauauauuuaaauggaagagaaaauauuuuuaugggagaaaaauacauuugaaccaugaaauuucaucuuuuaaauaaca

SEQ ID NO: 13371 - RNA, 24598 nt, Homo sapiens
cugugggacaaauccuuuuuauuacuaguauauguaacagcaauauguuugauuauucugugauacugauuucucauggcauacuauuuuguccugugcuguugccaaaauaucaguccuguuuuuguuuucuuggaaucguacaagauuauuagauauuuaacuuaguugaggaaguucucagagcauguaaaaagucaggcagguuugauuuuaaucagcuauuugaaacuaauuuuuuucuccucaauuauuuaucuuuagaaaagaaaauauuucaguugguguuuuuauaggaucaggaagaaacuuagaacaucuauaacucuuucugguucuguacugcugggauucuuuuuaggggagcagucuaaccauaaaacaaauauuuaugggcuacuguccauauagcuugaacaucagaacugugaggaaguugaaguaucuuagcugagggaacuugucaacuagaaaauuuuugaggucauugugaggucaggaauuuggaggucugagugcugauuucuaaacugaaagaggcaauuuaagagaaaaacaaaaaagagaaacuguccugaaagaucgagagacagauuaugcaagaaauagugacauauuuucuuuugagguuuugaagauuucuugcuuaggugaacuuuacuauugcugauaaaucuaugaugggauacuuaagaaaaacucuacguuuuuagguaaaauuaagauaaggaagaaccuuuaaccuuaaaagcccuugaaaauccuccacaguucuuuucaaaauaacuguaaggugcugucauuuaccaacagcuucuuuaauuaaacuugcuuuuuuucagguaccagcauucaagauauuaagaggacucuggaaauugugcugcauuuaucuuuaaauuguuuuaaaauguguuuuccaguuucauuuuaugauguuuauuagaaagugugauugcuauguuuuugcuuuuuuuccccauuucauuccaguugugggcuaaauauuauuuggaucuacuuuaaccauuaucauguaauuucucuggagauuagccuauuuuauaacuuuucagaacacauuuaaagacuaucuggccuguguaacaagauacugguuuugucucaguaugacauuuauuauccuagaccauuuaauuaguguuuaguaggugagcaguugacuaccaguugguuuucaaaaagaaaugcaguaauagggaguggaugaaaaagugaaaguauaaaguaguccaucauguuauagguaagagauuauucagaucaagauuucaacagaaaaaaaucuuccuuauggauugauauuaaaguuugaucuuaucaucuggaaagggcuuaugcaguuuuucgacagguccucuugcuuuuaccuuucuccuuuuuuuucuccucccuuccuagaacuaaauaugucuggcugucugauuugguugccagacuaaaauuagcccauagugaucuggcaacuauaauauuuaaagucuucuaacuugauuuguuuugacauguacaucuaguggggagggaaauauuuugguaaguagucacacccuaaauuuaugaccuguuuggauugagugaccauguauuccaguuugccuggggauagucucccuuuacaucuguuacuuauguguaauuauugauaacucccccuuuuacucucaaaaguguucuauuguagugaugaauucuuauggccacuuuuuauuuugauaaaugguauugauuuacuucaaauacgagucucuagaguuagcaaugauauuauaacugcauaaggacagguuucugguuuucuuccucuuuccugaagcuucucugauauucuccuugacaucacuguuuuuaccuuuauugauuuaaaucugugcuaucucuucccaugacuauuuccguagcauauuuggugccauucuuaagacuuugagcucaaacugugauauugaauaaacggcuuuggcacugugguugcaaagcagaauuaguggggcccuuuguagccugauagaaauuagauuucuggucaguugcacuuguuugcaggggauaaaggagugaaaugaggauaaaagggaaggaagagagauuagggagacugagcaguaagcaaccguuuauucuaaaaauaauuuuguuuaaauauguaaguuuguuauagggcauggugaguuggcggcauuuugugcuagcuugacuuauugcuuauaaaauuaaccucaggaauuagggauuuaacauaaauaaaauacauuaaauccuaagaaaaucuuuccugauuccaauuuuguauauucuaauauguauauauuuauuacuuuguaugaauuguauuuuaguccaaauauaaugcuuauauuauuuauuuuaaauaauuaauguuuuuaaucaaauuaauuaucacaauuggcuaugaggaauuucaaaccuauaaagugaaauagaacuuauuuaaacugacuaguaauucuguaacuuuuauuuuacaggucauguaauguuugcagaaauaaaaauggagaauggaaagucaaaaggcuguggaacagucagauuugacuccccagaaucagcugaaaaagccugcagaauaaugaauggcauaaaaaucaguggcagagaaauugauguucgcuuggaucguaaugcauaauuucaagccaugguuggaacauuccuacaucuguuuugcugaaucuccuaguaaaagucauuuuuuuaaaguaauauuguaugcuuacaaaagcuguaaaaaugaacuuuuaaaacucccaccagcuuuuaacaguauaauguuaaaaauauacuguaauuuuuguuaaucucaaguuuggguuuuuaaagacagcaagucuggucauucaguuuaaaugaaugguuauacuguuuuuaaugaaauaagccauuuucuuguuguuuucaguacuacauaguuggauuuguuuguucuaguuucuccaguuuuugucaacuuauuguaugguaaaacauagauuuuuuccccccaaacuucuguuuuauaauauguaauuuuucaugaaaagaaagggcucagaaaaauuaggaugugauuuugguugguuuuaaauuacuguaaguuuuagauucuaagguucaagauuuuuaaaauuugauuuaaaugaagaaauggauuuuucucucugccccucccugccauucauauuuucugcauaacacuauuaauaauaucaaccuccacagccccuuauuuuauuauuuccaauaauuccaaguucauauagaacugauaauguagcaagccccaaguaugauaauaggcagacuauucccaacuuucugucuaguuuccagccauugaagugaacugcuaaaaaaagaaaaauaauugaaauguugagagagaugguuauguaaguuaguccucugcuguuuacuucugcaggagcugauccauuuauaaaugcaguuuuaauaaaccauggaauaccaaggcacaacauaucaaacacauuggaucccacgauguuagacauagccauaucuccuuucccuacaaaagaaaagcauacuguuaaaaugugcuuaccaauacuguguuuuauuaauaaucuucauaagaaaagaaacacuggauacuuuuuuguuguugauucguuuugaaaaauuguuguuagagcaaaagucuuacugaauuuguauuuuuaaauuuuucuuggguuaguauuuaaagucuuaacauuuauuuaauaauuauauuuauuaaaccauuuuucaauaagguauauagcuuauuuguugcuuuucauuguaauuuaacaugguuaaugguuaauuacuauuuaacacacauuucaaaugaauauuauuugggggauuagauugagugaaauuaaccugcuauuaaauaguaaacuuuuccucuggagucacuuuuuucccccuucaaaguauguuacugaggaaguaaacuuuuuuuuuuuuuuuugguuuuuguuuuuugagacacagucucgcucuguugcccaggcugcuggagugccguggcgcaaucucggcucacugcaaccuccgccuccuggauucaaacaauucuccugccucagccuccugaguagcugggauuacaggcacaugccaccacgcccggcuaauuuuuguauuuuuaguagagacuggguuucaccauguuggucaggcuggucucaaacuccugaccucgugauccacccgccucggccucccaaaauccugggauuacaggcgcgagccaccacacccggcuggaaguaaacauuuuuaaagcuacuuuuacucauucuagccuuguagaaugaccauugcagcuugagggaccuaguucuuaccuuuucuugcaaccaacacacuugcaauugugucugguaugcuuguuccugcugcuaauaaaguaaggcccauuacuguaucgggaauuucuaguguuuccccuguaauaaacagauauuucaaguuacaaaucuuaaagauucacuaaccauccuuugcaguuauuuuggauauuuccuucgugaacaaaaauaaaauaggcacauuuagaauucagagccaauaugugcuugcuuauuaguuuuuuagcuagcaacauauuugaaucaggcugguaauucggguaacccagguagcacagauuuuuaaugacauaucuaaagauacguaacagcuaaaauucugccagugagaaauuuuccuguuugauauucuuacaaaagauguuuauguccaccauuaucucaucagggcugugcugaauauuugauaaugagacugaucauuccgcuuuuucuuucuuaaaaauauuagucagaguuaagcaaauuaauuauagcuaucuuuaagcuauaaauguguuaacauguauauauaccauuuauuauguucuacuuuagugauauaccuuaauuuagugggcuuuggcagggcgggggagggggaacguucauuaaucucugaggaaaacaaaaccuguuuucuacuugagucuaacauauggucccaauuuauuaauacuucuguuaaauuugaugucaggucaacauuuuucagaaauguauuuauucucagaaacagaaccagagagaaguuaaacaaaagguuauguaacuguuccuuuaauguuguaauugaaaacuugguuuagcgucuuuuuuuucuuucucuuuuuuuuucuuaaaaugccaacuaaaauaauuagaaaguagcuuauuuauugcaugcuuauacauugauauuggaauuggaauugguuguuaauuucuguuacuggcuuugcuagaauucauaugugcauaaauaacacuaauauuuaucaucuugggggcuguucugugaucuauuacaugauuuuugcucucuuuuuauuuuucuaguaucaaauguguucuggcugagugaauuuggauagauauaauaugcaagcuaauuggacuuuuucauuuuucucauuaaaaaaaggaagaaguaguccacuuuuugcuagcauacuauucugagacuuacauuaauuugggaaaagucaagggucaacaaauuuuugugucugugaggggccagauaguaauuauuuaggcuuugcaggcugugugauuucuguugcaguuauucagcuuugccaauguagugugaaaacaaucauagauaauauguaaaaccuuacuaauaaaaacaagcuggguuauguuggcacacaggcaguaguuuguucaccucugcuguaaguuaauuuggguuaaccuuuguaggagaaauuacagauuauuuuugucuuuguucauaguuuuuuuguuuagggacuguaguggauuauggccaagcagcaguagcuaguuaagucuuaaucaugaagguaguagaaaccuagaauaaaauuauuaugcccuuuucacucauuucauaauauguuuguauugccguguugaaaagccaaauaaaauacaauccaguuaagcagugagcacccauuguuuucccaaaaauagagcuccuugcuuuguuuuuguuuuuuuguucuuuuuuuuuuuuauuauggaauggaauucaauauaaagaguuuauuguggaccccauggaaugugauuaaauuauuagcauaauaaaaagacauccuaugaauuugauuucauuuauaagaucucuugaauuguaccccaggcuaaauaacaguggaaaauacaguuuauauauaauaugcaacucacaaacuccagugaucuuguuauaguaauacuuaaucauuuuguaaaugguacuaaucuucaaucuugcugaaaagaaauuugcuguguagcuagacuacuuugagugaacauaugcaauuuguucuuauaugaauauuuucaaguugugcuauuguacuuaaaauacauaccaguuauugugaccauccaaaccaggauauauguaaaugcggauauccauauugcagacaugaaaaagguuaucacaaaguaguuuuuccaaaacuuuuuucuacaaucuggugugguuagaaaaaguaauguaauaauaggaagggauaauacccaaaaaauucuuuuuaagucugcuucaggcauguugaaaacacuugguggaucuguuguggaaaaaguaaacacuuuugaguuuucucaaauggcuaauuaaguuagaaaugccuauuuagaaaguuauauugaaauaaauuagcuguaucaguuuuuaaaaggcuguuuaaaacauuugaguaccucauuacugauauugcuggugaaaagaaacuaauugaaacuuuagggcagacaauguaagaugugauacuccgcauuucuuuauuuggggccuuaaaucuauaaaaaugucuugggccauucguuaaauauauuguagauaguguuuaugaagugucaauuggacaucuccuguggauugucuucaguaacuuuuugcuuaagggauuaaccugguuucuaaccuagcuacuccaguugucuccacuucauaauauugaugaugccucugccugcccuauguaccagauaauguauacuuaaagaauauaaaauaaucauagcauaauuuuuuuauuaagucgcauauccuaauucuuaguggaagugguuuuuuuguccuauuucauuacuauuuuauuuauuaaauucagacuuuaccacaguucauagaaauaaccuuaaaguaggagguaguauaucaucuaaaguacaauuuaugaaaauugaguauauuucuuuauucaauuuaauuuaguagaaggauaaugauaauauauuggauaaaaauucgaauucaaaaauguucaaaauuuguauggcauuuacaaaauaauguaacaauuggaugaaaucauguuaaaacuaauguuaguacaacaacucauaaaaaguuugccaagcuucaaccaaugugccauuaaguaauauuagauauaauuuuaacauaaucaaagaauuuggauugguucuuuugcguuucuuauuauaaacuuaauuuggagaggcauaccucuuauaccugaaagaguagaagcuaaaauuuuuguaaaaagggggaaaagucauguuuuaaaauuuuaaguaguagauuagaauaaaacccuccuaaaggcuuaauuaaauuuagaaucuguuuuggacaaccacuuuauaaaaagguaacccaugaacuuauaauuuugaccauagcugaauuuucugacuuccuacugaaccuauuuaccuaaaaguuuugcuauugcuuuaaacaaugguaaaccucagcuguuuuucuucuuucuuccaaaccagccccuuuuucugaguucccaguuuuaauaagugcuguucccauuuucucagucaagauuaaaacauaggaggugucuuuguuccuuuuucuggccccauauagucuuggugaugcuuccuucauauagucucacaucuguucucauuuauucccaccacuuucacuuggucuaggcaccuaguaaacacaucagcuguuguaauagccucucuuacagaccucuuugucucuucauauuuuaguucggugaacaucauuuuggguaacauuacuaagauaacaguucuaauaauuucucuccucagaaaccuuccaagauucuuaaaauagcauuuaagauucuucuuauccuauuccuuucuaccuuuccucuccuuccuuccuaugcacauacugugcucuauguguuuuaucucugcaucauuuauggaaugaagaccucaguagcugcuacuuauuggucauaacauaugucauuaguuaaagucuuuccuguccagcaaggcccaauuuaaaugcucccuucucugugaaaaucuccuaucuguccucaccacauuuuggcaaucugucccauuugugaaccacagucacacuuuauuuuucucuuuuuaugguacuuaacguucauacuuuagcuauuuuguauuuccugugauauuggaaguuccuuaaagguagggacuuggucuuuaucauuucugagucuucacagucuuuuuuacauaaaaagcacacaauacuugcugaauugaaaugaaauuuuaaaguuuuuccuuugcgaauagacuuaauaaugggcaagauuuagugauuaccuucagaaaccugacuaaggccauguaaacuuauagagagcugagaguagccagaaucuucauaaaauauuccacuaucaguucuugauugccgacgaaugaaugguugaccuucaucuucccagcccaucaguggcuguuguucacuucucuccauagcuuuggcaagacaggcgcagcaaggacugcauuucuuuauaauauauugguuaauuuuaaugucaaaacacagcaccaaaacauacaauccauauaucaaaagcaguaaagccccuucauaccuacaaaagagaaauuuguguuuuuaaauuaaaagugaaagucauuuuagaguugauagcuuuugggcaguaucuauugaaugauuuucuaacaaaaguagccauagaacaaucaaacauuucuagauauuuuuuguuuuguagauuuguccagacuugauuacagcauuauuauguuuauugauaaaagcuggacacuucuguguuguuuuuuuuuuuuuaaaaacaagaucaacaaacucguuuuuacuuguagauuccuuccaaaugauagguauaaaaaugcaaggaaaaugauaauuggagauuuucaaaauaaauguaaaauuaauaaauaguggugaacauuuucugccucagcucauuggcauaauacauuccccaacauacauaauaauuauaaaauaauauaguaacuguuaaguuauuucaacuguccaaguuuucugguauaggaacuuuguguaaaauauuacucagauaugggaggcuuaggcugggauuuuucaguuugucauacagagcauuuuuaaugauuugaauguagcugaauuuggcuuacagucacaagaaaacaagauguucuaaaauauaaaauuauacccuuggaaccaagaacuguuucccuguacucuggcaguuagcuaaugccaucacauuugaaccuugcauuuaccuuuuauagccagugaaucucugucugcuguaucuuaaagaacaguucugauuucccuaauggaggaagaauuagcuuggauacucucacagucacuaucccuuacagacaacugcugaguucuagaaggauuucuauucuaccaacacagugucuuagggagacggacuagaggacaggaugauuaguuuagaaauuaugcuucuggcuagguuuuaaguuucuugauagcagguauuacgccgugcugcaagguuaugguucuccagauggacaccauuacauuuuuuuuuuuucauauuuuucugguguccucuggaguuaugcaauguauauaaccuguguagcuguguuuuacauuucauuaucccuuaugauaucuagcauagugagaaggaccuaguaggugccugcugcuuacuaguugaaaaaguuaguaucuguccacucagucaccaccuuuuucauuuucuuggaccagcuaggcacagagagauuguaaggaaagcaaacaauuuuuaauaugaaaagcuaagcauuguuauuucuuagaggaaggcuauaguuucuccugaaugagcaucagaaguuuggaggaauuuaaaaagacuucuuuuacuuccucuaccauccuucuccagucuuuuguggccaugaacacuucuaaccaaggcaaggugagcaguaacccagcagaagaaaaagucaacuguuguggcuuuaauggacaacaggaguugggaaacuuucugaauaggcagccaguggggagaaggaaaagugguggucuccagugacuagugagagaaaaaaggagacugugaagugauuaagaagaaauugcaaacuagugagaagaacucaaucagcaauugugaugagguuaacucacagaccuguuggaauaugguauagaaguggcagauuaagugacugaaauaacauuucugaaaaaaaauuacugaaccaucagaaauucauaaaaucucuaauuuuuacauaagaauuauuuucaagcuuaccaguaaacuugguugucauauauuauaccaagaacugcugcugcacuaauuguguacgcugcacagucucugaauaggggccaacaugauaguguugagaccuguaauaugguaaguuauuauuuccauuacauuguaacuucuucaaguacaauccuuaguauaauacuaaaauuguuuauauauuuguaguuaaauauuguuaucuuuugcauauugcuuagagaaaaaaauguaaaauuguguucuaacuuacacagacuuucauaaaucugaccaagagcuauuuguggauuaacauuaaauugaauacauguuguuuuucuacugauuaauaaauuugauugcacauauuauuagugcccuguuguccaucccagacgacgaacaguuaucuuuagaauuuuuuaagacaauacauuuuguugaaugguuuuguuacauaccguauuagauagcaaaccacaggcagcacagaugccaaggagauuauaaauugcagauccaaggauggugcuaaugccaauaucucccuuugugauaaauacaccuaugugcaagauaguaccagcuaaguuaguguuaacuugaagaaaauaaaaaucacacugaguaagcaagaaguauaaggagcaauauuuaccuaggaaagcaguaacuaauucaggagcugaacugcccgcugccaugaaaguugugccugcaacauccugagacaauccaagggcugaacauaaaugaaaugauuguuaugccuaauaaagugaaagaguaugucuuuacaacuaaacacaauagauacucaaagcuacagcuucacauaaaaccacuauuaaacuagaaaaauaaaauacacagauuaaaagaguccaauguuuugcuucuuuaugacuucauuacuuaaugcuucuauagaaagggugagggaaggccaggagacuaaagggaauauccugagugccaaacauaggguuauuuggaacccagaaaagcguucagaggcagagggcuuguaggugaguagcaacagcauggcuuugaaaauuaagauaauuuggaaauccuaacccaacuucaaagaagaaaaaaaagauguuaguuuuuuagauguauaaugcagcugaacagagcuuguucacaaauuugcacacaucuguuaagucaucucaacuguccguucaaauuuucugguauaggaccuuuguguaaaauauuauucggaauaugggaggcuuuggcugggguuuuucaguuugccaugcagagaauuuuugaugauuugaauguagcugaauuuggcugauagucacaagaaaacuggauauucuaaaaaaauuugcaguuucaacguugucuaauuacaaaugagagaaaauaacuagauuuaauauuguguagucuauugauuuaaaacauggaucuauuaaaauuuugcucuagaauaggaauauaagaaaauacguaauacuacaguuuguuucuauccaccaggcuuacaagcaugcaaguucauaaacuuuagggacugacaagaugagagucacuaaauuaagaaguuuuuuguccuuucaauuuuagggccaagggaccuaccaugggaaggaacagagaaagccguaggccgagauagguuugcauaagaaauccccaaccaggcuuuacugauaaacuaaaaacuagcuaauagagguagcaugccauacauuaaauuaucuacccuaggucacaaaguuaguaucgaagucagaacuagaauuuggguuuucaagacuugauggcaacucuuuguugauguuuauugucguuuacuauaccuauugguuuuugacgcuucagucuucccagacccucaaacucuggugugcuugguugacucccugucacaggugguugguauuuccuuauucuugucucugggaccaccuguugccugcacucaggugaaccuuguucuguagucugcugggacggcauuugagcuuacugauuccuuuuguguuucuugguguggcagauuguauauuacaauaauaguuaugguauuuuucugcuccacguaguuuuccagaacccuuuaauccccuacauaaaaggugauacgacuuccuuacuaucaucacaggacauuucccuuaagcuacgacaugguaaguccugcuacuuuguugaaacccccauacuggagaaaccucaugaaaagcccauauagaaauagagaugucuaaggaauugcugcuguuucaguccccagauuuugaaaauucccagccuaggcaccagacauaugagagagugagcucucaggugauucuagcuccauccucugaccauagcugcacaagagacccugagugagaacuaccuagcuuagcucaguaaacacccaaaaccgugaaaguaauuguuguuuuuagccacuaguuuuggggugauaguuaagucaucuggugguucauuuauuuguuguauuuauugaguacuuacuauaugccagaugcuuuuuuaaugugcuaguaauaaggcagugaacaaaauagacaaauauuccugcucucacagagcuuuacuuuuaguaaggggaagcagauaagauaagcaaaauagguaugauguuagagauaaguugcaaggaguaaaggcagggaggggagagagagaaaaaugucagagaggaaggauugaaauuuuagauuggauaaccagaaaggacuuaauugagaagguaacuaaagaccuugaaaugagucauuuguaugccugggcuaaaaguauucuaugcagaauaaaugacugcaaagguauugagguagaggcuagucuguguggugaagaaacagaagaccugcaugucuagaaugaagagugucaagggaaagcaguaggugaugagauuaaagguaauaggcagaucauguaaggucuuguggauccuaauaaggacuuuggcuuucauuuugaaagaugugggaaguacuuagaaaucugucaccuacauacugucugcugaugauaccagcuccagucauuaauuuuaucccuugggguaauuuggucugagagauccaaccagcccuaauccaagcuauuuugacaccugaaaaaccauugugaaaaguucucuuggggugguuagaauuauuuaggccaggcccucuauucuguuugccuuuggucauguugcuuguugaacaucuaccugcagugacuagugaagggugagaaauaaaugauuuuuguaguuuacauuguauccuagugcauuuuguguguauaaaggaaugccugagacuggguaguuuauaaagaaaaaaagguuuauuuggcucaugauuccucugucuggaaaaguucaagauugggcaucuggugagagccucaggcugcuuccacucaugguggaagauagagggggaacuggugugugcagagaucacauggugagagaggaaguaagagagagagguggguggugccaggcucuuuuaaacaaccagcucuguaaaggaacuaaagagagagaacucacccccuaggaaaggauuaacccccaggaucuaaacaccucccauuacuccccaccuccaacauuuaggaucaaauuucaacaugagauuuggaguggacaaauacccaaaccauagcauauuuccuaguauuuauuuuccugauuagagugauuacauacauauacacauauacaugcauacguauaaucacucuaaccaguguguguauauauguauagacacacauauauacuauauucuuauuacaauucugauguguacaacugaccauaauauuuaaaacauagaacaaaaagauaaaggagauggcucuguaauuaacuguuuuucauuuuagaaaugaaguaaauaauauauucaugguguacaaugcacucccauauacauaauuuaauaucaacuaucaugaaauaugaguggugguauuccauuuuacagauaaacaggcccaggagguaaaauaaugucacauggauugcaaggaucugaaauguugagaguuagggcauaaacccugagccuguugauucuaagcccaaugcuguuuuuauuuuaccacagaaacccaauauaagaauggcacuuaggcccauuagaacaugguaggugacugaaucuuuuuuguuuacacuuuguggcacuggcaccauaaucacccucauucuauucuuuccugguggaaaaaauaguuaccgagagccaagaauacuuuggaaguuuuccggcacauucuagagaauuuauagauuuagugcugcuggauauuaccaugaauugucuucccaaaucaaaacagggcuagauaauaaauagguggaagaaauugaaaaagaacagaaugccuuaucuuaaaauaacugcccaaacagugcagcugaauacugaacaaucuucauuuagcacuagcugaagaaugcuucauuagaaaacucagucucaaggaaggacaacaggugguccuuuagaaaaguuucagucccaaaaggcaguaagaauaaagcuuguuccuauucacugcacucaaauuaugaaaggaaagauuuuguauagauggauggauaaaacuuaaagauauuuuaacaaauuauaucuuaauguucuaagaauauuuuauaaaauguuuuauaccucugaacuuuagaauagauuggcuuugucuucuucgaccuuuugggugaaauuucuuucugcuauaguuuauuauuaaggauaaauuuuucuaguuuuuuccucccauagcuauuauucuuuuuuuccucuauuacucuaaaggaauaaucacauauccuggaagauauaguagaaauguucaacuugaguuuucuuuauagguuuagauaucaacacauuguuuauauaaaguacaacuucgugguaaugagcugauuaugaaaauucaucagacuuuuucuuaaauguguuuuuuucugugaugucauguuagaaaguuuauaaugguuuuugaaaaucuccuucuggaaauaugauauagucggaagaauauuaaacuaaaacugagaccuggauucagcccugccaguaacuugauaggagacuuaaguuauuuagacaagccucauuuugccaucugugaaauggaggaucagaccacacaaucuuuaagguauuaucuuuuuuuuucaaucuuuacucaaaguuauagaaugugaauucuaugcuuuaagacucuacaccacuuuuuauuuuuaauuaaauuucuuuuauaauaccuaccccccacccccaagucuacauuaccaaaauuuagacgaugaaggggaaaaauagaggaauacuuuuaucauaguauuuuaaccacuccugucauuucaaugugucuaguccuuuucacaaugcacauuuuaauauaguuacagccauaggcuauaugcaauuuggcguccuguggcaucauuuuuaaaagucugcaaacuuuugugcuuugugaauggauuagaguuuuagaaacaaucaaaagucuaucagacccaacucuagugaccauggugaguagucaugcugagucauacaauuuaggguccaaaaugaagugcaacagcaaacugaugucuuuuuugugauuugcaaaacugguucugaaauuaauuucaaauguauuccuagaaauauuuugagggaauaaaugccuagaggggaaaaauaguuacugagagucaggaauacaugacugcauguauaugcucugggauguuuuuaacaauaaguaagauaacuugauuaccuuacauuuaccaacucauauuuugucugagcaaugaaagaaugaauucugaaaccuguaaugcuuuuaaaggcugauuccaccgaaaaagacucucccuauccccaaucuaacagcuguaauauuacaguggauuucuaccugcucuuagccuaucuuaugaaguguaccucuuuuauacaagacacuuuaccuccaaaccuaacaauuacuucauuuuuuguuccauaacuuucccaaggucacauagguaauaaaugcagagguaggaagggaaccuagaucuuuuugacaccaagaagcugcccuuucagcuauccaugugggcaaaguaaagagauaauacauaacuuuauuauuauuucuuguuccugcaauagcaucgugguaaaauacugaguacuuagcacuuauuuagaucuguaugccugguguagauuuagaugcaauccaaagggaccacaauuuagaucagagaaaaaagaacaacaaagaggaugaaauacucuuaggagaaugaguguguagcagggaggaagcacuauucuuagauucuuuguucuuuaguaaagcuuuugcuucuguaaauuucaugaggauuaaaaaucaaacaauccccugaaacuguaggcuauccaaaugccauacucacagaauuauuugaauccuaauuuuuucaauuuagaaacaauucugccuggaauuaaaacuugcauuucuuucuuauugccuaugucugaaauguaaaguagaacauaagcaaauauuaguccaaagcagaguaagugaaaauuuuuuaaaauaaaaaguaaauauuuaaguauauuucccccaaaccuuauuaagaucauuuucauauaagacguguuauaauucgaagguaucagugugguagagagguuauaucuaauugaaugguauauuaguguaaauuuuuuuuuaaaguuucauagcuggcucacuguggaauuuggacucuauccagugaccaaucuuaagggguucucagaguuuucuauguauauaguuuggaaaaauauaaagaaaccugcccagaacagugguucaauaccucugagauccccauuacauaucaaaaggauauuuuguuuucauuuuauaucaucuuuuguguuucuaaaauuaaacugcuuagagagauuagacauacugguccuauuuggucuuuaaaugaauauaguuuauauuauauuuuuaauuuguauuauauauuggcuuauauuuaaauuauuuaaauuuaaauuauauuuaaaagugacuuuuuaaacaauaaaagaugaaguaaaaugguauagaugcuaauguaaaugaaauaaaaggaacuuuaaacagaauauuuuuuaauuuuaauuuuuauuuauuuauuuauuuugagauggagucuugcucuguugcccaggcuggagggcaguggcaugaucucagcugacugcaaacucugccucccggguuuaagcaauucuccugccucagccucccgaggagcugggauuacaggccaggugccugccaccacgacuggcuaauauuuguauuuuuguagaaaugggguuuuaccauguuggccaggcuggucucgaacuccugggcucagguaauccacccaccuuggacucccaaagcacugggauuacagguguaagccacugcuccuggccuaaacagaauauuccagagauauuuaagguauacuuuaaaguugucacauggcuuauuagauaaaauaacuaguuuaauaagcuuacuuccuaccuugucaaauagaccuuacuuuuauuuaccuuaaauuugguguucaaguucuagcagaugcaccguagauuugguuauuugcuccaaaaauacuuaaauaggcuuugguauuccccaucuccacuuucaucuuuccugaguaaaggauucuaaccucuguagucuguucuuauguaacaaugaacauucagugaauguuuucuaugugcuagguacuuguguaagcaguucacuuguguuucuucgugcacuugucacacagcacuaugaacugaaaguuguaaucacccuguuucacagcugagauaacagaggcagagggaaguuaggaacuuugcccaaggucacagugcuagcaaauggcagagccgggauuugaaccugggcuaucuggcuccagggugggcacuuucaauugucucucuauaagaguguggcacuagagcauaugacggcuguguccuuccccuccagcuguccggggauucucagcauuugucauagaccauucagcaacuauaucaauauauagagagaaaaaaauuggaaaaagccccaagcaaacaauaccagauaggacuacaaagugauguaacuaaauucacaaacuaagcaagggaaucuuagacacagguuucuaagucaggcuuacaugaaugaucagagacgacaaaggcucccuccuuuuccuuagucauuuggauuccucucucacugugucucugucucucuuccugucucucauacacaccccucaggguauccauccggguaacauucuagaguagcacaacugguuaggaugaggaagcucuccuuaguuuauuccucaccccauuaccucuagcuccuuuagcucuaacuugggcuuggauaaugcuccucuucugaucacaucuuuaacucuuuucccagaaucuccauucuguuucccagcccagaagccaaggcuuuccuccaaacgugaaaugcccuggacaacuagagggugauauauuuguguccccucuacaacaccaauuaauuucauuucagcccucuguguucagagaauuauuagcuucuuuuccuguagaaccaaauggacagaaaaagaagauaggauuacaggaagggggcauagcaacagcauuuucuuuuauuggcuccauacaguuaagauggugguaaagugucugagguugccucguagagauaggugcuuuuccagcuuuuccaguguucgaggguagaggagagggugugugacuuuuaugaucaugagcagagcaaggagaaggaaaaaaaauccuugcuggaagccucugguggaggcagcucuaggagaccaagaccaacauacauagguccaaaagagaaagagcacugguuugaccgagcgggggcccugccagagcaccagcaagaggcucugcccucuuccacuuccagcucaucgcugcacggagaugacaauccugagccucuucuagucuucaccuggcuaaagauccugcuguuggccaaaugagccacuguggugauuugaggagugaguggggcuggggugggacaggggccugccaauccuuccauuguauucuagguuggaacucaguauacauaccccacaagacauuauagccucaucuaugaugaugaaguuccacuguacuacauuaugaucucaugaucuuggacaaaauguuuaggccugggagcuuauggauaagugucuauagcauugauuuacaaucaccuauagguugccaaagguccaaaaugauuuuuguaaauaauucaauguauucucuuuauuuuguaauauacuuccuccauaguaacuguggguauuugauauuuuuuugucaaaauuuucagugcucucgagaggaaaauuucuuguaagaugguucaaauagaacaguucugaaacaacuauauucuagcaacgaaucucaaacaaggauguguaaaguuuuaucauguagcaguugagaucaugcuugaguuuuggcauuagagagaucaggacuuucucuguguggcuauguggucaugagaaauuaccuacccucccagccuuggcuuccucaucaguaaaaccaaaacauuagucccuauuuuguaagguuuuugggaagacuaagugaaaccauauauauauauauaaaaucauauauauuauauaaaccauauauuauuauaagauauauaucuuucaucuauaauuuuaucauaaguaacugauaaaaaauaacacuguaguacauuguggaauacuuuaguaaacuguuuugaggguuauguugauaacuauuaguugacaaaauggguggaacuauuaugacucaaugcucaucaagaaacuggggaaaggcaaagcacuugcagacuuuugaagcccguuucugcagaugugaagaaauuucaggaaaauuguuuuuuauugcugaugucauaauuuggauaagaccaugcuagaacuugaaaagagaagugacagaauuaauuuauaagcauuuaaaaaugaauugagcuagcacuauuucuaucucauuuuguugccaguauuuucaauacucaagaugagggucaauuuuuaacagcugaagauuuggcaguggcauggauauucaucaaucacacaucuguaagaacuacuguauuucagggcagagagacucacuugagaaaugcauguuugcugaugaucuuucaaaguaauuucacaaggugcacguuggaagucacuuagacauauuaagucacuuaaugaacaauauuuugaagucauaaucuaaauuuuaaugcaguagugucuucuacagggcuagaaagguuuuuuauuuauuuuucacuucuccuaagauaauuuuuauaauaaaauucuugauagauuuauuuuuucagucaugucauuguucaguuaagucauuagaaauggaaauuauuccuuacaauuuaaauuucuguguuuuauaugauuaacauuuuuaauuuuucaauuuuuaguuuuuuacauuuuucuaauuaaaagugcaguauuggcauaagaauguacaaaaagguuauuagaacagaguugggagcauagagacagaucuacaucuauauaagaacuuaguauaugaaaauugaucaacuguuggaaaaaagaacauuacauccuauagcaagacagauucuuaguggaaaaaauaaauaaauuuuaaaaaauccugcauguagaauaaaauaugaugauuguugugaccuauggauaaaaaugccuuucuaguuauaaaaccaaaaggagaaccauaaagaaaaagauuuacaaauuuacuuaaaauauuuaaacuucaaacuucaaugugauaaacacaaaaugcaaaaucaaacaaaccaugaaaaagcauaugauaugaaguaauacuagaaaaaggguuaauauccuuauauauuuuuaaagucuugaaaaucaauaagaaagagacagaauaccccugauauaauaugggcaaaaaaacacaaaaggaaaaccauaaaauaaaauaaacauauaaaauauucacccucauggauaauaagauaaacacaaauuuuauaaaauaaugggagguuaaagcaaccaaggauauuucacauauuuuucaugguuuucuggaauggaugcuuaaggagguauaaguaggcacaccuuuugugggaugccuuuugcaaauauauaucauaagacuuaaaauauccacaucucugccucuuaaucaggaaaugaucagagaggugugcaaagauuuuauacaauuaugggcaugacauuaacacaaaaaacuuaaaacaggccaaauguccaaugagaguaauaguuuuaaauuuuaugauaaauuucuacugggugccuacuauguguaaaaaccagugucagacgcucaaaucauuuauagaaucauggacuaucaugauaucauuaaaaauaauguuuuugaagaauguuuaauaauauuggaaaaugugcacuauaaaauauugugugaaaaaaaggaaagaucccaaacuguauauaaagcaagauucaaaagauuuaaaggaaauauaccaaaugguaacuguguagauggaaauacaggugauuuuaucuuucucuucuauuuuucuuguauuucauuaaucuaaguaaaacuguuaaauaauuuaaucuuuauuaaagaaaauaucaauuauauauaagauguaacgucaagauaaaagcauauguuuguaucuacuuaagaaaaauuguaauaaauuaggcuaaucuaucauauauauauauauuauauauuuucauuaaacagauagguguugagugccucugcuaucaccaguuacuguuuuagagccuacagauucugguauacugcagugaacaagggaggaaauaauucgcuuugcauuucagcagggguuggggguggggugaugggaaaagggagaguuuacauucaugcucuuucccuuuauaaagaaauggcagcaaugugugugugucgggggcgguggguggagguugaggacgcugcuguuacugugcagucuugugaauaugcaauaggaaacccaauccuuaauuuugacauugcuuuuugcuguaaugugggcaugcucagccaaauaaauaaccaaacaugagaccaagucuagaaacacacuuuugcucauauggcacagaacauaacugcuauccugguguuuagggaccagugcaccagugaaggucuaugcucagaauucugggcaacauauacugcugaaggaacagagcucagaggcuuggaccggcugaucuuauuuucagaaaccaauaaauggagcucuuaauuuuuaauaacugauuuuacagucaucugaugucuaaggucacuuaggauacaggacuuauucaucuaucuguuuauugguucuuaaauaucaauuaauuuccuuaaugguaggaugcugggaaaggaagauggggagggugguccuuaauugcauuuguuuaucacuuuuuauaaucaaaguuauagcgagcuuagaguaaaaauaaaaaaaaguuuuuugaagcauaaaauggcaaauauuaggaguuucauuguauuaggagcgcacacaaaguacauacaagugaaaucuuggaacaguucuuauaacaaacauccaggcaguagacaaacuagagauuucuggaaauaggcagaaaaauaauaacugccggguucuaacuugaagaaacucugauucacauuaacuaccaagagaaaccacacucgaccaguuccuuaagacacgggaccccacaacaagaagcuggugcucugcaaccaguugagaaguacaggacagcugcugagcuauuucaaagacagucauaucuguguggcacacucucccagaagguuacagggcaacuuuccagccacuuacauucacugaugauuuccagggaggguaggaaguauucaucacagacaauagauauggccaugaacauguaaacgauaauuaggaaauagauuaugaugccuccaucucugcgcuccugucucgugaaaaacccuucgggaaacuccgaugauggagaaauaacacauugggugcuauuuccuguuaaggaaaaggaggugaaaguuugaagaguuuggagucacacauuccaagcccacagagagcuuccuuaagaaaucuguaagugugggguaaccggguggaauuuuaaggacccacugaaaauguauaaagcgcuucugaauauaacacaguuguagaguuuucaaaaaauuuuuuugggggacugaaaagagauaucuuaaugaaauauguugaugauggugaagaauuaaaaagaggaaaucaugaaaucacuccuccuuguuuuuauuucugaaucucucuuccccaaguagaaacuguaucucugauacaugaagauuucuauuguuuauacaauuucguuuucucauugcagagccuaaauuguucacaggccugcaaagaauccauccacuguugcagagagaauuucuaagaugaaagauuuuuuguuuucaccaaaaagucuccaagaacaaaaacuggagacuuggccuacuaugaucucugugaauuacuuuggaguauauuuaagaacuuauuugaaggaucaaaaguguuugauaucuuuuuaaaugcuaaaauucagaagcguaaguaaaagugagcccauugagaauuuuccucuuuuugucccuucaucuguaugugguagcagcagcagcagcugcugcugcagagcuaacugaccccaauguccaccuaccuguggcccuugggagacguuggggcagggaggucccugagagaggcagaugugcaguggcccacaggaugccgagcaacagagcccuucucgcccauguuuggcccccuuuugucugcauuucugcugugcucuuacugcagcgugcagcuucaggaagggagaagaggaggauuaaacug

SEQ ID NO: 13372 - RNA, 43761 nt, Homo sapiens
ucacccagucucgaccgguucucgcgagauccggguuacugagcgcucggggccuuuucaaaucgggauccguuaccgcuuccccggcagccgccauugucgcgcucggagccccucagcucaggcggccgaggcggaggcagcggcggcgggauggcggacgccaacaaggccgaggugcccggggccacugguggcgacagcccgcaccugcagcccgcagagccgccgggcgagccgcggcgagagccgcaccccgcggaggcggagaagcagcagccgcagcacagcagcagcuccaauggcguuaaaauguauugucuuuuccuccgggaaccggggcgagguggggggcggggagucuaccgggcggcuagaggccgggcugugccccgaugggggacaaccacccccagaccccggcccgcccccgggccaucggcuuccugaggagcaggugcagcugggccgcucccaggcccuuccccgcccgccccaggccuggccgccuguggucugggagccggggcugggggcccggggaccagcgcucuucccugauuucuagcccgagacagcgaacaccccucuucccugacuuugguuaaagaaucuuugagcaaagcucagcgaccgccacgguuugcaggaaaauggucccccuuuaaggaccaguaguuaguguucaucacuagggaguaucuagggaugacaucaucggacauuuccucuuaaccaccgagaacauauuuaaaaggaauauuccuggcuucuuucugagcuucacaaguuuaguguuuuguuguuuucuaaaguguauguucauuuuuaaacugauuuauaccgagaggaaguuuaauaaugugcuguuagacucuauguuuuguguuacucuugaauuggcuagacguacuuuaaaaagggaaaugugcgaugugcguggcuucccuucccacuggguaaugugcgucagcuguggagaguauuuuuuuuuuuaacucaguguaugauuaucuuaaguuugguauaauagaugguuaagauuuuuuuuuucccaaaugaaggaagacuuuuaaggucgcagcugucaccagugccuauaaagaauuuaguugaccccaauccauaauaauuucugguucuagggaaauguuaugcucuccuuuguuccuguccugugggaggauaugaaguuaagcgcuuacuuucauaugccuaccuccuuaaaccugaaguugaaaguauguuaauaauuaagugaaaacauccuuuuccuucucuguuaugccucagagcagaaagcaauagauauaugcucacaguaaaauagacaagggaaaggucuuucugaccuuuguauaagcauguuugaaauuguaugguaagaacuggaccagucuguguaaaaguugguggcaaaaaagaugggguagcucuccccagcucuuugacacucuugcucucaaaugaguuugaacaggaucggcagcaucuucuaggagaauagaggugcagguauaagagauuggaacuuaguggaguuuauuccuggaugaagaguggugcaccucaguaauugaggaaccagaaagggaaugaagugcuuucuaccaugcuugccaaaaugugggcuuucuggaauuuggcauuaaaaauagaaaugaaaaccgguggaaugauaaacuuaaaaauaugugcuauucauaucuaaacacgaguauacaugccaccuuuucuccugaacaaaaagugcagccuugaauuacagagagaagcccuccuauacuuggguaugauuaguuuugauauaggggaaguuugguaucuaaaccuccaucagauuuucuauucccuucuaaagucucuucaugauuuagcaagacaggaaaagagaaaggagaaagguggagaaagaauccuuuucuaauuuaggaagagaaaaauauaaggugaagaaaugaagaaauauuacuaguaaauacagauuauuuccauauugcuuauaauucgccucucccuuucucuuuuucccagaaguugaaucgaguccaauuuacucucagggauuucucuuacugucuauuccauaagaagauuugugaugguccagcaugagucauucaaacugaauaacuagcgaccuaguccuuuuuuuuuuuuuuuuuuuuuuuacuucgugaacuaguaggaguggauaacaaccccaauacauaaaccuugaguugauuaccauauacuuuuaauaauaaaaauaauucauuguugauuauaaaaauuaccauaauauugccccaaauuauguauugguuggaauugaacagaguacugcuugucaucaggauugaaauaauauuugcugagguuaauccauaguuauugagggugggagaccacuaugucuuauucuucuuuguauucuuaaggccuaguaaauauuuguggaagaaaugcagaagugaacuuucaugcuuaugaaacucauauacagggaauuuaguuugcauauucacaccuuuagaaaagauccguuuuccaacuguagucuucuucuuuaacgccaaaugguauacuagcucuccuuuucuuaaaaaugaauaggagggaaaagagcaguauuauuauaacuuuauuauucauguguaauuaaguauaacuuuggaguagguagagauugagaguuauauuaggguacuauaaaauauuaagcauuggagcaagguaauguguucuuuagcugagugauuuuuauuaggaauaaagacuagaacuguuucccccagcuuuauugagguaaauugacaaaaauuguauauuuugaaguguacagugugaugguuugguauacaaauaaauugugaaaugauuaccacaaucacgcuaauuaacguaucuguuaccucgcauagcuaccauauuuuuugguguugaaaauacuuaagaucuauucuuuaagcaaauuucaaguauacaguaaauauguuaaguauagucacuauacuguaccuuagaucuacagaacuuacucaucuuauaacugaaaguuugugcccuuagaacauuuccccauccccugcugcccuccaccucugguaaacacccuucuacucucugcuucugaguuugacuuuuuuaaaagucuguguguaagugagaucauguagcauuugucuuucugagucuggcuuuuuucacauagcccaauguccucuagguuuaucucuguuguugcaaauggcaagauuuuguucuuuuuguaaggcugaauaauaauauuccaguguggauguguuguguaaacauaaaauauaauauauaucauguuuccuuuaaucauuuaucugucaauggacacuuaagucguuguuuccauaucuuggguauuguggaugaugcagcgaacaugggagugcagauaucuccuugagauagugauuucauuuucauuggauauauacccagaaguggcauugaugaaucaugugguaguucuguuuuuaauuuuuuguggacccuugaugcuguuuuccauaauggcuguaccaauguauauucccaccagcaguaucuaaagguucuuucuccacguccucagcaacaguugcuaucuuuugacuuuucgauaagucauccuaacagguaugaagugauauugcagucugguuuugaguuguauuucccugaugaacagugauauugagcaccuuuucauauaccuuuuggccguugguaugucuucuuuggaaaaauuaucuguuuggauccuuuucucauuuuuuaaauuggguugcuauugaguuguauggguuccuuauacauuuuugauauuaaucccuuauuggauauaugguuugcaaauuuuaucucucauuucuuagguugccuuuuuauuuuguugaguuuccuuugcugugcaauaacuuuuuacuuugauguagucccaguuguuuacuuuuguuuguguugucugugcuuuuggugucauaucaaaaaaaaaaaaaaucauugccaaggccaaggucauggagcuuuucucuuguguuuucuucuaggaguuccaugguuuuagguguuauaaguuuuuaauccauuuucauuuuguuuuguauguggauaucuaguuuucccaauaccauuuuuugaagagacuguccuuucaccauuguauauuuuuggugccuuugucaaggauuaguuuaccauauauuggggauguguuuuugaguguuuguuaugcuccauuggucugugugucuguuuuuguaccaguaccauauuguuuugauuacuauagauuuguaauauaacuugaaucagguagugugguacuuuuaguuuuuucuucuuguuuaagcuugcuuuagccauuugagaucuuuuaugguucauacggauuucaggaauuuuuccguuucugugaaaaaugcuguuagaauuuugauagagaucacauugaauuuauaggucauuuuggguaggaaggacauuuugacaauauuaauuccucucaucugugaacauggaauaucuuucauuuguauuauuuucaauuucuuuuaucauuguuugaucguuuuucaguguauagcucuuuagcuuucuugguuaaauuuauuucuagguauuuuauucuuucugaugcuauuuuaaaugagauuauguucuuaauuuuuuggauaguucauuauuauuaguguguagauaugcaguggauuuuugaauguugacuuuguauucuauaacuuuacugaauuuguucuaauaguuuuuuugguguugucuuuaaaauuuucucugaauaauuuucuauauaagaucacaucuucugcaaacagaguuaauuuuacuucuuucucuccaauuugguugccuuuuaugucuuuuauuugccuaauugcucuggcugugaccuucaguacaauguugaauagaaguggugagcaugggcaucuucucuuuuuccugcucuuagagguaaaaccuucaaauuuucacuguugaguaugacauuagcuaugggguugucauauaugaccuuuauuguguugaggaacauuccuucuauacugaauuuguugagaguguuuaucuugaaaggauguugaguuuugucaaaugcuuuuucuggaucuauugagaugauccuugauuuuuaaaaaauccuucauucuguuaaugugguguauaacauuuauugauuuauguaugucauccuugcgucccugauauagauaccauuugauuaugguguaugauccuuuuaaugugcuguugaauuuaguuugcuaguauuuuguugagaauuuucacaucugugaucaucagggauauugcuguaauuuucuuuucuuguaggauccuugucuugcguuguuaucaggguaaucuuggccuuauaaaaugauuugaaagacuuuccucauguucaguuuuuuggaacaguuugacaaggauugguauuaguucuuaaauguuugguagaauuuaccagguccugggcuucucuuucuugggagauuuuugauuacugacuccaucucccuuguuaguggacaguucagauuuucuaauuuuucaugauucagccuuggugaguuguauauuuccaggaauuuauuaauuucuucuaaguuauccaauuuguugguauauaauuguuaauaguaguuucuuaugauucucuguauuucugugguaucuguuauaaugucuccucuuugauuucuuuauauauuuuucuauuuuuuccucuuugauuucugauuguuuuucccccuuaaucuaguuugaucuuugucaguuuugcuuaucuuucaaaaaccaacuuuuaauuuuauugaucuuuucuauuguuuuucuaguauauuucauuuauuuuugcccugauuuucauuauuuucuucuuucuacuaaguuuggacugagcucuuuuuucuaguuccuugagguguaaaguuagguuguuggagaucuuuauucuuuuuuuuuuuuuugauacagagucuugcucuguaucaaaaaaaaaaugugcaauggugugaucuuggcucacugcaaccucugccuccuggguucaggugaaucuccugccucagccucccaagcagcugggauuacaggcaugcaucacuacgucuggcuaauuuuuguauuuuuaguagagacgggguuucaccauguuggccagguucaucucgaacuccugaccucaagucacccaccugccuuggccucccaaagugccgggauuacagaugugagccacugcaccuggccuggaggucguuuuucuuaauguagacauuuacugcucugaacugcccucugguaguuuuccucuggaacugggauuaauauuggaucucauacuacaccauuauacuuuuaaaaucacacauuaaaacuauguuucuucuuuugauguuggagcuugauuuuuuucagaaauguauguuauaauuuagauacgcauaguucaauuuuaagaauagauaacauuuuuaugacuauuuuaggguuuuuauuuuaaguacauugugggagugguugucuaaaugaacaguuugggaauuuaguacuuggaauucuggauguaguaccaauauuuuggaauuauguagcaucauuuccuuaagaguuuucacauauauuuuuacuuucucuuccaaaguauuuaugacuuggaaauaguucagaaauuauauaauuauggcucaguuucuuaauaauuagaucaucccuguagccucucaacuguuaugccuuuuauaguuuuuuuucuuuuuuuguuauacacugggaagaaacuuaagauaaauuuuaauucuacaucauagaugagcaguuuagcaguauuuuuaagaugcuucuuaugggggaaaaaugaagaaauuuacuuucucugaucaucuuugaguaaauauuuuaaagaaaauauuauauauaauguuacuguuuuuaauggaauuuucagauuguuguaagcaaauauuuaaucuauguaaccccaccuaagucaagaauagaacauuguaaguacuucagaacuuuguguaauuuucacaauugguuuaauccaggaagaaaauaggcaggggaagggguauuaaucuagagacuauauagauaucugcuuacugaauagagucuuaguuacuuuacaaacauucacugaauucaucuaagccuauuauguaaacaggcccuuugggaauugaaaagaaagguuuguucuucuaucugcgguacucagaaaccagagaaaaggccuuugugccuuuuggcugcuugcugccauuuucaaaagugucacucuguuuagacagguagguacuuucuagauuuagacaguugagaagacuccccccuaggccaugccauuucugaugaaggaauauguuugauagugaagauguccuuuuuaaggucuaaaaaaaauggcaaagcaaguuugguccaaaugucucuuucuuuauucuagcaguuuuucuggcaacaucugugcucagaugaguauggauucuuaauugacuguuaauucauuaaaaaauuauagcacaauguuauaugcagucaccgugcgaggugcugcugauaccaaagcagauaguuuuuguucucauagaguuuacauacuauauuuauggcuguguuaccuacaaagaagaguaguguucaagaagcucuguauauauuauguaacaaaugacugcaguuagagguguguggagcauugcaauguguggaucaccagaauugcugggcuuagaagauaauuuagagccuggcucaugaaacuugguuuguugucagaauaauccagaaagcuuuaaaaaaaauuuagauuccugggugucauccacagugauauuauuaguaauguuugugaaaaauugcuuuaaaauugaaguuuuguuauuaaaauaguuuuaaauugacuagagcacuuauuuaaauaagaaaucuauuggccgggcacgguggcucacaccuguaaucccagcacuuugggaggccgaggcggguggaucaccagaggucaggaguuugagaccagccuggccaacauggugaaacccugucucuacuaaaaauacaaaaauuagcuggguguaguggcagacaccuguaauuccagcuacuugggaggcugaggaaggagaauuccuugaacccaggaggcggagauugcagugagccgagaucuugccacuguacuccagccugggugacagaaugagacuguaucucaaacaacaacaacaacaacaacagcaacaaaaacccccacaaaaaacccuauuguuugugcuguaaaaaagacuuguuuugaaaaguaaauugcauuuuaaaauagaaauccaaauuuuuaucuguaggguuuaaguguaugccuacaucuuuuggaugguuggcauaugacaucauagaguugcauugugauuacgguauuauaaauuacuuuuuuuucuaguuaaggccucauuaaaaaucagguuuggccaggcgugguggcucacgccuguaaucccagcacuuugggaggcgaggugaguggaucacgaggucaggaguucaagaucagccuggccaagaugaugaaaccccgucucuacuaaaaauacaaaaaauuagcugggcaugguggugggcaccuguaaucccagcugcucaggaggcuaaggcagagaauugcuuggaccugggaggcggagguugcagugagucgagauugcaccacugcacuccagccugggugacagagcaaaacuccgucucaaaaaaaaaaaaaaaaucagguuuauaaaauuuuggcuuacguugcuuuuauguacugcuucuguccuacauuacccauuguagguaauauuaaugaaacugcauaauuugaugaaguacccuauucuaguuuauagguuaaaauguaacauaaaauauuaggauacuuuauaaguuuucuguguugaucaaaauugggaauagaagaaaguuugagagucuuaaugugaguauauucauauauagauguggauuuauauacauaacuuuguauuuuaauuaugcuucuaauuaagggaggagaaaguucugagaagaaacuauuaaccuuuaagagaugaacuuuuucagaguaucacuguguaaguuaguuuuuaaaaaaguuuuuaaugaugcccagaaaguuaauucuccaucaaagguggcaguuuuagauaccuuagaaguaaaauuaucugcucuucccucuguuccagucuaauagcauuuauuaauuaaguagugugaugggaaaaacugggugauuguuuggaugcuuacaacuauuuaaugugggaaaaaaaugaggacuguuaaaugagaaaccaaauccuugcuuugaaauagcauuggguaauuucaaagcucucaggcugauucuccagcuacuuugcugaggucuagcuuaguggagaguuuugugaggugauaaauauggaauacuuauuuaauauagacuuccauucuuauaagcacaacugaggguuuuuguuuguuugacuuuuuuuaauucacagggagaaugaugaaucagcaaaagaagagaaaucugacuuaaaggaaaaaucuacaggaaguaagaaggccaauagauuucauccuuauucaaaagacaagaauucgggcgcuggagaaaagaaggguccaaaucguaacagaguuuucauuagcaacaucccauaugacaugaaauggcaagcuauuaaagaucuaaugagagagaaagguaacuaucucugaaauaacccacuguuggauaaucuucauauaggcaggggagggaacuacacaaacauuuuuauuccucugagccacacagacucaaaaaauugauuuuuauuucuugacaugugaauuaaucuuuuccucuucuuucucuugacacaauuucauuacaagguaguauggauauuuuucuuuuugccauuuuagugggauaguagcgagccagcauaugcaugccaccaagaauuuuguuaaagugauugcuuugucuaguugaaguuuuuauagauuuuaaaagggcuauugcauuaguuaagcaauacauuuagcguguuaagaaugaauaauaaggucugauuauuuauuuuuuuuccaaaagcuguuuuguuacuaucuugguggagucuggaaucuggcuguggaauuuauuuuguuugcauugucaugacugccaugaugcugucuuugcaguucuaaauuaaaauugcauuacugcuguugcaguuuuguuuucagaauaaucugaaaaccuucaucuuauauacaugguugguuuuggggaaaaauaauuuuaauacuugaucuuguaaaaguuaguuuuguuaucucuugaaaaauugaguuucaacaguccugcaaacuauguacuuggcuuugaggcugaucucuucuaauaaauuuuuuuuuuuaaauugcauugguguaucuguuguaaggugacaacuauuugauugguuuuauucauugacuuuauuuagaaaguguguggcuugcugugaagcaugauuuguaaauuuaguuuacugauggcaaacaugauugaagacauucagguagaaagucaccuuaaaacagcuguuguguguaggcugaccaaaguuauuugaaaagugcuaauguugauguuuuuuaauaugauagguuaagggaccauuuguauguauaugugcauuuguucaccaacuauaucaugcuggccaaaauaugaucuguaguaugaauuagguuaauaugguuguuagcuuuuuuuuagagaauguggaugauguacauuucugaaaauuaguuaaauuuacauagccauugauaggagguauguuggucugguuuugauuguuggugaauaauaggugcuucucuguagaguugugcacaggugugcaguaaagcaagauacugguguuuaaauguauuguuucuugguaucuuccuuuuguaugucuuauguaguuggugagguuacauacguggagcucuuuaaggaugcggaaggaaaaucaaggguaagugcugugggcaauaaucugcuugagguuuaaaaguuccucagcaguuuacuuuuuguauaauacuuguaccaguuuuuggaaacuuaaguuucauuuuguuuuacuuuauuaugcaagauuugaggcucuauaccagcaagucugacacuuauacaaaccuagcugccuggaagggauggguuuuguaaacacuccaaaggggcauucacuuuuccaaugcucuaagguaauacuucuucuuagccaauaagauuuuagcauaggauuuuuuuuguuguauuuugaugucuucaaggauacuuuaaaagucacugaauugauaauauuccugaguuuuuugagggcuauagcuuaaagguguuaguucagaauguauuuuugaaauuuuacugaaaaguuaaauuugguagccugcaggacuacaugagaggcagugcucugaccaauugguaugaaugacauuuacgauuauauugacguagaaggaauugguugauaguauauuuugauuuuuagcaauaagaaugcaguauacugaagaauacaauggaaaacucuuagcaauguuucauuauguuaguaaaacuaguugggugcaugaugaauaaaaauuuugucauuacauucauaugggacuuugaauggcaaucacagggaauuauuuuuuaaauaacucuccaaauuaauuuauuauuaguuuauagaugauuuuuacauacuuccaacugggugcuguuaaaugugcagccaguuuuaaucuaauagagaacuuguuaaaaauaaaauuaauauuuauucacuauuuugauuuuaauagaguugaaaaauaugucguagacaauacauuuuuugaaaauauuuguaacuacagaaggauaggucuauuggagccuuuaguuauuuccuugaauuccuguugauuuaauuugugcagugacauuaauuuuaacuuaaugaaaagucaccuaaaagugaaaaaugugcuccaagcuuguuacauguuagagucuacuaucuuuaauagauauauuuaaaaauuuagagaaaauuugugguuacuugccuguuauguucuggagguauaaaagaugaagugauucuaccauauuauuaauugccuuaaugauugaaauguuagaacugauuauuaacuucauguacugaucuaaaacuuuuuuucuuuugcauauuuugacaaaucuaccuggauauaggguuguggguaagaaauuuuuucuuuaaguaucuuaagucaaauuaaacuuuggaaaaaaauuagcacauaaacauuuccuauaaauuuuuucccuauuaagugugguugaauucaaagaugaagaauuuguaaagaaagcccuagaaacuaugaacaaauaugaucuuaguggaagaccccuuaauauuaaagagguaagauuucucauauuuagaauuuaaacauuugacuauaaagacauguuuuccuuggauuuucaauuugguaauauauuugccugacuacaacuuuuuuuuaaaacauagguguucauuaaagcauuauauauugacgaaaguuuuacuuguacaugauuuuauauuugcuguuaagcaguuauccuauauacuugauugguuccaaguuguuaaaaauaaaagcacauaauuuaaaaaaauuugaggaccuagaaauucaaaggggauaaacuuuaggugcuaaguuuauuugguacagacauuuucaauauuuagauuuuguuauuugagaaauauaauauccuuguaauugauaauuaaaggucacuuaaugcaaauauguuauggauuugaauaaaauugauauucacuuuuuaucagaguuacuuggaaacuguacuagauuaaaauuuaagaaaaauuauaacuuuguuagugaaauuuauaacuagaaguuggaauccccuaaaauggaaaugucuucuuuguacaaaauuguagcaguguaaacagguugacaaaaaaugacuagaagauacaaacaaaaaauuuacaguuuaaccuugagaaugauuggcuugaauagcacucaucuucauagguuccuuuauuuuguauuguuaaucuuaauaguuugauuacagaccuguuauguacauauacuugcuaaagucuguguuaaaagagauaaauaguguaacuuugggacccugaagauuuuguacuaauacugaugcuaaucauugguuguagagcaguacugucacccauggcauuuaauaguauacuaaugauuugauuccuggcuuuaucacuuucuagugggugucuagacaugcuacuuaauuucucuaaacugaaguaaugguaguaguacuacugauaauagaggcauaccuuggagcuauuguagguuugguuccagacuacugcaauaaagcaaauauaacaauaaacugugucauauguauguuuugguuuugcaguacacauaaaaguuacguuuauacuauauucuguuuaaagugugcaauagcauuaugucuaaaagcacaauauacaugccuuaauuuaaaaauacuuuauugcugaaaaugcuagugaucauuugaacuuucacuguaaccuuuuugcugguggagagucuugccucagugcugauggcugcugacugaucagggugaugguuacuaaaguuugggguggcuguugcaauuucuuaaauuaagaacaaugaaguuugcuguaucaguugagucuuccuuucauaauagauuucucugaagcaugugauguuguuugauagcauuuuaccuacgguugaacuuccuucaaaauugaagucaguccucucaaaccugcugcugcuuuaucaauuaaauuuauauaauauucuaaauccuuuguugucauuucaacaguguacauagcauauucaccagguguagauuccaucucaagaaaugacuuucuuugcucauacaagaaguaacuccuaauuuguuuagguuuuaucaugaguuuacagcaauuuauucacaucuucaggauccacuucuaauucuaguuuucuugcucuuuccaucacaucuucaguuacauccaccauugaaaucuugaagcccucaaagucauccauuaggauuagaauccacuuauuccaaacuccuguuaguauugauauuuugaccuuaugaaucacagauguucuuaaugacaucuagaaugguacauucuuuccagaagguuuuuaauuuacuuugcccaggucuaucagaggaaucacugucuaugacagcaauagccuuacaaauuguauuucuuaaauaaucaggcuugaaaguuaaaauuauuucuugauugauggguuacagaguggauauuguguuaauagaccugcaaacaacauuagucuucuuguauaucuucuuuagcacucuugggugacaagugcauugucaaugagcaguaauauuucaaaaggauuuuuuuuuugagcaagaggucucaacagugggcuuaaaauauucagcaaacuauccuuaaacaggugugcugucauccaggcuuuguuauuucauuuacagagcacagacagaguagauuuagccuaauuauuaagggcccuaggauuuucagaaugguaaaugagcauuggcuucaagucaauuaagguuaccaguugcauuagccccuaauaaaagagucaauguggccuuugaagcuuugaagccaaacacugacuucucccuucuaacucugaaaguccuagauggcaucuucuuucuauagaagacuguuucauuacacugaaaaucuauuguuuaguguagccaucucaucaaugaucuuagcuagguguucuggauaacuuucuguagcuucuacaucagcacuugcugcuucacuugcacuuuuauguuauagagauggcuucuuucuuuaaaucucaugaaccagcuucaaacuuuucuucugcagcuuucucaccucucucagccuucauagaauugaagagaguuaaggccuuacucuggauuaggcuuuggcuuaagggaaugaugagggugcuuugaucuucuguucaaaccacugaaacuuucagaccacugaaauguuauaagcacaaacaagugaaguaucuuaauaguucaagaagcaucuucuguguuguguuauccuucuuccccaaagguaaccgguaucuuaaauuuuguguuuuuaccuguuuuugaaacagcauuaaggcuguuucacuuucucaucauucgugcguucacuggaguagcacuuuaaguuuccuucaggaacuucgaugcaagaggcccggcuuuucaccugucugaacuuuugacaugccuuccucacuaagcuuaaucaugucuaacuuuugauuuaaagugagagacuugcaacucuuucuuuuacuugaacacuuagaagccauuuuaggguuauuaacugaccuaauuucaauauuauugugucuuggaauagggaggccugaggcgacggagagagauggggagcggcuggucgguggagcagucagaacauuuauugauuaaguucgcuguuuuauuugggcacgguugauggugccccaaaacaauuaaaacaucaaagaucacugaucacagaucaccauaacagauaauaaugaagaagguugagauauugcaugaauuaccaaaaugugauacggagacacaaagugagcacauguugggaaaauggugcuaauagacuugccggacacgggguugucacagaccuucaauuugcaaaaagugcaauaucugcaaagcacaguaaagugaagcacaauaaaaugaaaugugcuuuuauuuaccuaauaggauuuuuaugaggauuaaaugagauacaugguaaagaacuuauguucuggcaucagagaaccucucuaacucagggcaaauuacuuaaacuuucuccuuuguuuucauaauuacuaagaugggaguaaugauagcaccuaccucauagugcuaucaggacucgaagaguuaauauauguaaaccauuuaguguuggcuauuuauuaugcuugugauauuaccaguguacaaagcacuaagcacagugcucaaaauauuuuagcuacauaauaaacguuagcuuuaguaaugaugauuguuacuccuguccaagagucuuuuguuccugagugugagauaauagcuugaaaucaaaggccaugcuaccaacauauaacauguaucccagauaccuuuauuugagcuugcuuccaaauuauucuaguccuguuugagucugggguuuauuauuaaaaaaguuauuaacaggaauguauagaauuagcagagaaaauuuugacuguugugguuugugucagccaauuauuggugguuuuuaugcauaagccagggccagugcuucagaaauauauugguaucuuaauuuucuuuaaauuauaauaaucagaaugauuauuuugaggauuaaauuagguuggugcaaaaguaaaugcaguuuuugccauuaaaaaaagcuuugaauuaaaauaauggcaaaaacugcauuuacuuuugcaccaaccugacaauuuucuguuuuauguuuucuguuucucuucaaaggacauguacuacagauucuuagugucuuuuucuuuuauuggaaaaaaaaguuuauuggaugcuaaauaucauccaauaaacuuccauauaauauuggaugcuaaauaucauguuauuguguucuuuuaaguuucagcacauuguagauccucaguaauauuucagagacccuggaguuauauaauccaaguugaaagaggaugccgccauuuuuaacuuuuuuaagagaaaaaaaaaaggcuaaauuuggccuagcuaaaugaugagggauuuauucaguugacuuuuuugaauuaaugucacuuuggcagucccuuuccugggauaucuaauuuauagagggguggauggaaugaaugcuuagaacugcuacugaggaaagucuaaggaagguguauuuccaauguuccuuaacagacuuuagaguuacauuuuuuucauuuaauuaaaugcagaauaguagcaguuauaaacugcuauuguaggcccuccaaaagcaauagcagucaguaaccagcaggcugacagcaaggggaaaagaagaguaaaagucauguuauauaguaggugguuuguuuuauauaaauuuuauuuuauauauguuuuauguauguaugcauguauuguauguguauauauuucugucauauauauguauauaaaagacagaucaacacagcaauacaucuuguuaauguuauaagcacaaacaaccgaaauagcuuacuauacuaguugaagaaauaucuucucuucugaguuaucuuucuuccccauagguagccacuguccuaaauuucguauuuuuaccucuuuuugaauccucaggccuaaagaauuuauuuauuaacuuauauguuuugaagcauucuuugauacauuuuuuuuuucuuuuguaauccuuuuuauuccuucauagugaagaaauauguugcaagccagaaugguuuuauuauuuuaccuuuucaccuuuuauucuccagccauccuagagaauuuauuaaaaucacuugacuuucuuuuuauuaguacuguauucccagacugaggccagcaaaguagauuugaugguuaccuuuacacuucaucuuagccuaaagauagagaagugaugauggggugauuaccuuuaacauaaucauuuggcauugcagaugauagucuauccauguguuuaugugguuuuuguuuauuuauuuuuguuuuuuaguauuccaccuagugggaugagugagaaguacauuuauguuuguguguguguguguguguguguguguguguguauguuugguuuuguuuaaagguaggguguuucucuuaaaaaauuaaugaaccuaacaaaaaaacaauguuuaauaucauuucucacuuggacauuuagcccuccuuuaucucuccucuccuccaucucagauuauaaucauuguugaagaagguaagaguuuagaagguggguaacuguauuuuguucaggaauaaaauuuacagauuacagucggccauccuauccucuaccccaguauuuggguuuuauaacagucuguuccaguauugaaaagcuuugaauuagucugaauuuggcauuccauugggcauccaauagugagaaaugaccauuccuacauuuuggaaagaaaaguugcagugaguacuucgcucuucuuugaguuacauguauguaugcauguacccuagugugagagcaaaauuaaacuaauuucaaguucuuaaguggcuuuagugauuggaaaaaaaaauuaacugacaucucuggaggcugaaauauuuuguuuauccacagguuuuuaugggacucaauucucuggaugagaaaaaagcucacucuucaagagggucaauaauuugagccagacaggauagcuacuguagaauuuaaauuguuauuuuaauuuuguagaauuagugauguauuuaguggaauuuaacauucaauguguguuauaggauccugauggagaaaaugcucguagggcauugcagcgaacaggaggaucauuuccaggaggacacgucccugauaugggaucaggguugaugaauuuaccaccuuccauacucaauaauccaaacauuccuccugaagucaucaguaauuugcaggccgguagacuugguuccacaauuuuuguugccaauguaaguucaagcuuuagucuaaaauuugucauucagauagauagcuaauuugauuaaaugaaugaguuauagguuuauagaacauuuugcuuauuuuuaacuaaaguaagugaaauaguaauuauuguaaacucaaaaucaauugacguauauacauauauauacacacacacacacacgcacaagguuagaguuuaaauacaacuauuuggauuuuuuaaacauggaacugugcaguuuauacacauucaagcaguucuugaaauuauauguguuuugguuuauauugguaaauggauuucuuuuuuuagucuugauauuugugaauaugcaugccauaguugguuuguuauuuguucuaagcaucugaaagucagugaaaacaauacuuuucaaaaucuggauuucucuugguaaaaauagauaugcaaguuucaaauguacaaaacagguuugagcaguugagagaugauuuuggaaauuaaaaaaaauaaggauaaggaacaauguagacguagcuuaaaugauuuuaagcaacugaagauguuuuaaaauuugaacauuaucaauauauuguugaacuagaauuaugguucuuuaugguuuuaagaguuuagaaaagauuuuuuguauuuacagauggggagauggauuuauuagguauguaacuuuauacaauuuuauauuaagcuugacuucaaaguugguuggaagaagcuaaaggaaguguucagcauagcuggaacugugaagcgggcagauauuaaagaagacaaagauggcaagagcagaggaaugggcacugucacuuuugagcaagcaauugaagcaguucaagcaauuuguauccugauuuacauuucagcauuguuuaugagguugaagaagcauaauaccaccuuuguuuuggcgggggguaauugaauuuaagguugccuggcuuagagauguguguuagacuuuagucuccagcaaauaaaacccuuaguagguccaaguauuaaagucacucuuaaaacuugaauuggccauauuguacagggcugguaugaaguuuuuucuuuucuuucuuccuaccacaauuaauuguauacauggauuuaacaauuguguaaucuauuguauauuaaugcaguuacuuuaagcgaagccuuacgaguuuacuuuuuucaaugguugaauuaaaaauacaucuuauugaugaaauaaaaccguaaagcaaagaauugaauauuuuuuugaguauaugaaaguggcuaauaucaauaaguauuaaagauguuaauuaaaauaucagagaguuggacucuaagauuauuaaaaauuaguuuguguucuguuauaauuuuauaguuaucuuaacugacuuuccuugacugaaccaacagcuauguucaaugggcaguuuuuauuugauagaccuaugcaugugaaaauggugaguuccuguauaucacuucaaccuccaaccucuucagaucuuuuauuggcucucuucuacauuacaguucuuugugguaauauguuaaccauauuauaaacuuucuugcaauuaggaugacaagucuguuccucaugaagaguaccguucacaugaugguaaaacaccacaauuaccacguaaguaaaagcuauuaugagaaacaacauaggcuuuuuuugguuuguuuuauuaugugcuaagcaacacuuuguuuuugugccuacauccuaguuucucacaauuugggauuaguuuggaguuaugaagauaguuuggcgcuauugauuaggaagacugagaagauaaguguuacgugccauuuuuuuuuucucuuugguaacuuuuccugacuaaucagcaauacauucuaaaauguuugguaaauuuauacacuugaaggaaaaaaaguccucuguaauuucaccaucuguggguaaccucauuauaacauuuuuguguauuuucuucuagccugcuauguauauuuuuuacauaguugggaacaaaaauaauuuugaauuauuuuuuguuuaacauuagaguauaagcauuuuuucauguugaagauucuuuucaaauauuuuuauugguaguauaauagucuaucauauagauguuccauaacuauuucacuguucuguauuuuagguguuuuaacuuuucuuuugaguaaccacagaguaacacaugccuuuuuguucacaaaucuuuguaauguuuuugaguacuuccuucagacagauauucugaaguagauuuacaguucucauggguuaguauuaucaaauuguuuuccaaaaugacuauaacaguguaauauacuuauuguauuaugugucucagugccucugugucucagugccuccuuugaaaaguggggagaauaauauugucuacgucaugggguugacaugaguauuacaugaauuaauauauguaaagcacuuagaaucauuuuggcauaauguaaacacucaauaaauauuagcuauuguuuuuacuauuucacugcaucuucucugguuuuuaaaguauucuuauaagaaaucuuaaauauacagacaaaaguaaaauuacucauauaguuaucauaugccauauuuguuguagauuuuuuucuuuaaaauaaauaaaauuuuaugguaaaauggagcuuccccaucucccuugcccaucuuucaacuuaugccuuauccagaggaaacaacuuauggauagaguauuuaucauuuagguuuuaauaauuugacuacacauuuguacauccauaaacauagggaauuguuuuguuggauuuaaaauuuuguuugagugauaucauaauguauuauguaacuugcuuuuuuuuuuaaauuguuuuugagauucauuuauguugauagauguagcucuaguuucuucauuuuaacugcugauaccacauuuuauacauuuuucuguuuuuuagguuauuuuaauuuuuaguuauuguguauuaaguuggaaaguauuugcuauuuuuuaucagaauuauauguucucuuuauauuugcuagaaauuauguguaaaacuggccuuccucuguuguuucugggaaguuuuuaacuacugaugguuuauauuuucugucuuuuuuuuuugagucaauuuuuguaauuucuauuuuucuaaggauuuuuucuguuuuuguucauuuucaaauauuuuggcuuaaauuaucucuuaaguuuuugcuacaucuauguuucuguuuuaaaaauucugaaugcaauuuuuauuuuuuucuugguuaauuuuguuagaaauuugucgguuuuaauagaguauucaaauaacugaauuuggauguuuuguauuucuaauuucugcacuuagccuuauuauuuuuuccuucuauuuauugggguuuaguguguuuuuguccuaacuccuuaaguugaaugcuuacuucaaauugguagcuuuuccuuucuaauauaagcauuuaugacuauaaaguuaguacauggguuuugcuauggagcauuuuuaugaugggucaguuuuuagaguauuuaaaaauuaccauuaugggccgggcaugguggcuaacaccuguaaucccagcacuuugggaggcccaggcagguggaucacuugaggucaggaguucgagaucagccuggucaacauggugaaaccccgucucuacuaaaaauacaaaaaaaaguagccaggcaugguggcgcaugccuguagucccaguuacucaggagacuagggcaggagaauugcuugaaccugggaggcagagguugcagugagcugagaucgugccccugcacuccagccugggugacagagggagacucugucucaaaaaaaaaaaaaaaaaauuaccauuaugauuucuuauugagccauguauuauuugaaaauggaaguuuucaauuuccaaauguaugaguuuuuuuuuuuuuccuuuguacuuuuucauuuuaauguggucagagaacaugguuuauaugugagugugauucuuuggaauucauuuggacuuauggauggccuaccauauggcacauuuuucuuaaguauucuggguacaguuggugagugcagugaucuauauguguucauuaaaucaaguuugcuaaucauuuaaauugucuuagauccaauacuuuuucugcuguaacacuguuuaucuuauuaucuuaugugucugguaaaauugcccaauagaauaguggauuugucuacuuuuucuuguuuuuacuuaaauauuuuuaagcuagcuuaguaggugcaucuagauuagaauugauauauuuuccuagugaauuaaaaauuuuauugggugauuuuuuuucucuaguaguuacuuugagucuuuggucucauuuuaauguaaguacagcagcuuuauuuuguuuaguacuugccugguacauuuuuccuauuuuuuuacuguuucaggcaugccccuuauaaaggguguuauugcugggcuuagacuuuuuaaaaaaaucacuuugauaguuuuuuucaccaugaaauugaagaguucaauuucuucacauguauugguucauuuggauuaauuuccauuauauugugucuuauuuuuuugucuuacaaauacuuauuuuacuccuaucuuggauucuucuggauauuuuaauauuucugugaagccugaaguuaauauaauuauucuuuuauguaauaguagagugaccuuuggauacagucacuuuccuacugaauuauacuaucauugcucagcauuuuaguucuguauuauuaguucuguacuauuuuuuuuucuguccugcaaauuagacaauguuauuuaccauuuucuugugucaucacuccucugcuuuuauagacucuggcacuaauuuuuuuccccugaagcauauauguuagaagcucuuuuaagugaggaucuuuuauuaguaaauucucucaauuuuggguuuuaaauguuuucaaagauaguuuaacuuguauaaagauugauaauuauuuucucuaagcacuuugaaaguauucuacagucuucauguuuacacuguugcuauuaagucagcuauuuguugaaucguccuuucuuuauaaguaaucuguccuuccugugcaguuugugcaguuugacagcaaagaccaaagucuuaaaaucagcuacaugucauuaugcaagcaaccuaaggucucaaaaauuuccucuucuauggacaauagauguggaaacacuuaaggugccauauaaauauaaauaaauauuuauaucaaugagaaaacuagguaauauaauauuugccuuauucaguguuauacuuucaugguuauugacuuuuuaguuugauuugaaccauuuaaaaaguaauuaucaaauuuuaagugggucuacaaauuugggcaagauacucauuuucagauaugugugccauauauaaggugauaugauauuauucaaaauccucuagguauuuuauuauuccucucaguguaccuuuaagugggguauaagguguacuuuguauuauaucauguuuuauuucauaaaacacuucucauuaauaaaugguuuuauagucgggcuucagugugcuacuuucuagacaaaaacaagaaccagugcuuuuauaugaaaauuugcagaaauuuuacagauacuacuacagguauauagcuuuuuaaaaaauuuuauugccaauuaguuaaucauauauggaucuuuguaaugauuguucucauuuuuguuuuagguggucuuggaggcauugggaugggacuugguccggguggacagccuauuagugccagccaguugaacauagguggaguaaugggaaauuuagguccagguggugaguauucuaacuuccucuuuucuuuuuaaaugauacauaugcuagcuaauaaagccuccauugauguggucuguaauaauguuuaaaggacucuaauuaauaguuagauauuuacggugucacuucauucugaaaaaggaaugaaaccuugagcacagcuaacaugaaagagauaggcagaagucaggaggguuucuuuggggccagcuauguuguagcuagccuuuuagcauuuuggauuuugaaaugucuugaaggcagaaggagaauauaucaucuaugaacaguauuuauggaguagcugaaaugcuaccauaucauaggcagcuaaaaucuguuuauccauuugggaagguggcuuuucagguaguuauuuggcugcucaccuggaagaacucacaguucauuuuuagagauugguuuuuaaacuuugguguuaggacccuuuuauauuuuaaaauuuguugagaacccgaaaaugcuuuguuuauguaguuauaauuaccaguauuuacuguauuauaaaugaaaaauuagaaauuaaaaaaauuacauauuaaaaaaugauaaacucauuacauguuaacauacauaaaaguuuuaagaaaauaaacuauuuuucaaugcaaaaaagaaauuggugaggagaguggcauuguuuuaccuuuccacacaucuuuuuaauguuuggcuuaauauugcuguuauaucuguuucugcacuuuaguuuuuugugauauuguacaucauauaguguuuggaaaauuacaccuuaaacucaagagaaugaggguaaaacaucaaauaaugucuuaguaguauuuggugacuuaaauaguuuugaccuauugaacccucaagagucccuggaccauacuuugugaauuacuguuuuaauugauggacuaauaaaugcuaucagauuccuauuuugucaagaugcuguagucacacuuuaaauuaugaggcucauuaucauaaucauucugauccaaacaaguuuucucccuuacccuuagacucucacaccuaccuacccucuccuaaauacauacuauuuauauuuugaaaauuuuuacugcucuuuuaacugcgauguuuagagaguccuuacauucuggccugaucucuaaaucugcuguaaugcuauuucugugucuaugcuggaaaaaaaaaaucauugauaguaguauuucuguguuuauuguggaaaaaaaagugaaugauuaccuaguucaagauauucucuaacugaauguuguggguguuacuagugaauuuugcuuucuugucugauaaauguucaaagaaacccuuuugaagauucaugauuagacagcugcuauggcauagcacuuuaaaccaugccuccuguacccuaccgcuucucuaguguuucauugugguuauaccagugguaucuauuuugcuauaaugcauuauaucaucuuuuagucauaaaaauaaaauauacuuaaaguacauacuguguauuuuauuugagguaugggaauggaugguccagguuuuggaggaaugaauagaauuggaggagguauguauaaagauuuguuuuuuuguauguacccaucaccauuuuuaauaaacuagaaacuguguugagaauuccaugaaaaaaaagucaugguuuauuguuggcucauguucuaaaggcugcuagcagaaauugagccugguacauacuuaaaggaaggugauguguuaagaaguagcugcacaagguaggguggaugaagagcuuacuggugagauuuaacauuuacaaaacguaccuuucagcuacaugacugacaguuggaucucaaaauuaaucuuuauuccauaggaauaggguuugguggucuggaagcaaugaauagcaugggaggauuuggaggaguuggccgaaugggagguagguaaauguaugcagugggaagugugugcauauuuaguuuucccuauuauuaauauuuccccccuauaacuuaggaaugugugcuaaaaaugucuucagaaggcauauaggcacuaggggauaaggacaggccuggggaauggggaugauauguguggcaugugagguaaauuggguaaaugacagacuauuuuauauuugugacuuacgcgucuuuucauaauuuagauacauuccugaauguuuucaacauguauugauauauuugaaaagguuaauuuguugcacaauuuuuucagagcuguaccguggugcgaugacuaguagcauggagcgagauuuuggacguggugauauuggaauaaaucaaggcuuuggagauuccuuugguagacuugguagggcuggcugcauacuucuccuuuucuuuuuguaggcuauaauuuuugaaauuugguuucucuuuuuuugugaaaaaucagaaaaucauaauguuuuauacaacuuauuaccugaagaaaacacuuuaaggauuuuaauaugcuagcucucuuuuucaacaucuuacauauuugaacucuauuuucagaagacuuuaugcuuuucauuuauuguaaaucagagcacauaguaccuugggaauuuuaaaguaugauuauuuaaaauuaauuaguauauuaucuuuccauccuuguuuaggcagugcaaugauuggaggguuugcaggaagaauaggaucuucuaacauggguccaguaggaucuggaauaaguagguuuaaauuuuacuagaauuuauucaguaauauuugagugcuugcaaagacuuugcaagaguaguuaucguaguauaguaauacuuuguucuuauacguuaaugugucuugcuauaauuugagaaaccuugauaauugagcaaagccuuucuguuugauuauuguuugaaauuucuaaauuaacuguuugaauuuuacuuuuuugauauuucuaaacuauguguuaacagccaauccaggaaccuucuuuccaacuaaggaaucuggggauuucucugaucauguuucaggagcaacuuuugcuuuagcaccaacuuuguuuccuugcuuauuuucuauaauagcuauuagugacuagcuuauuuuauuuguaaacaucuaugucuuuugguaaaugcagauauagcacucuuaggcaucuccugagcuugagucaggcuaagguugaaagagguacuuaauucuuuuccucuugaaccuuucccguaauagcaucaagaguaguugcaacacuggggaaugcugaaucucccauccgucuauuuccacuccuaccuuuuaggccuuauauuaagccugaauacauggauuauuuauuuauuuuuuuaaccucuuuugcuuacugggacaugucucugagcucuccauacuuuauugacuuccuuuaauugaucaaauuucacaaauagaaaauacaaccuauuuaaacuauucuaaaaguaaauucuaaaauccugucagcuuaagacgucuacuuccauuguaucuugcuccuuuuauuccuccuuccaucaucuuuuagccucagccauuuccuauuaguccuaacuuccuuaccuuccucuuuuaucucaguguuuguacuucuguuucccugauuuuauauugguuauucacaaaaagccaauuugagggugauguuaauuuuuagaauuuccauguuuggggauauuacauacaagacaaaagguuugauaaugaguaagaugggagcaauugaaaaggacaggaaaucgagucagugcauaagaaugaaguagguaugaguucggagcuaaauucuuaagcucuggcuaacgggaagugauagcauuuuuuguucccuugacaaguuccguguaauauugagauuaaaaguuauguuuugcuaugaguauugaauuaccaugagaauaaaaacugggaaacagaggugaagaugcugaggugaaagauaagcuaggaaaggaguauuuacuuguaggagaguaugaugagagcggcuugagugcuagaguuguaauaauuugcauuuaucucuguguaucuuuauuuuagcaauuauuaugcuugauauuauuggaaaauaaaaauaaggaucagaacaacuguccuguuauuggaagcagugauugguagaggauuuauauauuuauaugauauauuuagugaucagaauacaauuuuauacaguuauauaugcauaauguauuuauacaguggcuagaauuucucagcuaacuaaauguauauguaagcaaauucuguucuuuggaaaguuguuaucuguaugaaaauaauuuuauguuuuuauauuauuuaauuauauaaacaaauuaauuucccccuucuuucucaaaaauguuuaucuccuuuuccuccuuucuccucuucuccuuuuccuuauguuuuugaaacaaaaacacaaaauucccaaauccccccguccuuucuugaaaauccaggugguggaauggguagcaugaacagugugacuggaggaauggggaugggacuggaccggaugaguuccagcuuugauagaaugggaccagguauaggagcuauacuggaaaggagcaucgauauggaucgaggauuuuuaucggguccaaugggaagcggaaugagagagagaauaggcuccaaaggcaaccagauauuugucagaaauguaagcaaauaaauauuaaggauaauucaaauucuuuuuuuucuuguauauauguuacuaauaccucuuuucauucuagcuaccuuuugacuugacuuggcagaaacuaaaagagaaauucagucagugugguaaguaugcaaaugacugcagauauguugauauugauuauggaggaaaauugguuuuaaacuuuuauacacuguguuuagaccuuugccuguccggaugccuauuccuggauagucuugauagcgugccaggucuaauuccacuucaaauaaaugaauuauuucacuaucuuuugacuuagagcagugcuauuacuacuagguaauaacaagguuuagguaacaagguuuaggauauacccuaucauuguuuucuguuaauaaagauagggcuuauuuuauuaccucauuuuaaaaagauaaauauauuaucauucuuugcauuaaacuuuuuuucucaugagaaauauuaauaaaugguauauuuauuuccuuguuuauaguauagugcaggggauuaucagcauaaccaacugagaugcugauguccaauugauaaaggaguuaauaggugagacccauucuacauacacuguauuccuacccaacacaggaaaccuagcugguagcauacaacccacugucaggaaugccuuggacauggguacauuuugguugcccuucuuauucuuuuauaaacuguucuuaacuauaaugauacuacuuauacaaccuuaauguguuccacaggucuguggaagauuaggugguuuaucacuuuuaaaaaagagcuuuuuauauaccauacuuaacuuuuguuacaaauaucuuaauugacuaaauucucacuuuuucuuucuuuugcaauaaugagagaauucaugugaguguuauaaaguaaaauauuuuuugcuaguauuaauauuuuucugcuauugcauggaaucucagcgacuguagucacaauaggaaauuacauaagauagcauauauauaauuucugaggucaugaaggaauagguuuaguguucugucacaaaauagccuuuguggccacuacagagauaauauuaucucauauuucuuuauaucuaacucuuuuguagcuuuuauuauauuaauaguuauuuguucaaguuuucuuccauccuacguggaagcucuugaaggcaagaauugucuuuuuaucuuagcuccuuuuauugccucuguacauaugguaagaguuuaugaaaaguuuauaaguuaagcauucuggguagauguucauuuauucaguaauuuauucauuaaauccacaaacauauuuuuggcagucuguuaggcccuagaauuuugaaggugaacaaagugagaugcuccugcccucaaagaacauacaacaugaauuugucuaggauguucuguugacucucuuucuugaucauccuuuuauuuugaacuaaucaaaaauucaagaaaaaguuguugaaaacaaguuaacugguuaauagucaccacuaagagaaagcaaaauaguaaaguggccuugagguauuggucuucuuugcaggaguaagaagaucuaccagaaugaguaagcagugucuggccaugaauccuguagacuacagaggaaagaauguauauagggucuuagugaaauacaucaaaugaggaacaguggcagcaaguauaaucuguguugauuuaguuugagugaaaaaaaaaaucuccaaaugagauaugacauuauguuaaaaguagaaaugaaacuuagcaagauaaagagcaaagcaggacaaagaaaugacaaugaaaaggugaccauuguugaguugacuguucuuuauucuuuguaggcugcuuucuguuugagguuagauaugagcaaggcuugcagcaaacuucaaguguuuggugggcuucugguuggaguggcauuguuuugacaugaggacaucagcaauugcaagacauuuuuugaaaggaaaaaacauucaaaucuacauagaaaauuuuuauaguauguuagccauauaaaauaaugguuaaauuauuauucuuuacuuugcuauuuuagcucuauucuuauaauccuuuuucgauuauaauuauauuuuaagauuaaugauuuuuguuuuaucaauucuuuuguaaaaguuucugacucuuagauuuuauauuaagauaauaccauauuuacacaauucccuauaucucccuuauuuuuaaccuugaacuacauugauggaaaaguuauaauaauauagaauuaaguguccagcuauugacaacuauacaaauuaucuagcuaguaugaacugaaccauccauuuuucugccaugucacuuauuuauaaaucuuuuucuuaguaugagacauuucuuuuuaacaugcugcaagccaguaauggccucuugggcaguaaaaggcagucuucuguuguuguuuuucuuguaagcccaaagagaguaaguauauucucuugcuugcuucuuaguaagaaucuaguaguacuccuugcaucucccauaaacaauaucugucaguaaagggugccacuggcaacccccucugcuuauaaauuaucucuagugauuaacuguucuugauggaguaauuacaaaggcugaguaaauguuauauuauggguuauauuacccucaauagaacauuuucucagccuuuguaauucagaaaagauuguuuucagaucuuuccaaauauaacaagaugagaaauaagugaauauaacugcuauuuucugguuccaucaagccccuaaagguaacauuuuugaccccaggcugguaagauacacaucuuuccuguagcaaaagagaucuaucuuuuuaucuugccuuguguaauuccucagagagaugcauuuucaaaaaggcugaguauaaauaaauuaaccuauuuaguauuggaccccacaucauuucagcuugugcuaauagggucaaaugggcauagucuuuuaaaugugcucccaugucaucuguauacuuuagcugcauucuggccuucuggcucaguaugaugcaagacuauaacauuuuagaacuucagcacaaggaaaacccauucucaguuauuccugcuauaagccauauaaacagauauaacuuuguuccacagauuuccauuauguaguauuucuacaucagugugcuugucaacugcauggaaaauggaggcuuaugguagauuuuauugauuaaaguacuugcugcuucaagcauuuugaguggacuuuagaauaacuuaacaguaaaauugcaguaauaguacaaaugauauaugaugagcauucauugauaggcucugucuuuuguuuguaaagaaacaacagaauacuuugcuuuucuaucccuuauauccuuauuauguuuucuuaucguagaauuucugauuuuccuguuuucauccgugguuguguuaacuucauguaggcaguagauuuuauugaacauccuuuaauuuggucuauuuuuacauguguuuuuauacuggcauaucccaaaauauaccccacaagauguuuauagacuggguuaaauaaaacagaaagguuucuuuuacugugggacaaauccuuuuuauuacuaguauauguaacagcaauauguuugauuauucugugauacugauuucucauggcauacuauuuuguccugugcuguugccaaaauaucaguccuguuuuuguuuucuuggaaucguacaagauuauuagauauuuaacuuaguugaggaaguucucagagcauguaaaaagucaggcagguuugauuuuaaucagcuauuugaaacuaauuuuuuucuccucaauuauuuaucuuuagaaaagaaaauauuucaguugguguuuuuauaggaucaggaagaaacuuagaacaucuauaacucuuucugguucuguacugcugggauucuuuuuaggggagcagucuaaccauaaaacaaauauuuaugggcuacuguccauauagcuugaacaucagaacugugaggaaguugaaguaucuuagcugagggaacuugucaacuagaaaauuuuugaggucauugugaggucaggaauuuggaggucugagugcugauuucuaaacugaaagaggcaauuuaagagaaaaacaaaaaagagaaacuguccugaaagaucgagagacagauuaugcaagaaauagugacauauuuucuuuugagguuuugaagauuucuugcuuaggugaacuuuacuauugcugauaaaucuaugaugggauacuuaagaaaaacucuacguuuuuagguaaaauuaagauaaggaagaaccuuuaaccuuaaaagcccuugaaaauccuccacaguucuuuucaaaauaacuguaaggugcugucauuuaccaacagcuucuuuaauuaaacuugcuuuuuuucagguaccagcauucaagauauuaagaggacucuggaaauugugcugcauuuaucuuuaaauuguuuuaaaauguguuuuccaguuucauuuuaugauguuuauuagaaagugugauugcuauguuuuugcuuuuuuuccccauuucauuccaguugugggcuaaauauuauuuggaucuacuuuaaccauuaucauguaauuucucuggagauuagccuauuuuauaacuuuucagaacacauuuaaagacuaucuggccuguguaacaagauacugguuuugucucaguaugacauuuauuauccuagaccauuuaauuaguguuuaguaggugagcaguugacuaccaguugguuuucaaaaagaaaugcaguaauagggaguggaugaaaaagugaaaguauaaaguaguccaucauguuauagguaagagauuauucagaucaagauuucaacagaaaaaaaucuuccuuauggauugauauuaaaguuugaucuuaucaucuggaaagggcuuaugcaguuuuucgacagguccucuugcuuuuaccuuucuccuuuuuuuucuccucccuuccuagaacuaaauaugucuggcugucugauuugguugccagacuaaaauuagcccauagugaucuggcaacuauaauauuuaaagucuucuaacuugauuuguuuugacauguacaucuaguggggagggaaauauuuugguaaguagucacacccuaaauuuaugaccuguuuggauugagugaccauguauuccaguuugccuggggauagucucccuuuacaucuguuacuuauguguaauuauugauaacucccccuuuuacucucaaaaguguucuauuguagugaugaauucuuauggccacuuuuuauuuugauaaaugguauugauuuacuucaaauacgagucucuagaguuagcaaugauauuauaacugcauaaggacagguuucugguuuucuuccucuuuccugaagcuucucugauauucuccuugacaucacuguuuuuaccuuuauugauuuaaaucugugcuaucucuucccaugacuauuuccguagcauauuuggugccauucuuaagacuuugagcucaaacugugauauugaauaaacggcuuuggcacugugguugcaaagcagaauuaguggggcccuuuguagccugauagaaauuagauuucuggucaguugcacuuguuugcaggggauaaaggagugaaaugaggauaaaagggaaggaagagagauuagggagacugagcaguaagcaaccguuuauucuaaaaauaauuuuguuuaaauauguaaguuuguuauagggcauggugaguuggcggcauuuugugcuagcuugacuuauugcuuauaaaauuaaccucaggaauuagggauuuaacauaaauaaaauacauuaaauccuaagaaaaucuuuccugauuccaauuuuguauauucuaauauguauauauuuauuacuuuguaugaauuguauuuuaguccaaauauaaugcuuauauuauuuauuuuaaauaauuaauguuuuuaaucaaauuaauuaucacaauuggcuaugaggaauuucaaaccuauaaagugaaauagaacuuauuuaaacugacuaguaauucuguaacuuuuauuuuacaggucauguaauguuugcagaaauaaaaauggagaauggaaagucaaaaggcuguggaacagucagauuugacuccccagaaucagcugaaaaagccugcagaauaaugaauggcauaaaaaucaguggcagagaaauugauguucgcuuggaucguaaugcauaauuucaagccaugguuggaacauuccuacaucuguuuugcugaaucuccuaguaaaagucauuuuuuuaaaguaauauuguaugcuuacaaaagcuguaaaaaugaacuuuuaaaacucccaccagcuuuuaacaguauaauguuaaaaauauacuguaauuuuuguuaaucucaaguuuggguuuuuaaagacagcaagucuggucauucaguuuaaaugaaugguuauacuguuuuuaaugaaauaagccauuuucuuguuguuuucaguacuacauaguuggauuuguuuguucuaguuucuccaguuuuugucaacuuauuguaugguaaaacauagauuuuuuccccccaaacuucuguuuuauaauauguaauuuuucaugaaaagaaagggcucagaaaaauuaggaugugauuuugguugguuuuaaauuacuguaaguuuuagauucuaagguucaagauuuuuaaaauuugauuuaaaugaagaaauggauuuuucucucugccccucccugccauucauauuuucugcauaacacuauuaauaauaucaaccuccacagccccuuauuuuauuauuuccaauaauuccaaguucauauagaacugauaauguagcaagccccaaguaugauaauaggcagacuauucccaacuuucugucuaguuuccagccauugaagugaacugcuaaaaaaagaaaaauaauugaaauguugagagagaugguuauguaaguuaguccucugcuguuuacuucugcaggagcugauccauuuauaaaugcaguuuuaauaaaccauggaauaccaaggcacaacauaucaaacacauuggaucccacgauguuagacauagccauaucuccuuucccuacaaaagaaaagcauacuguuaaaaugugcuuaccaauacuguguuuuauuaauaaucuucauaagaaaagaaacacuggauacuuuuuuguuguugauucguuuugaaaaauuguuguuagagcaaaagucuuacugaauuuguauuuuuaaauuuuucuuggguuaguauuuaaagucuuaacauuuauuuaauaauuauauuuauuaaaccauuuuucaauaagguauauagcuuauuuguugcuuuucauuguaauuuaacaugguuaaugguuaauuacuauuuaacacacauuucaaaugaauauuauuugggggauuagauugagugaaauuaaccugcuauuaaauaguaaacuuuuccucuggagucacuuuuuucccccuucaaaguauguuacugaggaaguaaacuuuuuuuuuuuuuuuugguuuuuguuuuuugagacacagucucgcucuguugcccaggcugcuggagugccguggcgcaaucucggcucacugcaaccuccgccuccuggauucaaacaauucuccugccucagccuccugaguagcugggauuacaggcacaugccaccacgcccggcuaauuuuuguauuuuuaguagagacuggguuucaccauguuggucaggcuggucucaaacuccugaccucgugauccacccgccucggccucccaaaauccugggauuacaggcgcgagccaccacacccggcuggaaguaaacauuuuuaaagcuacuuuuacucauucuagccuuguagaaugaccauugcagcuugagggaccuaguucuuaccuuuucuugcaaccaacacacuugcaauugugucugguaugcuuguuccugcugcuaauaaaguaaggcccauuacuguaucgggaauuucuaguguuuccccuguaauaaacagauauuucaaguuacaaaucuuaaagauucacuaaccauccuuugcaguuauuuuggauauuuccuucgugaacaaaaauaaaauaggcacauuuagaauucagagccaauaugugcuugcuuauuaguuuuuuagcuagcaacauauuugaaucaggcugguaauucggguaacccagguagcacagauuuuuaaugacauaucuaaagauacguaacagcuaaaauucugccagugagaaauuuuccuguuugauauucuuacaaaagauguuuauguccaccauuaucucaucagggcugugcugaauauuugauaaugagacugaucauuccgcuuuuucuuucuuaaaaauauuagucagaguuaagcaaauuaauuauagcuaucuuuaagcuauaaauguguuaacauguauauauaccauuuauuauguucuacuuuagugauauaccuuaauuuagugggcuuuggcagggcgggggagggggaacguucauuaaucucugaggaaaacaaaaccuguuuucuacuugagucuaacauauggucccaauuuauuaauacuucuguuaaauuugaugucaggucaacauuuuucagaaauguauuuauucucagaaacagaaccagagagaaguuaaacaaaagguuauguaacuguuccuuuaauguuguaauugaaaacuugguuuagcgucuuuuuuuucuuucucuuuuuuuuucuuaaaaugccaacuaaaauaauuagaaaguagcuuauuuauugcaugcuuauacauugauauuggaauuggaauugguuguuaauuucuguuacuggcuuugcuagaauucauaugugcauaaauaacacuaauauuuaucaucuugggggcuguucugugaucuauuacaugauuuuugcucucuuuuuauuuuucuaguaucaaauguguucuggcugagugaauuuggauagauauaauaugcaagcuaauuggacuuuuucauuuuucucauuaaaaaaaggaagaaguaguccacuuuuugcuagcauacuauucugagacuuacauuaauuugggaaaagucaagggucaacaaauuuuugugucugugaggggccagauaguaauuauuuaggcuuugcaggcugugugauuucuguugcaguuauucagcuuugccaauguagugugaaaacaaucauagauaauauguaaaaccuuacuaauaaaaacaagcuggguuauguuggcacacaggcaguaguuuguucaccucugcuguaaguuaauuuggguuaaccuuuguaggagaaauuacagauuauuuuugucuuuguucauaguuuuuuuguuuagggacuguaguggauuauggccaagcagcaguagcuaguuaagucuuaaucaugaagguaguagaaaccuagaauaaaauuauuaugcccuuuucacucauuucauaauauguuuguauugccguguugaaaagccaaauaaaauacaauccaguuaagcagugagcacccauuguuuucccaaaaauagagcuccuugcuuuguuuuuguuuuuuuguucuuuuuuuuuuuuauuauggaauggaauucaauauaaagaguuuauuguggaccccauggaaugugauuaaauuauuagcauaauaaaaagacauccuaugaauuugauuucauuuauaagaucucuugaauuguaccccaggcuaaauaacaguggaaaauacaguuuauauauaauaugcaacucacaaacuccagugaucuuguuauaguaauacuuaaucauuuuguaaaugguacuaaucuucaaucuugcugaaaagaaauuugcuguguagcuagacuacuuugagugaacauaugcaauuuguucuuauaugaauauuuucaaguugugcuauuguacuuaaaauacauaccaguuauugugaccauccaaaccaggauauauguaaaugcggauauccauauugcagacaugaaaaagguuaucacaaaguaguuuuuccaaaacuuuuuucuacaaucuggugugguuagaaaaaguaauguaauaauaggaagggauaauacccaaaaaauucuuuuuaagucugcuucaggcauguugaaaacacuugguggaucuguuguggaaaaaguaaacacuuuugaguuuucucaaauggcuaauuaaguuagaaaugccuauuuagaaaguuauauugaaauaaauuagcuguaucaguuuuuaaaaggcuguuuaaaacauuugaguaccucauuacugauauugcuggugaaaagaaacuaauugaaacuuuagggcagacaauguaagaugugauacuccgcauuucuuuauuuggggccuuaaaucuauaaaaaugucuugggccauucguuaaauauauuguagauaguguuuaugaagugucaauuggacaucuccuguggauugucuucaguaacuuuuugcuuaagggauuaaccugguuucuaaccuagcuacuccaguugucuccacuucauaauauugaugaugccucugccugcccuauguaccagauaauguauacuuaaagaauauaaaauaaucauagcauaauuuuuuuauuaagucgcauauccuaauucuuaguggaagugguuuuuuuguccuauuucauuacuauuuuauuuauuaaauucagacuuuaccacaguucauagaaauaaccuuaaaguaggagguaguauaucaucuaaaguacaauuuaugaaaauugaguauauuucuuuauucaauuuaauuuaguagaaggauaaugauaauauauuggauaaaaauucgaauucaaaaauguucaaaauuuguauggcauuuacaaaauaauguaacaauuggaugaaaucauguuaaaacuaauguuaguacaacaacucauaaaaaguuugccaagcuucaaccaaugugccauuaaguaauauuagauauaauuuuaacauaaucaaagaauuuggauugguucuuuugcguuucuuauuauaaacuuaauuuggagaggcauaccucuuauaccugaaagaguagaagcuaaaauuuuuguaaaaagggggaaaagucauguuuuaaaauuuuaaguaguagauuagaauaaaacccuccuaaaggcuuaauuaaauuuagaaucuguuuuggacaaccacuuuauaaaaagguaacccaugaacuuauaauuuugaccauagcugaauuuucugacuuccuacugaaccuauuuaccuaaaaguuuugcuauugcuuuaaacaaugguaaaccucagcuguuuuucuucuuucuuccaaaccagccccuuuuucugaguucccaguuuuaauaagugcuguucccauuuucucagucaagauuaaaacauaggaggugucuuuguuccuuuuucuggccccauauagucuuggugaugcuuccuucauauagucucacaucuguucucauuuauucccaccacuuucacuuggucuaggcaccuaguaaacacaucagcuguuguaauagccucucuuacagaccucuuugucucuucauauuuuaguucggugaacaucauuuuggguaacauuacuaagauaacaguucuaauaauuucucuccucagaaaccuuccaagauucuuaaaauagcauuuaagauucuucuuauccuauuccuuucuaccuuuccucuccuuccuuccuaugcacauacugugcucuauguguuuuaucucugcaucauuuauggaaugaagaccucaguagcugcuacuuauuggucauaacauaugucauuaguuaaagucuuuccuguccagcaaggcccaauuuaaaugcucccuucucugugaaaaucuccuaucuguccucaccacauuuuggcaaucugucccauuugugaaccacagucacacuuuauuuuucucuuuuuaugguacuuaacguucauacuuuagcuauuuuguauuuccugugauauuggaaguuccuuaaagguagggacuuggucuuuaucauuucugagucuucacagucuuuuuuacauaaaaagcacacaauacuugcugaauugaaaugaaauuuuaaaguuuuuccuuugcgaauagacuuaauaaugggcaagauuuagugauuaccuucagaaaccugacuaaggccauguaaacuuauagagagcugagaguagccagaaucuucauaaaauauuccacuaucaguucuugauugccgacgaaugaaugguugaccuucaucuucccagcccaucaguggcuguuguucacuucucuccauagcuuuggcaagacaggcgcagcaaggacugcauuucuuuauaauauauugguuaauuuuaaugucaaaacacagcaccaaaacauacaauccauauaucaaaagcaguaaagccccuucauaccuacaaaagagaaauuuguguuuuuaaauuaaaagugaaagucauuuuagaguugauagcuuuugggcaguaucuauugaaugauuuucuaacaaaaguagccauagaacaaucaaacauuucuagauauuuuuuguuuuguagauuuguccagacuugauuacagcauuauuauguuuauugauaaaagcuggacacuucuguguuguuuuuuuuuuuuuaaaaacaagaucaacaaacucguuuuuacuuguagauuccuuccaaaugauagguauaaaaaugcaaggaaaaugauaauuggagauuuucaaaauaaauguaaaauuaauaaauaguggugaacauuuucugccucagcucauuggcauaauacauuccccaacauacauaauaauuauaaaauaauauaguaacuguuaaguuauuucaacuguccaaguuuucugguauaggaacuuuguguaaaauauuacucagauaugggaggcuuaggcugggauuuuucaguuugucauacagagcauuuuuaaugauuugaauguagcugaauuuggcuuacagucacaagaaaacaagauguucuaaaauauaaaauuauacccuuggaaccaagaacuguuucccuguacucuggcaguuagcuaaugccaucacauuugaaccuugcauuuaccuuuuauagccagugaaucucugucugcuguaucuuaaagaacaguucugauuucccuaauggaggaagaauuagcuuggauacucucacagucacuaucccuuacagacaacugcugaguucuagaaggauuucuauucuaccaacacagugucuuagggagacggacuagaggacaggaugauuaguuuagaaauuaugcuucuggcuagguuuuaaguuucuugauagcagguauuacgccgugcugcaagguuaugguucuccagauggacaccauuacauuuuuuuuuuuucauauuuuucugguguccucuggaguuaugcaauguauauaaccuguguagcuguguuuuacauuucauuaucccuuaugauaucuagcauagugagaaggaccuaguaggugccugcugcuuacuaguugaaaaaguuaguaucuguccacucagucaccaccuuuuucauuuucuuggaccagcuaggcacagagagauuguaaggaaagcaaacaauuuuuaauaugaaaagcuaagcauuguuauuucuuagaggaaggcuauaguuucuccugaaugagcaucagaaguuuggaggaauuuaaaaagacuucuuuuacuuccucuaccauccuucuccagucuuuuguggccaugaacacuucuaaccaaggcaaggugagcaguaacccagcagaagaaaaagucaacuguuguggcuuuaauggacaacaggaguugggaaacuuucugaauaggcagccaguggggagaaggaaaagugguggucuccagugacuagugagagaaaaaaggagacugugaagugauuaagaagaaauugcaaacuagugagaagaacucaaucagcaauugugaugagguuaacucacagaccuguuggaauaugguauagaaguggcagauuaagugacugaaauaacauuucugaaaaaaaauuacugaaccaucagaaauucauaaaaucucuaauuuuuacauaagaauuauuuucaagcuuaccaguaaacuugguugucauauauuauaccaagaacugcugcugcacuaauuguguacgcugcacagucucugaauaggggccaacaugauaguguugagaccuguaauaugguaaguuauuauuuccauuacauuguaacuucuucaaguacaauccuuaguauaauacuaaaauuguuuauauauuuguaguuaaauauuguuaucuuuugcauauugcuuagagaaaaaaauguaaaauuguguucuaacuuacacagacuuucauaaaucugaccaagagcuauuuguggauuaacauuaaauugaauacauguuguuuuucuacugauuaauaaauuugauugcacauauu

SEQ ID NO: 13373 - RNA, 8617 nt, Homo sapiens
uuaaaugugauuucuacccuaacauggauacagugaaaguguaccagggaacucggccaguguuggaacuggaccuguuccuguuugccaagagggguuuauuugccacagcguacguagcauuucucauaucugugucuuugaaagucaugacuuuauugcuguguuucaaagugguggugucagccuggugcuuagaggagggcugacagccucuucagagcuuccucucugaucuaagagguucugaagaugcuuuguuuuaucuuuuguuguuuccauguuuagagucugucaguucugaagcaaugaucugauauuguuuuuacaucccugggaccgcugagggagaaaaauuuauuuacaaaauggaccaagcucugcccucacuuacagacaagucaaagcagccagaggccuccuguucacacucagguaccuggaggcaggauugguucucgucuagaacucaaaagaguugacaagcaauggaagcccagaguagugaaugggcccacuuuagagcuguguuuaaacuucuagguauuaaaacaguauauaacauuauuacuuuucuuuucugaacaauuugacauguugacuuuuggaagaguauauuuuugccaaaacaaguauugugacgcagaaauaagcuuccagaauaaauaacaagucccgcugucauaauaaggacauuaaugcuucccucucucuaguuggagcacauuauugggcuaugacuuuggaauuucccauuauuuuccagacuguaccacuuaauagagcagauuuaauggauuguuaacuuuuuucacaguuaaaccaaauaauuagaaagaaaagaagauaauaguuagcauccagaacagucuuauuuaaauauuuucacccuaaaaguccugauguagcuucaaguugaauucaaacacaucauuuaugucauuuuaagguggacuguaaggaguaggccacggcccaugggguaucccaggagcucgacaguagccagaguauuugaaguggggcaauaucuggauuucccaucauucucuguggauauauaaaacuauuauauuacaggugaaauuucguccuugggcuauaguaggaaagcaaacagacaaacgauuuacaggguaggagauggccuugucgaagggccucuuuaaaggguuggcgccggucaaccuagaccagaagcuugcuaagucuccacuuggauccugcuguuugacuuggagacccucccagagaaaccaucuuuuccuggccucacaccaguguaugacuucaguaacuacaggacauucgugcauaaacaaaugccugguaacauucugauuuuugaccagcagaggucacuguggaccucauuaaacucaaacccauagcguuucgggaaguaauuuucaaaaaaccaaacguuugaaucaucuguuuauaaaauguguaacaagcucucccaaccucugauccuuugucccaggacugcauaccauaaguccacauauaaguguagcauuuagaugaaaucuacagguagugaguaccaauaaaguucuaagucgugcauucugguuugugauaaagaugcuuuuguugaaaucagcguuccagcuggauaccguauuugcauguacuagucguauuucaguucccugaaaugucugaaagguaagggugucuguggauaagacaguuuggguauuggcucuuaaauuucuauccccuuuccaucuuaacugagaaacuucuguuuuauggcaugcaaucugcuuaagcacuauuugacuuccaaaccaaauauuacauuuaaaaaauaauuuuugacaguaagaugguacaaaguacuuaaugagguugauaaaugacaauagcugcuaccguuuauccauacuaccuucuggagagaaaccuuucaguuccuacccacacucaaugcucccaacaucuuagaugcugacuucggacucuucauagaugcucaaauagugacucaucuuguaaacuuuuuugcaaauuuuaaaaaguucuuaccuuuuuuaggcguugucuuaguaauguucaacuugccagcuuuuuuaaacaagccucggaugccuccacuuuccucuucacacucauuaucuuugauagucgcuuccaaugcuagucucuccuguucuaaucucucuaauuccucugaugaaagaagacaaaaucaccuacuuaacucagaacuacaaaguuucuagaaacaaucuuauaaacuuuuaauauuuaaaaugguauguaugugauaaaauaauuguuuauacauaguaauuuuuucuaaaugauuuuuauauauuaucuucuaauacaaguaauauauuuugguugggugagguagcucaugccuguaaucucagcacuuugggaagccaagauggguguaucguuugagcccaggaguuugaaaccagacuuggcaacauggugaaacuccaucucuaugaacgauacaaaaaucagcugggugugguguguagugccagcuacuugggaggccgaggugagaggaucaccugagccugggagguagaggcugcagugagccaugaucaugccacugcacugcagccugggcaauagagugagaucgugucuccaaaagaaaagagaaaaaguaauguaucuuaguaaauuguauucagaaaguugucacaacuagcuuagaaaaacagcucuauguguuaaguuaugauacaugaaguuacagcauuuuuauuugugagggcaagagaggcuauuuaaugccacccuuauucacuaccaugcaaaaacaaacaaacagaaaaucuuucacacuguaagccacugauuuacugaccuaagcuagugggucagauguuuuacaacuggaagugacaaaauuacagaaguacacugaguauauaucagccacacaacaaugcuucaugaauugaaacauaaaacuagacagcaagaauuaagaaaagauaacaaaaucuuacaauaaacucuauaggcucuggauacaaauuacaauggaaaauauccaccaccaauuccuuucaauaagcaaaauaacuuuguggagugggugaccaaagucaaagaaauaaaagcugagguuucugggugccugucagaguucaaauugcuaaaaggggucuugugacauguuuuagucuggaacaggagucaagcagugcaaaauuuccugcccaagguugagacacacuauccaagcuuugauguuguaucuggcugccuuuuaucuuuuuuggauuccgauugugacgaaaauuuccuagcugcuauguaaugugcuggaucucucuuugaccucacccugcacugaaucaggguaaauaagacuuucaaagcagucauaugacagugcuacacuuaggaggcuucuugcuucuugcuuauacugggugagguggcacucuugucagaugcccucaucuuauugccugcugagaacagagccuuagaaaaugagcaaugcucagaggaagaggauagaaaaccuagauucaguguuacaaaacacugggagagcuucuguaaaugucaacccuuggagcccauugcguuaucuaucugugaagcgaagcuauacaaacucuagauuuaucaauuauguacuaacuaaaucugucaggacagucacaucccuagacgaugcugcuauucagcuacacagaauugucuggccccuuuccaggucuuagcaauuaaucuuuugcgaguggcaugagauuuaaggucaaaucacccaugugauuuccccaaagcuucaaagguucucaagaucagcagcuauagaaaaucugagaaauuagacugaugguauuaaagcugagacagaaguugcuuaccccugacuuuugaaaggagaagacaagcugcauugcacuggggggucacaaccaauuacagcucugcugcuggcuuuaugugacauuaggcaaguaauuuacuuuuucuaugccucggauuucccgucugugaaauggaaaacuguaacccuuuccuuuucccaccccccaagcuuugcaaaaagaauaaacaaaguuucugcauaguguuuuggagguccuuaaaaaacagagcaagaauggcauucuauaggcaguauauuuaugcaacuuuuggaaaugggccuagucaugcaaaacaaauugaguauuuugagaugccugggaguuauuuuagcaauugcuauuuauugcacacucuuugggugccagggacuguguugcauuuuauuccuuucuaaacaacucugagauaguuacuacuauuaucaucuucauuuuguagaugaagaaacuaauagguuaagugaguugccugauaucacccagcaaguuacaggguucauaugcaaagagaucugcauaugcuucccaccaugaagaccuuccuccuguggcuuauuauuauuacuauuucagaguuguuuuauuaccuuccuaugcuuuaucaucagauaaaccuaaacacucucaggcauaugguguaaugggcuaaguuaaucccccaaaaugauggcccauccaacaugucauuuuaaaaggaggacccuaaagauacgguucuauauggaaggcugcacuagagcagcagcacugguacccagacuuuguugucacuguccuggaugacggcauccuagcuguuauuuugucuucugggguauugcaggggccacuuaugggguaaccugcucuuugcaguccucugauguggcaacuguaagggcugcccugggaggggauucuucucuuuucuuuuuuuuugggcaggcuccagugcgcccuaugauuagccacugguugccaugcucuuuguccucuaguuuggacaaagagggaaagaaagauaaauccucuuuuguaauggagucagcgggcugagugaacugggagcgauuccaacaauugcuugaagguaugugcacagcccauccagaacagagcaagcugcaaaauugcaggccugagagacaaaaucaaauuuugcucgaaugcuuuagauguagcaguuuccucaaagaugauagagacagaagauuacagagaguauuuauucuaaaggcuaaaaucagcuugcuuugccaucuuggauuuucagauccauaccauggugugauucccauuugcauagugauuuucgcaaguucuuauucaaguuaauucuuaauuauucacuugguaggugaucuaaggccuccuucugugcacuccuuccuuuucgcauuucaacacuaaacagaagugauguuuugauuaucuguucuucugaaugaucuaucugguguacugcuugccucuguuugcaugcagggaaauuaagaguagacuuugucuaaacauuuuugucaacagaaauacuggccagaugacuugcaaaggcauaccauuagccacaaggggagccagccaagagaguaugaacgaauggauauaaguugauuuccacuagccugacaauaaaaauuacuuuuucuaucaucaccaccaucacgacuacauuuuuaauuuucagaaauuacaaagcccuuucuacauaguaucucauuugauacgaauacugggaugcaugcagagcugguauuauucuccccauuuuaccaaaaaggaaacuugggcucagaaaguucaagugauuuguccaagguagcacagcuagugacccaagucuucugcucccaauucuaguguuuaucccucuucucucuucuccuucagugauaugccuugaucgcaauagcugccuguugaaggaacacccagucugcauguuuucaaaaaccauccccaaauuucucaaucagaaucaaucuccucuguauuuccguaauaccuugcuuaaaccuuuauuccacuaacuacuauaacugugugacuuggaugucuaucuuauucacaauggacuccagacuccuggagggcagaacuuacgccauuuuucaucaccaacauuuauugagaguuuacuguaugccaaguacaaugccaaacacuuugcagccaucaaauucuuuaauccaaaacaacaaaucugugacguagguacuauaauuauucccauuggaaaaugcaaaaagugaaacacagagaggauggguaacuugaccaacaucacacagacaaaagaugucaaauuugggauccaaacccaggucugucuauuccaaacgcuaugcuuggaccucauguuaucccucccauguucuucaugcugccaccccucccguuuauuaccuggacccauguuugcaccaacaggcacucaagaauuguauguugaaauaaauuaaagaacagaucaaugcuguucaauucaguucaauaguuuugaaaguacugucuuuauaaaagaagaaaaacaagugcagaguugugaagaaugggggugugagaaguguguguguguguaugugugugugugguaaguacaaaagacaauguuugaaagaagugcaguuaauaccguauacaaaguuauauaaaaaaggggcagauagaggacagaaggugggaccagugagauaagagccugggaaauggaagcaugagaggcaaguggggaaggagaggggacuuuucccuggaaaagaccaccaccuggaaauccuuuaaugguaccuacugggaacuugaauacauuagauaauucuguaguaugucauaguuuauaaggccacauugcuacugagagauagagauagagauagauagauagagaucgagauauggaaauagggauauagagagcaugccugcccuucucucuuuucaagauguuuauaaccucaaccugaaguuaugacgguggaagaaaaagcuuagaccuguagguucucucaguugagggcagguuucuaaucaauuuugucauccacaucccaaacaguuuucacaguaauaacuaagagugacucuugagccauacugucauguaaaugccaaaaguacuuugaauaguaguuacuguauuuucaagugcuuuauaaaucgauuauaugguacccaguuggagugauuauuuuuugaaacucaauuuacuugucaagauugcuucaaauguuauguccccagucuuuuuuuuuuuuuuuuuaagauaucuuuuagaaauaggcagaggcccuacaaauuacaaucugcuuugaaucuuaaggauagagagucguuaauuaucugacaccagaagggagagcagggaaacccacuggggaauggaaucccuucccauuuuacagcauccuuuuucuuuauuaauuuuaaguuguaauucuuuccuuggucaaucaacucaaagcuguaaaugcucauaugaaucaaugugcuguaccccaggugaagucuaguugaauugaaggcaggaagcaauccugcagugguugccuucuaaucaaguaauuauuuacuacacugccaucugucuuuauuuugcuaagccacuugaucagacacagcaguauccccgugcucugagauguucacaaaucaugcuguacuuacauggaauacuugaccacaauauauggcaaaucauguuccaucacuuuauuucuuaccaguacaauuuugacuccuuguuguaguuggaaaacuugcuaaauuccucugggaagugagcaguaugaaauaucauggcuuuuuuuguguguguugucaggcaauaauuuauuaagagaaacuaucagucaucaguauuggaugaguugcuacaguauacaaguuacaauguuaugagcaucgaucuuauuuauauuaaaaguuauucucacauaagccugugauacaauauaaaaauaauugucguuagcugguaaauuaucuauaaagcugauuucuauucacugcuuuauuaacuacaguauaugggcacucugaauugcuaauauuuccuuuaaauuauaaucugugaugacacuguggugccuguguuggaaaagcuaugaugacaaucauuaacauaguauaaugcaauacuuaagauuuauuaggcccuuauuaggcccugaauuacagcauaauauaaugaaaugcaaguuuauuucuuccaauucaaaaucuaauaagagguuugugucguaaauuacauaaaccucaaaacaaugcauggaaauguggcggaaaguuaauuucuaucauguuguuuuucugcguguucuucauguauuuguguaacauuguuuuucuuuguuuacccuagauaguugguacuuguaauuauuuuauuagcauccaauugcauuuucccuuucuugacuaagaagcagaaauauuucaaacaucaaaguuuauuuaaauaggauacaacccuugggaaauuaaaaggggaugcaguucacugccaggauuauuugagaaauauugcaaaacuugguugcuguauugcuuuauagaaguaaauugauggugcaucuuggcagauggaacaaugaggggugggagcaaugcuuuucagcuacaucacaucuuucagcuugaagagaucaacauaacacacaaagcaaauguguaaucuaaauacaaguuauauuuugcauucucauuuuuagauggaaaacauuacagcacaaaagccaggagaaaaaaauuaaaguaaa

SEQ ID NO: 13374 - RNA, 237384 nt, Homo sapiens
ccuucaccgcucccauccuacauccuagguuccaacauuuacaggccccuggguuggacaccgacuuagagagagcacccuggauucaggccuggguggcuugaauugagccucagaagagccgcgucuggagugggcucucgacacccagggcaagugggggcggcagagcccucuccucggucggcacagcagccucugccgcggucccggccugcgacgcgcccagucuuagccucccggccuccggcgucugcugaguguccggcgggagaggcgcagggagcgcgcuaccgggaggcgcgggcagcggggacugguuuucucucgggccagggccuccggggcaaccgucuccagcgcgcauucuuggugcagguggaacagcuuucugcuccgguagggcuucaccuaucgcgggagagguuaaucucggaucuaaaccucgcagccgcagagcgggcuaaaaccgcuacuccaccucuucccauuucuccccuccccaccucaagacaaaaagucccaggccgggcaggaccugaucaccucugccuccucccacugcgcuaauccugcgagcgagaggccccgcaccgaggcggaggcuggcaaaggggaguggaaagggaggauggauggggccggggggugggguggugaugagggcgacgaaggagggggugucauuuucuuuuucuuucuuuuuuuaaaaaaaguauuucucucgcgagaaaccgcugcgcggacgauacuugaagagguggggaaaggagggggcugcgggagccgcggcagagacugugggugccacaagcggacaggagccacagcugggacagcugcgagcggagccgagcaguggcuguagcggccacgacugggagcagccgccgccgccuccucgggagucggagccgccgcuucuccagugggugcagccggggucccgacgggggucgggcggccaccggggcuggagcugcggccacggaggcuuuugcguuugcgccgcgccgagggcagggacagggacuggggugaggggcugucccggaacguccacagcuggcgcuggcccuccccugccugacagcuuccuggcccggggcucuuggugccgggcuccgcgucagauguucggggggcgguggcaucgcccggagucggcggggacggcgcggcuggcuuccagccuggcggagagggcaggcugaggaguggggcguucagagcgcgcaucgcgcgcaauucgugccgcuaaaaaaaauaaacccagagagcucgcccggggcuuaggaccgcuggggauauggguacuuugcgccgcgcucuucuggcggggcccgggaggccgagggaucggccggggcugcugccgccgggggccugggcuuuccagccagcuguggaccaaacggucuucccuuacccaaauuaacugcgccacgcgcaggcggcgcacggguugggcuugggaauggggaccgcgaggcuucagcaucccgaugcccugaaagucuccccgccucggggauuugucucuguguugcagcuggcaggggccgccugaagugggagcagcgccuggagaaggcgggaggagcccggcccgggggacgggcggcgggauagcgggaccccggcggcgcggugcgcuucagggcgcagcggcggccgcagaccgagccccgggcgcggcaagaggcggcgggagccgguggcggcucggcaucaugcgucgagggcgucugcuggagaucgcccugggauuuaccgugcuuuuagcguccuacacgagccauggggcggacgccaauuuggaggcugggaacgugaaggaaaccagagccagucgggccaagagaagaggcgguggaggacacgacgcgcuuaaaggguaaaggaaccgguucccuccuuuggugugggucucccaaguuucaagauccagaacaacgggcaggaugacucucccuguggaagacuccuuggcaagaccuccugggggcaccuuagaggugcuaggguuguuuaguccccaccccguucgugguuaaacuaccuugccccuacucccagagauuucugccccaaaggagaggacgugguuaaauggaaucuugggccauuguugaggcagauuuugggaggcgagaagaguuccuuggggaagaaggggaggaguugcgagugggauaagaggagaagcccguuccuuucccugcaauaucaauucugguuguuucuagaggaaaguacuuuccuuggggucaucuugguagaugcuguauuugaaagggggcaaggaaaggaagggauucccaugacagucagaggagaaaucacacaguaguugacucuuccguaaauuaugcuuauuaaaauuacggauuggguuuucugggcaaugcuuccuuuagaugucuacauuggaagcagaacagggcaagugguucugagaacugguuuuuugaguuguguggggcucuccguuucacugcagcaguaaggcugcuguggccggccuuaagggaguauuuuuaacuagugguguuuguguuguguacaugcaacugaccauuucacuggcuucccaugccgcuguuacagauguuucagccggaaaaauuuuaauuagacuugacuaaggguugucauuuuccuguauugaaggacagugggaauacauuuccuuuaagagaaauuugucugcaguuguuuaaguuaaagccuccauggaaacaacaggauggacugucagugaccccuuuuaucuucuuggaggagccuguuaaauaaauucagacaguauauauagggagauuuuguauuaaauucuuaccauucucgcugaugcucuuuuccugagugguucuguagcuuuauuauauagcucugggucaccaagugaugguauccacuuggauauguggcuguucauuucacuuacucuuuuuuuguuaugagguguuauagucauguauauguaguaaaauuuguguuuguauggcccagauaugagaagaaaaaguaaacucaccagaccaguuuuugacuccuagucuggaguaaggacaagaugauuguaugagccaagcacuuaggcugugauaaaauagcacagaaaauaguuaugauuaauucgguuccaucuuggccuucguggaaaauaaacccagaauuccgauaauguuggaaggaaguuugcuuaucaugguaaaccugaccuugaucagacagcagauguuuauugcccugugugcaaggcacauggcaaguucaauaaguagacugaggcucugauuuucauauguucucaagaggaccucauuuaguccaguauuuuuccuucaaaaauacauuucuccuacauaauaauaucuuaauaucuauucugauaggauugcuccuguauauaaaggacguggggauuuaauucuguggcugaagaucugcagagaggugugaggccuggucagacauuugucucauuucucugggcugucaccaacuaguguguucccuugggaaugugaaaaaagaaacuaagcuuuacuuuguugcuuaacaggaugccacacuuuuacucacacuugugcuuuuucucucugguuuuaaauuuguuugugauuauagagagauaccucucugugcuccucacaguauuugaucauuaacacagaccuuauccuauuguaaacuauuuauaaagccuuccuaaaaacaggguauuaauagaauuguaauuauguguguuccuaauucucauguuaauuauaagauuuuauaauaagugauauauauauauacacacacacacacacacacacauacacgggggugaaaauaauaauuuaaaaauauauacaauuaaaaguauuucccugccaccuuucagagaccauuuucuuguguauuuuucuauaaaucuuuuaggcauauguauacauguacaaauaaacacaaauauauauguauacauacacauguguguguguauccuuuuuaauacauggaauguauuguacaugcaauauucugaacuuuacuuacuuuuuauguaucuuuaaugcauccaucuauuaacucauauggaucuaccucauucauuuucuuucuuuuuuuuugagacacagucuugcucuguugcccaggcuggaguguaguggugcaaucuuggcuuacugccuccaccuucccggcucaagcgauucuccugccucagccuccagaguagcugggauuacaggugggugccaccaagcccggcuaauuuuuuguauuuuuaguagagaugggguuucgccauguuggccaggauggucucaaacucuuggccucaagcgauccacccaccucugccucuccaaauuacaggcuugagccacugcgcccuaccccauuuucuuguuguauagaaccucauuaugucacuggaacaguucccuagugauggcucuuuagauuacauugagucuuuugcuauuaccaacuuucuucugcauaccuguguuuacauacacguguuuauaugugguauaaauuaguaaaaauagaauugcuggaucaaagucuuucccauagauuuuaagcaaaccccaauucuuauguuaaauuugaauaacauuuuaaauuuauucccucugcuuauugccguuacagucucauaugaauaaauccuuuaacggugcccugcuguauaaaucaucagaaaaagcaguuauguacuacauuuuuccaguuauugcuuaaaauuucuguuuuugucuguuaaaauauuaccggcuucaaaacucaccucuuugacuacagugaaaccuguuuaccauucugauuggagaugcacaguuuaugaagugaaagugauuuguaacccccgagucugccugaugcccaguugguggcagcaacuuucagcaccucacuaaucuuuccucuaguuaaaagguaccuuaaacucaucaguaucugcugugcacugguuccuucuccccagcaaauacugccuucuuguuuuucucugauguggcaggugacuacaaaauccgccuugguauucuucaaaugcauauauauuccuuucuugucagcucccucucuuccuagauuagaaaacugccucauuuucugcucacuggaugugcagucccagcuugucuuccucuccucccccccuguugcagguguucuuuuuuuuuuuuauucucuccccacugggcagcaaaaguuguuccacaguggaaauuuaggcauccucaaguuucuucccagcuucugcuguguuuucuuagaguaaauugccaauuucuguuuuuacaggaaauccuuuuuuaaaaauggaaucagugugguccccaucuacucugcaaaaauugcauuuuucucuauuuucaaaugagauuuguucaaguuucaaaaccacgugaaauaauaaauguauaguaguuuucuuuuccuugggcauugcuugauaugugaaauggguuuaugaaaaauaauaaaaucauaacgcuauuuguuugacuuucaauucaugggaauuuuucucagcuaaacucuaaauggugauuaggcaaaaagugugggagacaguccaaaaaaaaaaaacucaacuguacuugaauagcaauaguuaugcaccauuuauuuaugauugccuuauugcuuuagcucccaaguaaggaaauauuacuguuuccugucaaagggggaaaaguucuucacagugagaucuccuuucccaaaccuuggagaagauggauugagacuucugcccuuguugugugguuuauagguacaugagaccaguuguauuugacacaauuuguccccuugugugugauuccuuuuggucuuuguuuauuuguuuauuuuuuuccagaggucuuguugccagaaaaauacacauggaacaguucauacccaugguagauuaugugauggcaaacuccaagggauuaguuauguagaagucuguuauuaaaauaaagaacuguaauagggaauacagaaaaaguucuguagacuuuauaaaguccauuuuacuuuauaaaggggacuuuaagacuucaccugaagucagaugggcuaauaauuaaauauggggaaagacuccugcagggguaugguuuacauuuauugaaaagauuaagcuaaaauauugggacacaauuuuuuuuuaaaaaaggauauaguguucuuaaauagaagauuucagcaauuccacacaugaaacaagaagguagagacaaaauauuuauuuaugugacucauuuuguaacauugaagacauagagguuguuuauaaaaauguguaaguugguaauacaaauuaauuaaaacauacaucagccuauggugaaaugagaugagagcugauggaaauggaguacagacuucccuucaaccuuauuuggaauuuuaaagaauauuaaaauguuccuuuaucgucuuguguagcauauacuuuaaaaauuauaguauuauacugaugacucuaaucaagcaaaauacuaaaaaauuauuagaguauucauguaccaguuuguuggcuuuuucuuccaguaagccaaucagccuaaccacuuugggaguuuuagcuuuauuuucaaugugaaaauaagauuuuacaaauguuuucuugaaagagaaauacauucuuuuaacaauuucuuuguuuuuaaacaugaacccagcaaaugggccugcuuaagcaacuuagaauuuuuucccaugagauucuuugaagaaaccgacaucaauaauauaucaggccugaguuauguggccuaacucaggcacaugauaguuuagcguuucaugauuguucaagucgauuuucucauuagauaguuaaaucauugaagacaagaauccuauuauaagcauuuuaccacuaacucaucauuaagugggguuucagaaaguucauuaauucaggaagucuugauugaaugcuagcuugaguuuaguucuguggaaggccagagacauauaccccauaacccuggggguacuucaggaaccgugagugcacagaaggacagcgucccuggaaagggggucugguauuaagucuaaacaaauacauaauaacaauugcagccaugguagguaacauuuagguaacaucuauauguuacuaagcacuauauguugcuaagcacuguucuuacuguuuugcauaugauaauucauugaauccucauagccacucuacaagcugggugcuuucauaagcuucccuucacagaugugagagccgagguaugcagagguuaaguucuaaagacaaaacuuaacguuaacuuuucuuucuccauuaauuuuaguuaugguuuugguuuuucauuccaccagacaaaaaugcaggcccaagacauugguaaaauuccacuuaaaauuccuaauauucuuucaugcuaguucacaaauccuaaguaugguuaaucacacaguauuauuuaguccaacaagaaacuuucugcaaagacauuaauaaaacagaaagaaucauaggauguuagagccagugggacuuuggacagcguauuauauuuuaauauuagaccuugacuugugugagggugguagguaaccauugcaggcagccugcugggcguugugugggcuucugagcuggaggcauugcuguuuauguuguucagaacccucuugcugucauguccccugugagaaaucucucugaauaggguugcaagaaguauuucucuuuccaguggaaauugguaugugucuuaaaucacgaccagucauaugaguuauuuaauuauuucuuuuucauuuuuuaaccuugguugccuguaaacucagcccaauuuuuuacauuaaauugcagccauaaugguaaaaaaaaaaaaaaaaagcucugauguaucacuuaugauuguacuuugcaaauacuaauuccuuuaaaacauaaauccuuuaugaggaaaauuaagcuuauuuauucauuuaacaaaugaagaaacaagggaugcagaguuucaguaauuacuccagggacauaaacuaguaagugguagaguuggaaaaucuagcuucauagcuggagcucuuaaucuuaauauuuuacugcuuuacaguuauaauaaaucuuguagcugguaaauuuuuuucuuucauaccuuuuauaccuucguuucccaagaaucuucucccaccauugcuauguggaaagacucaacauuuauugauggcagaugcuguuacaagccaagggaagcaucauugugggaaugggauugaucagaagugacuuuacagugaaagucuauuagggcugggcaugguggcucauuccuguaaucccagugcuuugggaggcugaggcaggaggaucacuugagcccagaggguugaggcugcagugagcuaugaucaugccacugcacucuagccugggcgacagaacaagauccugucuuaaaaaaaaaaaaaaaguuuaucaguggucaacaaacugaagaccaagcucacuuuuuuugaaaauagaguuuuauugaaacaaauccaugccuguuuauuuacuuauuauguauggcugcuuucucccuacagcagcagaguggaguaguugcaacagagacaguauggcccauaaaacugaaacauuugcucuuugguccuuuacagaaaaaguuuaacaaccucugaucuacgugauaaaaagugacugucuacuaggagugagaacuccuugaaggcagagaucuugcuuguuuuauuuaucucuaggaacaucuaggaacuggguaugcggcacauguucaauagaauaguuuuugauaguugaacucugagcaauuuugaugagcugauuaacuggguaugguuaauuauauagacuagagcuuggaguaaguauagcugagaaauaaaggaaagaugagugaaaaauacaucaagggaaagggauaugaagugucugaggucuuaggacauugacugcaguugggcaggguuggcacggcaugguuccaagugacaugguuuguagugcagucuaugaaacgagugcccucuggagcugugcaguuugcaaccuugagcaaucuugugagcccguacauagguggcaauguuguuagggaaaggagagggacuaguggaaauauaaaugucacugauguugugaaaggcaaggacggggagcuaguaaaggauucuaagauaggaacaugaucagaucuuugccacuggguagaggugugaaggguagaugauuagagagaagagagacuaaagacagggagauuuggauuuaggaggcuaauauaggagucacagugagaguccacgauggucugagcaaauucagugaaaggggugaagaaagaagagacucaggugguuccagaguuaaugcagacaguacuugacuaguugguugugaaagacaaaggcgaggaggaccuagaaugcucccaccuccauauauauucaaacuuaccauacacgaagucauuguagcaccauaaagagaaaauaaagggaaacgagaucaggccuaggcccucuacuaccaugaaacaaaguauuuucauuugugaguguuugaguuauuuuauugcuacguaacaaauugccccagacuucguggcuuaaaacaacaauuuuauucuuucucaugauucuguggcucaggaauuuagacaggacacaguggggaaucuugucucugcgccccacaaugucaguugggcuggaacaggcaguaugacuucuucacauaugcaucugguucugugaccaggcacuggcgccugcagcccuguuuacuugggugugguuuaucuaaauggacccacugaggaggggaauaaaggaagcaaagagccacuugucuggcucugcugggggccuuccaaguuuuaaagcugucucucaugcagucuccugccugaaccugcccccgggauggagccauugaauguguuuuuuuucaaauggggagacugagccccagaugcagcgacuaggccuugcucagagugagugucuguuggggcuggaucuugaacaacagccuccugacccuggucacauguguuaaucccacauauugaccguaggcuaacucgaagggcugggggcuggcuggcuggggucacauggacucauauguccucgacauugccuggcuuccuugauucuccuuuauauagucucagguuguccccuuucuauacguggccucucuacauggucuuuagagcagcauagccagacuuuuuccauggcaguucaggaucucucaagagcacaaaagugggaacuaccagacuuucuucaaacuuagccuggaaucgcaugaccuggaauuccauccaagucauaggccucauccagauugaagggcauggacuauuaagaccuaccuuuggaugugaggagcaucaugugucugcugggaggggagaaaguggagccaucuuuggagaccagcuaccacugugaggcaauagaucuuugagaaggcuaaucagauacuuuaaguuuuaauucuaacuugaucaaguucaguuggcuuaguucucuacugaggaugccucauuguauuuugcugcuguaacuucagaaugaaaaagcuccauaaauauuguguuugcauguucuguuagauucauguuagggcauugaucuuaguuuguccacaguucugcauuuaaagaacucacaacugucaggaauaaaaugaaaguuccuaaugaagcaguauguuuuguuuuauucaaauaugagaauuucaaaacaucuaaccauuuuccauuugcuuuuaagaaaaucagcuuuuaagauuauacaugaaauaaauuuaaugggcaaucacucuaauuuauuaacuuugguauguuuuaacuuucuucuguauggaauuuuauuuucaauuucuauuuauagccucaaauguauguaucuguugguguaauccaccucaauuuuuuaaauuagggguuauacuaauaaguaaaaauagguugcaguugcuaauagaauugguguuguaaugagcugaacuguacuauuuuucuuauaaauggaguagccacauuaucaauagaauaaaauuggauuaggaauauagucaaguuugcauugugggugucuuauacuauaucaaauccuagauuuaaauuucuugugacuaccacuuuuucaacuuaagugacuuuuuuuugguugaaguuaucacugacucuauuuauucagcucccucagagcggaagagagaaagcaaaaaucccuaucuccaccauucccagccggagauguauuccagacagcaagcaggcucagagugggagaacugcuccauuaaacaagugguuuaguucaacauuuugaaggauuaugaauuccuagaccaucagucauacuuacauucaaauauaaguauccaaacacaucuaaguccaaauauaguacaaccauuuuaugauguugguguugggagacaggauuuaugucugcccuaaagacacauugucugcugucaaguuucaugguuuugaacugaaguaugguaauaucuuuauuaauaaagacaauguauuccagaggcaggguuucauuuugugugugugugugugugugugugugugugugugugugugugugugguuuuuuuuuuuuuuuuuugguuucuucuucuuccuuuuccgguucuguuucuccuucuuuguugccaucuuuuccuuuucuucuuuuucuucaucaucauuguuucaucuucuuuuuguaaguaauuucauaagcugugcugcaaauaaaauagggaggauaggaauaucaaaugagaguuaaaaccuuaagaaaaguaaacaaggucuaaguaaaauacaaaauuuuuaccugggaacauugggguguucaaaaagcaaaacaggguuaagguuuuuguuaggggaaggaaggagaaagccugagggaagcaggaggagagagcugggagaagguucuggagugaaagucuugccagccaguggaccuaggcuggacagagcagaugcuggguuuugaaagagauugaugacaaccccuucacucccggcagcauugggaccaggcgaccuguggccuuaaucagccucuuuuaggggacagagagcuuauggaggagagucaggacauaaaagaaagacacuuggaugccagaaaagauucguaugaaaacauuuagaggaaugcaguggaaaagcagguuaauccauugucugguaugcaccuguguauaugguacuauguaaaguuugaugcauccugcuucuuguaacuaaugguuuauuguguaucauuuccccuguucauucagugcuaauuuguaagauuguguaaucagacccuaauagguuugggccuuugaugaauaacuuuuaaaggaccuucuuauuuuuaaaugcuuuuauuuuugccauugaaauuauggcuuauaucuucuuccauagccagaccauccaucuuuagaaaaauucauauuauaaauuaguuauaguaggacagauuuuagaaauguauaaauacugaaacugaggcccagagaagguccaggaacaagugcucaaggugcuuauuuuccucuccgguucguagguguggaagcugagucacgugguagcgagagcugaccuaagaggcgcguuguuggguaauagauugggccucuuuguguucacacccucaagagguggacugguaucugcaaguucucugcuauacuugaaauaaccaaaccuuaucaauccugugggcauggguguuuucuuucucucauuuauuugaucuuaggcagugugauuacucucucagcggucagcccugaaggggugauacuguagcagaguuuuagauccucaguacuacccugcucucagugggaaccuccacauuagaaaggauugggugggaugggacuuuuugagggagguaguugucaaugaggguaucagucaggugguuggaaaaagagaaauagucuucuccgggaaucggaagcaugacuccuccccgcaacccuccaccacacacauacucacacuucuaauuggcagucaaagagucaaaugaccugggaucaacuaaggcaguucugggucugugauuaagcuugguuucuuguuguguaacuugcuggcucaguuauccaaacuauacauuaagaguuuauguaauaaacaugcuaaagaaagaaaaaaauucuuaaauucuuguguuuuccuccauaucaucucaccuaguaauacuguaaaacaucugccuacuccaagugacaacuauguuaugagcauuagcugcguuugaauaggacccaaugcuucauuuucagaaugaacacccugucuugggcuuguugauauuauuaucuuuuuuuccaaugauucuaggcagaacugccauuuggaauaucuuucucucccuuucugaugggguuaaugucugaggagauguaggcaaaugcuuuucagugaaggacuugaugugcagccuuuaaguagacaaauaguuuuuuaaucuuucauggacugcuggugcuucacaccccagaguugaggccacugaccucaaguuugcaaauuuuauaucccauuaccacccugugagcucugugcuccccagggucacauagucgguguuuuagcuggaaucugagaaagugccugaacauuuccugaagaguuggcuaggaauguuuggcaguuuggucauaaaaacccagagcuaguggcugggguauauguuauaauuaccucacacuauuuccuauuugagccuggcuguggguagugggguauacugguauugauugugggaccauauuuuaaaggaccaaggagucauuuucaaugaucacuaauaaccuuuggccacacuuucagggagguuuggaaguguggaaauagacaugcuuugggucaaacccuggcuccaccaccuucuaggaggaaaccucagacgagugauuugaccucucugggccucaguuucuucacuuguaaaugcgauuaaauuacucaucuuucuguguuguccuaagauuuaaugggaugguacauuucaaguucuuaguacuaugccugacauguuuagcuaugaugaugagaaugauuauaaugcuguuacagauaaggaaaaugaggcagagagucauccaaagaggcuguuuuuuauggcuaaagcaaaaaucuagauaaucauaccuaucuggauaccacagucuccacuuucucaucauagaaaugauuauauuaagaaacaggaggcaaaccugaauuuuaaaauguucaaaaguguaauuuuaauggacuuacuauaucuguggagaucugguuauacuuaaaggcaguuuggggauaaguuuuuauuuuuaaauuuucucuuucccuaaauuguguugucuucauugggaaacaaacuuacuaaauauuauuccuuauuaauaugcacccccucaacucuuccaaaaaaguuugcauuuuuuaacuggcagaucugucaaauaggccuugccucuuuccugauuagcacauuuuuuaaaaagauacuuugugaaaagaauuuaaauuuuaguaaauggaaagacuggguugaaaaccauucucuuuggcagcagugcagagauacccugggaguuagaauuguuucauggcaagguggugcgcuauucuugaaaugugcuuuaauugccucuguuggaguaaggauuugguuauaauuggguagcccagaugaccaccuacaauucuuagccacacugccuuucaacacauaaucucagagguaaagagauaagcccucuuuuccagauugcucaugucagaucucgcggagaacuccagcacugccccagucacacgcccuucacugucgccaaagaaauaggacacuccagcuggucaggacugagccauguguuaguccugccugaaccauguggaaugggcuuaggaaacgaagaguuugguuagcagagaaggggaagggauacuggaugggcaaacacaacacaucugcacucacagggagaaagcucccuuuuccauagcgucaguauucccuccacccacucuguuaucacuguccucucuaggugcuuugugggcaggccuugcuugcgugauuggggacaggcugacucagauuggcagccccugagaagagccacuuucuaguugagcguucccuuccuuuggcuucaugccaugcagcaacauaaugcucauuuacuacaaagagauucuuauuuguucuucuucuucuguguccucuuucucuugagaaauugaaaaucuuuuuauuuuuaaauuuucucuuaaugauuuccauuuugauuuuaaugagaguugacuuucggagaggucuuaaacuauugaacauccgugagaguggaacaaaacauacauuaucuuaauuuaggcauagcuuucguagaguuccuauacgcugcacccuacaugccagcucugguuaacugauuggcaguaaacucuaagaaguugcgguugcuucauauucauucacagccuauaaaaauaagaguagaguguuuuaaauaaggaacgauuugaacagauaauaguuacuuuucuauuugccauugaaaauguucaaauuacuuaaugucucucauccccgugggguaaaucacaccaucaccaacagaaaguuuguaaaaaaguaagaauauaaaaucaaacaaaugaauaccagguacuuucuuuucuuuucuuuucuuuuuuuuuuuuuuuuuuugagauggagucucacucugucauccaggcuggagugcaguggcacaaucucggcucacugcaaauaccggguauuuucugugcucuaccgacuuccugggaaaaaaauaaaccucaaauaaaauaaacuuuuccuuuuaaaguuuugaaaaccuuucagguauuuuacaaagauaggcaaaccacuuuuucuccuuuugcuuguaagcaguucuaacuuaauccagacauuauugaacuuugacagaagacagcagggucuaauuugacugcagacugacucaucugcucauuugcauuugggaccuuccuugaaaauagguuguuugacacacauucucacacauugaaaggucagaagacauaccaggauucuuugcuaaaugauuuccucccuccauuucauauuucccauguccauaagaauucuuccacuuaugcacagaaaaacccaaauuuaaccuuuuuauggaccugauacacaaaaaccccuucccccaaaacacaucuuuuguuaacugauggguuuauguuugucauaaagaaagauaaaaugucuuuaugaaaaugaaucaugucaaaaaggaccugugaugcccaaggggauccauccccuggaccgacauguuaauuguuugcacagguguagugaagucauuuguucuuggauucuucaucuagugaacuguaaccuuauuuaguagcuggauacuuaguaggaacacuuugguuaguucuugccacugauuuaacaugguacacauguugggauuggacuguugucucuuaauggggguccccucccucucaggaauguugagcugcguaacagauaaaggugguucuucaagugaacgaaaacagaaaacaaaaguguggcaugauggcauguaggagacuguggauaucaggauggacuaggccaggugcugcugcaaauuuguguuuuuuaaaaagaauuuuauuuaacacagauguggauaauuucaaaacuagcaagaaggauacaaugaugauccagcuucagcauuuaucaauuaauggucaaucuuguuuuaucuacuucuucucucccucauugcauuuauuuugaaguaaauccuugaaaaaucauuuuacuuuuaaauauuucaauguguguccuaaaagauaagggcccuuuaagaaacauaaacacaauaacauuauucuguuuaccauuaacacuaauuuucuaauauuaucaaauauucagugaauauuuaaaauuuccuaauugagucauaaauuuuauuuguuuuuuugcaguuuauucaaaucaggauccaaaaaaguccauauuuugcaauugguugaucugucuuaaauauuuuugaauauguagauugucccccugucaguuuuuccuuguaauuuauguauugaagaaauugguuccuguccucuacaccagugcuucuuaagaugccaguccacaaacuccuguuacugguccaugaugagaugagaagccaggguguaaauccaaaauaugucacuaagcacacuauuuaguucagcugauauuuuauuucuagggagacuuucucgaugaaggaagcagugagaugguuuagauucuagcuuaaacuccuuaucucaauauagacuaguaacgucuaguuuguagaacagcacuggccaguccuuggaccacacauggcuuucaccacuggagaguuucuugcaguccagugaugacugcauuccagugguaugguccuaccauguuucucaguccccuguauuuguugugaauugcuaguuagagcuagaugcuugauucaacucaauuaacuuuuuuuucaagaagacuuuauaagugguauguguccuuccauuaggagggacaucauuacuacuagucucucuuuuuguguuauuagcauucauugauaaucguuuucuagaucuauuaggguggcagaauggggauauucaaauucugucauuuccuauugacuuacuaaugcuguaaaguuuuacuccuaguuuugaacuuaggcucaaugcuucacagccaguaauguuugcaauaugcugggucugauuuuucuuaucugcgacuuuguuguagaaaaauuauuuaauaucuaacaguaaggauaggcuauuaugagcuaugaaauuguggaaaauucacacagaaggagccuggcauuugaaagggaagaaaauaauucugcaaagguccauuuaucccaugaucuuuugugagugucaagguggaagcacucaauguguuuuuauuuuaaaguaagggauuucaggcaagaaccuuaugaaaaguugguaagauuuuggacuaugaggguaauaaagaagauaucugcagagauuuuaauauucagaagugaauuuuuguaccuucauuucggcauugcucucucaggaaugcucuuuuuuuuuuuuuucuucaagaaauuggaacaaguacaaccuuagugauucaaaugaaagauucugaaaauuacugguacacccaguccccuuuggggaaaggaagguagggacaagagcugccccaggagcaccuccccgacuguuuguaggggaugauacgugcgcaugugcaugugugccaggcacaucacccguguguuucaugucagugaaacauguccgucauucucuaaggccucauguauucuuacuugauagaaaacuccugggugaaaugacaggcuuuuggaacugcuuuuucgucagugggugcugcuacagagauuuggaagcccuuuagguaugcgagguggauguauuucugucuguuuugacaucaucaucaccacuucagaaguugucauguugaaacuuugugcuggcauuuagcaccugcucugcuuaauuauagcuugaaacacaaauacugugacaucuucccuggagcuggaagggugcugagaggacagugcuggcaucacucacacugagagggaaaucuuucggguuggauuucagggaagagcugugcuggccauuggaaugaggacagucaccacuuucucuguguaauggacaauaucccagcagccucugaauuaagucacagagacgugaaauuggaggguuuuuuuuagaagaucaucuggaucacccaggccuucgagcagcucauugucuuccuaagccgggucagacaguugccugcguguccugaugguuuugcuuugagcuacuuuucaaaagacaagccacacccauguugaaguguguguacuaacacauuccaaugccagcucugaguagguuuugaauuauccacauguugaaucuuucuugugcucucuacacauccacucccucaaacguugagcauguuaagagcugacuaauguuuuuaccggagggugcaggacagaauacucauucucuguugggaaaugcagaaacuauuucagaaacagaagugccaaucuauaggagugaauguuccuaaaauguguucucuuuacauuguuuuccuuugcuaauacacuuccaaaacacugucuuauuuauuuauuuugcaaaccuaguaaaaaaaucagagcacaaaaaaugauguacaaauuaguuuauacaaaaaagagaauacauucucuuuggaguauuuauggaaacaucuuucuaaucucuaaucuaaaaaucuuuaacacuaaccuuggaauguuauuaauaaagucuuuugguuuuuaauuagggauuuaugacguuuccauuguguagccuuugaaaaauuacuucacuucucacauuuucaguuuccucaucugagaaugagcacaccaauacauuuucuugauaggguuugggggaagaguaaauuuuauaaauuaaagcucucuaauaguugcuaauuauuauuuuuauuccacugaaugacuucauguggacuaaaguacugauuugguuaaauucccuuaaauuuaaauuagacuauuuuuauuaaaaguuuuccacauaucuaaauguuuaaaaaauaaaugcuuacaacuuuguuucaauuucaaaauuaaaaaaaaaacuuaaguuuuugacugcuaauauugugaaguguuaauuucaaugaaauaaucucagcaaacugcaugcuuuuaccuaacuuccucugacuuuauagaaacuuaaaaucuguuagugauuuauuuauuuauuuuuguuccugagcaacaauauugucccuguuuugaugggagggcuagauagagaaauguuuuaaagauccauggccuguugacugcuaugaaauaugguuugagcuacaagaucucugaagcuuuuguagcuauaaauguuucuaaaugaugcaacugaaacauggaagaauuucacucucguacuccauguauuccacuuauggguaauuguuguuauguguuagauuuuuuccuuuuaauuuucuaaaauuuaaaaaaguagaugaaaugauacugauuucuuacuaguaauuauacuuuucauuuuuuuuuuuuuuuugagacagggucuugcucugucacccaggcuggagugcaguggcgugauugcggcucacucuagccucaaccuccugggcucaagugauccucccacucagccuuccaaguagcugggaagcuacaggugcaugccaccaucuuggcuaauuuaaaaauuuuuuugaagauauagauucucgcuauguugcccaggcuggaucuuuuuuuaaaaguuucuuauaaacauauccaccuuuuuaaauaaauuaaauacucacuacucugauagacuucucauuaacuuauguugucuuagugguaaaugaaacucuaaacucucauuuaccacuuaagauucaaguauuguguuaggugcugggauuguaaagauaaaucugaacuugcuauauuuaaggaacuugcauacacacacaaaaaaaacgcugguaauuuccaguuuuaggagaggugaaauucuugaauaauuuugguaugagacuaaagucaccaaauaggauucaaaacggacuugcuuccuugcuucacguguaagccacucgugcuagaaauagcucacugaagucuaucugugagccaguccaggauacugauuuuauguuauaguugcuaauggggcgggaucuucuggccuuuaaaauaaaucaggugcaucgaggaugagaacucuccagguuuuaagucucugauucauggaccuguggauguccuguauuggcccugauggucucaugcaggggguccagaagggugucaagccugggcugggacggcucugacucuggcugcccucucaggacuguguggaguugccugaguuuaagguguucauuucucacagaucacugggcagcuuacuaagcugagacaugguggguuugaguggccaaguuuuccucugguugccugccguggaauguguuuucccauagaaacaacauuuuaaguuguggucagguucccagaccagcccacaauagccuauucagcugauaaugcagcugagagacugcuauuugacuggucuggagaccaaaccaccaccuauuaacauuguuucuauuggacaggccauuccaaguucuaaauacuaauauagaaaugaaauuuuggagcucuaccuguuugucaauugggggcugacagcauucggaacucaaguaucaaaucacccugcacucuagguuccugaaagaccucauucuuucuuucuccuaagucugaccccauuggcugauuuuccugucucuuccuggggcugccaguacauucagaagauauuaucucccuggacagagcucuugguuugagaauuucugggaaguggcaagaaucaugguuuuaguccccaguuccuucugugggugguaaaggaauuccacaagcuccacccccggcuccgccucuggccggccucucucugugcaggcucagaauccccucaccacuuguuuuguguuuucaaucauuucuaugauuucguucacccuuuggaaaaguacaguguggcuucaacuugaauaaauggaaugaauaucccagucaaagaaaagcucuugauagacccugagcucacuggugaaguccagggguuucagagugcugggaagcaguucuuuacacaggcaacauguucucaucgugucauuggccauauccucucagaugcuccagaagcaaacauuugagauaagcuggauuuucuguuuggaagcaaugcuuccucauccuuagauggucaaauaguugaaacuucaugaagaaauucaccucuucccauguaugggagcaacuuuuacccaaccaaccagacaugugacgccaguaggccagauacagaugcccucccuuggagaagugauccaguacacacuaggacagcaaguuauucaaaucauugccuucagaacuuugaggaguccauucuggugguguaauuuucuaagcagacaagcagacuuaguguucuuagugcugcuuaauccagaguuccagaagcaugaagugaagagugcugacuugcugcacacaugauguacuuuaaacaucugugccucuggucuucaugguucaauugucuaguuuccuguagagugcaucccauggcuuuuugagcuucaaauucuuuuuuuuuaaauauauacacuccaccuauaaaagauuccaauaggauuuaaauuggcugucagucuaaaaaugaugucccagauccgaggaacugccuuuucagcuuucuauuuccuaauuuucuuaggcugugcguguguguguguguguguguguguguguuugugucuuuguguguguguaugugagagagagaauguguguguuggggaggagggugcauguguacaugcccuugaagggggacgacauuuuuggaccauaaguucuugggcuauugcuuuugaucaacacaaaaucuccaugaaaaguugaggguacacagugaaugaaacuguugaugcaacaccuuugugcugcuugugcugugaguuacuccacucagcagugggaaaagccuucauccaagcagcacauccaaagagaccuaucaaggucacucuaugaauuuugucaugauugucuguaggaauuggccgcaugaggcuggcuccaucuauggccuugaucaguugcagcaaucugccauaauaaaaugcaugccaacuugugagcugaaaaccuucacuuaguugcuugugggauuuuuuuucuucuuuugccaaagaaauaaauagaaucaaauguuuacauauguguguuauuugucuacauugauuuuguauuuucucaaaggaaaauauugauuucugaguuauaaacauggguaacuucacugaucagaauaaguuaaugacaggcaugucagugaaauaaucaaggcacaaaaccaccauacauuucuguuuaacugccuauguagccuuucaaagacguguuaaauagucuucuuuuaaauagauaaauuuauaagaaauaauucuaucgcacagauuuuaaugucgguggcauauuccaucuggcuuacuuuuggcacugaggagaugauauuaaucuuugcuaauuguacuucguacucacuauugccuuuagucaauauuaucuugugugcuucuaaauagacuccaggauagucuaggcauaauagacauuguuucugugccugaagaacaauuuauuacucugggaguaaagggggugguggguugggcuucagggaugagaucuagacauauaauuguuuuaaauauauaacuacaguauagccuauguagguuuuugaagauaugucuggaauuguguuuguagugugaaagauggauggauucaucagggaacacuaagggagauggaacuacauauugaaauggaaagauggaagagcugauauaaaaauggaggaagugucugguuuuagugugugucagagauagcagugcgugcaugagugagggcugagacggugaagaagaggagcugaguaggaggguggaaguugaagguauagguaaagauaagaguugacagguagauuaggccuaccugguagauaucugaaccuaauaaugagauguuuaacauuauagagagugaagguccaucuuugggcuguaggggaauagaaauaagcacggugaauaugaaaagauacuuacccauauuguccuaauggaguagagagaaacuaggaagccaggaaaaaagaacaugauauugguccaacaaugaaaucaccaggauuuggacaagggauuugcuaauggaguuggagaauuuaaggggaauuucaucagugggaugaaauaaaacuagugacuccccuuagcaaccgggaaacaucaagucauagcucagauaguccucuucugagcuuaccaugcaugcuguggcuaaaggccuuuguucuggccucccugaguuccccaggcagaccuugauguuagugcuuugucuguuguguagauaaucuuuguguaugugccuguguuccuagacuguaagauccucaagagcaaagacugugugucuuagucacuuuuuaaauauagcuguuuuauuuauaauugcauugggacaggauuauuauuauuuuaccuuaaaauaaacuuuucacuuuagaacgguuuuagagucacagaaaaauugagagaguugccauauacucuggacacuuuacucuguuguuagcaucucauacuagcgugguauauuuuuuguaauuaaugaaccaauuuuuuucuuuuuuuuuuuuuugagacagagucucgcucugucacccaggcugaagugcaguggcacaaucucggcucacugcaagcuccgccucccagguucacaccauucuccugccucagccucccgaguagcugggacuacaggcgcccgccaccacgcccggcuaauuuuuuuuuuuuuuuuguauuuuuaguagagacgggguuucacuguguuaggcaggauggucucgaucuccugaccuugugauccgccugccucagccuccgaaaguacugggauuacaggcgugagccaucgugcccaaccaaugaaccaauauugauauguaguuagugauuaaagucuauuccuuauucaaauguucugaguuuuuacuuaauguccuuuuuauguucagaaucccaucuaggauaccacacugcauuuaguagucauguuuucuuagacuugacuuagcugucacaguucucagacuuuccuuguuuuaaugaccuugacaguuuuuagaagggcuggucagauauuuuguagaauggcccuuaguggaauuauuugauguuuuugucaugauuacauugaaauuauggguuuuugggaaaaagaccacagagguaaaguuccauuuuuaucacauaauauuaaggguuuauaguaucaacaugauuuuccauuguugcuguaacccuucauugccuggcugagauaggauuugucaggauuuuccacuuccucccccucccuuuauacuguacucuuuggaagacagucaguauguguagcucacauguaaggaguggggaguuaugcuucaucuuuuugaaggcagagcaucuacaaaauuauuugaaagucggaagcacaagagauuugucuuuucucucccauuuauuucuucaaucauuuauuuaucaguauggacuuauggauauuuauuuuuuacuugguauuguaauccaaugcugcuuuuguuauuuuguugcuccaaaaggguucuagcuuuggccauuuacacuuccuucauuuggcuucugugucccuugccaugcuccccucaguguggauguuuguuuagcacuuccuuauacuuucugucacugcaagaugcuacagauucagcuugucuauuuccugcccagcccuagaaucaucucccaggagcccugauuccuuuuauugaauaauaguauuagcaaccaagaucuaggcauuaggugugcucuucuuggucaguuuuauuucuuaucuaacacagugccuagcacauaauaggcucucauuaaauauugcugaacagccagcaguaauggaauguugaguaacugaugguacaaaugacucaauaaaauauuauguaucuaucaaaaaugaucauuagauuuauacaauaacauaagugaaaaaguaacaaaaaaugaagauuguaauaacacucaugcaaaacaagcagagacucgugcaaaaaaugcuaacauggggagcuagauuugaauuuuggcuccccaguuuauuaacauaugaauuuagauggauuaaucucuauggcccagcuuccucacauuaauuauaaugcaacaguaaugauaaaaguaauaacuuauuucauagaaguauuguggggagguaaaugagugcugugacugaaauaggauaagcacucaauagauaugauuaauauagugauuauugugaggcugauggaacuaugguguuuugucuuuguuucccaaacccucaaugauguguaacauuacauacaucgucaucucuucaucucucuucccagucuucuguaaggaauaucuggagcuggaucauuccagccaugauagucucacucucccuuccuaagaauucccauagugcuuccuauuugaaaugauugcucagcaauguuuuuauguugucugggguucaucacuacccuuuguacauacaugcuccuccagucccccgaccauggcucucaggaaaggggcagcuugagucccucucaugagcccuucagcgcacaaccaaauguaucucaauagguuaauuuaauuuuuaaaacauguugauuuggcauucauauaggucgaagcauguagaguauccagacuucaauaaauguuaguucuucuccuguuuuuuuuuuuuuaacuuuuauuuuagguucagggguacaugugcagguuuguuauacagguaaacucgugucaugauuguuugagguacaaauuauuucaguuuguuucuuaaucauauuuuauuuccauagucacaaaaaaacaagaaacuuaaaaaaaaccuuuggguugguaaaaaaaaaaaauuguugaacagcuuugugcuugugggcaaggugaauaguccugauguauccgguuguggaccuggcagugaacuuacuggcuacacaggaagaggagcuauugaucuuggauaaauugaguuugagaugguaacaaaacauuuaauucuaaaugcccugaaaacaggaacugaagagagaagaaaagagacagaguggaagaaaggcagauaggaaaggggagaugaggaagggagggagagaaggagggagagagaaacagauggaccauggcuugggaggaaaacguaauagagucaccaaucuacuggugauggagaaggcaagaaggggauaaagcucuugaaaaccagaauaaaucuauuauucauucuguuccuuuucagauuacuuucaucuaaaaaauaaaaaaaaaucccaaacugcacaaaguaaguuagagugguuggcuggcuugcauccucaaaggaggaagccagaauugcccgugucccaagcagugucaacucagacaauccagaaaagagucuuugggucuacagcaguggucuccaaccuuuucgguaucagggacugguuucguggaacauaacuuuuccacggaccaagggugcugggggauggggggaugguuucaggaugauucaagcucauuacauuuauugugcacuuuauuucuauuauuauuacauuguaauauauuaugagauaauuauacaacucaccguaauguagaaucagugggagccuugagcuuguuuuccugcgacuagaggaucccaucugguggugauaggagacagugacagaucaucagucauuagauucucauaaggagugggcaaccuagaucccucccacacgcaguucacaaucagguuugugcuucuaugagaaucuaaugcugucccugaucugacaggagguggaguucaggugguaaugagagugaugggagcagcuguaaauacagaggaagcuucacuugcuugccugccacuuacccccugcuguguggcccaguuccuaacaggacauggaccguuacuggucuguggcccagggguuggggaccccagucuagagagucaagcugaagcuuagggaggucauggaagcuguucucauuaccaggguuugaaguuuuguuacccagguugcauugugacuggcagauggacuguaacagucacaugagguauucacaucacuacugggagacuugaccucugacuucagugaagagggccagaauaaaggcacuaaaauaaagagggggaauauuugaaagguucguuagaauaguaugggccccuucaucagacaguacucaugauguuuuuucuuuuuuuaucuugauaagaaaauugucaaagagcaaauaaaaucaugauguguaguucacaauacaggcagcucauuuauguauuguaauuguuucaugaucuaucacauuuuuuauaguggaaguuauuuuaaccuuggaacaguaggauguuaagauauuaacaugggacacauuacaugggaaguuggguguccuuuguugugugagggcauguaccuuuugauccccuccagauuuauacuuaaggggcuaaaucauaguuuuuuuccuuaaagguuaaaaaaaaaagcaguuaauggagcagggucagucucauuagcccuuaccuaguacuuguucuccuugcccaagaguuuaaucacuaacaaauauguugagaaacuaacauauaugaaauaagagccuccugaccuuguuuuuauuaccuuaaccuuuucugaaaaggaguuugcacuuugcauaggaaacagaaaggcuaucuugcuguaagaggccaaauugcagaagugggcuuuggcuaaggaauguggacacacugcagacaucuugcacagaggccaagucuugcaaugauguggucagacgugguagaggccagcuguuugcuccguugagagaggcuuuugccaguccacaggcucucugagggcuauguuuaacugaauccaaguaucaaaccugcugagacucacucaucccccaggguguuuggaguuggguucuuacagagcacaauauugaaaguaacugguaagagaaguuacagauaaagacuuagcuauuuuaaaaaaauguaacauacaguggugaaguggaauauaaauguauuuucccucuuuccccuauaaacuauuggaauacagguaaaaacaguuuaugcuggcugggcacgguggcucacaccuuuaaucccagcacuuugggaggcagaggcgggcggaucacgaggucaggaguucgagaccagccuggccaauauggugaaaccccgucucuacuaaaaauacaaaaauuagcuggguguaguggugugugccuguagccccagcuacucaggaggcugaggcagaaaaaucuaucgaacccgggaggcggagguugaggugagccgagaucgcacuguugcacuccagccugggcgacagagcgagacuccaucucaaaaaaaacaaaaaagcaaaaaaaaacccccaaaacaguuuaugcugugcuuuauccuuggucuauugauggacauucugugauuuguguuacuuaugucaccaugaauacuacuggaugaaauaucaucuuguccucuaaguacacuuuugacuuaacauaagguuaggagagcguacucuagaaucaggaggcuucuugaguucaaaucuccauuagacacgucuaagcuaugugaccuuggccagguuguuugaccuucuuaagccauaguuuuuuuuuuaguguuaaacauuauaacaauaaaaauuaccucaaagaguuguuauuaggaugaaauaaaauaauauaucuuuagcacuuagcaaaaaguuauuuccccuuugaauuuuaauuuuuuaaaauuuguugaauguuauugcuacuugcacagagcuuuaaauccgacuuuguguguguguguuggagugauggggguugauggggauggcucaugaagugaaaagagaaagagguauggaugcuauacuuucauugacccgaaagaguaacuuuauuaaagauuuaccuuccuuguacaagcauuuuguauugaaaccuuauaacuaaaucuuuuauuauggaaauaauccagcaugucucauuuagaguuuacauauuuugguucuuuccagcuucaauaagacauucauuuauuuccagaauuagagcuguuuuuuuucuguguauaaguaaaacaaaugucaugcagcuuguuugaacgaguucuaauaguuugcaguuucucaagaccaaaagcagcagaggagaaaucuuacauguuucaaauacuuugcguugagccauaccacauagcauuuagaaugauuuaagaaugaauggcaacacaauuaaaacaaucauugucauuugaagguauugguugaaacagcugaaauuaaauaacauguuacuuguuaaugauaaaguuuuaaaacucauagaaagucagaggaugcaaauaaaauaaguccaacccaaaauuauaaagaaccuuaagaaauacagugaaaugaaaaugugaugcacuaaugaaagggaauggugaaugaauaaaacaagaaguauucuguuucaaagauaagacguucauacuucgaaagucuaguuauugcuuuaagugaaagacgauggaaauagaagagcguauauuuuaaaaugaacaguuguggaugaauauuagauaagaaagcaagagaacucucucucugcuuccccggguucucaucucuuaagguaacuagguugaaacauuucuguuuuuuguucuucucauguaacaccaucuaccauguuuguaccucuguaucuagauuuaaacaguacccacugguuucuugcuuugaaagauggggacuuagcucacuaaaguaucuguacccucuuucucucuucuucuucacaacuuuaaaauauaguuuuaguauaacuuuuauguauugguuauuuuaaaacacaguguaauauauauaagacucuguuucuaggaucagcugcuuuauugacugccacaccuuuccucccaaauuguuucccgaguuaugucaucugucccauuacuuuuacucuugugaagguuuacaacauuuacauuuucuuuuguaacuauaguaaauuguaaaaucuuccauguuuuggcuguagauugauucuaaacauuaaaaaaagaauguuuauauuaccaugcuuuuucaaauuccuuggaaaaucuuuagaauauuuugcuuuguaggacugaaauuguuauucuggauccuuuguuucugagcuucuucaucuuguguauguguuaugacauacauauuuuugucagacacuaugacugugacauauuaugucagacaauguaugauuguaguaaaaaaaaaaaauaaaaccuuguuaugucaaccacagggcacccugcaaaggcucaggagugcucugacacuauuccaggauuugguagggauuggacuaucuccagcggagcuguucuaaugggcuguugcuggagaagguuugaggugguugacuuuggccuggauugucauuucaaauugagagaacuuuuauaauaaaaguuuggaagguuugugcguuccccucuaccccagcugucuacccucacuuccucucucauuuuccuuuccgagaauuugaauuuccccaggaacuucuggacacucugaaguuucaggcauuacuuugucauggagggacaaaggguugagagccuuugacuuaaaauucuccauaacaucuuucuuccuuuauuccuuguguuuccacuggcugaguaaccugggucagaagaugauuccaucaggaugauaaugcugcauugcauuuucaucaucuuuuucauauaugaagcuuucauguccauuauuugacauauauacacacaagggagacauuucauugugccauuguacacagaaauauacugagcucacacaggcucuaacaucaugcacauauuucaccucuauccaaucauuuccucucuauccuuagagaaggccugggcugcuggguauggaguuagggcccuuuccuuggcuccuccagcuuucuuccuaaaucccuuucugaccucagcaucugucagugugaagcauguguggugcccugcaggguguuccagauuuucuggagcaacaaaagggguaaaggacauagcaaagaccuuauguugguucccaaaccugcaugauguugaaguagugaguucagaggaaaugugggaggacucuguacuguuucacguggucuacauauacaaagagaaugugggagugcacccuaacugaaaauacauuuuagcuauacaguuguuuuuaaagguuuaugcuuuuggguuuacaguguuuauaccaguaagcuuuggaauugcuccuaguuugugaaauugauugcaaaacauuugaccuuccuuauuagccccugaucgcuagcagcuagcaucaaugcuuaggcccucaggauacggcaaaguaaaacuaaugguugcuucuaggucucuguguauuauagucucuguccuaguuuccaguguagaagucauuggauccuuacuuaguugcucccugaaauuguuaaauguggaucaucuggauucugaauggaguuucuacuccaagacaugugaugaacugucuguaaacaagaaacccagagugacacugauuuuauuuucuuguaacugcuguuaucaaguguguuuccaaacuuuuuguuuuuggagacagagucucacucugucgcccaggcuggagugcaguggugcgaugucagcucacugcagccucugccucccagauucaagcgauucucgugccucagccccccaaguagcugggacuacaggugcgugccaccaugccaagcuaauuuuuguauuuuugguagagaugggguuucaccauguuggccaggcuggucuugaauucauuaccucaagugaccugcccaccucggcuucccaaagugcugggauuacaggcgugagccaccgcgccuggccuguuuccaaacuuuugcuaaagaaauauuuacauguuuuggccuuuauuuuuuucugacucaugucagaguuugcguuccuguaauuuuagugaaagggagaauauguaaaauuauagaggugagaugggccguaggaaaauauauauauauauauggcuucaaaguguagaaaugugaagucuuaugugcauuagauuuuauuacaaacuuucuuaaccauauugguaagaaauuuauuguuuaaguuuauugucuaauuuaagacuuguauggcuucaugaauugugacagaaugugcuacauuuuguaucucugguuuuuauuucccugaugggccauaugcauaggugauauuaagggaugucccuguugauaucacuauguuagugucccaagcuaccaacccagcauugagucucaugaguuugcuuuaucugucugccaggauucaucuugcuuuuauaacucaggaauuuuuuuuccuuuuauuuggccaucucuuccucuucuucuuuuuuuuaaaguauggaauucuucuguuuuuguuuuagacccaaugucuguggaucacguuauaaugcuuacuguugcccuggauggaaaaccuuaccuggcggaaaucaguguauuguccguaaguaaauagaaaacuugucauucugcauguccuucuuuuguuguguugguugcauggggagccuuagaauguggccuuuuguaacuguacuauuaaucuguugauaguacagccuuccagcuuuaagacuuuucuaccuuuccaguuugggaaauacaucaacuuggucaaacccugucaaaguuuagucacggggauacuuugcuugagguugugucauuuacauauguugugccuggcuacacagacuaucuaauuacuuugaugggaguuugaaugaaaggguauuauugcugcuuuucuuauuguaauuucuaacuuuguuggccacucacgggccuuaccaaacccuguacauugaauuugggugauugagggaccaagagcagaccugacucuuagacagaggggaaaggaaggagauagaucaccagacgaagaucaguggaaagacuaagaaagaucucaaaugauaacagagguuccucuauugauuucugcuggcaaggcaaacuuccagauuuccccaauaucccacaaauguugagugacaaaucgcaugccagacaagguguucuuuaauggagacaccaaagucaaauuuagucaugaugccugcccuucaugagcuuuuacaguuguuguaccuaugaaauaauguccaguuuucagaaaacuccaguaguauaauggggaaauuuagagcugaagggacauuaagaaucacuuaguucaccuucucacuuggcugacaguggucaauggaguauucaauagacuauauuggccaauauuugcuucaugaccugaaaaaguuuaacuguuucucaauucuugauuuugaccagaaagcaucuccuuuauuuggcacauuauggucuaagaccaaaauuggaucacuaaaagagaaauauaaugguauuuggauuuuucucaaugaacuuuauaauagaacccuuucuuagccuucuguagaguucucugagaaaugaugucuccagauauuuaaauaaauguuuacuggaucuuugacaguuuguuucuuagucguuuccaguuuccauccuaaacucuuuggauguuugaaugcacuuucuaucaaguguacucuuuuagccuugcauaucauguuugcacuugcaagauugugcaggagcuugaggaaaagaucaugccugucaugacgaaaaguagugaccaagugcuagucugccgauaaauauaaaucauaugccauuuaaacuuacuguugugaccacuagcagagcauuugguaccagcaugauauuagucucugggugguaugcaaauguuaguauuucucuaaaggaugaauggcuuccugacuguagaaucaguacucuagcaguagauuccagcauucuucucucagacuguugauggaauucagaacaggauaaaaauuaaacauuaaacauuuacaauaggcuggacgcggugguuuacgccuguaaucccagcacuuugagaggccgaggcaggcggaucacaaggucaggagauugagacuguccuggcuaacacagugaaacccugucucuacuaaaaauacaaaaaauuagcugggcaugguggcacaugccuguagucccagcuacucgggaggcugaggcaggagaauggcaugaaccugggagacggagcuugcagugagcagagauugcgccacugcacuccagccugggugacagagcgagacuccaucucaaaaaacaaagcaaaacaaaauaaauuuacaauaaaauuggcucccaagaguaauaauguaauuuuuauaucauuaaaucuuagaguuaauauaauaauauauuucuugugaucauauaaauauguuuagaugcaggauuuaauuuguuuguuugguuuucucuucauagccuguccugggcuucugauggauugagugcuguggacuaagcaaagagagguugagaaccaccgugacuggauaaaggaguuguggauuuuaaagccagaguuuauuuaguucaauagacuuguuuugaaaaugaguacaccugaggcuuaaggucauauaagucaugauagcaaaguuugugagggaccugagaacccagguuuccucauuugaggauugguccccuauaacaaaucguguuccaaauccaugugcuaacagaccucugguuuauucacagccauuugccggcauuccuguggggauggauuuuguucgaggccaaauaugugcacuugcccaucuggucagauagcuccuuccuguggcuccagauccaguaagucuaacaugucauuauauauaauauuauuuuaugugguuauaccccauuuucuccuaaauuugauuuuggcuuuccucuuuccugcaauacauuuuuucacuagaacaucugccuucucuguucugcccaaaauacuuggaaaggcuuuccuucaucuggccucucauuucccuucuuuacucuuuauaggaaaauuaccuauggggcauaguuacuaugaauaguauaaagcuuauggccuuuuauguagguaucgccuuauucaucuuuguaucuccaguguaaacaccauaaaaggugcucaaugaaaugguuguuuaauggacauuuuuggcucaagaaaucuaggcaugcuuccuugugguacugaaauaugaaucugauuaaaaacuuauuuaagacucaagaccccugcuuuacaagaagaaaauguaagaagucauuauggaaguuucugggggugauuuauaaugaagcauaaacauauuuuuccuuucagaauguugccacuuucugugaugccagaugaauauccacaguucauucuucagaaccuuuucuugcuuguucuguuguuuuucuuuuggggguuugggcaagugagucauaauugguuguuuaaaaagcugaaguucuuguuuguauaaacagccccucaaaacuuugaccguccccauggcaaaaaacguaggucccuuuuccguuucuuuuuguccuguaagaaaaugcaccccccuuauuguguguccuauuuugacaaaguuuuaaagaaaaacauuguggaauaagugcauucucuuuuguuuacugcaaguagagacuucacugugucaaggcucauuaccuguuaagagucugaacauuugagugugucucucacaagccaauuaacagguuagggcaaauuguccuguguagcacuccuggugcccucuugccucccuuggcuucauggaugaacacgggggacucuuccugagagcuuuguauacuuuucuggccagagagcaugccaggucugcaugcagggcaagcuggaagugcuggggguuaguggaccuggaagcagacuuuuaaccaacaacagauggagagugguuggauaagugccucagcuuccuugccucucaguuuggauaaccaugagguucacucugcacugucuccugaaguuccccagugggaccgagcccucgcuguucacagugauaauagauuugauaauguacuuuauuagcuuccuucucuuuuugucucacuuucccacucuccuaugaguguuuccuagaauuacuuucagaacaaacuacuuccauuuaaauuauugucucagaaucugcuucugguggagcccacacaguaacagccaccuuuuacuaaauacagccaguuacaauugggauagaaauugcccuaugggcugggacucuugcuuauugcacugaauguguagcauaguuuuccuugaucucagcuuggugucagacaugcaucuuccgaguaauagcagguucauucuacguagcaagagccccugaacuggaggaauagaacgaggcagagaagccagcuggcagcacaucugggaacaugcgggacaucuccgucucuauaagggugacuuccaggcugccgcugaagcauaagcaucucaggguuggaaaagaagugcaguuauaaaguugggaauagaccccaucucucagauuggucccugaaccaacuaacaacauugcacuccucugggggaagaaauauagccagauggcaaaacuggguauuaaguugggaaggucuucaaugauaaugugaacugauaaugacuucucuaucgaguagaaaucaugagauguggagacaggauguuaacaagaccagagggaaaagccaugguccugguagaauccaaguuaacuguggggugugacgaguauaguaguaagguccuggggccagauuuagucuagagacuaaaauccaagacuguggguggugcuuucugaggaagucugagucauaucuaugguaccuggacguuagacaaaguccccaaguagcuuguggaugagaguaguguaaggaggagguucugguuucaucaggaucuuugggguuacuugaaaucuuuaaaauuguuggcuuugauucucucugcacuaauauugucuaaauggcuugcaaaauuaaagauggcaaaauauuuuaaauuaaggauagcuggggaugaucagaauucauuucucaucuuuuggagugauguucuagggaacagcugugccauuccacagaacauccugaucacuuugcuaacuuuccugcuaauagaaggacaauucuacucagugaaauguuugcauucacuacaugugguucuacuaaaaaggaucaauuuagaucacugaacgaauuuuuccucugaaaaauuuuauacuuuuuauaugauagggaucaaggaggucuaggcaagucgugggaccucagagaggcuuaguuuucccacuugaauaugaacagaauggaagaaguguuguucuuucaggugguuuuugacuugaguguccugugacucugagaauagaaaaugaucucuuagugaccugaaugagagauugcauuuccagaagguucaaaguaccagccagugauucucuuggacaacaggaaguuguggcuucccuuggugcugguggaacucucgacacucgucauucagcaccagggcaaaaagaaugauuggcuagacagcgucaaaacaguaguuuuucuagacuuuaauuccagcccucuuuaggacuguucuuugcuaugucagucucugaggguacagauggauuuugagcaauccuaauugucauaaagaccuaucaugguuuacugauguaugaauuuacucauuguucuaauauguguauacacacauucaaauauauauuagcuuguaacacugggauuaauaaacucuauaacuuuacauauauauuugucaguuugggcuucuauaacaaaauacuguagacugggucauuuauaaacaauaaaaauguauuuuuuuacaguucuagaggcugggaaguccaagaucaagaggccagcagauuacaugucuggugaaggccuucuccuccuagauggugcuuucuguguguccucacauggcagaagggacaaacaggucucccaggccuuuuuuuuuuauaaggauacuaauccuuucaugagggcucugccugcauaacuuaaucaccuccccaaaggccccacugcuccauacucucccauuagggacuaaguuucaacauaugaauuuuguggggacacaaacauuuagacaauaauauauauauauauauauauguauauguauguguauauauauaauugucuaauuauauauauaauuauauaugauacaugauaaaaguuguuuccuauaguuuauauuuuguaauuuuguauuuucuauuuuguaauuccuacaguuuauauuuuguaauuuugaaaucuucucauucuguuuuacucuuuacacuuuaagaaugcuaaaaauuaaacuucauauucugagauaauuguagauuuacaaacaguugccuuagucuguuuucugcugcuauaacaguauaccacagacuggauaacuuauaaacaacaaaaguuuauuuggcucgugguucuggaggcugggaaguccagagcauggcaccaaugucuauagagggccaucccaugguggaaggcaucacauggggagcaaguaugagagacagacagaaaauggggcugaacucccgagaugaccaacccacuccugagauaauggcauaaauccauuuaugagggcaaagcccucaugaccuuaucacgucuuaaagguuccaccucuuaauaccaucacaaugauaauuaaauuucaacaugaguuuuggaaggaacauuccaaccauggcaguuguaagaaaucagaaauauccuggguauucuuuauuuaguuuuccccauugugacaucuugcaagacuauaguacaagagcagaaccaggauaucacaaaaucaauacaguuaagaugcagaacauuuccaucaccacaaagagcgcugauguuacccuuuuauugucauuuucuucccgacauaauucucucuuuaauucugacaaccacuaaucuguucuacauuucuauaauuuuuucauuucacaaauguuauauaaauggaaucacagaauauguaaccuuuuggaaguggcuuuuuucacucaucagaauucucuggagagucaucuagguuguugcaguaugaacagcuuguuaucuuuuauugcugaguaguaguacaugcuauggauguaccacaaguuuguuuggccauucaccuauugaagggcaucugaguugucaucaguuuuuuuuucuuuauuauuugaacuaagcugcuaugaacauuuguguacaaguuuguggugugaacacaaaucuuauguucucugggauaaauacacagaaaugcaauuucuaaguuguaugauaguuucauguuuagcauuuuaagaacugucaaacuguuuuuggagucgccguauguaccauuuugcauucucaccagcaguguaugaaugacccaguuucucugcauccuuaccagcuuuugguguugucuuuauuuuuuauuuuagcuauucugauugcuguguagucaucucuuacugugguuucaauuugcauuucccuauuggauagugaugucaaacaucuuuuuaugugcuuauugccaccuguauaucuuuuucagugaaaggucucuuuauaucuuuuguccagauucuuauuuuucauuaaaauaauuuuuuuagacggggucuuacucugucacccagguuggaguacaguggugcgaucucagcucacugcaaccuccgucucccaggcucaaguuauccucccaccucagccucuugaguagcugggacuacaggggcacaccaccaugccccacuaaguuuuuuguauuuuugguagagacaggguuuugccaugcugcccaggcuggucuugaacuccugagcucaagcaaucugcaugccuugggcucccaaaguguugggauuacaggcaugagccacugugccuggccucuuuugcccagaugcuaauugaauuguuuguuauuucauuguugaguuuugagaauucuuuguauacucuaaauacuagcuguuuaucagauauguuauuugcaggcauuuuaucacacucuguagcuugcuuuuuaauauuuuuaaugggaucuuucauagagcaaauguuuucaaauuugaguaagucuaacuuaucaguuuucccuuuacuggaucaugcuuucauugucaagucuaggaaugcuuugucuacuccuagauucugaagauuuucuccaacuuuuuucugaugguuucauaguuuuauuuuuauuuacuuauucuuugagacagggucuugcucugccacccagauggguaggcagaucuuccccacuuuauccuuuuuuuguuuuagcuauucuaguucuuuucuguaaaaacuguagauuaaucuugucuauauuuacaaaaccuuuuaggauuuugauaggaauugcaucaaaccuguauaucaauuuggggcccuuuacacuuuucaaaccccuuauaguuugaucacauuuucucauuuaauuuacuucaauucaaugagagugucagcaggaccagucgcagacaaaaccucucggacaccgguuuuaggaaggggcuuuaaucagcugggagcaagaguuuggggcauuuguacucccaaugcaaaucugagcucuaaggguguaagaaggccagcagaacaauucuagaccaguguguuagcaaguuugagggaguauggugcaaccauccugaaaguguggggacauucagaggaagggaagguggugcuuuagccagucuggaagaaguccuccuugaaaaagcuuuucagggaagugugggauuuauauggacugggaggagaagcaugcauggaaucuacucagacuuguccuuagaaaugguugaacucuuugcuuucuacuccacccuuuauggaagcaccuuuaucacuacugucauuuaacuuguccuucucuacagcuuuuccagcuuggcuagauuuuguuuguuuauuuguuuguuugagaauuuuagugaaguuucucuuccaagcugugugucuuuaggcauccccagacaucuguucacuuaagggaaaugccauugcuguuaucccucuaaaugaaaauuguuuuuauccugcagugacucugauugucccuguggacucuugucucagguguagaguccagaaguuagucuagcuguuuaauuugucugucugugcuuuuccuaguaccuaaauuaaaaucacauguucgucauacaaaugcuuaugugcaaauugcucccaguguucuuccugccaguugugccugccaagaugauggcaggucuuuagaaucauuccaaaccuaaugcaucccaaagaaaaucauuaccugagguauugagauccaggugccagcccugccucucucucauucccauagcgugcucacauuguucuuuucugaugaaucauuuaagaacuaaucugugcugggcuguaaucuaaagaaaauuucuucugcucuuucuggccaaugcugccaaaugaaagacguucaguaagucacuguugaaugacugaaaugacugacugacaucugauaugaacacaaaauuaauuugggaucuuuuauggauauggggagauggcaacauuuucuguuagcucuggguuauugagccuuacaugaaacccuuuacggcugucugcucgucuucaagggcagguccucacugggacccuaggacacucaggguucacugcauauggcuggaucugugcacuuugauuccccuaguguuuucaauuucuaguaaaaucuuaacacagauugaguuuaggaauaucuucugacuugggguacuuagugcauccaguaaagaauacagcaucauuauggguguaggaggaaccccuagguuucaguuggcuuuuuuaagagacguagaacuuggucuccuaauuaugauacaucuagaauucuuguucaaaucaguauaaauuuagaauaugcaucaauggcaggacugaauccaaaauaaaaccaauuucgguauauauucucuguaaacuauuuccugcguguacagugaaacuacguaucuaguucuuucacuuccccacagaaauccugagcgacugcucccaccuuuaucggaaugcuuuauuccccacuaaagaucuaagacucacaacgaauacaguuucccaugguuaacacgguggcaaagcaagugauucagagccuauuaccugugcugagccugccuccuccuggcuucccccaaggauucaugcauaugguuccuugaugucuucuuguuucacaagucugaaugagugcuuuuauuuuuuaaagaaagaauauuuuaugcuggaaaagguuugccugaaagacaggguaaaaaauauauaucagggagauuuuuuauuauauugcauuuaauuguaaacuuaccauucuugccagaaagaagaauucauucugauuuucaacuugaacaaauaauguaaagucacuaaacuacuguuagcuuuuuuaucucaaaguaguuaaauggcuuuguugcucaugugggaauggaaauuagcucuuggcaugaacugcuuuaauugaaaucaguuugaaggcugaguuccuaugcugcuugacagaugacaucauuuccugugcuuuucccaauccucacuguuuuucuaagauaggaugaagcuaaguuuaacuucaaauuuaaagcaacuauacaccuuuucaugaccuacuuagaauauuauucaaaguuuucacuaaaucauuuuuuuucuuuguauacguauagacagauuuuuaguuaaaaaagcaucuuggcugagauguuuuaacggaaucauaagagccuaaaauaacugcaaucaguuuccgggguugcuugauuucauuacuccaacaaaggaguuauuucugcauucauacauggggaaacaaagauaaaaauauuuuuaauagcaaccuacuuaguagggcuguauaagugccucggacacaauggacaacuucuaagucucaguuuggucuuugggcauggcuuuugaugucaucaucaggcagcaugaguuaaguaaauaaaaauuaauuuagcacaguuuuauacagcacuuacauauaaagcaaggugcuacucuaggcacuuaagagguauugcauaauuaaugcucucccacuccccacucugaagaaguuuuuaaacaaaugagauggggcaaaauaaguaaaaauaggcuggauuauauaauauaugcuucaaaagagaaauaugaaguaauuggaaaggagagagggcucacauuugguuugggagauaucagaaaagauuagcggaaggaagcaauauuugaaauggguuuuggagauagauaggauuucagguuugggggagaacuguguguguguuguguugggguuuaggaguuaggggcaaggagacaaagaggcagguaagagagaggguucuacagagggacuaggacaaggaaagugccggguguuuugcauggcacauaguaggcacucagaaauguucauugagugaaugaaugacugauaaguagaucaggggauggagucauaggacauagugggcaugugccaaggagccucgaaagauaccuggggccaugcugaggggaccgugaauguggagagauggagguggcucuaguucaguagaaacaggccuuugaugguguuucaguguguggcauguuguugaaaaggcauuuaacuuucaacucaaccuaacuucuuugugcuguaaaaggaaggguauagaagauaguggguucugcacuuuccuucccuguuggcaggcugagauuuguguagcuccuuauaaaaauugucccuuucuccugaagucaaguagccacuuuucaauaccguggcugaggauuccuaacaagggguaauggacaggguggcuguugggaggaaucuucuauuugcucugaagagaagauuuggccccugugcuucaggaagagugagcauaaacagcagauuucugcuuuuguguagaaagaagauauucucuucuccuuagcuaaaauuaucgaaccuucuucucugagaauuuacuuccacaacuuggaggaccagacagaauaagccaaaccuccaaagcccaauccuggccuccauguguaggcagguaucaacaaggauuagugguuaauucaaucaagcuuuggacuaggaaauagccuaggauuuugaaagugcuauuagcauuccuaaauuacugaccuagagauagccugaacacuggagaaaugagagcacuugccugcgcuguugucauugcucacuaugagcccguggcugucuuuuacuccagcuucucugagugucucauugucuggggucuaaggcugucagcccauggucuuucuacccugggccccgaaaugaacacuucuguaggugaaaaugaggaucuuauuuaguuugagguuacaguuuaaacaagcagcucuuucucaggcaaauccagcugucccugucgucaggcaguguuguuauuaaaugucuuuguagguauuuucuuuuuucucuauucugccucuaaaauuucuuuuaacaaaauucuuuggaauuugcuacucuuaacuguuccccugugccaucuaccugggauucuaaaucuuuucacgggaaaauuauugccaucauaaucuugucucauaugguuacucaaggcaauacuuucuuguugguauaaauuacagaaaugacauugaguuguaauuucuguuaaauuaaagaagucauuuagcacuauuaaagugaaugccagagaaacaauugcauugcaugguaaaugauuuuuuuuucuuucuuucgcucgcucugucacucaggcuggaguacaguggugcgaucuccgcucacuacaaccucugcccccccagguucaagcgauucucuugccucagccuccggaguggcugggauuacaggcaugcgccauuacgccuggcuaauuuuuguauuuuuaguagggacgggguuccaccauguuggccaggcuggucucaaacuccugaccucaggugauccgccuaccuuggccucccaaaguguugggauuacaggcaugagccacugcgccuagccgguaaaugauuuuacacacacaaauaauauguuuagcauucucaauuaggucauuaucagguaaaaauagaugaauccugauaagcuauuugauuuucucuucaaauaacuacaaaucaacuccugugagcuguugcaaucuaugcauuuaaguugcaaaagugaauucuucuucuuuuuuuucaaguacaacacugcaauauucgcuguaugaauggagguagcugcagugacgaucacugucuaugccagaaaggauacauagggacucacuguggacaacguaaguacacuguaguuauaaguauucuagauguuaaccuguuuguagacaaguagaauaaagagauaagugcugauggauuuucuucgauuaccugggacacagcauguuuacaaguguccagugaccuuuacagaugaacaaaucacuuacucaaaaaacuuaacaccaaauuuccaauuggaaccuugauugguuacagguuguuugauucauuuuccucucauuuaccuucaccaccuugcuugccugaucuccuugauuucuagucaccaccaaaggagcagaauucuuguucauuccagacacauaccuuccacccacuugcugaacuucaacacuuggauuuucaggaagcaucucaaauaaaguauuucaaaacucagccucaucauucucucuaaacauguccuuuaucuugauuggugguaucugcaucccucucauuuccuaaucuagauucugcuaccgaaguacuuaucacaugguguucaguuugaagguucauuugcacacaccauuuauuguaucuacuuucuaccagucccugugcuuugcagaagacgaacauucuuuuuaaaaaccuuguuuuuuuuuuuuguuacuuuaagaugagcauauauacccuacagaaaauuuggaaaaguuuaaaaauacaaaaaguaaaauuauucgugauuucaucauuccagauaguaucuucuagacuuguaaugcauauuugguacaugaguucuuacuguauauauaguuuuuguaccacuuuuucacuuaauacuuuauucaaaguaugcucauuacacauuuuaaaauacauuuuaaugguugccuaguacucuauuaccuggauguuugacuguuuauuuaaugaauccucaauggugggcguuauucagggcguuucuaauuuuugcuuuuguguauauauuuauuaggauuaauaauguuauuauaaauaaacaaaaauguagagaaugcccuagugaccaucuguguuagucuguuuucaugcugcugauaaagacauacccaagacuggccaauuuauaaaagaaagagguuuauuggacuuacaguuccacauggcuggggaggcuucauaaucaugguggaaggcagggagcaacaagucacgucuuacauggauggcagcaggcagaaagagcuugugcaggaaaacucccccuuaugauaaccaucagaucuugugagacuuacuguuaugggaacagcaugggaaagagaccugcccccaugauucaauuacuucccaccucccacaacauaugagaauucaagaugagauuuggguggugacacagccaaacuguaucaccauccacacacugcagugggagaagaauauugguugaguuuuguguagcccagccuggagagaggagaggcagccuccgcagugugggugauccuugggcugagucuugagggauggguaggagcuuaccugucaggugauggggaauggaccuuuuugggcagaugguagagcaugaccaaagcaccagcacaagacacagcaagggaugugggacauagcaagugcuuugguguugcuagagcuuaaaugcagaggagagugaggggaaaggaaguaaggucagauaggaugucaugggccagguuuugaugccuuuauacauacuauguuuucuuccaaaguagggcuaggaaagaagagugagaccacaacaauaaacaacacuaacaacaucaauaaccuacaucuuuucaguuacucugugcuuacugugugcuaggcacauuuuagaacucuauguguguuaacucauuuaauaugacaacaacucuuuguauuagaggacauaaauguuacccucuggcagaugagggaacuggaacacagggaccucaguaguuccucuaaggguauauagaugguaaucggcagaguugggguuggaacccaagcagucugacuccauagcccauguguuuacucuugugaaauaccaaccuuauuacccuucacuuacgaagguuuacagugagaaagaucacaguguggaagcgcaacuggaggaggacaaaacaggagcaggaagacaaguccuaacuaaggcuauggcuguggagauggcgagauggggcuggaucccaaggcauuccaggagaaucaggaggggcugcugggcaucucuucugcuccccuuggugcucccugagggaguuuagcccaaugcccaacacacaagugcuuaauuaacacuggcagaauuagaaaacuuuuccuaaacuucagcuuccucaucuguaaucugggaggguuggcuuaggcaagcucaaaauuucuuuucuguuuagaagcucuucauucucccugacuauaaaucaagaggcaaagaagacaauuaauuuacauaaaccucucugguuauaugaugaguaauggccuccugccauaauuuuugguuaaaaaggguugugucaguucagguccucuuaugccaagaaaauaucaagacagaauuagacauaaaagagaauuuauuggggaaaagacccgugaagaauaaaggaaagaggaagcagaaguaggagggaauggucuucagaccaugaugccugucugauccugugcaaggagggagggaaggaaggacaauugcauagaaggaacuucagccuguagugcagcuccaaaaagccauagccagguugauggagaacccagggcaaaaagugcccaucaaagaguuccaugauggguggaaauagccaggcuuuaguauccuaaugcuguguuuagucauuggcugugagccugcccuugacaugaacauugcagcagaucugaagguacagcagcuggaaguggucugccagcuaaacuugcaggagauucucuugagggaaaguaugaguggcucaacuucauggcugcuauaggguaauguauggaaaaauguauagaaaauauauaaggagcaaggaauuugaauggagguuuugggggagccucauggagcaguaagauuucagcugggcuuugaagaguggguggaacugacauauuuggcagagaagagccugccacgcaugacgaagaugccuagaaagagcccaugcaugcacgaguuacaggaacuuguacaaagaggaguuguucagcacaugaacuuucaauucuuauuuuaaugucauuucuaacaagcaaaauauccugcccugaagcaucucuagauuuacugcaccaauaguuuccguaaguucuguuauaacucucaauuggauuuucauuaugguacuuaaauuacugaagaucauuaguaguauuuuguuguuugcaguuaauugugcaauugaacuugcuacauuucuguaauggugacaucagaggggcugauauuuccccucaugggagcccuguugcaauuaaacguaaaucauaagcaaaagagucuuugcuaacacacaguucccauucagugacaucucuuagaaaccacuguuuucgagguuaaacugaaagcauugcucagaugcuucacggaaugagaccaucagcauuaacauagauacaaacucaucuauuccaggcagcuuuaccuaagaguggacugaggaauaucugaguauguguaacuguagagugaccguccaaaacaaacaccagggugacuuuagacauuuuauuguuguccuuccagaggaccacaaguguuacuucauuagcauuuauuuucagguaaagcgucucagcucucuccuuauuuuacagcuguuugugaaaguggcugucucaauggaggaagguguguggccccaaaucgaugugcaugcacuuacggauuuacuggaccccagugugaaagagguaaugguuuuuaaaaucauuuacguaaagacaugcugguaccuaaagcuguuacuaauuugcacagacauugggucugcauggcuacuuccugaauguugcugagcuuugaggggauuucucauuugucauugggaaggucccuaggaugacaagacagcggcccugaaucuaugcaugauauucggcaauguuugucaguccaaguuuaccuaaauucaguuauuugcuaauuuggugguacucaguuaugaguguauacauaauuaccaguuggcaucaggauaaaaaggggagaacuuucuucuguaaggguaaggauuaagcucuuuauuaugccagugaauuaaguggucuugaacaaaacauauguauggaaagggagaauuucaguaugaaaagcacaccuaaagaucuguuggaccuguugggggcuguagagguguacaagcucagcauucaacacucaccauagauauauugagugucugcugagaagcuacuuuguguagaugguuuauucaguacucaucgcagccugcuagaguguguagaauuauccuuaauuuugcauaugagaagaugaaggcacaaagagguccagggauguccccaaggccacauacauaagaaaccuuuaauuugaauguguguuuugucucuucaagucuaauguuuacugcugcucuuaauuaaaagaaacauucuaccugauuugccuaccuaaaaauacaaguaugauauugagauauguguggauaugcaauauucuuaaguuuuuuucccugaacuuuggucuuacuaauaaucuugucucuacauuuauagauuuuuuucucaucaucccuaguuuuauaaugaaaguuuagaaguuuuauguuacacaaaacuguaauugaaaauuugcaugaacuuuuaaacugcaguaaucacuuuuagccaaaguuguauagacaucuuauucuaagauggaaaguaaagauucaguagcagauguugaauaugucauuuaaaacauguaauagaggaaaacaaagagcagagagugguuugugagaaauuauuuucugucuguguuuauaauuuaucuaaauucaguuauuugcuaauaaugcaguaauaccuauuugagcaagaaauuccaggucgauuacuuugauuacuagguaaauuacauuguaucucuauuaaugggaccacugcaugguauugauguguaaugcauaauagaccuuuacauugcauguugauauccuuuaggagucccuccuuaaacugcuucucuuuacaacuugcacagauguguuuuuauucgcuaauaauuauaaugguccagaguacuaaaaacuauuucuucuaggcaauaucauucuguggccuuauuacuuaaucagggaaguuguaggagauuaaaauuguuaauguguagcuugaggaguggugugugaaaauaauuucucagaugauaaugcugggcauaauuuguuuuagaaaaaucacuaauaagaugaaguuacagggcauuuuaccuguaacauuuuaccuguaaccauuuuaacaaagugguuaaagauuugcugcaaagacuauugaugcucauaguugauauugaugauaacacagucuaaaauaaagggcaugauauugaaccauuccacagugauuucuucaaagauuugaucuuuguccaagauuaagaaauguccugaauggguuaaauuacuaagcuacuaaucaaaacuggcauguuacucagagguuucuccaaguuugggggugucuucaacugcuccccuucaggaaaaagggcuauccugaaaucugcacuaagguguaaauaucuguugacuccauagaauuuucccaguggugauuuucaaaaucaaauucauccccaaguggcagauuuucaggcauuugugguaguggagacuggagagcagaaggcaggcuugcccguuaguagcagaaggguagugccaucuacccacugccuguuuuacccacggguacagucccagaccuucaaugggagaagaaaaacaugggugucauuucccacaccacaugggagagaggagucuuuuugauuccagaauucuauuuccauuuguagagucuucacuguuugcugcucuuaugaaagucaccugcuuaccucuuugaagaauuagaggcaguagauucucuuacuuagauguauguucgugauuucaagagugaugaauaaaaaucugauaccgagucaggacagauccauccugaaguguggggaaguauucagggugacuuccgaugguggguugguauacuuauuguggugcuuauuacuggauaaguaccuagguugguuguauucuguuuuaacugggaugugauguuuauuuuuuaaagugcagauccgggaggccuuuacuacuuuccuuucucccuucaucuacauuuucccuuaguacucucuccacaucucuuuuuauagcauuuacugcauugcaucaaaacagcaaguuuccaaucucccucacuagagcauaaguuuucaggagcaacuauaguuucuucaucuucuuaauucuagccuuacugugugaugcacaguacacgacccauagaugaugaacuggauucauuuaauagcaucaaaaaaucuggagauauaaugaucggauaugaacaaguaucuccuggaaauaauugcuguuugccaacaguccuggauauugauuucauugguuucaugcuaaacagagcugauuacaauguugauaucuaauugaauuuggucccaucuuucagaagaaugaucuuucagguccacaagacugucauuuuucaguuaacagggaugcaaaaaggaggaauguuuugaucaaaacuaaguggcaauaaaaacaaaagcaaaaaccucuuaucaugauauaauacacauguaagggaacauuuagaaugucaguuacaaguacuucucaggauaaagaucuaugucccugggagaccuuggaacuuuuauacauuaauaacuaccucagagacccacuaugagugugaaauacgccuuugggggucauacuggcaggauuuguaucacauuaagccaauaagucaaucuuaaucauccaugaacauaguauuuugguuuugugauggagagaagcagcagaucucaugcuugaauuaugaaucauaauagucauauaacaguguaauaagauuauaaagcaauuagucuuacuugcagcuuuuugucauuaagauaaguuuguuuaaaaacauucuuggcuggccagccucauccccagugggcagguagcaaugauauauuuuaccauugccacuaccauuguuucucuacacccagaggauaaaaaauagagaccuguggcuuauuuggccugugaugucuacuuuuuaaaagcugaauaggaauaccuuuaaauacaucuucuaguuugucauaguccccaccacuaccuauugucacaucuugcucaaguucauucauuuagcuuagguauuagcccuugugagcauucaaguuugccaccuccugcugcuuucucugucaaagauugugucuuuauuuuuuuuaaccacaaguuucuuuaauuuuucuuccugucacuuuuuuuugguaaguucacauuugugguuuucuuguugccuccuacuccgacccuuugccuucucuuugcuugggccuugagcaacuaguagaacuuaaucacuucuuagcucagugguacaguauguuagcauuuguuaucagauuauugaagugaggucagugccuguuuuggcaaugacaauacaagcuagucguauauugccauaguuacugcuaacaaaaaaacuguguggaaucccuuucucuugccaucuugccucagaaugcacauuuaaaaucuuguuaaaugccuuuguauuaaacacagugaaucauaugaguggaugagacuuuucagggucaugucaaaagagaaaagaaugauggagauagaccugaacuuggagauggggguggggugugaugaugaauaggcuuagggaagaagagaaacaaagagauacagcaagagaaccaggagagcauugaaccaaacaaacaaaaaggaguucaagaaauaacuuggcaauuguuagacucaucgaaggucugagaaugagaaucauaaagcggccauuggacguaagaacagcugacauguacugaguacuugcagugugccagggggugugcuaagcacuucacuuugaugauuugcaacaaccuuaugagaaaaguccuguaauaagucccaucuuauggaggaauaagcagaggcaaagagagaucaagugccuuguccaagaagggacagcuuauaagugguaaaauagaggccugaaccuagacauucuggcuccuaagccugugcacauagccacuguguaguacuuggacuucacuggaaaggggccacucguaacucuaaagaccucacuggaaaggggccacucauaacucuaaagaccucacuggaaaggggccacucguaacucugaagaccucacuggaaaggggccacucauaacucuaaagacuuuucugaggaacgguaagaagaaaccuagaacuaugaaucuuagaauggaagucaagaugaaaaggcaaaagaaaggauucuugcauauucuuggauguuucaaauguaggguuuuggaauauuccucuauuugauugauuucaacguacgaaucugcucuuggaaagagagagauuccuguguguuuacaggacauauaaaugugcuccaaaggacugaacuaacaugccuggaaguagacauauggaaugaauauugucauuuagugcaguuaucauggaaaguuauaucauuuucuuguaauauuacaacagcucaaaauguguuuggaacucuuuuuuggaggugccuuuacagaaucagcaauacauucaaaucagugugugauuuuuuuuuuucccuuuugaggaggcauuugaguuuucagaaacagccuacaguaauuuacuguuaauucuagugacuacaguggguaaucacacauuuuagcuguuugggaucaaaagcagacuuagauuuaaaaaauacuaaaaauaauuuucucaugugguucauaaagcacauggaauugguuuaauguuuuaaugucaaacuuuaugugagccagaggaugaagccuuuuggaagcauaaaugcaaauagcaagaaguuuucucucauuucuccaucugaagcugcucaucauguauccucagaauauuagcaugcacguggacucuucuaaauccuggugcauuuguucuguguuaaauuccuacccaagucuaaacugugaagacaauacuuggauuucugccaacuuaagaaagucuguuggcuguuaugcuggcuaucaguagauaaaguauaggggaaagcauuguugaacugauagccuuaaggaaaaggaacaauuggggccaaaguggaguagaauaaaaaugagaggauugaaauaauccuuaguucauuagagaagcagaacaguugaaagugaacuagcucuucaugcagguacuugcuuccuaggaaauuacagucuuaaugaagcugaaaagguuuuuguauuuguuagcacaacaaugaaacagaauagaacaaacaacagcuagguugauuguaauuccaccuccuucuuauaugugcaguugacguuugagaaacuuguccucacaccuuguuucucugaugauguaaaaaugauuuugcacagauaucuuucuaaugauuuuauugaaugacuuucaaaaauacuacauuaagcaguugauaaacacauauuauauaaauccaaaaaggcagcaucuauacugugucuagugaauggaaaggacuaacauguaauuauccaaauauauaauaaucagauaguccauuuuggaaacaccugcuucgaaaaagaaaguaaaaacuuuaccuuaucucaagaccuguuuagagagcuucauggaaucaggagcugauuuuccugugcuuuuuuucuccugguguuuuucaggaagguauuaauaaaauacagauucauuauuauuuuuucucuauguagaaguaaguuuuacagagcugcauuucugacacgaauuuuacauaauuuuaaauuguagguggcuaucacuaaaguucccaagguaaugccacaggcuaacucccauucuccaugugccuuuggaaggcagagcucugugaacuauguauauuuucuucuuuccaaaagcaaaaggcaguaaacugucauuacuaaacuacacugaaggccucuaugaaccucucuuuugguauuuaguuucaauggaaaguaacaauguggcagggcgugguggcucacgccuguaaucccagcacuuugggaggccggggcaggcgaaucacgaggucaggagaucgagaccauccuggcucuacugugaaacccugucucuacuacaaauagaaaaacaaaauuagccgggcgugguggugggcaccuauagucccaguuacucgggaggcugaagcgggagaauggcgugaacccaggagguggagcuugcagugagccgagaucacgccacugcacuccagccugggcgacagagcgagacgccaucucaaaaaaaaaaaaaaaaaaaaaagaaaguaacaauguguagauagcaggggcacaaugcccuaaauguuacugugcgucuacagugguauugcaacauuuguggcagcugguggaucacugaauaaacuagauuuuccuagaauaguuccaggaauugcaucuuuugacacacacacucguuuuuuuguggcuggguaacuguauacacugagggcacacaugcuccucugucucgcaggcugcacauaugugguaugaacaagcaguggggaugggaugcaaccagaaagaagcuugauuuuugucucccacucacugucccucucggcccacuuuguaggcuacuucuucuccugcugguagaugaaaucaucuggucuguuuuggacuuucuccccuauaguuccuuuaaugggggcagaggcaucuguguucugacuguugcugacauuuucuuccucagucgcugggcauccagugguacuuccagccucuugaguucucuuugcugcuccaaggagccaucugggaaaggagcuaggcucaguccacaucagcuuucuuuuuggcggccccuagcuuguuggcagaaaacauucaugcauuuuuucugccacgauaaauugcuggagugcaaacuauugacacguuagcaaaugcucauuggaaccauuguccaagcaucuggccagacaguuuccaggcauuugacagucccuaguccacaguguccuccagacuucuggggauagguaucaugcaaucugaggagucucccugaagccucucucaugacuuggcaucauaauguggcccuucaccaguuucccaggaagggcuaguaacagcccagcucucuccagaguaacccgcuucccaucacuugcuacuuuggacauuugaauacucuugauaugcauaaagguuuaagaggucaucaucacccacuuugcaaauuaugcaucaaaauaucacacuugacuuagaauguggcaucuguucccuuggugguucaauugaaauuuugauucuaacauucucuuguguuaucaaagcuaaucauuuaguacaacuguuaaauuuagugucaugguuucaucuucaaaaacaguuuuuuuaacuucauuuuuuuuuagcucuuaugaacuuauuaaaaagauaaaacuaauuuuuauaugucguuagccccacauuuaauauuugaaccacuuuucgaucuuagauguucaaacaguagaacaguacugaacaauagaaauauaaugugagccacauauauaauuuuaacuuuucuuguagccacaugaaaaaguaaaaggaaacaggugaaauuaauuuuaauaauauauuuuauuuaacccaauauaucugaaaguuuuaugucaauagauacucaguauuaaaaauuaucuaugagauauauuguauucucuuuuccauucuaagucguugaaauccaaugcauauauuauaccacaucucaguuuggaccagcuaauauccacauguggcuaucaucuuggacagcacaacucuagaacuuccaguaauacauauccaaacuuuacccaaaguaucuacuagauuuccaguuuucuuucuuuuccuuccuucugcugcuucuccagcucuucagaaagcagcaucuuagaaaaucaaagagaggcugcauugauauuugaaaaguaaaccauuaaaaaaaagaacuggggccucagagcugagccuaauuucucagguucucugucuuaguagaaguuugaucaaauauaagugauaaagcucaaucucauguuauaucaugucaauuagauauaacaacuacagcauauauuuaauaaagccuuggcacuaagcuaggcaugaugauagaaucaugagaggaguguauggcucuugucaugagggccuuaaaauaauuuuuggaaagacagacaugcauacuauauuggaaacaguuaaguaaccaagcagggccaggauuuagcuaggcagaggagauaaaggaaaguacuacagguaaagggaagaguuaguacagauuuagaggcuuguauugaccuggggaaaagggaggacccugcugugucagcuuucaugguacuggagcccuucugugggagaagaggcaaaggcacaacgucaacucacauaacuccaaagaagggagggccuauugcaagcuucuccacgaugcccuuccauucuauugaacugugcuucuguacaauuucugucugaagcaggauauugggauuaaaaaaugccccuuuguauguauaaauuagugggaagacuggucuauuucugaaacuguuuucacuuucuuauagacggcauucaggaaauccuuaccaauuuuauaugcccaacugagaguacuucagaacacuuaauguuuauguucccaguaguuauggucucuagagagucuaugcuguuuuugguuuaugaacauauguuggacaaauacauggggcuucauggucccgacgaugugccaaaguacuuuuuguagaacaucagucccaugagggguuccaugaaauuaaguugccauggauauaauaucauuuuuggaaacuccaucccaugucuucuuggggaggcaucggguuuguuagcucuugggaguccugcaggaaggaaacuguuuuuacuuaguuuaacucacaucuccaagcccaugaauuuuagaauuucuucuuuccaauuuguuuucccuuaacaccuuuaaugucuucaucuuggagaucuggauucuuauuauuuugacagucauuuugaaagucacuugacaucugcaugacaacauuuucauauucuagauagauguuuugaauccauguaugauccucauuuuaaagauaaauauuugccuaaaugucuagagguuuuuggaggaagaucuucauuauuuaaucauucaccuuuuggguuccuaagaggauucauuugaccauaaauuuaaacacagcaugagacacucauccuuugggguuugguucucaaauacuuuaaagaaucauauaggagagcuggacuaucccauuaaauaccgauaacuuccuaguuuuuaauggcuugauguggucagugugcaugccauccugguucugguucuuaucagccacuggggguacuacuucuagaacuaggaguaugagauauucuuagagcuagagcucccuuuucuauacugguuagauccuuuucuuucaaggucaaguuuaagucucauucucuccccagucacuuccugacuguaggaggccagcccccaaacccccaccccaaccagccccaucaguuucuaugcaacuuugcugacauggccaccucuggccucccggaccccacccacauuucaguugcucagugaaucuauuaaauuuuugguuuuugccauucacuuuaaggauuacaucagacauuuuagcauuuuuauuccuccaaugaauucuuguuuuucuugcauuuuauuacauuuuaaacugauuaacugacccagugcuugucucuggggauauguacucaugauuuuuaaauauuuacuaagagguaaagaaugagcauauucaccuugucaaaaaacuuuuuuuccaugugcauuuauugauuuuuguguugaaauacuucuaucagcauaaaaccaucuagaauucuguuucauggcuucaggaagccuuaucagcaaauugcaauauuuaaguuuccuuaaaaauauuuucuuuacuaagugaaacauaaaucaucuauuaauuuuaaaauaugaaauaauuauauagguauuauuucaguauuuucuuuaaaaagucaauuugguuuaugagucccaucaucugggaauuacacaauuggcuaaucugcuuuugggacuacuaaaauagagguuuauguauagucuuucagucagacuaugguacuccccauaggucaaagacuagaaauuagaucugauacuucuuccuauuucacuaccaagcuuagagcugugaagagaguagguaucuauuaaauauuuguugauuuacauaauuuaacugugggcucuugaagucgaugagagggaguguuuaaauguuaaauacaucuguuuaauccaacauucuaagaaaagacauucuggacaacaauauuuauaaaucuauguguauguuauauggaaauauuaguguaguuauuuauaacugaaauauuguaggaagugaacgcaugaaaaaaaauguucuccaacuuuccugccauauucccucggugauaaucuuuugucucugaacuguuugagaagagcuuuauaaguaaacaauagauugggauauuuguuuucucaggaaauaaagaauguucuaaugguugaguuuauaagauagauccauuucuaucucuguccuuagagagcccuuaucuuguugccugcccucuccuaggaggcauuguugaccuuuaccauuguaggcacugaaccacgcugaaagagaagccuuacaggauggaggcaacuuuuauccaaauugaaaauguuuuuauaaacauacauuagcucuucaugaaccauuuguuuccugaagucccaauggaaaugaucauauucuguuagggauuccaaugauauauucuuuaaacuaagacucgugaacguuaaaaggcaaaagcgaagccagaaguaaauuuugacucauucuuuauauaaucauuugaaaacuucacuugaaaacuggagaaaauuuuggaacuuucuuguucuacuauggagaagauaaaagcagaagcauccacaguaucuuaaugauauaaaacuggcuuuggaaagaaguauguaauagaauucagauuguccuuggaggaaaacaacccuaaaucaccaucgaaaauucuuuauuuauuuauuuuuucagacggcauaauuuggagugggauugggcuauuucuuuucagaccuuauuuaggccucauuucuuucuacaguguucuccacauugccaagcagaauaagcuaucacaaaacuaaacaaaaggcagugccuagaaggcaucccaucccuugacggagccaacugggaguguacccaggacuuuccuguucucauggcuccugggguuguuauucuuuacuuuuuaugaaugagacaaaaugauagugaaauuauuuucagaacuaaaucauaucucaaaggagucuucauuccaacuugucaguaucacaugacaaucauuuuaauguuuucauuuaaaauaucuaauuaggaggaguuguguuuuucuaauugccuagccauuccuagaaaacugaucacgaacucacgcucugaggauaaaucuugcuacuugcuggauugguggccuugagcaaguuacugcaugucucucaggcacaguuuccuaaucuauacaaugaggguaauuauaguauuuaucuaguaagauugucaggaagauuaagugagaucauccacaaaguacuuagcacaggaucuggcacauaauacauguauaagaaauguuaacuauuuuaaauucacaugaaaaugaggguaaucuugguugacaaguaucauuucauuaacaguaucaugaaauguucacauaucccugaaauuacaccuaaacuuaaaggccucauuuugaccauuuuuuccacuuagaaguuuuguuauuuuacuugaacagcguauuuuuuggauccccuauucagaugaaacccaacauucuugagcuggauauagaaaggucaacaucaagaaagaagcacaucaaccgugugcuuuucuuuaguacacauucaacuguugcaguuguaaugaaggcuaaaacuacaauagugcaaauaguaauaaagaaagagaaaaugaagggguaaggggaaaacuauuuccauaaaauguaauggugacugugucugggaagcauuuguucucccaauagcuaaccaaaaauuccugaaagauuugcuuacuuuuacugacauacagguacagaagggaaaaugaacuugucuauucagaaaaggccaauaacgaaauauaagagguacuuagcuauuuuagaaaugcggcauucuaaaaucaaugagagguaauagacacuuacccaucaguaaaauaaacugaacaucucuguaaaguauacaguuuccagguggcuguaagaccuuaagucuacaaauacggccuggucagguuggaugggagugggggaugcuuuuacucauggaaccaugugccauucuucuuuuguugcaaaggacuaaaaguguuagucccagaggacuaaaguuagaaaaaucaaaacauuugguuauuuuaaacccacaaauuucaagcugcccuuguuaguguucaguuuuguuaagucuauccauaaaaaggugugauguuaugcugaaaagaaauuguucuaagacgaagagaggaggugugaguuuaucuaucaugcaugaguauuucucaggcacuaugcuaaugacuggagauguauaauaaugaaugaaacacacgcaucccgccuucuggagucacauuccuguggagagauggaagcagugcuuagaagggcauguguaggaaggcuggccacacauugagaggugugcaguggugcugugacucccacgcugggaauaggagcucuguacauuuuucuauagcacauuagaaguuugauggcuccggcugaccaugagacucuucccagaggagccucuggaauaccaacuuuguuaagaugagagagcucuucuuauagguuuccaaugcccuucaaagucagagggaucuugagucuuuugcugcuuagauugcuuuuccucuaauccuugugcucccacagggacucugaucccuagcuuucccccagaaacguuaaugaacuggaacucaaguguccaaaaaaaugcaaguacaccacaaaaaugguuuguuuaggcgucaaacauuuugagauaaugcauacuuuugaauggaugccugcagucuugucccuggggaacgccuuuggaugucaugcaauccuggcuucaguaaaucauuugcuguuuggacaagucguggccaccacgucagucacuagauacauuuguaaugguuuacgugaacaauaacaacaaccaccuagcaacacacuguuuggucaugucauuuuuuucuaauaccacaugugguuuugugggcuuuagaagaauaaauucuuacugcaucuaaaaggucuugaaaauuaaacagcaaauauuguuggaggccuacugugcacaauaggugaaaucacacugcauguuguaagaaugaaacaugggucuuugcuaguuuauuaguaauuuuauacuccacacgggagagacuauuucuguucuguucaacauuuuaggucuaaugccugacacgcaguagcccagcaaguauuuguugacuggaaaaaugaacaaaugaguaguuuucaggcauaguuuauuucuugaauuuccuguaauucaaaaaagaaaugacugaucuaccaucuguacuuuuuagccgauaguuuuuucccucgacuuuuuaaaaccaugaacacaacagugucagguagagccaaguguauucugugaaguguuaauaccucagagaugccacauuuaugucaucccuuccauuuaugcagcacuuaugaacauauaccaccuuagucaguccuuggggcaacccuucauauuuuauagcaaagagugagauugaaggggaaccucugugacucggaauucuaaggcaggugucuaggaaugagacuuaugucuucucagucagcccagacuauggggcaucuauauucuccaacauguauuugcuugcuuuuagagcucacuguggucgcuagcauuaccuuuuguuauuauuaacuaucuuuuaauuuuagcucuaucuuuguucuuuccucucauuuuucacaccuuuuugauuuucagucagacugcugacacuuugcuauuucuguucucugugucucuuagacacuauguccauuuuuaaaauuucaaauuugagggaacuaggcaauauuuagaauuaauuuugucaaggagagcuugucuuuaauuguaaguggauauuauguggugaaaacacuuggcuuagcugaaauugagcugugcauagaaucagaagacaaucugguccugaaggagucugagaacacacaggcauggauaauccggaugugugaaugaaugaacugcugcugugucacgcugcccgggacauccuucuguuggaauuucugugaaaguagaccaggcauauugcauauuggaguguguauuccaggaagaguugagaauugguuuucuuuuaugaccucuuuguuuucuugcugcacguaucaggagauuugcaguuucugucauauaaaaacuacuggaaauuuagaauuaucuccucugagagcaugagccccuugagaacagggaguuuugacugucuaauuacaguggcuagaaaaugucuaacacagaguagauggucaauacauauuuguugaauuaaagaauggaucuggcauauauacagcugaucacuuuuugcaauaggacauggguugaugguguagugcaugauuuguuggugcauugcugugaugauguucugagcucacccagccucaguuacucaaugacagcaaguucaagucaugucagaguugguguuuggcucuugucugccccacuauacaagugcaugcaguuuuagucucuguuuugguggguaguuuccuaccccucuggcucgcuauacuugauuaugaaauuauaauuggcuuucguuuaucucuuuaggauagaauaguaacuguagcuaaucuguggcugaaaauagggagauaagaaugaaaauaauuaaaauggaucacucuggguagccugaagugacauggauuaauguacuaucaguuuuuucccccugagaaacauuuggucacaaggaaguuuggcuuucagaagaaauucagauuuggguguguggcuuuuggcauagucuagcaucacuggaauggccuaaaguagauguuucuuuuuuucccaugccuuccugugggugcucagaacaacccggucuuuugacuguaggguuaucugccauucguagacugagcauuaucuugccaagucauauggagaagccaguuaccgagugcacuuggagcagaagauaauacuuggcugaagcauccuagaaagccuaaaaagcuuaugucagagggauauaacguagaguuucuaaggagagguggagaaagagacugauugaucgauugcuugaucuccaaagggcaggggcucuaccacguguuucauagugcuaggaaauggcaaacuuuaaaaagguguucuucaguugccccaagaaauacaaaugucacgcuugucugacugucagggaugaaugguccuagugcaugcaugaugacuguauauucuucuuugauagcgccaugguguggguagguaugaggaucuguuggcuuagaagcaauuggaaaaacuggacaaggaaggaaaagaaaaugaaacuaagaggcuggauugagaaauaccaagaaggguggaaauuucaagcuuuuuuuaacuucaguaacuguaagagagaaagaaagagaaugaaacagaaaugucugacugugucccuucaauuucaaaacauauuuuguagcucuccacugacucugguuuauucauuauuuauuuaauagacuccuuuguuaacuucaggaaguuaauacuaguggcaauucuuuuagucguauuggguugcuaaaaagcuguggacccuaccacauaccacaguuuagauuaauugaaucuaagugugcaugaguuugauuaaauagggauuuauuauuaagagcccuucuuaggacauaugagcuuggaagagccugauuuauaacuuaguagcuuuuucacuuugugaagggaugggacauaaaguguucuuuuccagagugauguggacugagauaagauuuauagauuagugaaagaaguccacgucucagucaaaagauuuccagaaauguucuccucauuauucuucagagaccugagcuauuccagauguccauagguuucagaaagguagcuucuggggaguugagacuuucuaaaagaugaaaaugucaaccuucuuccuucccugcuuuuuugagaugguaguagagcuauauauucaacuguauguagaugaaauuguaauauaagaagaaaaauaauggccauuauuaaaauucagcaguaggccaaacaggaauuauauaacuguuuugcuucauagauagaauuguuccuaaauucagcugauauggaauuuuuaagaauuuauuuuuuggggggucaagaaauguucuguuguaagcaugcaaggaaaaacuucuuauucucugcucuaauugcuacauccagauauuuguuaugacauacaagcaagauucagugcucguggugaaaucucugugccucaaauugcauuugcccugccugcccuccuuucaaagcugugcuuaccacuuugguauaaggucacugaaagugucugcgagcuuuaacaaguuggagaugcauuucuuuuuuuuuuuuuuuccccuuuuuuauuuuuauuuuuauuauuauacuuuaaguuuuaggguacaugugcacauugugcagguuaguuacauacguauacaugugccaugcuggugugcugcacccacuaacucgucaucuagcauuagguauaucucccaaugcuaucccuccccccuccccccaccccacaacaguccccagagugugauguuccccuuccuguguccaugugaucucauuguucaauucccaccuaugagugagaauaugcgguguuugguuuuuuguucuugcgauaguuuacugagaaugaugguuuccaauuucauccaugucccuacaaaggacaugaaugcaucauuuuuuauggcugcauaguauuccaugguguauaugugccacauuuucuuaauucagucuaucauuguuggacauuugccauuguggaagucaauguggcgauuccucagggaucuagaacuagaaguaccauuugacccagccaucccauuacuggguauauacccaaaagacuuggagaugcauuucuacagcugacauuuuucacuuaaaaauaaauuauaggaugcgcuuuggagagcacacgccuaggaguggaacauuaacaaaggauacgucaaaccacagacacuucuaguggauccaguucacaguauugccacacagccugaaaaaauaacauuaguaccagcaaaacuaucaucccuaacauucagucauuaucccuguggacaggcuugggaacagccauguggauguagcugcuuugugcuucuucccaugcagauuugauuuuucuuuccacuuucucccuuuuaaugaaugaacuaaaaaugaauuugaacuacuugccaaccuuagaagguuugauuuuaaaauauauuuucuucucaaauacacgaaccaguagcaucacuuucaauucccuacucccauucucuguccaaaaauacauaugccaaucuucaauuuuuuuuuuguagauugcauguaaacgaugguugguuuguauaaagauaaauauuacuuuaguaacaagcacauaguaacagcuuaauuucuuuuugaauuguuaggcugcacaaaucaaucauguggugccagcugaagacugcuuuuacaacaagacauauguuacaaauauauuaaucuuagcggcauauggcaccugagaccuuguaggaaggcguugcaaaaaggacgaucaugcccuauuagcuggcucacuuccuaacuuacauuaauucgugcauuauggaacgucaccaacacaugaaacaaaaaguagaaauggcacugcugaguaaucacaagccauugacuaaagaaacuucagggaaggcggggcaaugagcauucuuugaaccacuuaauucaagaaauaacaggcuuuguuuauuuaagaggccagucugucuguuuucugauugcauucuuauugugaaaaugccagagcauauuacaauggauaaaaugagaggaaaaaaagggcgauuuaaguaggccaggaaagaguggugguagauguuugaaugcccccccuuggaauuaaucagugguuuauaaaccugaaauacuuuuuaauuuugagaacugaguuucugacucaaauuauacaagagaaaauguuacuuggcuugagaaaggaaaaacuuugguucauguaaauauguacccucaugccuuuaucaugggggaauuguaauuagggauucagaaucuugagaacacuauugugaccuaguuauuucuguacagcaagugcucacaggagguacuggcuagaccugaaaauaaugaauuaagagauuccagcugggaugugaugaaagcauuuuugggaaucucuguaucuuggcuggaccacauggguuauaacuuggagagaccuaaacgaguaguaguauaugacagauuuauaguccaauugauguugggcaucagaaaaaaaggcugagguuaaaaaaaaugaccugagaauuaugaguucuaaaagaauugcuauuggaagggaugcuaaugcaggaaagcaugaauuccuuauaugagggcaauaaaaauaauaaaauuuggugcugaggcauugaaugggaaacacaguagcuuauuuuucacagagaccccuccuccaagaucccuuaucuaccuucucugcuguacaguucuccacaacacauccuccaucuaacauauaguauauuuucugucugaccuaguucuuccaugacauuauuaaacuccaugagggcagacauuuuguuugccacugcucccaccaucccccacacuuuguuguauccuuagcuacaagaguggugugugacacuuaguaggcucuugauaaaaauuguugaaugaaugaaugaaugaacgagugcaucaauggugucauuuuuaagccagaaauucauuuuagucccucucuucccugcaucuaucucucccucccucccaccuucccuucauuccuccagcaggcacuggaugugcuaaggcacaaagaccaauaaaacaagguuccugcccuccagcuuauggucuguugggaucaacccauggguaaaugaaggaguccaguacagagugauaaugcuauauuagacaugugcacaaagggagaucagaguagagggggaaaaaaacauuuaaucaggcugagaggucaaggacaauuuuuuuccagagaauuaaggauuggaaaauuaaggauuuguagagccuaaaagaauauguaagaguugaugaaaaaugaaaugacuugcaagaaaggauacgaccuggaagaagaagacaacguugucagggaaacggcagguaguucaccaugaagggagggagaugaugggagcagauggaguuuggagguaaguuaaauggagagucauuucaaaaucauugguuuuccaagguguuuuguuguguucauugagagucaacaauacugagacuucauaauacuucagacaaguaggugagaccacuccaugugaguuuugguccucuugcucuucuguuucccaguuuacuaugugccccuucccagcuugauaugucaggcuaagaaguaaguggacuuucuguuucuauucuuuuacuuaggauaaugcuuuccaguucuaaccaugaugcugcaaaaaacaugauuuuauucuuuuuuauggcagaguaguauuccaugguguguguguguguguguguguguguguguguguguguguguaucucacauuuucuuuauccagcccuccauugaugaauccuuauguugauucuauaucuuugcuuugggaauagugcugugauaaaaauaugaguacaggcgucuuuuuaauauaaugauuucucuuccuuuggguagauauuguuggauuaguucuuugagaaauguccauacuguuuuccgcagagguuggacagagccaaauauuacauguuuucacuuauaagugugagcuaaacaguggguacacuuggacagagagaguggaaugauggacauuggagacuaccaaaggugagaagguaggaggagggugaaaguugaaaaauuaccuauuggguacaaugcucacaauucagauaauggguacaguaaaagccagaguuugccauuaugcaauaugugcauguaagaaaccugcgcuuguacccccuaaauacauacauacauacauacauacauacauacauacauacauacauauguaaauacauaaagaauugagcggagcucuaaagcugguuuaccauuuccuugccagagcauuauuuggaguguggagacuuuaacauuuaauacgaguugcaagacucuaaaguccaugcuagagcaauugcucuuucauccucauuuuguuaucugugauugugggcaggggccaucucugaaagaauacuccugucuuucaugguauuuacuugaguuuauacuucgugucacacgugaacuauuucccgucucuaaucugcaaauguucccuucuggaacccguuuuuauguuuaaccuauaggaaugccuaacuguugaguaaaauggugcuuuuguguuauuuucaucuaacauaaccucagaauuuuaguagauuuuaguauuaauaucuuuauaugugaugcagucaucaucaauauuuguucuuuuaaauuaacauucaaaauuaaaugaacaaaacaacagugauauucauaaaauuggaugcuauuuugugucaggcuugaguuuccaaauggaagccuccugauuguccugaucugaugucacauggaagccacugcauacucuugaucuuuucuauguuucuaaucauuuuauuaacauuucuuggaaucuuuucuagcuuauugcauuuauauuggcugguuuuauagugauaagaagauugagagcuguuuaggauauagauguuaucuguacguggugccuguacaaaguaggugcuuaauauguuuuuuuuuuuuugaaugggcaaguaagaguuauauuuuuaaaacaugcauuggaucauuaaccacuuccuacugccuuuaggaaaaaguccagacuccuuugccagagccaccaggccauuuacaaccuggaagcagcagaccuuuucagccuuaucucuugcugucacaaacaacaauccacaaucuacaguauauguuugcagugccaugcuucauccaugcugcuccuuccauuugacauucuuacugauuugucagaugagaaagcuuccauuagccauucacagaagaaucacuucucuauuuccaaaacauuguuuguacuuccaggauaaucacacugguucauuucacugucuauacuuaucuccccaucuagguuguacacucaagacagaggcucugucuuacuuacauuuguaucuuuagggucuaauauuguaccacugaccauugcaaggacucaggaaugugcucugaauuaauuaacaagguaauuaggccagugccacagccugaguaucacacagcuucauggucucugcuccacaccaugagaacaggacccgugcggucgggacaaggcuaaagaggccuaacccucagccagggcucugcaaggcugcaccaaggcuggguuuaaucugggaccccucauucauccacagucaguagaggagugaccaucacuggcuucuaaaaauccauggcguccuggccugucugcacagccuacccucaucagagaagaguucuuugaugguacugcccagggucucuugauagcagagguuuuccugggggagcaggcucagucaaagccucagucugguucugaugguuccuuuaauuguuugccaagaaucugguuaaagggaacaugacagacuucaagggacugaugagaauccaagaucuccuugcuggccacaaaucauuaauugagagcuaugccuuaggaggguaauauauauuuucuuucuuaugaccaugauuuuacaugugcugaagcuuauuuagucuuuaacucuccauucacuuagccuuguaagaccuguuuuggaauaaucuuaauuauuauuguuauuuuaaaauuuagccauuguccuuuuuuauuuuuauaacacuauaagccauauuguuuaauuuacaauuuauuauauucuguugugauaugagaucauagugaugguuaguacaacaaugugauagcuaucacuuuaugcaccauuuuaagauuaaugggcaucaugauaugaguuauagauaugaaguuccaauguauaauuugagcuguguuguguauucugggccauaaucaucacauaacucagcauauguauauauaaauauauggaaaaacacaaacuugcaaaaacaauuugagacaaucccaaaagauagaucucaaagaaagauuucuuucuuaguugaaacgcuuucuuagccuccuguuuucggauaaugcucaaacuccuuaguggaccagacaaagccucccaugagcuggucuuucccaccucgcuggcucauccccagcaggugcccuucauuuaucugcagaaccaugcccacauccucccauuguucccccuuuucacacuuaacagauguucgcaacuagucuacuugucucuguuuggagcccuucgccucuuguuuuuuaaaaaaauuuaaaugcaaaacagugcagugacuaauaagacaaccauauuuaaacugucuaccugguauuaacaaaugucaacauuucaugaauuuuaaaugaacgaaccagagcaucucagauaaagcuuaugucccucuuuuucucccuaguuccuuugccauuccucucuccagaggugacugccaucaugaauuugugcuagaguuuuuaaucuugucaauuuacuauguguaugauuucguggccauuuguaacuguguagauuuuacuuguacacuuucucuccaagauuuuuuuaaaaaugccguuuuagacaauccccaguacugauccuugggggcucuuugcuuccuauucuuugaggggucuuuguuuuuuuuuuuaacaaacuaauuaaauuguugcuuauuucuuaaaaauuuuuuuacuguuucuggucuggagcuucuucagugauuuugugacagucuuggaaaaucuaauuuuaauucuccccuuuauugaaaacuugguuggccuuuucuuuuucugaccuccucuugccccuacaaagguagagauuuaauaauacaugauuucuuuuuacagaaagcacauuacuuauuuauuagcuugguaguuucagcauugagaauccuucauuuauaauguucagaauuuuucucaaagaccuuuuaacauuucgauccuuuacuuaagaaauccugauaucaaaguaauccauauucauaauagauaaugugaaaaguauuuuuuuuaauuuagaaaagugcagagaaauuggagaaaauacucauaggucccugagugacugcuauuaauguuuaauaugcucauuuaagaaaguuugggaaguagcgaagaaacuaccuaccauacuaauauaaucacaguuaauauuugccugacuauauuuccuucuaguuucuauuuuucuuuacauaguaaauuucuuugcaaucacaacauaaauucaguuuguauuauauguuuuccacacauacacauuuuaaaauacuauauaacccuguguuuucauuuuuuaagcauuugggcucuacccuuagcuuuaauuuuuuucuguuauuucguuauguguaacaucuuugaacacagaguguuuuuuguauuuagaauggagugaaauuguuggaggauggcuacaggcacuuuaaagcccuuacuaccuauuaugaauguggucacgugugcaccugcaugucuaaguuuugguuucaccucauucuugccaucauagggauuuuuuaaauaauaaaaaagaaagaaaaauccuugcuuauucccaacaauagacauuuacucuuuauugaaauagguucuuaaaucuuuuuuuaaucuucuuuacuuuaaauauuuuugcagguauuuaaauuuguauuaguguacauauauuuuuauuuucauuuuacaugugguccuuuuccucgugauuuaucuauggcuuuuaagauuagaaagucuuugugcuuucaaagauucaauaaauauuuuuauucauguucuuccaguuuuuugugguucgauuuuuaaauauauuugaugcuuuaaucuaauuuggauuuguuguaggccuaagacagaucuaccagggugccauuguucugcuauaccuaguuuaaaccagugauaaaugcuaucagugguggauggaugaauuccaagauucauuucacauuuuguaccugacucuuuguaggaguguuauuuaaaucaggcugauggguguugcuaaaauguuggaccagccuuggacuucucauacccaugcugaccuguggcucagugggaaucuagcauuugucccugaacgugcauugcccuugguuucugaauagccuccagcuaguuuauacuagaucuuuggccuuucucuggggcuugugaacucugcuuuccagcaaacaauguacccucacuauuagucaacagaccauuuuccuuaggcccuggaaggccuauaacacaagcuccuucauccacaggcagaaucccuuccaaucaccuuuccucuuggaucugcccacccauccccugcagccuggccagcagaugccaguuugccugggcuggucagcacauucacaccagcucucucuccuuagcugacugaaaggcuuucuuuuuuagcuccaugacugcagaauaaauaagagcaauaacauugcucuuuuguuuuaaauaaaugaguauggggcaagugauucaaucaauaacugagcaagaauugacuuuuccaguuuaaauguagugagcacccuaucaccuagaguguucaacagauucaggaaaacauuuuaagaaauguuagauaggggagucaugaauuucaugaggaugacugucuccauaaucuucucacccuaagguucugaaguuacgugaguaucucauuucacaccucccuuuuuuuuuuuucaaaguuuucccaacauuuacaguagcagaggcacaaaacaaauuuuuugcauguguauuuauguauguguauacauccuuuuauugaucucuucaugaaaagguaaggaaugugauauagauuuauguaaagaaucuuauuugcuagaacgugauguuaaugaggucauaaccgcagguuugauccuuagauaagccaacuguguuaaguccuaggauuaguuuggaaaaaauggcuucuaaaaaacaggaaaaauaugauuggaaaacagguuuaguaucugccccaggugguuagauauauaaagcuuacuuauccagugaguguaagaaaccaaaaccaaaacaaacagaaagaguauuaaguccauacaguugagauagaaguagaauaucugaccacagacuuguagguuguauuaguugacaacgugugcaucuuuuuagguaaauauaagaauugguuugugaauugauuuuuuuuuucaaaaaagcaucauggagguguaauuuacauaccauaaaauucacccaucuuaaguguauaauucaauucaauuuaauucaaauuuuaguaaauuuagaguuaugcaaccauuaccacaaucuaguuucagaacauuucggucaucccccaaaagauuucuuacaccuguuggcaaaaaauccuugcucucucccagagcccugggcaaccacuaauacacuuucugucucuauagauaugccuuuucuggaccuuucaaauaaauagaaucuuauaacacauauuauuuuauauuuggcuuuuuucacuuggcauaauguuguagcauguaguuuauuccuuuuuauuguggaguaauauuccauuguaaggauauaucauauuuuguucauacauucaccagcugauggacauuuugauuguuuccaguauggggcuauuaugaauaauauugcuauuaacauucacauacaagucuuugucugaccauauguauuucuucucuuggguggauauuuagguguagaauugcuggauuauaugccaaguuuauauuuaacuuuuuaagaaacugccuaauuauuuuccaagguagcuguaccauuuuacauucccauuaaacaaugagugaggguucuaguuucuccauauucucacaacuauuuuacugucuuucuuuuucauuauaaccauucuaguggaugugaaaugauguccugugguuuucauuuuuauuuuccuaaugauuagugguguugaacaucuuuucaugugccuauucauguaucuucuuugguaacauguuuacucuaaugucuugccggcuuuuaaaauuggguuaucuucuuauugaguuguaagaguuccuuguaguuuuuaaugcaaguucuuuaucagauauuggaaauauuuucuuccagccugugacuugucuuuuuaauuuucguaauggcgccuuuugaaguauaaacauuuuuaauuuugaugaugucuaaauuaucagucuuuuucuuuuaugaauugugcuucugauauuuuaucuaagaacucuuugccuacccaagaucuuaaaauuuuucucauguuuucuucuagaaguugcauaguuuuagcucuuauauuuaagucugugauccauuuugaauuaauuuuuguauauggugugaggugagggucaacuguuuugcauguacauauccauauccaauguuacuaguacuauuuguugaaaagaccaucuuuucucauugaauuuccuugacacuuuugcugaaaaucaguuagccguaaccagaaggguuuauuucuggccuuucuauucuguuucauugaucuaaucucuguucuuacucuaguaccauagucucuugauuacuguugcuuuguaguaaguuuugaaguccuccaacuuuauucuucuucuucuaaauuguuuuggcuacucuggguccuuugcauuuccauauaaauuuuaccuucaacuugucaguuuccacaaaacauugcauugagauuuugauaaagauuaccuuuaaucuacaggucaauuugugaagaaauguuaacaguauugauuuuuccauucugugaacauggaaugccucuccacuuauuuaaagauuuuucgacuuaucuuggcaauguuuuguucagugcacaaauuaugcacuuuugucauuagauuuauuacuauaaaucuuauuccuuuugauguaauugugaauugaauugcuuuguaauuuaauuuucugauuguucauuguuaguauauaaaacuaugacugcucuuuguauacugauguuguauucugugacuuuucuggacuuuuuuuuuuuuuuuuugguagauuccuuaggauuuucuuauacaggauuauauugucuuggaauaaagauagucuuucuuucuuucuuucuuucuuucuuucuuucuucuuucuuucuuucuuucuuucuuucuuucuuucuuucuuucuuucuuucuuaucuguauacuuuaauuucuuuucuuugcaucauugcacugguuagaaccccaagaacaauguucaauagaaguaacaagaacugauauccuuaucuugcuccugauauuagaaagaaagcauuuguuauuucgccauuauguaucauguuagcuguagguuuuucguagguacccuucaacagguugagguaguuucuuucuguuuauguuuuguugagaguuuuaucaugaauagacauuggauuucgucaaaugcuuggucuauaucuauugagaugaucaugugguuuuugucuguuauucuauuaauaugguguauuacauuaauugauuuucagauguuaaacugaccuugcauuccuaggacaaauuccauuuggucauggugaauacuucuuuuuauauauuguuggauuuggugugauaguucuguguugaggguuuuucugucucuguucauugggaauauuggucuguaguuuucuuuucaugucuucgucuggcuuugguaucaggguaauccuggcucacagaaaaguugagaagugagccaauuuauuuuuuuuaaacuggucucaguuagggggaaggaaggaugguacacaacaguguuucucuaucuaugaugaaauuucauuuaaaaaucauuucuuaucuugugaauugauacuuuaaaaauauaauaaaacugaauuacuagaaaagucauacaaaaauauacaaauaaaagccccacugaugaauuauauucagccuauauuaaauuacuccaugaaauugauaaaaacguuccuaaagguuuacucuuaauuucuguguuuaccucaucacagacuggacacaaaacaguucucacaaaucugugaaccagcuuuuagucugguguaaagcacugguguaaacccaugcuucucaaacuuuaauguucauagaaaucaccuggggauccuguucaagagcagauuccgauuuggcagguugggggcagggccugagucucugcauuuccaucaaacucccgggugauggugaugcggcugcugcugggccacaggucacacuuugagugccaaggcuaugaaaaacaaugcagacagcaacguaaaugugauuuuuaaauaacccugucauaaauugcuuugggacauauuuuggauuuuccaagauuguuggauuguuacucagcugucaggauucucuagauaucaguuguuuuucuuggccugugaccuuucugggucuccagcuguuccucuauaaauccaagggguugaacuagaagaucucugaaguccuuuccagaucucacagucuaugauuuuaagcauccaugucaaaggagaauuaugguuucauuugcauuuucuuuuuguauaaaccuaauaaaacaugaacccaaaguuuuaugcuacaacaguucuuaacauaauguuaaaaaguaacaguaaacaugcuuuacuaaauuuuggaugauucaggaagauuagugucaacauucaaagguuuuuccauguugaagucuugaagagaaagggugggggucuuguuuaacuuuauaguuggaaauccaauuaaaaaaauaacuggcuugcuuaaaguguggagacacaaguaaaauagguguuuauauuaugaaauucaaguugacacaaaauagcugaaaggcuucaauuucagccaaguugaaaugaugucauuguccuuuauauuucauuuuauuuacugagauacuugaaacuuuuuccccuguugcuuaaaagcaaaugaaaagggugguaaaucugugguggaaauguguugucaaaaccuccaggggcuguauccucagccuucagcacauauuagugugauucugcuauucuuacuacagaugauuacagcaaacucugcaaugaaggguggaggcauuuggucagccuccaaagaaagugacuaauauuugaccuaauguacagaguacaugaauaacauauucuuaggguaagaaaaaaauucugguuuacaggguguguaagaguucauauuucuuuuucaauucuuccaaaagauuuaaaauacucagcugcucuauuaaauuuuuaauuccucaggcucaaaugcaaaucaugcauuagaugccauuauucaauucaauuuaagaacagacucuugccccaggaauuuauuaaaauaguuuagaaucuugaagauaaagaguaucaguuuugugaguuuguaguacccucauucuucaaaacagcuuuuucguuuuauacacuguugaguaaugguuucccuggguacagacauuugaagucuacaaaauauauaggaguuuuuauuugcugagauuaguggaaaguuagcauuuucuuuuucuuuuuuuuuuuuuaucacauugaacaucauuuaaauaauauacuuacuguauuucuguuauuuuuggcacaauauuuuacuugguggguuuccuuuuauucauuuaguaauaauggggucagcuuggcaggccuuuuguuuuuaauuaacuaacacaugauuguguuauguguuaagauauguucauuaauguuaggaaaaacacagaugaaaauguuuacagugguucacucuggguggugggauuauaguugaauuucauuuucugauuucuaauuuuuugugucuuuugaauguucuacaaaggccacauaauuuuuuugaauuagaaaagaccacaaguauaaaauuaauaaaagcuuagaauuucuagcuuuauuucucucuggagaaagggaacuuuucauguaucuauuuaauauguaugaugcacuuacuauacaccaugcacuuugcugggucuggggaggaauaggggaggugagagacagcuguuucccuuaagcucaguucuagaucuuuaucugaccaagguaugguggguggggagcaauaaaugauaucccccaaugaauuauuaccaucguaaagugguaaucauuuuaugcuucucgccuggaauuuaaagaggaugaauugagauucuauauguaaggcacuuggucuaauacuugguacauaggaaaguaaucaugauuacugugcuuugcacauucauggugaugaacucauuaccucuggaguuaggccggucuguuuagauagccugggggaaaggugagaccagauacccaggugacauucaucucugagauaccucccccauuucugcaguuauucuuccacguggcauccuuuuaaauaccaaccacuaaaaguuugguuuauuaacuuaauuccuuccaagccaaguuucuguugggaccuuucucugagaaugcaguucuaguuuuaucaugaaggauagugagaaacuaggauuuauuauguaguugugcaacuauaaauauuuauuucaucgauaugugagggccaccugggauuuuugcuuuuuaauuaauuaaauuaauuuuauauuaauagacaauaagcauuugagaaggcaaagauauaccuagacaaaaaaaaaaaguccugaaucacugaaagcaguuuagacagagacauugaguccagaaacuucaacuuaauucuccccaaagugucuuuucugugaccccacaacaaagcacacacaaaaccgcauuggcuuuguaucacagaaaugcuuuccugucccagcaguugauucuaauaaguuuguuuuauugaucugguugcaaggggugcuguccaacaaauaauccuauacaauaaaaagccuucucaagugacuguugaauagucagggugguguuggugucugugugaugaugaaggugaugggugagcaaaguucagcuaaucacaggguuauuguucuauggugaggcagccacagcgucacucuugagcuuucugcaugccugccucccauaccaaacauuacagccuuccccuaaaacuuccagaccacccacuggaacaauauaguauauaaaaggauccagaugcuuggaaagagaaagggugaagugcagagcaugcgugauaccugcucguuggcccuucuagauuuugagcacuguuuuuacauagcuggcucacuaaagagaucaaacuucaucuccaagucucauuuucagagcauuuuuugaaauauaucaagauuaaaauguaucacaaaaaaucugcauuuuuaaaauuguucuggauucaggggugacugugccucuacggcucugcaccuuucuucaguauuccccagaaaacagggggaaacaaaucguuguaggaugugcacacacguggagcucuaaagcuagacaggauguggggaauagaggagagaguagagagugucaaauaacagagugauacccacgaggaaagaguaccaaauacauggggagcgcccguuugcagaauggcacaggagaguuggcuaaauacacauaacuuacacuugaaggcuuaauugcuuggaaauuuuuaaaauauuuuguuuuauaaauguauauauuuggaacuuaggcuacuugguagcuuugcagugguucaccuggugaaauauggcuucucaaucuguuuguucaaaacagauuuaauagauaggguuuuuuucccuccucccugccugcucccugcaggacagcugauuuacaagaggcaaucuccuucauaugauacucauuaauuaauuuauuuaccuaaccccuucauuuucucucaccuuccucuccaguguugcuuccuuaguuucucuuuaucacauuaccauuaaaaauauuuaccuaaaagucucuuucucucucucaaguuagcuucagaaaaggagagcuggccgccuguuuucacccauaucuucagugccuagaauagugucuggcagacaguagguacucaaugaauauugaugauaaaacuuaguucaugaagaaguucuagacaggacuaugaguaaaacaucuugguucauuugauuguucaucuguucauucauucacugucucucauguaucuauugaagacauagucugugcuaaggacuguaguacuagguacugggcauauaauccuccucuaaaggacuuuacaaauagauaaaaacaucuucuuuugguacaaucucuucauuuaaauaaaagacuaaugaaaauuagauuuagaauguuucauuacaaauuuuagaguccuccaaacuauugauuaaaacaauacauaaauguuucccuuccaguuuaaauuaaaucagaaagcuugugugggcuguucuccuugccugguuuagacuggaagaccccagcuguagggaagaugcuuuccucaaaccaugggcaggcagagcuuuccugccagcgagcaaguuggcaugcugguguuugaguggcaguccauuaguuggcaucaccaccuagugcaaucucuaaaaaauagcaaucuuuguccuugaaaaugaaaauacuuugguuuuaaaaauauguuucuguuuuuaaugaauccaagacuugaguuaauuuaaaggcacucacauuucccuuugcugauggcgacaccuaaaacguucaugcccaugcacaaaaggguauuccauuuggaguucucuuacauugacucaauucccuauuuguaauacacaacauggccaccauugggcaacaaaauaacuuuauuaaagcaaagaaaaacuguggguuacuguguuacaugcucuuucagaauuguaaaguuucccugaaguagauauaucacaguaauccauggccucuuuguggccuacggucugccaaaauuacugaagaugucccagcaucacagcacggaccuguggagaggaacuuuauagcauucuggcccaaucucugcuuuuuguagaggguucugaggaguuucggugaacugagcuuacuaaccaggggucacagagcuaauugaugggaguccaggcuugauuccauucuucuaacauccaguccaguguugcccaaaaugugaucuacugacaacuuacgucaugauuggcaggguuacucagcaaaaaugauuccuggcccccagcagaaucaaaauuauugaggguucaguccagggauuugcguuucaauaaguuccucagugguucuuauggacacuaaaauuugggcuuuuuaccaauaagccuuaagaccccauuuccagggaaagcuaugugcuaaauaguucuuccagaaugcuugcccaagagaaugacuugccuucauauuugcucugcuguguauauugacaguauaaaccauuucaagaugagcuuuaaggaugaguaaaaacauacgcuaaauuaggagcugaaaucuuuaauuuagagauacuuuuuccauagucugagaguaggaaaauuuucaucugaagguuguuuauucaguggaugaaucaaaaauuguugauaaagucuaaaaaagguaaauaugauucuuuaaaauuuugaauugaguguaauggagcuugaauugauauuuaguauguucuauuuacuuguguuuucauaaaaaccuugcuggaugaauauucagggugccaauaaauuuguuaccuguuuggccauaggaacugggcagagggaaguuaugggaagacuuuucagugaauauuuucuaugcuucuugauuuuugaacccuuugaauauauugccuauucacaaauuuuuaaauaauauaaauguuuaaagcauuaacauucauuguagggccuuaguaggugauugcucugacucugcccaggcuacaaaaacacauacucuagaaucuaggugucccuguagcagaagguaaugaacauuuccaaagggcagagccaggaagggaaagacugcacauucagcuaguuuuaaggaaaucacuaauuggcuugaaaagacaagucauuuuguuuuagcacuuauacucauuauuuuaaagccccucccugacagaccacucaucacugggguuuugggugaccuugggcaaaucacucaacccucuugagacuuuguuuucuagucuguaauaauacugaugaaaacucccuguauuucaguuggcugacgauuucugaauacauuacuuaguuuucacaacaacucuggggguuggguaguauggcaugaucccuauuguucagaugaggaaauuaugacccagagagguuauaugguuuagagagggucacacaggggugggacaucuaacuuccaguacugggcucuuuccacuguggcaugcaggggacguggauuaggcaauuuccagggccucuucuggcauccaaguccuugaguauaugagcuauuuggggcuccgucaacauuuguugaagucuuuuggaaaaauccaaaggaaauugaagccauggguuugcaauuuuagaagcucgcauuguaauuagaguaucaaaaugugcucauacgaagacaaccgaggaauacuuacaaagccaacacauaccaaguuaugcaaauuacaaauauaccagaucucauaucacauagcacaaacucugcaccuaacuaccaaggggauggggaaucccaaaccucagagaauaacauuugacucucucauccucuccuaaaugauacuagcaacugcucuuugagcacccaguaaggcaagcauuuguuacguauuaucacauuuaauccuuaccacauccucugaggcagguauuauuaucccaauuuuauaggauaaggaaacaagacuuagagauuaagugauuugaauaaggcuuguaggugguaaagcccaucaccaaccaggguccuuauuauuauuguuauuuuuauugcuaucuccuacaggaaaguuaggauccuuuauugauuuaaggugugugcgcuuugucucaugccuggcucgucuucuugucuaagaguacacguagcgugguuucagauaaggguauguugaagagaaaacuuaacguaccucugccaauacccagggugagccugauuucaugcaguagcaauuugagucgccuuuagugggcccaugaguaaaggaggcccaugaauucugccuucuugccucaaaacucuuuauuaugugagccuggcuucuccuguguagcaucuguuacuucguuuugccuuccacauguacuaaguagaaauagacaaacuuaacucuugcagauaauagaugacugaaaacagaugaugggcacacaaaacaggcuuugucuccauaggauuuuguugguaaaauacuucgucuuucacuucaauauauuuuguucauuguuuugcugcugcuuagauaugaaaacuuuccucuaucguccuaaucuucugauaugccaucaucucuuucaaccucuuuuccgaugccagagugaauccagucugcccuugaauacuguagaaaccucuuggcaguuguuaacaagccuuagcauuuacucagucauucugggaagagaggggaauuuacacuguuuccuuaguucacauagacacaggcgagguaaguagccuggcuggguuggcagagguucuugaggauuguaaaaacugugcuuugcuccggacccuggcuccucacagaggucugccugcuuguccuuggucuguguccuccgcaggccuuuuacuugagucagacuccucuaaugagagaguucuuggguuucagucugggggaauccagccuccacccgccagacuuccuggagagcucucugcugaugcugaaagugccuggagccuugaggauuggaucaagcucccuuucgaaggggucucaaaauucuuuagacauaauauauuuguggcuacaauuuguuaagaaaggaaacaggcuguacuagccaauaaauugucaaaggagcacauaccuaagauagagagaaugguuugcagcacacaacgcucucacucccuuuucuagugcucuguauucaguauuuacacuaacuuuuaguagcagcugauuucuaagaagacuucuggcuucugcucuuugcauugaccaaaacucuuggggcauguguugagugagggaauaccuuuuuauucaccugcuuccuagucugaacuuucagauaaucggcacuucuuguucccagugugaauccaaagagcugaaacagcuuucuuugugggaaaucagguaagugggauuucucuacagggaugcagaugcagaucugaaugcauguacagugcuccauagcucacugacuaagcuuuaaccagcaagucagagcuauacagcaccuauagguacucccacgauacuucaaaaauuuucauggaauuauaaacauugauugucagaaaaacagaccuaguuaucucauuuugcaggcuuugcgucuuugaacacauuugauauccauuccuacuaaauuuucucucugaaucugaucugucugcuauucauauauuucuguuguuuuauuaguaugugcuguagccagauauuuugcuaauuugugugcuuuuucuuugcuuuuucauaauucugccuaacuucuuagguauagaauuuccaaagcuaguuguuagugugccaaaacagccaaaacagcuuuaacaaaaaaaacuaugcuuugcuugacugggcuguaagaugacuuagauaauuuaugcuucccuucaccauacuugggggaguaccuguuuagaaaggguuuuauauccuggcuuggaauaggucuaauaauuuaaacccucucuccuggaauuaccaaggucuaaaacuaaaccuuaugcuaauaauguugaaguugaaaugguuuucaaaaugauacccaaguguuuauaauuuuuuaugugcugaacuguuuuguuuagauaaacuggaagaagauauucugggauaggaaauggcugaaggaaacaaaggugugugcagagaaauacaugaaauguguuguaggaucaaagauuuaacaguuuauauggaacaaggagaccucaaauagggagaggggaaauggaguuggaugguaacuuggccuggcugagaggacuuggagugcugauuauuauuuaugccuagcuuguuuaagaguuuuuaaaaaauaggaaaccacaugugaaugggagugggggaaccacucuaacuuuuaacuuagccacauaggagaagccuacuuauucagaccucaagccuuaguccuggcaaauucaucuccuggugauggcuuaauuauauuucaggcauaguauucaaggugaguguuaaguuuuuauuuuuaagugagaaucuugcaaaugcaagcauaucaacugauagccagugucuuagggccccugcacaaacagcuaaguaugcucagagagcccuacuguggaaaagaugcccuagaggaacacccagucauccuuuccuuuaaccuucaucucaucguuuucucuucccuuccccaaccuggaccuaucuugcccagccuucucaaugaauacuuggcaugaacuucauucacucaacuuugucgcugacacgcccguuguacugacagaauccuggcuugaauggcgcuugcucagcugugcuuuagacagacccuucuggcugaccugguuuaaaccuggcuuucuugacgccauccucagcguguuccaaggugaaaaaggacucugcugccccuucuguugcuccucugcaggggaaaccaguugccacuuggcaccaggauguaucaggccggcauccagaguaguaacaugauuuagugaaaauaguacuagaccaggaggaaacuugaguccuagugcugguuugcuuuucaguggcugugugaccuugggcaaaucauugcaccaccccaaucucaguuuuuuucaucuaugaagugacgagcuguucucuaaaaaccuuucugauccucaaagucaggaauucacauagguuaccaaauucuugaaugaauagagauuuggguucuaagugcuuuucuuuucaucuacugcacugccuuuuuacacaaaacaggggccaucucuauauuguuuuguagugugcacucaacuccccucucaaucuuggguucagguaccaaaaagaccuuccuucaccugcacaguucacuacaaagaagggcauucgaaaagucuguaagugggccaggugauucaggauguuucgcguuacuuuaagaagcuuuuucuugaauuaaaucacucuauuuuuagcaacucacugggugaugcuuuuaaaaauaucacugauaaaaaauaugugcuugagacaauuacagguauuucacauauaauauuucacccaaaucuuaacaaccuuaaauucucuccgcuugacacgugaggggauugaggcuuacugagauuaaacaaugacacagggcuaagaaugggcaggguuggaauuuaggucagaacuuucuguguccacagccugaauucaacucuggcacuauguucacuaugaggaguagcugccauugcuguaagaauaccuggcguuuugugcaggagaucucagggaacccuuuuuguuagguuucaaagaaaaugauuucuaacugcauuucagaugccuggaauuuaugcugugccaagcacuuuuccacuuaauucuaaauccguggguauuucaaggggaauuuaacccaugugguucugauucacuuguacuuaacucaucaaaaaggauuguuuuguaaaccuuagccucuucuuaugaaugcuuucgagcucauauuuggcuggcauuggcuggauuucgaaucugccaugguugaagcuugguucuuaaauccuucuuuccaacaacuauuuugugguaguuucauccugggaguggauggaaauugaaggugagucaugaaggcucuuccaaaacuuuaccaggauuccagugguauagacagucacuaaccuuugagguucgugagguuuguugcacucaccuacagccuuaccccauuaaguaguugaauugugcauggaugugaucuaugaggguaaaaaauuaaaaucauagauguugcauuuuccccugggaugguguagagaaaaauugucuuugagauaaaagguauuuguggagguuagguauauuacuacuuuggaaaggccuuuuagcauagagucuucuauuugggagacauuagaguuauagagcuaguggaaaguuucuuucagaaacccccauuagaaauguagaaggcaaaagccuauuuauuaucuuugcauuuagaugaguuggguacauucaguucugauaaccugcugaguuggagaauuaauuaacuugucuaauuaacuucacaugagcucaucuaaggaauguguguaguuguguggcccaggggaagcaagagcaauuuuuauaccuaguuaacaguuugguuuaagaaagauauauugagugucuucuauuccaggaaguuggggauagaagauaagaguucagagauaaacaagacucucuccuccuaaggaaccuaccauuugguagguuauaaccuauaugcuucucuuuggaccauggccaaaugguaugacuggcaaauagucaauguacagcaauacaccauaggagcucagaagaugaagauguucauuuugauauaugaagcuggacaggcuuuucccaaaaugcaguguuuaaguuuggucuugaaggauaagaaggcuuuuaaaggcagggucaagggcgagacaaccagacauguucuuggguaauacagacaaugccaaauagucuccacagauuucugcucuguuuauagacguggaguggggugacucugcggaggugaaucagagcguuagaagcucaugcugggcgaaaggggguugugcacaguccucgauaaugagcagcugggauuaacaugacaguuuuuaaccgagcacagauuuucagggcugggacaguuuagccuuggaucaagaagaaaacacaggaaagggacaaggaagggaacaagaugugaaggaacaguaugugagauuuacacaucaucacugcaugccauguuuaaauagaacauacugcauaacaucuuaacaugcccuuacauuucuauaguguacaaauaauggcuuauucugucucacguugaagaaaccaauuaaaugaugcauguuggguauaaagguuuuuucuauugaaaauaucauugucauagaauagaaagaguuacaaucagacagaaaauuaaauaucuuaaauauuucucuuguauaguguuuacaaacacccuauuaucaucccuauuuauaauuaagaaaacuguggaucagaaaguaaauaauuugcccauggucacauagguauauaagacacuuccauuucaguuugcagauauaauguguauguguguauguagcuuaccuuuucuauuugucauacuuuuucaauucacuauaugacacauuuacagaguauaugucauguauguguuaguuacaaaccuauuuuaaaaaugaauacugcccaaccuaagcaguaaaauaugacugauacccauuuaggauuccccguaccaucucuuuccugcuucuccacagggagguaaccucuaucauagauuuuauuacauauauuuuuuuagcugacaccaacauugcuucuguguuaccaugguuuacagugaauauauuuacaaaaacaaaauugggauaauuuucauuucuugcaaacaacacuccaacacugcacugaaggcuuuguuagcucaagauuuaggaguaugagaacaagguccugaaacugauuugaacguugcuucaaucucgacugcugugauuuaauccuggggagcaagagggcaaaaaugaggccaaaggggaggcaugaaguaaccaacagggccugaucugggauuugaaagauguagauugucguuccaucugccacuaauuuguucugugacauugagaaaauaacuuugccgcucuguguuuugauuuacccuuguguacauuguaccgucauuuugaggaaggcaaaguaguggggaaagcacagcuuuuagaaucagaaacaccaaaagcugaauucucauucugccacuuacuguuuguagaaccuugggcaaauuucuuaacuuuacuuugagccucaguuuccuucuuuauaaaaugaagcaaaagucuuccucagagaauuguugugagaauuaagugagacagcaugucucccuuguagccagcaccaugcuccauaaaugcucauuuucuuuuucuucuucuauaaguuuccuuccaauucuaaaauaggagauuccagugcucaucuuauacauaaacgacugaagcacaaccagcucauaauuauggaauuuccuguauuaaagggcucaacauuucucucaaaucagacuugucauuagaagacuuuccaaggucuggaugaaucuuuugaaauuaacaauaacaucuggaaaaaaaaaauggcucaucucacacucacagaguagagagaaaggagugagaaguauuauauaaguucauuuacuacccuugauucucccguucccugagccaaaacaauagacuauaaagcugcgacuucauuuuuauuguuucauaagccaucugcauuugcauaaagugucaguaccguuacccuauuuaaagguugaaugucacugugaaugcaauacuuaccuuuuacugucucccgggaaccuaccuaggcauuuacauaguucuuugcuuucuuuucaauccauucuuauugacguauuguuugaaauuggccacuguuugggaauaacuccaaaauuccauuauuuccauguguccacucuguuuauauuuuuaugauuguuaugguaagcaaucaaauauguaacauuugggaacugaggggaggggaugguggucuuuacuuucaauugacgguaguauauagggcauaucacauucaaaauaucucaauuauuuaaaaaauagaauagagaaagagggucaucuaacagagauauuagugagcuuauuuaaaaaauagaacguaucuuacaagugagaacuggcaguaaucuuaugaugguaaugaugcauaugaccauuuauuugauuuaauuggaaaaauauguguacaucagagaacaguggauuaacggagaugaucagaguugagucaugucucaacauuagauaucuuacuagguuucgaggaagaaaaauuaaguugauuuggggaauaugagcuuaggaaggaauaucuggaauucucauuugcauuuggguaaaauuugguuaugcacuugaccuacuuugcucaaucucuuugcucuuaauuuuuaaaauacaagcuacauaaaaauuccagaaauguaguaucuuaugcuuggauuauucacucauauauaugucaaaugacaacauaauuuguggacuuggugucucaguuagaaaugaguuuggaugcaaaugaugcaaaacccaaccacagugacuuaaacaaauagggguuaauuuuucuuaugucaggaaugaauuuggagguauaugguagcugguggugauuccacugcucaaaaaugucaucaggccagccaguggcucacgccuguaaucccugcacuuugggaggcugaggugggaggaucgcuugagcccaggacuucaagaccagccugggcaacauagggagaccccaucucuacaaaaaauaaaaaaauaggcaggcauggugacaugugccuguagucucagcuauuugggaggcugaggugggaggauugcuugagcccaggagguugaggauauagugagcugugaucccaccacugaacucuagcuagggcgacacaaugagauucugucucaaaaaaaaaaaaaagaaaaaaaaagucauugaaacugagguucuucuuucuuugugcuuuauaaaaccacaaugagauaccaucuaacaccuauuaaagcugcuauuaaaaagucaaaaaauaacagaugcugcagagguuguggagaaaaaggaacacuuauacacuguuguuggaaguguaauuaguucaaccauuguggaagacaguguggugauuccucaaagaccuaauuacagaaauaccauuugacccagcaauaccacuaccggguauauacccaaaggaacauaaaucauuauauuauaaagacacaugcauguguaugcucauugcagcacuauucacaauagcaaagaaaugaaauccaccuaacuguccaucaaugagaccggaaaaagaaaaugugguacauauacaccauggaauacuauacagccauaaaagggaacuuugcaaggacauggauagagcuagaggccacuauacuuagcaaacuaacacagcaacagaaaccaaauacuacauauucuuacuuauaagugggaacuaaaugaugagaacagauggacgcauagaggagaauagcacacacugggccuuuuggagggcggagggugggagaagggagaggauuagggaaaacaacuaaugggaacuaggcuuaauacuugggugaugaaauaaucugcacaacgaacccccuugacacaaguuuaccuauguaacaaaccugcgcuuguaccccugaacuuaaacuaaaaguuaaaaaaaaaaaaaaaagaacaaggucuucaugaauccaggcuuggacuugaucugcaugucaccuuuaucuuugcucuauauugcaaauucaacuguuguuuuuaacaaaaggccaggcaagggaguagagauaacuuagaacaaaucucuuagcucuucagaauggauuaaaaggugugucuugcagauugugggucauugacgucauuuguuucuaagaauagcgggauguauugguuauguguacccaugguaugugugggaggagaggaaaaauagaaggaccagggacuaugguagguauuuuguauacuuauuuacuacucauacaaccccaggaagcagagaaaacugacucaaaggguaacuuuauucacugccacauugauaaucagcauuccagaauucaaaucaagcaugauagauucacggaauuauaaguaguuaauuacaucuugagcaaagggaaugaauaguucaaaagauuaaggauuuagacuaacuuaaagauaugucauuuugcauccuccauucauucauucauucauucauucauucauaaauacuugagugcuuauuaugggcccauggggauauucuaggccauggagaugcaaaguuuaaagagacaaaauauguauccuuaaggcucacaaucugaugaaagacaaucauauaagugagaguuuaccauggaguuugguuagugccacagaggagggaaggaguaagucgucaggggagacuuccaaguggaggaauuugguggaaaaauagggagaggaaaggcauuccagguagaggagauggcauuugcaaagacguguggaagagaaacagcaccgugaguugaggaacugcaguucacucagugucaauggagggggaaggcauuuagggaagaggccagagaggaagccaaguagggagcauuucacagagcguuuuagggucuaacugaaguuagguucacuccagcagggcaaagggaaaugagggucuacacuaaagcaguagcaauugaauuucagaggaggggcaauaaagaagcuguugaggugguaaauuugacaaaguuugcgggugauuaggugggggugugagggauacucuguaauccccgcugcccugagucuguggcccugugaugugggcuguggugaugcccuuucccaaaauaagaagugugggaggagcaagucuaauggcaaaacaagcuucuaucagacaucuuucuacacgcucugcccuuccugcacuauggaaacaaccuucucuuccuaaccuagcugaagccauccuggcucaggccagcugaaaggccacgagggcgucugaaugguucaugauuugaccacuugaaugccaucagagagugaugugucuaacucgagacgaacagcaaauuaguugcugagcugagacuggcgugcaggccuccucacuuuuaggcuuauugucuuuagguucuagcccugcacuguguucugccuaaaugggcaagguaacauuauccacaaaugccugcugccguuuggggaaaacuaaccaggacgguauguguuacuaaaaguuagcuaucaauuuauagagggcagugaugacuuucaugcagguuuauguuucuauguggcucccuuuggaauuacaaguaaaggaaggggagaacuggagucguuuuuuugucugugcuugugucacuaacuaggagaguuuuuuuuuuucuuuucuuugagaaugaacauauaaaacucuaguaaaucagaguaaguuaucuaaguaaugccaaauucuuauuaguuacuucuuuuuaaauagugcaggggauuauuaccuuuucugagccauggacacuuuuaagaauuugaugaaagaacacguucuucuuccaaaaaggaauaaaugaaggcacuguauugaguccaagugcauugguugcaaguaauggaacuagcuuaagcagaagaggggauuuacuguaaggaaaucccagguuauaagaaacccaagggcagguacuauagcagggcuuuacccagggcuggaagcaaaaaccaaaugcucucuccaacucuuucuggagccagcuggucucuaucccugccccaugcagguggacugcucugugcaucauguacaugccgccucccugcucccaagguaagucaccugaggucuagccagcugcagaggugaacaccagugcucgucaaucccaauuccagauuucuggaagagaauaugugauugcucacuuaauuguguucagauucaucgaacuugcagaugugauuuauguauaguuucagggcaccuuuagaccuaccaagucccaauuguggucuucaaguuaagaacccauaacuagagaaaucugaaugcccauagaccagcagcacuaacuuuuagccguacaacuacugcagaaauuugaaaauacauuugaauagaaagcauuugcaugagcauaguuccuaagaacacuugcuuugugcaggaguugugaauuuuaaauauuaguagugaaaucccaggauggcgaauaugauguauuuuaaauuauaacacuuuccaaggucauugauauucuauuccuaacuuuuacccuuaaagguuuggaaaauuccauuuuaauuauuguuaacaugcuucauaaauauccaagggaauaaaacauagaccuguuaauacauccagagagcuaaaaucuggcucaaguuguuuuuucuuccacaguuggagaaaauugugguguuuggcuucccucuuggggcauuuuaaaccacuuuuaaugcugucucuuauuauuuucuaaccauauacacuuuccgaacguaucuaacuagcugccuuagaugaaaccccagugucuggccaagcugauguaaaucucuaguaagugguaagagggaacagaguaacacagugcccugucaguguucagacaguacaugauuuaguaguuguaggacuuauagucucaggagcaacuuuaaaucuuuuuucuaguucuauagaauggaaguuucuaaggcauauacuauucugccacuggcuccacugggcaacacuuagcuagaacuagaguggccuaucugcccaugggauaguauuaagauuuaacucuucacaucauguguaccuggggugucugggaaauaacuauuaauuccaaagagcaggaugaauauuugcauaauugcuagucugugccauaaaacaguugucacucaccaguggcccagaauaucgaaaucuguauguuuccaguggagcugccaagagaccccaugugauugucccauuagugauguguucucacuccacuuagcaggucugaaaaauggacgaccauaaaauaacagugaaaacucaguucuagggucugcugccuuaguuguuggugucuaagaauauggaucaucuguuguauuugauaucugagcacguacugauuuuugucaggaaucuucucuuguugaugaauuaaaucuacauaaucggguuuuggugcugcugccucucccacccccucagcucccaugccugucuuuugcacgguucacucacguguucugaguaaugcuuguacuuucuuccaacuugucuuucuucagcugaguucagugccagacucugagcuggaaacagucucaggaauuuuucauucaucagacauuuucuuccaaagaaaaguucugagaagaggagggccaccuugauaguauguuagcaugcuucugugacugugugugugugugugugugugugugugugugugugugugugugugugugugugaaagagagaagauauacaaacaaccuauauaccacauaucuauuagcacauggauauuugauaaaaagccaauucuagaaauaacauuugccaaccaauguaucaaaaccaucucccugccguuuaucugucuugauauuacagaaaguucauauuuauagaaggcauuucucagcugugguuaauaauggcugaacuuuugucccugcuuuaaguuuuccaccagaucucucagaauugaugcuaucauggaaugugaauguggugugucuccauuuccuguagaaugaacucagggcuggcagcuaaagcuaguggucuuggauucccaugcccugucauuuacgaaaggggcaguggaguuccucuggaggaaaucccacccaccacgccaggauuccaucacauauuguuggucugggccguggguacuucauacuugguuuucugugaaaauucaccaaguguguuugaaguaagaaucucaacccuaauguuuauacauaaaugucugaauaugauaggaguaaaugcuugcucacaaaaaggaagggaaggaaaagaaauuuauaaaaaagcaaaaacacacaagucaggguauaauuacauuauacacagguuuuguuuuuguucauuuugauagcauuaagauuuacagauaauaugauuuuauuuagggacagccucacuaauucaaguuaccuguucuacaccagguaccuuauugugagaaugggaagaacuuguuaacggauuauuaguauuuacagccuaaucuucccuaguuuccccguuucagcaaaugaccauuuauucagugauggaagccagaagcccgggagccuuccgguuucccucacgcuucccaucugauccauccacacgugcuguugguucuuuggcccaaggacguccccuaccugcuggccuuccacccuuucuaugccaccacucucgccaacuuucaccucaaauccuucaguagccucccugaaacccuuuccauuucaacuccugagcccuuaaaggagcacacuucucaaauaacaguggcuuuuauuuucaguggcuuuuuauugagcuuugagccagauccagacuccucaucauaucccgagauguccugcauaauccagccccugccaaaggauccaaccucauggcaugccccuuccccuuugcacucaaagcucuggucacagcggcuuucuuuuaauccuagagaagccaggcuaucugccagcccagagccacuguucuugcugucucccauacuuagaaagcgcuuagauguugcacagcuggcuugugcucauccuuuaggccucaguuuaaaugucaccuccucaaagaagucuuuucugauaacuuuuaccaaggcagguguacccaauuauucucuaugacagcagcaugcuuguuucauuuguaacuaaauuacaaccucaaaucuaaaacuauuuuaauguguugaucuauuuauucacuaccuccuccacaagauugcaaacuccaugugaacagagguuuuauguugugcuauucacugauacaggguuguggcucaauaaguauuugucgaaugcauuaaggaaacccaugauucuguuuuacaguuguaaaauguaggccuuuacaacuguaaagcauugaagucaaaguguuuaauuuaauuuuagguuguggaauuucuuucuuucuuucuuucuuuuuugauacagggugucacucuguugcccaggcuugagagcaguggugugaucgcggcucacuacggcaagcgauccucacaccucagccucuugaguagcugggaguacaggcgccuaccaucacacccagcuacauuuuuguguauuuuuuguaaagaugggguuuugcuguguugccuaagcuggucuugaacuccugggcugaagcgauccaccugccucguccucccaaagugcuggggguauaggcaugagccacugugccagcuagaauuuucuuuuuauuguguuaaaguauacauaagauaaaauuuaccauuuuaaccacuucuuuguguacaguuugguggcauuaaguacauucacauuguugugcaccuugucacccccauccaucuccagaaccuuuucauguucccaaacuaaaacucuccauuccucccuccccuaaaucccuggcaaccaucauugcacugcugucuaugaauuugacugcucuggguaccucauauuagugcacugcaaucgauugauauuuuauaucaauuuauuuuuauugccucuuuaccaacauaugccuucacccuccacguacacaauauucaguguuaaaauuggcuugcuacugaaaaucucauuucuaauaauuauuuaaugauaaaacauucuauuaggauucuucaugaacuuaauucaucuuuuguggaacuuauuuuuggaaaauaaacaauauuacaagguacuuuuaugauauacagguuaauuuaagaauauguugccccugacaauuuuuauauuuaaucauaagacccuuuccucuugggcuacuaaucuuguuuuuggauuggagagaauauuuuaugcuucauggcuuugaaaaaauauaaaagaacaaauaaauuguuauacaauauuauuguuuuugucuugcuguuuaauagcugaugcucuguggucaaacuucaguguuugguuuaacguggcauuucauacaagcuguuuuaaaagggaaugaaucagagccaacugguucuuuaaaguggaauuugcagaccauuaagaaugaaaguauucuguaugauuuuauuaucuugaugguaaauaugucacccaaacuaugauuugacuuuaccgauucucccagucuuuuuuuuucuaguaaaaguagagauaacuuuacaggaagaugaaagucaguaaugacuuguaggauuuauagugaaggaacaaauaauaucagguaaaugauuauuucaaaaugagauauucuuuuacucugaacaagauuucuaacuguuuucuucaucauggaacagaauaaaaugugguaacaauuugcugcaguugaauugcugccacacauaauugggucccacagaacuauggccuggauuuuggugaauugcuuagucugcauguuagauuaaaagguguacaacaaaucaccuuguuucugcaguuuugaaugacauuuacauuuaagucauagugguaauacuuuucauuuauggaauaaagaaaauaaaaucagggaaaauacuaauguagaaaugguuuuguuuuuuuccuauaugguuuauuucuaaagugcuuuuuaaaaacauuuaguuacaauuaagccauaccucagaagcaguuuguuaaagguaaacauuuugcauaauacaguuugguaaauuuugccaaaagguuguauucuuuuaauaacacuguauagaccauguuaaauagguaaucuugugugcaguauuuuauauaaaugcauggauuggaaaguauauucaaaccuuauugugucauuuuaaaaaugccauguagcuuaaauaagaugggagaagcaacauugcauaguaaaaguaggccugaaaggaauuucuuuccccugaaauuuuauuauaaaaaauuucaaacuuaaaguugaaggaauaauauaaaguauacacauauacuuuccacuuauauugaauaauuguucccacuuuuauacacauaauagcucucuauguguauguacacauauguauguauauauguguauauagaauauguaaaauauauauuaaaauauguauuuauuauuuauuuacauugcugaauuauuugaaaguuaaguugcauacaucaugagacgucaccucuaagcacuaaggacauucuuguauguaaccacaauaccguuaucacaccuagaaaaacaacaauucugcagugucauguaguauguaguccacauaagauuucugaaauugucucuuuuagaaacaguauccaguugaguuuugauuauuaugauuuuuaaucuaaaauaaucucuguacuucuuuuggugaagagaaaguaauuugcuuuuggaaaaguucuagacaauugccuuagaaaauaucacauguucugaguuuucugguuguuuccuugugguguaauuuaccuuguuccucuaucccuauauucccuuucagcuagaaguuugguguggaaguuugauuagauuaagccuugacacuuuuugacaagaaacuucauagauaaugugcacuacuuuauauuuuauaaaaucaggagucccggaagaauuucagacgaucuccgugauagugcaauucuggaaugaaucaagaguugacuuuugguguuacugaugcuaaauaggccuuguauuugggccccaauuggagaaugccccuggaauuccacucagauacaagcugcagcaguggguagggguuggaugugagaguuccugacagcggcaugagaucauguauaucagugugcuuuguaaaacuagaaggaaagagacuggaaaugggaauucuacuaacuauuaggacacugcaguaguggaugaucaaccuuccuaaauuuugacuuuguuguuugcuuugaugagcugguaguuaguauaauuaacuauaauauaauuaguaaagaacauaauaaagugccucauaaucagugcagcacuguggaaaugaauaguauuuugccaugauuaggaugucaguccuaguugagaaauacuggguuaugucgaguggcagugaugccaguuuaugggcuggcuuauguuccuaaaguuagacuuucagauaaguaguuguuaucuugcagagaucuccaauuaaucauggcacacgaguacucuucauuaaaggaaaagagaaagaaggaaaaaaaauacacacacacacacacacacacacacacacacacacacacacacacacaucuuagaguccuagagggcagaaauaaucuuggggagcuuuugcaagacguauaugccugggccccaugccacaucuacugaaucggguuccauggggaaaacugggggaggacagggugggacccaggcaucagcauuuuacaaaagcucccccaagugauucuauuauguccuaagguuaagaaugauugcaguaagaagaaguaacagcaguuaggaggcugauuaugauaauggaacuucuuaacuuuaauuuuccuuagacuaaaaguucucugaacuccuuccucagaaaguuguauugaaauuccacacauuaggagccuaauguuccccaggccaaccuaccugggagaaauaagugugcugugacccucuaugucauggauaaauugauaucucauucuuuuguuugucauuuuuaugaaaagaaggauuuaaaauaauuggagccuagugcccaaaauuauauccuugugccuucccugcaguuugugguuuagugacugggcaggagggacgagaauucauuguaccacagaauauucuuucccuguaaacgaugcauuugcuucggggugaagucugauuacaaaugaaagugaaauaaugcuguagaccacagcauucugagcugcagagcugggcaugagcugaggaucagaggcugcagacacauguuggucagagcccaagccuugaggccaaaucuaacgggacuggagagcaauccuugagcuaaccacucagaaugggaacauggagaugcagaauuucccaugaaccagccacacuggaguaagccaguuaaaaacaauuagagucgcacuuuaauuuuggaaagacuuggccuguugcccuaguucaugaaggucuuauaaggaagugauuguagagcaauuugcaaauagaaagcauuucuaauacuauauuuuaguugcauuaggaauaaugauuuacacugaagccaggaaugagucagacguuacacaagcuuugaguuaagcacacucccugucuaaugcugagacuaucugaaaaaaaaaaaaaaaagaguauguaaauuuagcuuaauaucauguaagugcuaugggaauaauuguaaauaauuggauuauuaguaaggaauugggagugugggcagauuucuuucugcgguuggaguauuggacuaaaaacagcauaaccuuggcaaucuaaaugaaguacaggacgaaaagcacaugccgccaaaucggaaugacauuugaaaaccauguuaauacagcauuuaccuuccaagacauuuuuagauccaauuuuauuucauccagauuaugccucucccucuacaaucagcaauuuuuguuuaaaauauggaucuacaaauacauuuauauccacuugcuaaucuguacugucaaauaagccaguuugaauuuguuuccaaaauaacuuugucuauagugauaaauaucuagcacagaaauguacuaaguccauaguuucuauucuacauaaaguauucgccaaauauauaguauacuuaauaaauuggaucccuguggacuguugggaugccuaauauagauugucagaauuaacaacuaccaucucgauucuauguauuucauauugaaauaagaauaauacguuauugacccuggaaaagucuuaagggguuuuuuuuuuuaaugaagaucuuccaaugagaaauucacaugugaaguuaugaaucaguggcagacagaacugaaucagauuuguauuagcauuuuguagagugucuggauuuugcuggugucacucacaaaacaccauauuuguaucuauccugaaccuuggcaauccucauauauaagauaauuccauagaguaucuuggcaagaggagguggaaaaacaaaucccaacaguguugaagagaggauuauaaauuaaaauucauguugcguuaugcuuuuuaaaaaggauugaauauggcaagcuaaccugaaucuguuugauuaaagcauuugcacuugucucaguaaauuaacagaaagaaacaagccuaaauucucuuucuuguuaccuaacauggagaguuuuauuuauuuuuuaaauaaaagauuacacugcugugaucuuucuagucucagauguaggauauauauagucauaaaaaucuugaugacuguuuuuauccugaaaaggauucauuguaauguacacugaaugcuauguguaauaaugaagaauuagaggcaauuuaaaugauagacaguaagaaaauuacugaacacauucuguuauaacuugauggaaaauuaugcagcaauuaaaaucauauuguagaauagcauuuauuacaugggaaaaagcuuuggcaauguuaagugaagaaaauccagcaggauucaaaaguauauuuuuaguauaauccuuauuuuaugauuaaaaaaauaaaacacacacaugcauacacacaaaaucuuacguacgauaauauaaucaauacguuaucaaggguuucuuuagguguaauuacauuuguuuauaugcuacugccuuuucucaauugucuaaaguaauuacuuaauuuugaauuaaaauacauaauaaaauauugaaauagaaaggaaagaccaaacagcaaagauguauuuauuaaaucccuauagguauuuguuugggagaauugagccaaaaaaauaaagaugacuuugguauuucacuuuguccacauaguuccugcauuuuaaagagauuuuguuccaaauuacugcagugcugagugacuuuuucuucaucgaaagaacgaaaugagggcugagauuuauucaacagcucaguauuuaauacuuguuuauauuuuuguuugaauucaguaucuguggaagaagauagcagguuuugaauaaaucuggcauacaauguaaaauauuaaacuauaccuacagcuugacuauauaaaacuaaaaaaacaguagaguaagaaaugcauaaacaaaguaaaaaaaaaaagacaaaugauaaacagagaaagugucaggagacagggcuggaaagguggguggggcuauaucaugcagagaagagggacacagaggucuuaggcuugucuuuuggcauggugagucugguugcauguagauaucacucacacaauuuuugaccuguuugcauaucaccuguacuaguauuuaauauuuuuaaaaaauugaauuaaaagguuuuucaauucaucauccucauagcagacauaacugugaaaucaugagucugauauauuuaugcuguuucauaauacacauuaaaauuaauaugugacuacuaaaaucuaaaauuaucuugcauccugugagugggacauaacacuggcauggagggagggagcuggggaacuggggacucggcauuuggaccauccugucugucucuccagugcugccauagcuuggauaugguagucuucuuuacauauaugacuggcauggaguuuuguuuuuggaauucuucagaagguugaucuuacagcaugggcaucagagcagugcuguuucugcaacaccauugaacagaggugguucauugcagauagcagaggagagggaggaagagcacguagugauggggagcagauggaguugaaauuccaagggagggguuggaguggagaugcaagaaaaagaaagcaagagagaacacacaggauagagggaugccagcagauaagauucagcuauugccaaaacauuguuacgauccagaauguugacucuugcugguacuguaaugaaaaguuguccuuuuuuccuuaguaaauagcaugucugcgauguccuaugagcuacuuaaagaaagaagaaaauaaugaaagcaucccaguaguuucauuagcacagccagugauuuucauaaaacuguugcguucacaggugaaaggaacuuacuggggucauugaguccauuuuuagacucacagggaucacugcaccuaaacacuucugaaaaugaccuggaagcaugcaaauguugguuuguggauagaagcccaugagucuuaccccagcccagccucccuugucugucaaggucauuguagaaccacggaaauggauauuauggcccugauuucucucacaaggggacaaccuggguuugguccucugugcucacuacgucuuuaucuuucuuauuuguuguuggcucucucucuguaggaaaaaaaaaaaagaggcagaucuuauagcuggugguagacugcucugauuggaaauucucuuguggacuuagcuuaucccuguuuugcuuuaagaugguccuuuugccuagggguuacaaugauuucagaccaguguccucacucuuuauauuaaaaccuaauguguuuugcauggacaaaauuuuaaauucuuguuuguugguuugcuuguuuuguauuugaaauaagaugaccccaacucaaaagaaacagauaaccauuucuuuuauugaaggaacucccaggaagaaggugccaugacuugccucacugcaagcuucaaaauucuuugcuuucucagcccuaaauaacaauagacuggaagcucugugaggucagggauuuggccucuuuuagucacugaagcaucuguaucaggcauaggagcugauucaguguaggcacugauauauuuucuuaaguaaugaguggauaauaauauuaccauguuacauuuguauagcaauucacaguuguaaagaguuuuccauuagcucgccugauccucacaaugccguuuucaaaguggguaacaacugauguuuucaucccuauuuuguagguuaggaaaucggguucagaaguagaauggucuauccaaggccuuacacagggacagugaugcaugauucugucccugaaauucauuucucaauuuggagucaagcaagauggagcacagcuguuccucugcaugaugguuccugcuuuucuggauuuucaucagauuuuuauucuuuauuuucagauuacaggacaggcccauguuuuacugugaucagcaaccagaugugccagggacaacucagcgggauugucugcacaaaaacgcucugcugugccacagucggccgagccuggggccaccccugugagauguguccugcccagccucaccccugccgccguggcuucauuccaaauauccgcacgggagcuugucaagguaaacccgggcugauggaauuauuaauggauuaaucuuauuugcucuggagagccauucuccaaugaaguugaagagaauggaaaaguagugucagcuacauaacuucacaauuucgcugacugcaugauauccaacuaaggcauuaggaacguggcucucgagagagcagcugaagucuuacugaauguuuucuugccaaccauucccccuuucugaccccagagguguuuguauguaccucugacuccagggguggugugauucuguuuacagcgaugcagugcauuauggcagugcuguguagaaacacaaagcaagguuugugaacaagguaguuuauguuuuucuuaauuuuuuuucuucauuugaaacuguugaguuccucucucauggguugugcuuaauugaccugaagaaaauuguuucucucgacauuuugcaugcuacauuuugcauuuuuuuacaaguccaaaauaaauuaggauuuguuucacaguuuuaaauauccccagaugucgccugcuagcugcuucuccugccucccguagaagcccuuacucuguuuuuggcuuuuacuccuguucuuccagcuguacaaauucuuuuauugucuggaugucuggcaggaaacaggaggaagugaacagaggcagcuccacacuaaacugaugggauugaaaacucucagccuguaucuguuuccuuuagacagccucaggacuuuuuauagcaaguugcaauauuuucagaaacuucaggauaugcuuuucugaggcaaauagauaauacuuuggcguuguuuuguauguuaauucuaaggguaaugugcaauaaaacagaacuugagcuuagucacacaguuuugugggucuccauuacauuccacuucaauaaauuccacuucugauauugucauuccuggccuucagcucccauguacaacauacagcuccuuuggaugcccuuaaauguaucccucugaaugucaggagaagaaauaagucaccuugaaacucuaaaauuaucaagggauggauuguaguauuuuacaaaaguuuaguuguuuuuuggugccuucuuauuuuucccguuuuuagaaaaucccagugaguuuugaagaauuuguucaucuugggauuacaaaguuagcuaauacccaugaacuuguugacagugaccagagagcuagacuuuuaacugccucagcugcccaucagugacccauugucagagguuagggugcuaauggaauuggggggguggggauaaugaacugccuucucuuuagcuuugcuauucguuucauaaaucuggaucuuuccagcauuugcuuccuguuucuuucuaacucugcuauucaacauccaagaaaaaaaauguuuuuuauaagaaaaguuuugaaaacccauugaaucacaauggcaguuauauugcuauuuugagagugaaauucuucauguuugguuguuguuguuguuguuguuguuguuuuuucuaagagauucugccaccagguuguggcucuugcuccuugcugguguuuccaguccuugggucagaugugaggggcugugggcaaauggguucauaaaggagcuuauucugucuucagaccuggaguauacagccaguggagaauugccuugucuauauuuucuguuggccagaaaucaugaucaacaagacagcuaguucugccuauauguaaaaaucuugauuuucaaaaacauuuuaaaaaauacauucaacacaucaagagaauggaaaauucuggucuaagacaaaacugaaauuggcuagaaaacauaauuuaaugauuuuccacauauaaucauguaucuguggguuaagauauuucauuuaaaacaguaagugauacuuuuauaauaaacuaaauuguuguuucuuuaauaucccuuuuacugcaugcugacuuuucucaagaacacagguugagaucuuauaaacagcaaucacuuuuuucuuuacucaaugaagagugaaacuaaagagcacauuaagcuuccagguuucaaaaagaauacauuagacuguuugcuuggggauucuuuauuaaaucagacuuuucuguuaugaacaaagagauggagagaauguacauguacuuuauaaucuuuauaacaaaaguagugagccugaaaugauuaauuuugcuccuggaagguuaauauuugggcuuacacauaagaacccaaguuaguccuuaggugcugguuauacaacagugaagaaaauggacaaagucccugcuuucuggaagcuuauauugaagacauuuugaagacauucaauuuauuaaauaaaacaaacaggcauguauuaggucagugggugguuaguccuguggaaaaaaauaaacagggaaggaaggaugauuagagccagcagccagguguugcuguuggacugucaagggaagggcucguggcuaaaguggcauuggagcacagaccuggaggaugagacaucgugggccaugcagcucucuggaggaagacuauuccgggcagaggggcagccuuacagagcucuguggcaggugcauccuuggcauauuugaggaauccaguguggugggagagauaggaggguggaaaauggguaaaagaucagagaagucaugucgaacuccccaggacauaguacacacuugcacguugagcuggggaaagacaugaucucacugacauuuacaaaaguggcuucugguggccacugugccagcaagguaagucugcagcugaaacuacacacucacucaccuaacaaucucucucacuucuuggccuaauuuucugaguuguuuaauuuuuacugugcaaggcacuucuccagaaugugaagugaacauuuccacuucauuugcgcaaaaacauuagcugucucguguagucugagugaccuucaauaaauuccguuuuaacuaaaucacucaguacaacucuuaaagguaguuucauuguagaaauguauugcauuuugauuugcaagauuuuuugaauaacucugauuauuacuaccaaucuggagauaaaaaugaggccgugaauaauggccuuuuaaacguaucuuuauacuuugcugcauaugugcuaaaacccgcaaaaguuaaugcacucuccucuacauuaggaaacauggaaggugggaaaacaaaaaauacuugugacuucuuauggaacauuauuaaucaaacgauguauuuuacauaaugcaauugugagaaacaguuucucuaaucauauuccaaauauugugauggacaaauaacucaccgauauaaauaugguaacauaauuguggacaaauuaucacauuuuauucugcaaugaauuucauaugaguuuuuuuuuuuucucucugucuucuguaaucugacagauguggaugaaugccaggccauccccgggcucugucagggaggaaauugcauuaauacuguugggucuuuugagugcaaaugcccugcuggacacaaacuuaaugaagugucacaaaaaugugaagguaagaaaucuuaugcuuugcaguugggggguguagugggggcaggcaaaacucaacauuagaaacaagcuuguuugcaaauuauuccuaaauccuucugucuuugucaucccugugaauguguaaauauaauauuuuuaacaguaauaauaugccuuugugcuauuggaccagaaaaacccuguagcuuuuuccacuuuuauagacccaaaacaagagguccaucugaaucaaauuaaauauuaaaaacaugaaauauuuuugaaccaacauuugguuuaaaauguucaacacacauguuuuugcauaguucuagagacaugaauuuaaauuuggucauuagauaucauucagaauaauauaucuuccgaaguuuuucuaguuaaaagguauguuugauuuuguguguggggaggcagauugaucuauuaacccuuauauuuaugcuccuaguacaugcucaugauuuucuuuucugggggaugguaauugccuaucaaaugaaaagcuuuuaauguuagucaaacagaaaaguaauuugagauaauuuuuauauuuacauuuaguuuauagauugaacuucuacaaauauauauacagaggauguguuuauagucaccacuacugcuacugcucuuugccgaaaugaggccugacuuccaauuacagucauaauuucuucgugagaggggagcaucuagaaaauauguaggcagcauuggacucucuuuucuuugaugagugcauguaacuuauauauaguaauguccaacaauaguguaacagcauucucagggcuacaucucucaucaagaucagaagagaaaacuuuuuccuucauccucaacucaccccaccuugagguuucacuuagauggaugcauuuuuauugaaaacagaugcuguuauauuuaugccccuagacucuaacagugaguacauucuaaguuauuugucugggcuggauaauuaaccuugucaguugccacuguauaucagaugagcaaaagacagcuuuaaauuuaaggugcaauucauaaguuacauguaagacauuuaauaucuacuugcccugaaacugaauaaucuaacucugauagaacuaucuuuaugaguuggaauuguuuuuagguuauaaaucaucauugaauuuauaauugauacugcauucuugaacauguuauacauaguuauucgggguaguugugaaaaaauaguucuuucuaaagacuucuuaaaaaaacauuuuaaguuucaaagaacaauaaaguugacucuugauaggccaauguauuuuagaaguuguacuguagaucuaaauuugaagcagagaauguuggcacugaaaggggcaaagaacucagcuauuuccacacucuacauuauauauuaaggaauggugucuuggguguauuaaguacccugucugaggccauucagacaagacugcucaaauuuaccucuuuaacucacacucuggugcuugcugagccauauuacauuguccucuuuccuagaugaaaguuauuauucuggaauagauuuucgggccauauacacacacacacacacauacacauauauauauacacacacacacacauauacacacacacauaucuuuauauagacacacauauaucuauauacacacacacauauauauaugacauuaacuuaacaagccauuaaaguuuaucacaugcaaaaccuacaucaacgauagguuguguuuuaucuuuuaggcuuucucaguuuaauauauucagcuucagaauauauaaucagcuucaagauugaggggaguauaguccuuaugacuuguccagucuguguuuuguuuucugaaauuaugauggcuuccagccugaguagaauugauuuugucucuugcuuuucauucagacaagucaauuaacaggaauggucuauggauguggacuagacagaagauucuaauuuaaugcucagacugaaagaaaaaucauucgaaucuuuuuauugaugcuaagaaaccuauuauggugguguauccaguggaccaaaaacucagucuauuacuuaauccuuuuccacacacaaaaauuuuccagcuacaugugaaagucagcagcaagauaaaaacagacuauuuuggcuagauuuuuuuuuccuuugccaucuacuauuacauuaauuuagauaaugguuuuuuccuucuuuuccuucuaguaucaaugcaaaauugauacuagaggagaauguccuguuagugcuauacauucucuggccuggagacuggugugaacaggguugaccugucuuacucugguaagaaaguaaucaggaaguacccugagagcucuuggcaagccggguucacuuuuucgacguccuugcucuuuuccgguuacagugucucacuguggaaauggcauaacucugggcaucggcuggugucuagauggccaauagagggaacccaggaagucuggcccguaaucacugaauauguucccuagaaagaugaugaguauaaccaugggguucugugcccuugugaaaauguccugguaccuuugccauugcuuugaguggcuuuuuaaagguagcuuccuuuagacuuggaggggaaggaauugaguacuuuucauagaauuuuuucaagaaaaaccaauuccaucaaauuggcuuuagcaaauucacaagaugcuaacccucacgcucucagaucugagaaugccauuauucgaguugcuuuccaugagaucuuccucuugcagaauucucacuuccuuccuaaaaugucccucuuuccaaaaacuaaaaaaaaaagaaauguuacggaaaaguguuuuauaaauacauauaauuggaggacauuuugaaauguaaauuaacaaguugaagggauuuaaauaacaauuauuaaauuuucauacauuuaagaaggaaaagauugagauuuauagcugugauuugagaaaaaaggaaagaguucaugcccaccuucuuuguugaucuuuccaaugacuguagaguacgcaugcugaaagaacacaugaacauuuuucuuuggaaaccaaguccauauuugcauagguuacuaugggaggaaauuaagaaauaaaaagcguaauuaagggauuaaguuuuauuucuggaagaaguccguuggauuccuaauuaaccacuaauauuuugggauuuagauuaucgccagcccagccuuuagcaauuauaauagcacugcaugaugcacaggaccuuuuuaaaaguguagcuuuuaaauccaugcacuccauaauaugugagccaaaaaccucaggacuuccccuuuccaaaauaauagcauauuuaucucauggcuacuuacuguuaggggcucuuauccucucaggagcuaaggagaauucccggggcggcuuaacccacuaccauagauggggcuccauccucuuucagcuguuugcaggcccuagacuuucacuguucaagguaacuggcucucucuauacaauuaguugaaaaaaaaaaaaaucucugcggugaaggucaaagagcccuggaaauaaggcaggccuggcucccguccuugaugccccguggucaagucccuaaugcuuugugugaucuuagauaagucaauuaccaucucugaguuacuucagcuuucaaaugaggggguugaacaagaugcuauguggggguucuuuccaguuccagaauucagacuccauuuucaaguugugaucgggcggcggaugcagcaugaauaagaauucagacuccauuuucaaguugugaucaggcggcggaugcagcauggauaagaauucagacuccauuuucaaguugugaucaggcggcggaugcagcauggauaagaauucagacuccauuuucaaguugugaugaggcggcggaugcagcauggauaagaauucagacuccauuuucaaguugugaugcggcggaugcagcauggauaagaauucagacuccauuuucaaguugugaucgggcggcggaugcagcauggauaagaauucagacuccauuuucaaguugugaucgggcggcggaugcagcauggauaagaauucagacuccauuuucaaguugugaucgggcggcggaugcagcauggauaagaauucagacuccauuuucaaguugugaucgggcggcggaugcagcauggauaagaauucagacuccauuuucaaguugugaucgggcggcggaugcagcauggauaaaagcuggcguacgugaugugacuauaaaauaguauggcugacguuuuugucaacaugaagagucagcuuguuuaguuuuuagugauacauuuuacacuggguugaguuuguacaaucaaaguuaagcucacaggcucaguggcauucaugaucauuagugugucacauguuacuuuuaaacagcugccacaguuuuuaguuuuuuucucucauuguauuaguaucuaggcagucaggaucagguuaacugucaggaucagguuucucuugucaaguccacaaucuuggauggagcuucuagauagccaaguaauagauggugaugccugucccagaacagacaccaagcuccauccaucugcccuccacacucuuuccucccauucugccagaggagcccuaggaugaaggggcuuaggcaugggaagaaugcucugggagaacagaugagacugaaggaugggaaggagcagaaacaaaggacagguggcgaauaaggaaggaagagaucugccauuugugacucuucuuaaggucacagcaagaagccaguggggucauggacagcuaccaugggacagcuacuccccagcagcucugccuccuuuucugccucaaggaagcagggagaaauguccagagcacggaaauagcucuucccagccaagcaccacuccccagcaagcguccccaccugguuugcuuucauggcuggcauuugacacagccugauuuauagaaacugagaaagugaccguucucaaauucccucuuaacuugggaugccucaaauucaauuaaaaggagaugaacacagagugggaagaacuuggagaaauaauaaauucauaugaaugaguuucagagugugagucaauccuauucaaacaccuuauucuggccuuugcugucgggaacuuuccaccacagccugguaauagauagaacucuugcuuuuauuuguuacgaagccaugccacugagaaacaaggugguuuaggaaaggggaaaggcacuagacaccugaaggcaaaagggugugucacugagaaggggacauauuaaggggaauuugaagucguuuaagcucuuucaaauguaacaauuuggccuagucccauuuuaucuuaaucuaugugaacucagggaggugugcacuaugacauauuuccugaccugcuggcuuucaaaggcauguaccuagguggaaacuccccacacccacccuaaaaaccccugccaguuggagacuuggguuuagccucacuuuauaaaugaugggccucuuugcucuuauuucagguuugauucaugucaguuuucugaaggccucaguguaaugcaagaggcguaccugggcaccagagguauagaaucaggcccacaguccuaccugcauuauaaggauuagaugauuggguacacauaaagcauuuugacuaugucuagcacucagcacaugcaaacucucaucauuauuguucuuguuauuguuaucuucaauaaagggcccaaaucucacucagccagcauggaaaagauguuucccccauucugccaauguuaauucuauuguuuaaacaaauuuuucugacaugggcugucauuuaaaccuuuuagauauugauguacgcuaaguggccuuaauaagaaugguagcugucauuuauauuaauggguugagaaaaaauauuuaauaccacauugucuccucaugcgaucuuuggcagguguuguaggacucagauacuaacuuuuagggacacuuugaaaaagguacauucuucuuaauuacaauuauagcuuccucuauccuuaaaugaagcuuugaauccuguaggcucuuugacauacuugcuuuuuguuuguguuaaguagaaguguggcugccuugagauauuacguggguaacccuaggcucugucugcccuuggcaguuucucuaccugacccuuucacagacucuaaugaaauuucuaucugucagaauagaauaugcaccuuuaccguuacauaauuuugcaaugacagugcuguuuauguuagcauugacucuaauauaagcagugaaauauuguuugguuuagccucuagccuagcauggaagaauggugauuuugguuuuaaaaagguuaaacugcauguaaacacugucauugcugccuuuuuuacuaacaaggugaacuugagucagaagauacuugaaucugguucacuuagaacucuauuuugucuuauaaaugaagagaguacuuagccuguagaauaaauguucuuauuggggguuguaagccuuucccaguuuuaacggugucagccuggccauuguaauacucccaggaggccuggcucaaaugucuccuuucccaaggucagugcagaaagcucugcuggucucagagaggaggccaugcagauucccugugcccugaguuuacuucuagccuaagaaggaagcugucauuuuuuucucuucuucugcuggugccguaucuguugacauuugucagugugugggucaggcuauugaaaaccucuccuugaaggaaauggccauauuuguccuaagggaauuuuacugcuuccuugaugggaaccaguggugucaagcccugagggcuaaccccagcuuuggccuccauagcauucaggauguuuauuagaggauguccuugggaucaacaccugcagaagagaagaggaagaggcaagagcgugcagagaaggcaagcuggggugcagcccaucaacagccuccacuggccccagaaggaauuggggaaucggaggggccuucaguguugucucccauuggggcaggaugcaccagacuuugauccuccuucacaauugcuuauugggugucgggugccugggaagggugugaccucgggcgagguggcucucugcgacucaggcaaucuuagaaggggcugagagccaaagaccguguguugacaguauucccagccuccugggcagcaagucccucuuugaaggggacguugguuagggcacccaguguccaucacaguucauucaccaaccacagaagaccaucauaaugguaguuugggugccacugagaacaccaaguuggccaaguugggaucagcacucagaccacaagaucucuucuguaggauuccaguauccgcguuguggaaaauagauugaaaagcagcgcaagaagugauacagaauauaaaauaauuaguaggagaguuuaacuuaaugcaaaacauggaaacaaaaggaaaacaaaauuuuaaaauaaaugacauuuguaacauuaacaugcuauaguuacuuggugaaacaacaguacacagguuuagauuuuaaaggggggugauuucauuuugcccuaaucuguugaauuugguaaaucuuuuggguaagucuguguugaaagaagcagcaucuaccuuugaauugacuguucuccaugcgguuuuuacuuuuuaaugauggcuguuuccagggacaugauuugacuaguguuaacaucugaguccuucuacugacgaaugguuuuauauuguguucuacaaaugcugagauucuuuuuuuuauauuccagauauugaugaaugcagcaccauuccuggaaucugugaagggggugaauguacaaacacagucagcaguuacuuuugcaaaugucccccugguuuuuacaccucuccagaugguaccagaugcauagguagguuuaaugacaaacagcaugcaugguuuguguaagucaguuccauaacaaacaacuuucuaaacaagcuuguuaaggagcacauauaauuuaucaacugagguaaaauguacauuuuuggaaaaauguuaaacaguugacugcccucuuaaagaacagaggcaccuuguggucauuuuggagacguuuugccucccauaaaagagggaugauccaggagaccuuacagguaucuucagucuauuaauuaauguugcagucgugcagcauuaaaccuugaagccaucccaggugucucucucuuuuuacccccaccuucagucauuccccagaaccuauguuaauuuggccugaauuuuuucaauaaucucuuaauuggucucccugcuucuuggcuucucuacaauccaucuugucagauuuaucuuccuaaaauagugcuucgauuaaauaacacucuugcucaaacccucgguaguuuuccauuaggacuuagaaauuagugguuuucagucuguguccaguggauccuucaaguguuucaaagcccuccagggcugcagggauugcggagggcacagagaaaagggagagagcugaguggaaagggcucuuguccccccacacucccacacacauucuaggcauagcaauuucacuuuaucugcugugaguguuagacuuccaugucagguaucaauuaaaucagggguucuauuguuuaaaaaauagauuuggcugggcgcaguagcucacaccucuaaucccagcacuuugggaggccgaggcgggcaguuugcuucagucaggucaggaguucaagaccagccuggccaacauggugaaacccugucucuacuaaaaauacaaaaauuugccaggcgucguggcgggugccuguaaucccagcuacucaggaggcugaagcaggagaaucacuggaagccaggacguggagguuccagugagcugagaucacgccacugcacuccagccugggcgauagaacgagacuucaucugaaaaaaaaaaaaaauagauuugacagcugcuggauuuaauaauuguuaagacuucuuuaaaagugcaguguucuagauuaaaauucaaguuccaaagugcacagucugauauuuaaggauuuuaagagagcuucaaacuacaugaggauuaagacauauuuacauaucagaugguucacauuuuaaaaguuacuuucuuuuuaucaaauguauccauacuaacuuuuuacaaaggaggaauggaagggaacuaagauucauggaucacaggguaugagguguuuuauguaaauuaucugacuugauguucauuucacagcaguauuguagaugggaagcagcugagauugagagagguuagauaaauaauggcccaauaguuuaaguggguagugagagagggaucugggauuccaccgugaccugagugcacagcccagauuucccucauuuugccuucuaccccucaacucuggaugcaguucacucuuucuugccagaucccuaggcaagccccguuucuucuuugcaacucuguugugcccauaauuagacacuugucauacaaaaugauccaagugaccuuucugccuucuggugcuccuauuucccuccaugguaagcaacagagacccccaaaauuauccguagugaugagaaaauacaaauagccccugacaguauaaacaaauccaaggcuuguucguaagacaguuguuuggaaugaguaggucucaccaauagaaaaccuccuauguagauagugguaugcaguaucuuccgugcacauuucuucuaaccguaaaauuccaacugucaccugcugccaccacauucugagacucucagaccucccagccccgagcucccuuuguguucuaagcucuuuuaguauuauuuuauuucuuguucugugaucuuccuguggcauuuguaauauugccuguaggguugucuuuuuauauuguuguguucucucucuucgacuccuaggagucauaaagauguccuuucccuaguuugagccucacaacuccuaacuccugguuguacacaaccauguucgugacagguuaggagaagccuguugacaggcuagacgaccugcaaacgccuauuuaauccauaauauauuugcuuugauauaaugugauuucuggguccugagaauaagggccaagugauucaaaaggggagaaaagagugagauuuccuccuccucuucgccagaugucuuggccagggcagauuuaaaauggaagguguuugugguuccuucugugucccuuuauguccccuuagcuugaguccugaaggucuucaaguuauucuacagccaccccuuacccucuguacaaagugacauaccaccacaacgguucccccccccccccagccacccuugguguggcacugcugccuaacgaagugaaaaacuucaggcugcuguguccuggaggucauuuacuccaaaugguuuccaauuuucaguuuuuucuuccuuuacuuauuagccuguagguuuucauuaaaauuauaaguuauauaaauguguauuuuuaacaaaggugcuucuucagcaaaaaaauaaauuagaaaaauuauuauuauaugugcaggugccaucuguaaaucagggacugccaguaacccaaacuugauuuguaauuuuuuuuacccccaacauucaccauuuugaucaagaguuugugauccauugauuuaacauauaagucagccagaugggcaauaacaugguaucauaguugauuugcaaaauaauagacauuagcccauuaagcuuuugucauuggcaacuguaggcccuaguuuugcucugaaagauagcccaugcugaaaauuauauguacaaauuccauaauuuggucaaguguuuacacuggguuuugaccaccgaauucauuugaagcugggauauaagccaguuuugaauaucucuucccauucugaacagucuuugguuuccaugccccaaauauuuacuaauucccaaguauauaaaguauuagugguuuuaaggcauuacaaauuagaauguaggaaguucaauuucucugcccucuugacgggggagguaccaccugaggcuucacagagagcauacuugucuauacucccucuccagccguuuauccuggaccaggcuggaauaaaacuuguucugccucuuuggugaaacuauuagucugaccagagguacaggaacuggaaccacaaaaaaauucuggaaagcacauuuauacuggcuagugguuuuaaguacuuuucggaaauaaucuuguauccuuuaaaacugacccauaauuuucuuuuaugguuugucuagguugguuuuagucuucuucacuugauguuaauaauuuaaauguuucuaaauuagccuuguuuuuauuuuauuucauuuuauuaauuuauugaaaccucaagacaugagggcuuuguguucuuaagaaugauguagaugauaacaauuacagguaugacccucuuugagaaaacuugaaauuuaauauucagacuuacaggaaacccagggauggauuuuuggcuaugaaagaucuuugcuuuacaaaaggauuuaacccuuauauuccuuuaaaucagugguccccaaccuuuuuggcacaagggacuaguuuuguggaagacaauuuuuccauggacugggagaagaggaugguuucaggaugauucaaguacauuacauuuauugugcacuuuauuauacacaauaaaguguauuauauuaaauuaauuaaauuaauacacaauauuaauuuauuauacacaauaaaguguauuaaauuaauuaauacaaguuaauauuacauauuaaauuguaauauguaaugaaguaauuauacaacucaccauaauguagaucaauggaagcccugagcuuguuuuccugcaauuagauggucccaucugagggugaugggagacauuggcagaucaucaggcauuagauucucauugggaacacacaaccuagaacccucgcaugcgcaguucacaauaggguucaccauccuaugagaaucuagugcugccacugaucugacagaggcagggcucaggcaguaaugccagcaauggggaguggcuauaaauacagaugaagcuucacucauucaccugccgcucacccccugcuguacagcccaguuccuaacacgccacagaccagaacuggggauuggggccccuggggguuagagaccccugcuuuaaauaacaagcauauugacgauauuauuugcuuuucaaaauuuaauuuuauaugaucucuguagagauauaguuuacuugaagagagguacacccucagcacaugucaggcaguaaaaguguuuugcauuuugcuuaccugccuucacuguuucgugguaauaucucaaaggcauauggagaaguuagguuuuccuaugccacaaacucuuuccguaacccagagcugcgcugcagugugucggaugucaugacaauuagacaugauguaacccaauaaaagugauauagaaaugcgucuuaccauguugcuuugagaagacacuuucugccaaaaacaacaacaaaauccuucuagagcuauuguauccuauaggacuaagaacuuggaaucaagggccauuuugaaguuauaaauaacuaguaccuuauaaaaucuguuagggcccuaagacaaaaggaaaucuugauuaauaagcauuggaucuaaaugcaaagugacucauucuucaaaaauaacaacaacaacaacaaaaacuuaugucugacucucacaguugcagacuggaaaauaagaaagaucuuuuagaaauguagacuaaauguuguuuuaaaauagauuuacauauuuuccuaaaauggcucgaauuaagcaguuugaaaccagggacaacccagucucucuucagcauagagacaugucuuuauaaauaauaaacugucacugcuagugauuuucuuagucucucuuuuccuauggcacacaugguuuuaaucacucguucccaccuuggguauggaaugugggacuucagccaagugcacuagcacacaggggcaaaaggugugagaccagggauuucugacugagcacuguuccugugcagcgcucgcagcuucccuuccggggggcagaggugugaguuaauccugccguagccccagugugaaguauggagcugcucgggcaggggaguguuguuacaaguauuaucucagcgauguguguguguguauguguuucuuuguccucagauguucgcccaggauacuguuacacagcucugacaaacgggcgcugcucuaaccagcugccacaguccauaaccaaaaugcagugcugcugugaugccggccgaugcuggucuccaggggucacugucgccccugagaugugucccaucagagcaaccgguaagagcccuuccaguuaucugcagaauaucccaucccagcccucacaagcccaguggcaaugugcaugaugcagauguaauggaaacuuggguaaaugaguagucuccaggaaauauaagagaugacguccagggaaauuucccuagaaaaugcacaggaaaaaaaaaggggucuguacaaagaguacuguuuucagguacugcuuuuuacuuagcuggcuuauuacuacuaaacagaaaccuuuuggggaaguacuuauucucauuuuaguacuuaauggcucucauggaguacucaaaagcucaguagaguaaaacucagcuuucagaauuuuucagguaaguuguucaggagacacauuuccuuuuuccuaacauuggacucuuuccuuccugcuaaguccugcuuguuuuuuuuuuccuucacaguaucucuuuuaucuguccauuuuuuuguuucuauuagaagcguauuuucucuagucuggacuguuccaguagucuccuaacuagucucugaaauccaccauugccauguaccuuucccaaaguaugagucagugaaguucaguuuaaaaaauugugucuaggggagaaaaaggagacaccuuuugacuaauugagccuauuucaaaacaccauguuguacacaaugaaugcauacaauuuuuauucauuaguuuaaaaauacauaacuaaacaaauacauaaauacagcacacuuucguuagucgagaaagauguccaaaaauauuuccccaggaugaacucaggcaauauuuaguggccaauucacuccauuucuugcaaagaacauuugcuacuuagcacaguauuuagagucccaaaucuaaucccaguucaucuuuuuaauucuuguucuuuauaguaguuuaaauuauaugauugaguuuucauugcacccaauccgagcauuucugaauucaaguuggcuuuuuuuucuaaaacuucuugccaguucaggcucuuucucccuacuccugccauccuugccuguuauauauccucuuuucuuguuaaggaucugcucaaacaugaccuaauccaugaauaucccgagguaccugcagcuggaagugcucccuucuuccuugugcuccugugguucuggcugguacuaucacuauggcaugagugccauauguguguucacaucuugcucuuuuacugguugaucaaucucauuaggaaaucucauucauuauuguagucucauauuucucaugcuuuuuacacuuccauaguauuuagcaaaaucuugcuuauaggaggcauucaaauacagagagcaacuuauuaggcaacaucuuucccaccaauugagcauauuucaaaacaucacguugugcacaaugaauauauacaauuuuuacuugucaauuaaaauacuaauacauaaauaaacaaauacauagaugaaguuuaccuuccugaguccaguaggggaccauuuaguagaucacuguuuagaagcacaugacuuccuacuaagacauggcuuagguaccaggagaauggcuuuuaaaaugcauauguuaacuuaggaaucagcagcuuugauguggauuccuuccuguguugaggcuuugaauagagaagaggacuagagcagguuuaggugccugcaggaagaccuacuuugggacaguuggagcagaagaccagguuccuguguguggcuuuacagggagcuguccucccagguauaccacugagagaugcacagcccucagaggccuugggcaaaacagauuuauagagcaaaauaacuugcagguagguuuuuguuuguccaaauguuccaguacuggugcuacagagaucugggcucuuacagagagugaugcaggaaggauuuuagauuggccagcuuuucacucuuuaaaaaauaaaucagcaucaucuuggguuaaguggagauaggaaagauggacaucagcuuaacaaaauuagccccacguugcugauccugaauguaaaggggcaaugagaagauuacuaaaucuguaaaaaauaggaagaaauaucagauucagucugauacaguuuccuagagagguuaagaugaauuuaauggcauucuuaaaguaaaauacccaccuaauuagcagaaaugcugauaagcuauuaaauuucuuuuauauaaauucaaaaagucuuaaaaagaaaggccgaauugguaccuacaaaugcuuggaagcaaagugaguuccuuaauguaacugucauuuaauaaaauuaacacauaguuaaugaauuccuguuaugugcaauuugcagggcaaggcugagagugggaacuagucaugaguuagagaugaucccugacuucacagacuacacagucuuaguggugggaauuuggugagagcagguucccagggaaugguggauauggcacguacagaugauaaaucuauaggaagaaucacuguugguugacaaacaggauugagacaucuugagucagggaagcaugaacaacauagaauuccuuuacaaauacauucaaguacgucaguaucucuguaauuugaaauuccagugaaaucguaauuaaaaugcuguaagagaauuaucugaaaacauaaacuugaccugagauggaaaugucaaauaugaaugaagaaauuuuagaaauggaccagaaaguaccaacaguacuuuccuauuuaaccucauguaaauuggcagaaugucccgugagguugaaauaugaaugcauuucaguaagaccuauuacugucugaaaauaaguuaaauuuuagucuguaaggaaaagaaaaauauuagucuaauuucuauuaauggcugaaacuagcauagaagguauccaugagaaaaucacuguacaacugugaaaauaaaauuaccaaaauccuagcaaaagaggaaaaaaaugaaauuuaaaagucacauagguuacuuauagaagggaacuaugaaaaaacauggcuauuuguaggcaacaugaaaauaaauaaaauaaauacauccuuggaaaccuggauacugcuuaaaaacaccuuuuuggaagcccagaacaaauguguggaaaccuaaagaugauuuauuugauaaagaccugacacugugaaaaauaguaaucauccuaaaaauguagaaucauagggaagcagaugaugaagucaggauguccucauucagagggucacuaugcagcauucauacccgacccacaccccuugguguuucuccucccuuaugggccacuucuccauugauauugcuuucuuuuacgaaucaguauucuucaggguucugucuuugcacucccuucucuuccccuuccacaccacucuuacaugagcucauccauccccauggcuuugaguaucaccucucuguacugaugacucugaaacucacgucuagccuugauucgucuaagcuucacacugucuuuuacaacugcgaagugauagcuccacuuggaugucugauaucucaaaacuccuauguucaaaauggaacuugguuucuacccaccaaaucugcuaucaccaugauuuuucccguccaggcaagggcaccaacauucacccaauugcucaaccagaaaacuaggagucauucuugacuucuuguguccugagcucugacacuuacuacuucacugagcacuauacauuuaucucaaaaaucuacuucacugaacacuacacauuuaucucuaaaaugugcuucagauuuguccacuucuguccgauucaaucacugacucccccauccggacaucaucaucucccccuuggucuucugcaacagccuugccuccccgcaguaauguucuucauauguuguaauuguaagcaugaucuucugaaaauggucaucugaucaugucccacccccguugaagacauccagugguuuugcacugcgcauaaaauaaaauucaaauuuuuuaauguauucuguagagcccuguggaauccacaggugggacuggauggagaaaguaguacuuuuauguuuuccaugaggugaauuuugauacagauaaagacucugagguuuugggaggaacaugguuuuggauuugaauuauuguuccagagugguugcugcugcagguauuaaaaaugggaauccagucaguugguucuuuuucuuuucuccaguugaccugugaauuuugaggaucaauuuuauucaaaaauaucuuuaaaaaaauaaggaugacuucugugggccuaugaucauaagcuacagcucagcuguuguguuuuguuuuguuguguuuuucuagaggauuucaacaagcugugcucuguuccuaugguaauuccugggagaccagaauauccucccccaccccuuggccccauuccuccaguucucccuguuccuccuggcuuuccuccuggaccucaaauuccggucccucgaccaccaguggaauaucuguauccaucucgggagccaccaaguaagaauucaaaaaucaucuaguuauuuuucuugcauuguucaaguuaacauuuuuuuauuauuuauuuaugcuacuuuagucauuaaauaaguuuguaaauuguuauauuaauuuuugguuuacauaauguuaucuauaucuauaucauauguaugucucaauuuuccuauugcauagagaaaaacgggaggcuuccuauucuccagagauuaauguccuuuuguuauugguguuuucaggcaacuaugggagaguuaugggcgauaguuaaaucugauucacagaaaggauuaauagaggagguauaauauuagacuuuagguuacagagcuugcaaggcaguuuuauaaguaguucaauaccaauaucucucugccuuuguuauuucugcaaacuagagguuugagagugagguggugaagagggcagagaaaagcaggcugcagcuggguugugagcuccccagugcucacagugcaaugugaucucuguuggcaggguggaaauaugcucuguugucaccagacgaccuuugcccaaagaguauccucuuuccuuucugauucaacaucuuguucauuauugucagauuaaguacugaugaaagauaccauaguuaaaauaauuuuaauggggcuuaauguucuucuaggggugcugccaguaaacguuacugauuacugccaguugguccgcuaucucugucaaaauggacgcugcauuccaacuccugggaguugccggugugagugcaacaaaggguuccagcuggaccuccguggggaguguauugguacgugauccauccuagguuggcaccaagggucuguuguaauucuguuccuugacucuacugguuuucuauugcugcuguaacaacuuaccccaaacuugguggcuuaauacaauacaaauuuaaauuaucuuucagcucuguagguuaguaguccaacagaagucuuacugggcuaacauccagguguugggagggcugucuuccuuuugguggcucuugggaggaauccaucucuuugccuuuuucagcuacuagcagcugccuguguccuuagcucaugaccccuuccuccauuuucaaagccagcaguguugcaucuucaaaucucuuugucucucucuggcucucucuugcaauucccucuuccacauuuaaggauauuugugacugcauuuggccaccuguauaauccaggagacucuccaucucaagaucacugauuagcuaccuuaauuccaucuacaacuuuaauucuccuuugcuagcuaaacauauccauagguucugggaauuaagacaugagcauauuugggaggucauuauucugccuauuaaaguuacuuuuaacuuucauuguaaaagauacucaaaucauuucugguaacuccaauuuaagacacccuaccaaaagcccuaccauuaaaagaaagcguuaaaaauauccccaaauuauggaauuuugcacauuauacuagucuaaauguguagcuuaccaacucucuuagacuaguuauuuuaaauggaagaaagaaaguuuaaauugcugaugaggcauuuaagcuggugaagggaggaaauguaaugaaagaauaaucaauuuuuggauuggauaagaacacucagcuccuaucaacuuguuuuuaaaauaaguucaccucuuaguucuguuaugaauucuacuuuuauaauuauaaauuuaugauuugucagaaaugaugaguucuuacuuucccaaacuauuuaauuuccugaugauaugaacaccccuucuagaggucauccagagcugaguagaagugggaacaucuaacucaggguugcggaaugugaggucaaaucuguaucuggcacuaagaagcauguggacaaguggguuaucuuugcuaaauuuuagcuuccucuuguuuacaaguagggucauauaaaccaguuuaucucuaaauguacugauaauucuaagugacuguaaaacuagugugagccuguguauugaacacaucuggggaugggggagacucuguggugauugagaacugcccuuuaaacaacaguugcuucauguuuuguucuaacauuuuaguggaacucagcagggaaugcuuggauaugguuagaccuucuuuuuauuggaaaaaaacagagcuucaagagauacucggaauccuauccagaagccacuucugaaauguuagucuguuugguccucuuagaucagacucaaggaagaaaaaauguuuauuagaucagauuguugaguugcuacauguuuggaauuuuucucugcaaaaugacacaugaaaauaauacacuuuaacugcucaaccagucuucaaauggcuaaugacauauuguaguggaaagaaaaaagauccuuuuauuauguuauuuauuucucaaaaggaaaauguuuuauauguauaaaaggaacccagaaagucuuagaauuaugagguauugcuauguaauuuugcacuaaaauacauugugcuuugcagauguugaugaaugugagaaaaaccccugugcugguggugaguguauuaacaaccaggguucguacaccugucagugccgagcuggauaucagagcacacucacgcggacagaaugccgagguaugguccuggcuccugacguggaaugugggacauauaugcuaacuggggguuggcuucaaaggaguuccauggaguuuaaauaacccaugccggaagagacuaauacagucccguggcuuuuuugaacuuaguuccaccuauugucauucugaaagacagugucauaaaaucuggcaagcauugaaguuauuuuauaagaugcgucuaugccugaaggaaaaucuuauuuucaguauuguugucucgucacuauuauugccucuuaaguuuucaucugagaaguagagaguggaauuguccuuuaugacacagcaacugaggaaaauuucaguugaaauuaugugcaauuaauuucuuaauggaaaguucuaaaagauagggaugucacucuaagcccuugcugcuuuuuaguguggucagcaacagcaucuccuagagcugcuuggaaaggcagaaucucagguuccaccacagacauacuauugcagaaucuauauuuuaacaagaucccccagcaaucuguauguacauugaaguuugagaagcacugcuauaaauguccccucauaaaaaauuucccaucagguuuauuaacuaauuuauuaagccacccaauaugccuuuuauuaaaugacucuuauguacugaguuucuaaaacagaaauaaauaagauacaaugaucacugucagggagcccaaacaucuaucuccaucucuaucucuaaauuaagcacaaaaugaacuguaucauuaauucaguaaagacagaaaaaaaaaacaggcaaauacucuguuaaaguuaaauaaaagggcccaucaaugauagacuggauaaagaaaauguaguacauguacaccauggaauauuaugcagccauaaaaaagaaugagaucauguccguugcagggacauggauggagccggaggucauuauaauuaguaaacuaacauaggaacagaaaaccaaauacugcauguucucacuuuuaagugggagcuaaauggugacacauggacacauagaagggaccaacacacaccggggccuauuggaggguggaggguuggaggagggagaggaucaggaaaaauaaccaauggguaguaggcuuaauaccuggguaaugaaauaaucuguacaacaaacccccaugacagaaguuuaccuauuuaacaaaccugcacauguaucccuaaacuuaaaaguuuuuuaaaaguuaaguaaaagauagcgagguuuauaucacuuuagaaaauugguagccauugacaagaguuaaucuuauuugccucuuuuagcaaaagcucuucaugaguugaagacauauagaaguuuuaauuuuuaucagugaacuggcuucaaaauuuaugaauuuuguucucacguagagauuucuugccaccaguguauuuuagugcacuacauauaaaugaccauuuuaagcagaaaaaaacuggagcaaggacuuugaacucacuaacauuucuauuaauuaguuauaaauauggauagguugaacacguaacugaguugagaaccuucuuaauauuaugacuauuguuuaauauaauuaacauguacaaauagcauacuaggcauuuugcaauaacagaaaauaaaaugaaaucaauguccagagacugcacuguuaaauaagcaaagagaggugguuauugagagcacucagcuggggcaaggaccagccaguauaaacucauguaugugguuguuaucaaucugagacuuaguauuggagacugaggaugaccugaauacuuaaagcacugccuucuuuaagagcuagcacuaagguuauccugaaaauaagaaguugagaacgugcucacauuauuuugcugaugaaaguugccacagaaugguccaaaaggcugugcacauaacugggaaguaagugaggggccgaguagaaggggauagaaggaugggcagaaacacaguagaggagaacuuugaaugacaagcuuuaaauuugucuuauagggcaauggggaaccccaugacauucugaaauugaggaagagagaaaaauaugaacuuuuuauccuguuuauuuuaaccuugggccucaaaaaauuaugggauccuuaaaaaaaaaaagucugcucaagaauaugugguuuuuaccauuuuuuuuugaguguggagcaagucugauuuuuagcaaggauuaagaaauaaacgagagagaaaaagaucguagguuguuggcacaaagaucagacagaagaaaagcccagacugccucagcucguccaaugacuuguguggaaaccacugcaggaucugcccagaaagaaagugcaucugagggccaaccacaagacaccacacagacacaggguaaacagucagaguaacugacaugccaugaacgcacgugcucauuguucaggggauauuuagggcacuuauacucagacaaaugugaccucaacucugcauagauaggaaugcucgcauccaacuccacauaguuucuuggucccugucuucugggaauaagcccuggaagugauugugugccuguguagacaaagagguuuguguucauccucuuugauguuuauccagguuuguagcuucuagaaacugagagaaacagauaauccagggaaccaugcuauccacuuuggguagauuguuaauauuuaagggagaaaucagauacagguuguuucaguuauuguuauuuuaacacuuccgugucaagcucuguuguguaccuuggcauaauauuaaccacaauagaaaaaaaggaaaaauacccucauagaaucaauauuuuauuugguugguagaauacucauaaaguuguuuuuuaaaagacuaagaaucuaucagcaguaacccugcacguaaaccagaauugguauaaggaagauggacauuuuagagaugugauugacgguuuucaggcagaauuaaggugauuguuuaaaaaaauagcauauguuguauuguucugagauagcuauaaaauaugucuuuuaaaauuauauguuuaaagaugccagccaaauuucaguauaaauagugauuuauacugguuaaauagaugugcuuggaaaauggugaagaagaaucuauuuuguuuacagacuucggauuuaaggagucuuauuagaaauuagaguuacaucuaaugccauuauacagguuuuuuaucaugucuuuucaacucugauaacccuaaauaucacauuauuugauaaccaauuuauguuggagaauauuauuaaguaauuaaaaccaaaagccaagaucaugaguuugcaaauggagggagggggaaauaaaauaauuuuaacuccccuaaauaaagcuauuucuucuuuuuaaacuuugauuuuagacauugaugaguguuuacagaauggccggaucugcaauaauggacgcugcaucaacacagauggcaguuuucauugcguguguaaugcgggcuuucauguuacacgagaugggaagaacugugaagguaauaauaguauacuaauguuaguccucuccuuccauugcaguuucaauaucaggggucuuuaacaagaccaaauaaugagugaaaugucaaaguaucaaauauguuuuauauauuuuaucucaaaaggaagccuaauuuuccaugauauucauuucuuaauuuacauuugugugaaucaaauaacauuuuaauaugcuaggagagcuugccauuuaaagaucccuggugugaugaaacuucuguggcacaauuucauacuuucuaauuuuuuacaaucagaauuuguacauuuuuuaaaaauaggacacaccuaagucuguguauuaucuagccguuuauaaucuuuuuguuuaaagugucugccuaguaauaaaaugcuacuaaucaguaucugaaauauauaucuaaaauagauauaauguaaaaauacauguuauguauauuuucuauauauguaauauguguauauauauuauguauauauguauuucugaauauguaauagauaauauucauaaaauacauauuuaaauauaaauaauauauaucuaaaauauaaauaauauauauuuaaaauacauuauauaugucuaauauauauauuauauauaucuaaaauauguauauauaauaaaucacuuuggucuuucuaaagccuguaagugaaaacacugugucuaaaagagcaagugccucccaagacagcuuuaauaucaaauaaaauaacauagugaugaauuuaaagaaccauccccaauguuuaagggaucuuaaagguucacugccacagcuauaauccauaguugagccauguauucuaaaaguccacuuuuuaccugccccuauuuaaaauugcuucaaacuacaaguuaucuucugguuuucaucuuuaaaagaauuaggauguagccuaaauacauuucaaauuccacuaaucuuaguuuugacuuauguucauauucagagcauuagaaguaauaugaaucugugaaauaaauauacccacuaggcuauuagcacauuuuucaguuuguaaacuauuauuccuaaaaaggauccugauaacuucuauggagucaaauuuuauaaauagauauaccuauacaucuagcccuagaguuugcaugcacaugccaaaacucaagaacuugagauauguauuucauaugucccaucuucuccuuccuuagaugaucuuauuuggaugaaaguuagccuuaggcuguaauaacaaaaagaaagaaauacgaagaaacagaauuauuuucauccagauugguuuccuucguaagcuuacucuucuggucauaagaaaauguauguuuuguauuuucagauauggaugaaugcagcauaaggaacaugugccuuaauggaauguguaucaaugaagauggcaguuuuaaauguauuugcaaaccuggauuccagcuggcaucagauggacguuauugcaaagguucgugcuauaaaacccuagaucauguucuucacgugccuuuucuccuccuuauguuguuuagagguacuaccuuucuuuacugauucuccccacuuaaaguaccuugaauuuugguuugggaaaccugacugaaacuccuucuuaaauccagccauccaaagagcuacaguuuaugcccagaagacuauuguuauuucagaaaggguauuugaggucuucucaaaggagucaaaagcuauguagcaaauaaauaauccaaacugccuauuggucuuccaacagaugugggcauuguucucaagaagcugaguucuaccucuucuuuccaguuagggaauaauggugguuaggcuucuugguggcuguuauuugccaccucuuacaucuuuaccuggacagaauaguguagacuguuauuugcaaugaucucuuccucauaauuuccucuaggcaucuuaagacacagaaauuuuuuuuaaggauaauuuauuucggcuuuaucaaguuacauaagcaagaagggaaacaggauuaagcagaauaaauaaacaaccaagaaccauuuuuuuaguuugguaaaccauuuugaaauaaucucauugccccagguaucgaagcaaaaaugaggauuuuuauuuuugcuguugagaauugggguccuaagaaaaguuacuggagacaaauuugugcuuagugucuccugucuuauguagggaucagugauuacugcacuugguccaggaucugaguuggaaccagacuucuuaaagaaccucauacucaaagcagguccagaaaaucugcuaaaaugcugcacuuagagcuucugggcauaguuucagaugcagaaguguagagggucaagcuauucaagguagaggaaagcagaauaaaguccuauggugccucuucucugugugccccuaguggacagcuuugguaaacguguuauggaagaaagccuuguauuaaguccuuggcaagaugugcauuuucuccaggcuuaaaagaacuucaagcccuugguuguuuaccuacauucucuaugaccuucacaucaauggcucuuaauauugugcaaaccugucuucccagcaagagaaaacaguuggguguuucaaauuugaaggaggaaggugguuucuguacuuuugagcccugugcuaggaggaacuuauaugagaagacaggauuaacacauagaaauauucuacaguguaaaauagcauaaaacaaagugccaaauugugcaaauuuagcacuguacaaguaaaaaagaaaagggaagagaaugauugcuggaauauuuggaauuaggcuuccaaaaaaaaauaauagaaagagauaugaaagccccuuugugagcagaccuaggagaauacauaaucuucuugaugauacacagagcacacuaagauucacucuucaugccucuaggcuccugcugacccaggccacagcgucccaacauuaaguauggccaauagauaaugcugugaccucauagaugaaaccagguuuggcaaccauuggcaaccagugaaauaguauccuaucaauaaauugguuguucuauuaauuugaaagugcugaugauauggaugguuuguucugacuuuagcauucuggcuuaaggaucugagagagagagagagagagcuccacagcucuguauuauuaucaaugucuuauuuuuuucuagcuuauagagcauagaguacacacacuguaauaagacuaaaggaugaaaaaagaaauuaaucccauguauacuggauuucuuccuuuuuauaauuuuugucuuuaugccauaggguaagauuuucuccuagcccugagcacuuaguucugagcccacaaagaugugacuguucaaagcugaaucaucaaugcuaauucagucuccacaguuaacucaucugaucaacaacauggcuucucuguucacucucugaaaguugaagccacuaacuuugaccaagguuaccucccuuuggaucuaccuuacaucuccguucuuauuaaaaacccuuuguguuaccuuucagguuguagucuccacguuuugcugugugucacaauuugaauaaaaaguugaccagaauaacuaaccaauuugaguuccuguauuuaaauauaacugcuguuucaaauacaaucuguacacagaaccuuggaccacccgaauauauuuugugccaaacaacacaagcuaaguaaaacacgaagguguuuuacucucaauuugccuuuuuaaggucaggagaaaguuaauagucccauacacuaguuguauauuauaaaaggaguuguuauaaaaucauuugcuuuuuucuuuuucuuuuuuuuucuaagacacagucucacucugucucccaggcuggauggagugcaguggcacaaucucagcucacugcaaccucugcuuccuggguucaaguaauucuugcgccucagccucccaaguugcugggauuauagccgcaugccaucaugcccagcugauuuuuguauuuuuaguagagauggaguuuccccauguuggccaggcugaucuugaacuccuggccucaagugaucugcccaccuuagccucccaaagugcugggaucacaagugugagccacugcaccuggccuaaaaucauuuacuucuaaguguuguauguuuuccaaaccacaauuuuggugccuuuuguacuuccccauauuaaggggggaaaaaacccucugcuauuauuaauauguguccgauaaagucuuuuaccagaccuccuuaaguauacacauaaaauaccauaaaguguuuguaaaguuuaagaaagauuuuucuuugcuggguuccaacugcauacagugcuguuauuggccaagaauggucaugaaaauaaucuauauucauuuucuguucuuuuucugugguguuccaucaaggcuuuaguuguauauccuuuaauuuuaggcgaauuuucccagagagccaagacaugggugauacuagaagugaugccagucugggugaugaauaccaaaaggaaagucuuccuguaguuuacuauuacccuagauuucugagagcccuggaagagcuacccugguuauacauuucacaaaacccuuugucuuuuagcagccauuguucuccuuccucugauucuguuuuugccuuugugauuauuuuggauacaaaaaucucuugggagaauauauuaaaguuacuuuuuauggaaaauaaguuccaacaguugauuucucuugauuuuguuacuguucuuucaaaggaaaaugagaaugccauuugagcuuuuguugcugaugcugcauauuauuuccuaucuuccccauuuucaaggguuaaaacauaauugucaacauguuauaauuuuagauaaaugucacuucauuuuuaauaagugccuuucucugccacagacauuaacgagugugaaaccccugggaucugcaugaaugggcguugcgucaacacugauggcuccuacagaugugaaugcuucccuggacuggcugugggucuggauggccguguguguguugguaagaaaacaucauggcuaaccuuaugagagagguucagccucugucacucaauaaagcccaaugguaacaaacgcucucuacuguagcagauaagauauaaagaauauuugcagagcaacaaaccaacagggucaguucucuuuuuguguaaauugaacauuaauuugaggauuagaaagaugagcuaagugaaaagcaagggaauccccaccuauccuucccccuuuucuucccuaaucccguagcugucuucaguuuucuccaggccuccuuuguugauauuggucauugaaauugaugugcauaugcuauuaucucaugaugaacauuuuaauagagaauugauguccaugggcaguauagaaugcaaaggagaauauggauaauccagaaaccuguaugauaguaguuuuaugaggcuuuauaaaaaguaugagacuuguugaaaaauugauaccaauuuuauccagauuauuuuuaagaaagguacucaguaagccauuugaauuggaaaaggauagggcauagcaggagacugucuuccuggugguaaagauaacacagcuuaguugaccaacaucuacauauuuauauaacgaaccuuuuacagauuaaacuuucuccuuuuuggaaaguauaccuaauucagacauucaguaauugcguguuuauuuugggauaggccgcauuucuaauaaaggucuuauuuagcaggaugugagauucaacauucauccaucauuaauucaacauuuauuaagugccugcucugcacaggcccgagaaagacaaaauaagugagauauaauuccagcauugaagggccucacauuuuaguaaaccaugauacucccuagaaaacugaagcaaucuggccauugguuuccagugcuuagaagcugaacguguuuuguuuuucuguuuuuguuuauuuuuucuucaaauggagccccgauaucagaggcauucccugugaguuacaccagggaugauggauaaauaaagcccucuucaacuuugacuugggggguucucaucuguuugaagugacagugugaugacagaugcuucuuccuguuuagacacacacaugcggagcacaugcuaugguggauacaagagaggccaguguaucaaaccuuuguuuggugcugucacuaaaucugaaugcuguugcgccagcacugaguaugcauuuggggaaccuugccagccguguccugcacagaauucagguaugugguaucauggagaugcccucguacugccagccuucugccaccauugaggucuuugcauuuguggaauucacagggaagaugacauuuugcucuccagguacgccaugugccuucuuggggucuuggcagaggccagccagugucuagucacagguacuuaucuaagccucauaauuauuuggaauaggcauugcauuugugccucucguauaaacucuccuaccucaauaauacucaagcuguuugcaauacaugcaccuugccuuguuuucuaaaguuguuucaugauguuugcauuuugcagaaacuauuauaaaagcagacuuuuacacagcguaaaaguaaauaacugucauauuacuugacuauuuccacuagcuuuccaaaaggccauuuguaaauuuuguuuacaucccacguauugauuuuggugugguuuucuuuuucuuucuucuucuucuucuucuuuuuuuuuuuuuuuuuugagauggagucucgcccuguugcccaggcuggagugcaguggcgcgaucucagcucacugccaccuccgccucccggguucaagugauucucugccucaaacuccugaguagcugggauuacacgugugcgccaccacgcccggcuaauuuuuguauuuuuaguagagacgagguuucaccauauuggccaggcuggucuugaacuccugaccucgugauccaccugccucggccucccaaagugcugggauuacaggugugagccaccgcgcccggaccggugugguuuucuuuaaugauuugauuuaaccugagagaaaaaacuauuuuucuccaguugaagugacauggccuaaugaaaagagaacuggauagcgagucagaauucucuuccuccaucaacaggcagccaaauuacuuaaucaggggauuuaguuauuuguguauuuugcuuauuucugaauuuuccucaccuacuuuucaaaaggauuugagguggcuuauauuaauaaacauaauuauaaaauagaauaaugcagacaagcuauccuuagacacuucaucuacaaaaugaguugccuuagauaauccaaaagguccuguccaguuguaaauuauuucuauuuauaaaacaagaauagauuacugaaauuaaaacaauguucugccaguauuuaaacacaauuuuaagguagcuuggcaguggaccucuaauguccuaaaauaaaguuagaccuaauauugaaaauauguagcucugguugguuguuuuuacauauaggauuuagucaguuuauuucugcccuaaaggaaacaaauuaaagaguaaaucauaauuuuaaaagauuuguuauuuuaaaaaugauaguauuugaaaguaacaguuggaaauuaaaauacacuaugaaaaguuagagaaaguuaaauggaagacuuuaaaagaaauggggggccaggcauggugccucacaccuguaaucccagcacuaugggaggccaaggcagguguaucacuugagguuaggaguucaagaccagcuuggcugacauggugaaaucucaucucuacuaaaaauacaaacgaacaaacaaacaaacaaaaagucaugcgugguggugcgcgccuauaaccccagcuacucgggaggcugaggcaggagaaucacuugaauccaggagguggagguuucagugagccaagauagcaccacuguucuccagcgugggugacagagcgagacucugucucaauaaagaaagaaaaaggaaaugagggaugccuauuuaaagaaaaaaacugcucuggcuaaugacuucacccggugaauaauauagaaauuaucauuuuauguaugaucaccaaucaguucaauauguguuuauaauacuuuuauuauauacaaauaccauucuguugaagacauuugccuauaacuuuauaguuguauauuauuaauaucauccuuuuguguguuacuuuaacuuuucaaaguacuuuacuuaccuacuuugaauuugcaauacagacaaguaucaugaaagcuggcacacaagaguacaggugacuuguucacauguugaaugauuggaagagccaagauuuagaauccaggaaccuuggugcauauaguuauuugccuuuguauuuuccucuggaccaagugcacuuccaaagaauucuuaaaauccacagggaaauuauguggguuuauaaaaaggugaccaaaagaccagauuucuuuaagcaguugucuuaguccaguuuuuguugcaguaacagaaaaccacagauugaguaauuuauaaagaaaaugcauuaauuucucccaguucuggagccugggaaguccaauaucaaggugccagcaucuguggggggccuucuugccaagucacuucacagcugaaaguggaagggcaacagagcaugcaggagugagagaaagcuagagaggacugaaugugcuuuuauaacaaagucacucucaugauaacuaacucacucccauaauaaugacauuaauccauucaugaggguagagccuucacgaccuaaucaccucuuauuaggccucaccucccagcauuacuauugaauuggggaugaaguuuccagcacaugaacuuuggaggacacauucaaaccaaagcaacaguaaagcuuaaagagaguuaaauguaaggcccgguuccacuaacuuuugucuuauauuugaaugaauuuacccaaaaaaggguccacacauggaaguaguuucauucauuugguuucuccaccucuuuggucaugaaccauccgaauguaggauaucccucauuucaagaaugggggguaggcuguuuaaaguacugaaaauauucaaaaggaaugucuucagucaguugagggagagacuccaaauauacaaaaucugaaguucaucuuuguggucugcaagucaggcaagcuacauaugaagcuguuucucacugguugcuggagcugauucacauuguucagcaagcccucuuguguccucagccuucugacaaugacauuucacagacauggaucaguuaaacccacgggaguguaauuggucaguuaaacccacaggaggguaauucggggggauuuucucauggaucccucaugucacugucuccauggcacuacgcggaguuagcucaucaacaccuaccccucacuauguguuuauaauacuuuuauuuacuuauuuuuuuauucagggccugagcugugcacaguacacguucaaucauuaaacauguaauguuaauucuguacagccaccaggugaaaugggaguugucauuccaaauuuaugggagaagaaacuaacagaggaaaagggcugcuuccaaaacucccagcaauuagcguugucaucgguauuaaaacccaugcuuauuugaacucacuacaaaaaauggucuaguaccagauccugccuaaauggaaaacaauggugacaauaauuugcuuccauuuaggccaaacaucagcaaaauugucauuaucucuaaaaguccuuuuuauaaaacugguaugauuuugguuuucuuguuuuauuacuuacaguauuucaugcauauuuuagcuuuuugcugauacagcagaauaaaaaagaugaauuucuuuuuguucccacaccuggcuuucaaacacaccuucccaucuguuguuuuuuugaccccuucuaagaugguuugaaaauuaaaucaucacugcuuucucaaauucacauuuguuagaagacaugauaaucuuugguuguauaacucauuuaccuccaaugucaucaggaugcaauucucuggcaugcaggggauaggaacuauuugcuucagcagugaggugcagucagccucuacaauaagccccagcccugauauccaguucuccuuccacuuaagcacagaugauuuacauaugaccaugagacuguguuugccagaaaccauuggcaacuuaaggggacacuaguuuccuuuccuuggauagugugauuccaguuaguucuacauuuucaucauucacucuuauguuaaguauuguuggaauuguauauaaaacaugguauuaauuuuaagaaauagaaauuugauucuaucucaaauuuggggacauauucuuuauacuucaguuuuuucaauaugaucucacaguuuuaacauuaagcaauacuuucucuauggauauaccauagagaaugaauccaguauccugauacauauuaacuuuaaaaauacacuuaaaugcaagaguagguauucuguuguugcucuugugagaggaggcuagagaauuugcagagagaaaugaggaaauguuaagaaccaauuguacugaaaaaacagcuagcacugagaaacaaaauuauccccaagauggugggagaaaguuuuauuaacaguuaagaaaccacauuuuaacaggcacauuucaccguaaguguaaaguguucccuggugaacaaaaucaaguuauaggaaaaacaccuuuuccgaaagggcuuugcacaaggaauugcuauaacuugccuguauccuuaaaaguuguuuuccuugaugauguguagccuuuaaaaugggagccugguguaaaggugacucccuggggagauaccuccuuuuccguuaccacuuaaguuugguucuacucacuuuggaggaaaugaugugugcaaaaccaagggcaggaucuaccuguucugcaaacaagggaaucauuuacuaucuguuaauuuauugcagcggaauaucaggcacucugcagcagugggccaggaaugacgucagcaggcagugguaaggauuccuuucaaaauuuacuaccuucaguaugugcagaggcagcaucaggcuuucuuguggguuuccaguugaucccuuuacacuagucuggccugacucccucucuggccaucacugugccauguaucugggaugcucagaagccuucaguggcagagcagccggggcacugugggcucuaggauuucuggguguggcugugggacuuggccacugagggggucaggugcucucucagugugguugaugggugcucgcagaugauguguaaugacuuuuguugcucaugcuugagaaggggcagccugacucucuuguggaucuuccacuaucaaguaccacucgggaugaugggcuaguugaaccauucuccaucugcauucugaaggauucugaacuguuaagugcucaguauuauaaaauggcaauagagagcagugacaacaauuaacugaguuaaaagagaaugaaauauuuagcuagagaaauauuggugccaugcaaggaauuaaaguuaaaaaggagaauuggaacaaguaugacaauaggugacaagaaagaggaagggauuauuuuauuaauauaaagcuacauaguuugauucagggagaucugaaagaacauggacuggcugaauugauugucaguucauucaguaugauuaguuucaucauugugcgugaaugaaaauguggaggggauauuuagaggaggaaagaggagagguaaggaaacuuauaacgaauaaggaguuaauggggaauaaguaaguugugauagggacuuggaagaaaaaaaaaaagucaacccuaauuuauagaagagucaggcaccaggauuugagacuauccauucacugguugucauucugcaccugccuugacuaugagauucccuccucaguugugaggguacagaagagggagggccccaccucaggugggcagagcaacggaggcuuuuucagagcaugugguguuggagcuggcuuuugaccuguaaauaggccugcuccaagcauuccugacacagagugaagagggcauuauauguucauagaagagugugaagucugggauaaguaaacaaagaauuuauauuuuaguuuuaucuugaggauauuguugaaccuaugaaaguuugaaccaugagaacgauauaauaccuuguuuuuaggaugguaagaaugguugcaguguagaguagugcaggguagauggaagaaagaggggcuggugguagggagaccaguugucgggacuugggaucugcugucgauccauuuuuccaucuuggugcuuggacuaggagaaguccaggaggucuccuucagcuugauuaaggauugguuaucuuguaguuccagcugagaugcaaaguuccucucaggaacuugugggagaaagauuggacucagaauaucuuacagugagaaaaagagacagaguguucucuuuccagugaaaucgauuuuuuuccuccuguagcuccuaaggucauuacauuuauuguaguguuauauuuuuaacaauucauucaguauuuauuuuauaaucuuaauugauuuugaccuuuuuuguggugcagauauaaaugaaugugcacuagauccugauauuugcccaaauggaaucugugaaaaccuucgugggaccuauaaauguauaugcaauucaggauaugaaguggauucaacugggaaaaacugcguuggugagaaguuuuacccauuuucugaaacauugccugcauaaugcauuccuucuuucauugcugggagaaaacugccuuugaguagcuuagaggacugggcaaauggacacuuuauacuucggauguuagcacagcauauacauaucuuuaguaacaaaaauuuacaucacugaaucuucacaguuuaugaauaacgauguaucagauucacuccuugaaaugauuugcuccuuaaaauaaugauguaucagauuucacuccuucaaagagaagcuccuuagauauaagaugcagagauucugagccauucucaugugacuacaaagucaaccuugauuuuacugagagagaagcagcucuucucccaaccauuuauuagacuuaaucagaaaaaaacacagcuuauuuucaggaauaccugcucucuuaaaguuggguuuugcuucagacaggcauauuauucagcuaaaagcaagcaguuuuccugaggucccugaaucaugaagcuaaauuccccaugacaaucauaaaugcuacagauuacuuuguacuuuauaaucauaccuggagacaauuugaauuauuauaaggaagaaacacccauucuggaacuaacacauuucaaaguuggaccauacuuucuaaauauuuauuuaguuccuuaaaucaauaagguuaauccuuuuaauucgacaaaaugaauuaaauuauauaaauuuaauuauauaauguaacucuauaaagauuaaugauuuccagcaaaucuguauuuucuuccugcuaaagaaauaagugaauuaaauagccuagugacuuuaggcuuuguagauauuuaguuuagauacuuaguuuaaaaccaggucaagccucuguuuuccuaaaaugagauaguuuagguaaaagcuaaugcuacaggaguuuugccuuuuugcuugaauugaucacgucguuaugacuuuaaagaucuaauguaaaagagcaaaguagauacaggcaaaguuugggcccuuuuuaaguguuuauuuucauugacuuugcagauauuaaugaauguguacugaacagucuccuuugugacaauggacaauguagaaauacuccuggaaguuuugucuguaccugccccaagggauuuaucuacaaaccugaucuaaaaacaugugaagguaaaccauauuuuuguucuuauacuguguacuuugcuaucuuuuggaaugccauuagaaaaccauaagacugaauuagagucuccuguauuuuagacaguuaugccaguuuaguugaaauucugugguucuacauggcacuaguauguacuuuguaagccacuuaugguauuuacuuguaauuggcauuuuaauugccaucauuuaauagauaaagaaaauguuaugugucugcuauuugagcuauucauucagaaaucacauacacauuuacuccagauuuucuaaauaaaaagauucagccaagucccguauucuauacuauagagauguacuagucuauacuauagaguuauuauuuuggcauuccaucuaguguaggaaaaacuauuuagcccagcuuuacugugugggauuaaggauauguaguagcaauuggggucaaaguugaaguacucuuuuaggcccaagacuagauuuuagcaguaauguagaccuguuuuuguuucagacauugaugaaugcgaaucaaguccuugcauuaauggagucugcaagaacagcccaggcucuuuuauuugugaauguucuucugaaaguacuuuggauccaacaaaaaccaucugcauagguauuuaucuuucugagaaugauuuuucuauguuuaucaauguuguuauacuuaaugucagcuuuuccugcaaaagaauuuaaguauggaugaacaauauuaaaaacuucauuauuccuuguuucaaaugcuauuuuugucuauaauuccaagguguauguuugaauuuuuauauagauucuauuaaauauuauucccuccucugcagaaaccaucaagggcacuugcuggcagacugucauugaugggcgaugugagaucaacaucaauggagccaccuuaaagucccagugcugcuccucccucggugcugcguggggaagcccgugcacccuaugccaaguugguaagagaaacccaugcugugguuccuauaccacuccaauggucuuugcauaaaaaggggaagccuaguauuucauuuaucuaggcucacaugagaauuuucaaagauuuaauccugauggccccgaacauauugcugaaugggaaauaagaagugucaaauuuuaugugauuuuguucauuuauuauuuucuaucuucacauuguaaugugguuaguuuguguugcuucccuggagcaccagugccugccagcucucuugggaaccuugugguuagggguucugagcuuuuuauagguacagauuaucuuucaaaaagcuaauugauguaaagaaaccgguauucaugacuaaacuucauaaggguuucuggugaacuucuaaaucuguugggaacuugagguuugagaaccuugcucaugguuuugcugauuuaauguuuaaauauauaaauguguaaauuuaugugaaugcuggaggccaugagaucuccaaauuauagacuugaguuuucuauauucagguuaaaguaauucuauagugugauuccuauuuucaggugaacagcaagagagaaagcuaccuucaguuucccucuuagcuaucacuuuaacaugaucuauagggcacgucugugucuuuuggaguaucuuaguggaauugagcuuuauuugaggagacauuucauuacuguucuuccucaccuaugcaaucgcagaaacauuuuguuaucucauacuuauagcaacacaaucuacuucauguuccaggucaucuuucauguuucuuacacuaugucagaacugcaaagucuggauauuguuaucucaaauuuguuuucuguuuuguuuuucgcuuuuuauuacagaucccauaugugguaaaggguacucaagaauuaaaggaacacaaugugaagguauuucugauuacuuauaaaccauacauuuuugugugcauaaugaauguuuguguuaacucggacuggauaaagcugucauauaacuucacagggagaaauaugcagcagagaaaaaaaauaaugagaacuacaaaacggaacagcuguuaauuucacaagcauauauauacuguugcuagugucagaacgcuauguccaaaggacaggguggguggcugaaaauguuuuagguugaucgcaguuuagagagacugcacuuucaaaaugcuaucaggaagagaaaaacaggaaguuuuugaugagucuguaaaauuugccuuucuuugguuuguccuggcauuuuuuauuuguuuguuucacagucaugggugauuuagaaggacacauucuguuuucucuuuguugaaagucugcauggaguuucuucaguuugcugugauucuuucuccuggaguuucagauagacauaggucauggugacuaacacaaccugacaugacacagcagcugaaaaauuuuaaaaacagcaauuagucccauaugugggaugaaaugaaguuuuuucccuguuaaaacaaagaggcacacuacaacccccacccaaggucuugcuuuccaaaugaugacugaauccuuuggccuuucucugguccagacccgcuguuaauaacuuaucugaccucagcagcauauuuuguuguacaaguggccaaaacaaaacaaaaaacccaaaaagguagauuccacccucuccccauugaucucucuuacaaggaaagauucagaauauuuuuucaacauuccuguuguggaaaguuauuucuucuaaauagagacacaguguguaugaguuucuuagcuaauguuccccccucuuuuuuuuuuggcauuggcaaguaagugccuuucuuuugauuaacuugguggugaauacuuuuccaaauuaagugcagagaacauauugcucuccauuaggcaaacugggaaggacugguacauuugagagagauuggaugaaugaugaaugaaugaacaugaguaucuuuuaauuccccucaacccaagcugagaccaaagcauggacagaacagccugagaccauggcugaguuagaauugauuguacauuuucuggugauuuaucagaacuucuuaaaagagacccuucacuggcccacauauuccuuggugggauauuuuucuaugcugaacuucaagcuguuucuucuuugcuaguuugaaaaaccagguuuuugcuucucuacucauuuccagacaucuggucucauaaagcaaauuauauugcugggaaccuuaccugaaauguccgcagcuaccagagcugucuccaagaacucacaccagcugccugucucuacaacucaaaaguuauucccugaaaccaauggagaaacucuuacauauuuaguaauaggugggcucguucugguugcuauucaggcacccuagaaauucuacacaaacuacuuguaggcaaacuaguuuuaugaacuuaccagguucaaaauggggaauaauuaugacucuaugaguagaauaagguagaaugauauuauaaagauauauuaacuuuauacuuuuuuuuucuuuuuagauauagaugaaugugaaguguucccaggaguguguaaaaauggccuguguguuaacacuagggggucauucaagugucagugucccaguggaaugacuuuggaugccacaggaaggaucugucuugguaaauacugagcucauuauuuuucuaauaauaauuuauuaacgauuauuaaaaaugaaguuaacaagauauagcugagcacuuagcuucagguacagacacacacuccaaaauucagcauguccgauaggguccauggccacuccuuugacagucuuucaaauaguaagcagcaacuguaguuucuguugauaugcaacuauuccuuaaaucacuagcaucacaguuauuuuuccagagcucuuaaaucggccccauaugccgugaacuauaaaauacaagcugagugguggagaaaagaacaauauuugcacauauuuggaaacuguagcccaugucuucuaagcauacccugacauuggccagaaggacagguccuugcaaaaacaccuguggagaucaggagugaagaugccacuccccugaaaagugaaccugagaaagcucagcccaggguagguaucacugcuagucauagugggauauucugugccaacugcuagagcccaaaugggauccucuagccaaauugucucaccccaacccuaaguccuuagaacucuaaguccuaagucccuaugggcucgugauaguggcaaguuugagaucgcacaucucaugcaucuaaggucuggcagacuuauucugguguuacuacuauggcuucugccugccuagaguauaucccuuggaucacugguuucugaguucaugacucuggaaaugaugcuuaccuguacuuugcaucugaaaccacauuacuuugaaguguaggcucagugaagacuauuguagguaguuaaaaaagugggccgggugcgauggcucacgccuguaaucccagcacuucgggaggccgaggcagguggaucacgaggucaggagaucgagaccaucuuugcuaacauggugaaaccccguuucuacuaaaaauacaaaaaaaguagccaggcacgguggcgggcaccuguaaucccagcuacucgggaggcugaggcaggagaauggcaugaacccgggaguuggagcuugcagugagccgagauagugccacugcaguccggccuaggcaaaagagugagacuccgucucuaaaaaaaaaaaaagaaaagaaaaagaaaaagaaagugguauacagugaaggauuuugaucacuuacgaauuagaauuaacaaaccuuuaaauauugaacuuuauaguuuauaguguaaauaaauaauauggaauggaaccgggaauucaaagccaaaaguauuuuuguaauuaaggaugucaguuaaugcuauucugagucuuaguuuauuuguuuaggaagaaucaguauuuaaugagaaucuucuucuagguucuucaguugaaagaugcuucaguguuuaauuuaggauucacuuaaaaauaauuuaucuuaauaugggcagucugaauauaaagcugaauauaaagacuucaaaaacuuucuaacguuagaggaaacccagggaguuagauauauuguuaaugaccccauugugaaggagaaagagaaggaagauacaucuuacauuucaauuacacuucauuauuuucagaugcauaaucucaguugagcuucacagaaccuucugagagaugagugcaacauccuguaacagauguggaaauucagguuuaggauaauuuauugaagacaauccacugaguuacagaagaggaccaaaauccagcucuucugaccucugcucugcuaggcuuucugcucuucuuuauaaucccaugaauuuggguuuggggcuagagguaucccacaaguaccuugaagaaugugcccuuaagcacguguuuaggugaaagaaauauuugagaaguaaagugaauggcuuuucuuugcauuuuucucuuuaaucucaaguaaagcaguccucuuuccagaguucaucauuccaccuuuccaaaaaugaagugggucggaggaaaaggugauugcacuagggcagacacgcuccaacaauaaagaguacaguuggcuuuuagcuguggaggacaugccaagacaucauggcaugcacgcaucggugauagguauuucuguacaggagaaaaacaucucccgaaagaacacugugggaucucucagaauaccauuccuuauguagaauuaucagauguugaaagggaacuuuucagaaguaggaggugcaaacaugggcugacaaagagagucuuuauuaggcaaggauacuuaccccagagccugggguuuuuuuugaggaauaaaacuaauuccagucaauaaguauacagcaaauuauuaugugugcaguauuuuaccuaacagaguguuggcaguuuggggcaguggaagccguguggcucuauuuaaccucccuugauucccucugacagauauccgccuggaaaccugcuuccugagguacgaggacgaggagugcacccugccuauugcuggccgccaccgcauggacgccugcugcugcuccgucggggcagccugggguacugaggaaugcgaggagugucccaugagaaauacuccugaguacgaggagcuguguccgagaggacccggauuugccacaaaagaaauuacaaauggaaagccuuucuucaaagguacaauguuacguuuuccauggccaauugccucccuuuuuagacaaauaggaugcauuuucaugaucucagcacucuacuugaucaucccagcauggacuuuuugcuuucugaauuauauaauuaucuuuguuuagaaaaguaugaacuuuuuguuuuuaacuguuugguccaagaaguccuggggguuaaaauuguucuguauggagagauaguuucagauaguuucuagguggcccucuuaaaugucaguuacguaaacucaaaggaacuuuaauuuugcuuccaaaagcuaugguaauucauugcugaagaaggacuugguguucuggagauuuaaucucccaguucugucuuacauguagaaauuacuugcguauuucuugaguguuuggucuuguuuuggaaaaaggcccuguagugggaaacucaggucacauguuacauguaugcaguuuucuaguguacaagaagcucuuuaaauuauauuaaugagaucuugagcuggaugcgguggcucaugccuauaaucccagcacuuugagaggccaaggugggcagauuacuugaguccaggaguucaagaccagccugggcaacauggugaaacccugugucuacaaaaaaaaaaaaaaaaaaaaaaaaaaaaauaucuaggcaugguggugcacaccuguaaucccagcuacucagauggcugaggcacaagaauugcuugaaucugggaggcagagguugcagugagccaagcacaccacuguacuccagccuugaugacagagcagauccugucucaaaaaaagaaagaaagacaucuuaagguauauacauuaagaaaauauuuuuaaauuguacaaauuauuugcaaauaauuuaaauuauaaauuauaucuuugaaauuuuuauauuuuuggcauauccaaaaaagcaccaaacaguauuaagugaauaucucauucugcuacacagucaauugauagcuguaggauaauauauucuaauaauguucuaugugcuuuaaauauagauacuagugguuuagaauauauuaucuauucacucagcaaguagugguuaaauauucacuaugugucaggcagugugcugggcccuagaagucugaauagacacauuauuugcuucuuuaacaaugcuuuauaaaauguagaaauuugaaaggcuagaaauguuuacaaagucauauaucucauggaucaucacacauucuuggaaauguauacugccaagaccuuaaaucaagaacuuccaaccuucaugauuuaaaauggugggcauugagaccuccugacugcuugcucauaaacuuauuuugccccacauuuucuuauucuugaagauaucaaugagugcaagaugauacccagccucugcacccacggcaagugcagaaacaccauuggcagcuuuaagugcaggugugacagcggcuuugcucuugauucugaagaaaggaacugcacaggucaguuaaugagccuuaagggccaggagaggggacguccuuuaaaacucuuuaucuuuaacauauugucgcaagaauuaaggcuguccugagacucauuugcugccacuugcuguuuuugugcagacauugacgaaugccgcauaucuccugaccucuguggcagaggccagugugugaacaccccuggggacuuugaaugcaagugugacgaaggcuaugaaaguggauucaugaugaugaagaacugcauggguaaguuugggaucauuugaucaacacagaaagagaaggauuccaugaagcuuugauggcucauagccuauguuccagguucuuccugcugccccagugcaaccagugaaguuaggaaucagucugcaacagagggagacugagguagaaagaaugagggaauucaugcuguggguuugugggugauggcggagaccaguugugggcccuugagaagugauuuuaacaccugaaauggauacccaggcggaagagaggacaauugagacagaagcuguaguagaggucccuuuacaagaugucuguccaacacuucuagaaaaggugauugguaaacuuguugcuuuaggucugguuuccuagaaacaaaguuugaaauggagauucuugcaaaagugguauuucuuacugugagcaaauucucucagaagguacuugucaggaaguaaggagagcaggguagugcaggagaagaaaauaaaccaagaguuuggcugcauuuugguuuuagucugauccugcagggagaucugguguaugaauagcaccagagaguugucccaccuugagacaaggaggucaagauggacacccagcaaugggugggggaggagugcuuggucugguggaggagaugaggcccccaccuuuaacauggucauuuccauuuugcagauauugaugagugucagagagauccucuccuaugccgaggugguguuugccauaacacagagggaaguuaccgcugugaaugcccgccuggccaucagcugucccccaacaucuccgcguguaucgguaaggagaaagacuuucacaccauuuacuuguggucaguuguuugaaugacaucauugccaaaguuggaagcuuauguuuggguguuuguucuucuuauuuucccgacagacaucaaugaaugugagcugagugcacaccugugccccaauggccguugcgugaaccucauagggaaguaucagugugccugcaacccuggcuaccauucaacucccgauaggcuauuuuguguugguaaguucuuuuuuauuuuauuuuauuuuauuuuauuuuacuuuauuuuauguuauguuauguuauguuauuuuauuuuauuuuauuucaucucucccuaaaacacucuauguacucugaguuuuguuuucaucgcuacuuuuacuuaucuuucuuguuucccugcaauauucuuuuuauaguggcucacgaucuuuggaucucaucuccauuaucuguuuaaagagccaguuaagugaaggacauaggauguuuuagcucuaauaagcauaauuugacccaugccguuuggauagggaacaguagcagcaugugcuuugucuacacacaugcauaccaaugcacauuaacaaaugguaacuaaccaccugaaauaaacuaaacacggugagugcuguggaaaagagcagaaagcugaguugaaaucacugcccuuaugugguuuagaucagcuaaaagauuucaaaaaaauaacuauuggaaagaagaccauggaauguucauaucuuacacugcaauugaggcuaugccuggcucuccuuaaagauggguuuuugugggacaagaauuuugcuuuguggucagcccucuguagguuuagucgugcugugaagaguggcacagacaguccuguggcuuuauugugccccgagucaaagugaaacuuuguagaaacugccaguuuuugccugguuugggguguacaccauguggaacugccaagucucacaugguuuccacccaaaaccauaaaucagcccaaaguuuucugaaacauggcccaggacaacucagaacuucaacucagguuauugaaaaagauuggaaccucagccaaucaaacugaauuucaaguuuauaagugaaucuguggccaagagaauuucauccacgugccuauuaucauaacugagauguguucuccuagcacccaauacuucuccugcauugcaaauggcacaucaugcauggugcaauuaauuguucaucugucuccuggccacaguguaaucauuuugaagucaaagauugugucugucccauucacuauuagagucucaucucuagcauauaguagguaugucauuaacauuuguugaaggaaucagugacucaguugcccuagaaugcuuuuuccccuuuauuugacguaugccuggaaauguuaaaaaugugccaugcucauaaacacagagggagguguguuagcccauuuuugugauacuguaauagaauaccugaaacugggugauuuauaaugaauagaaauuauuaguucacaguucuggagggugggaaauccaauaucaagaagccaggauuuugcaugguccuucuuccuacguuaucccauugaagaaagcacgagggugaaagagagcaagagggggcugaacuugaucuuuuauaacagcaccgaucccaccaugaggguagagcccucauaggaugauuaccucuuuuaaaggcccugccucuuaaauaguguuacaauggcaguuaaauuucaacacgaguauuggaggggacagacauccaaaccauaucagaaggugauauuauuuucauuucuuuuagacauugaugaaugcagcauaaugaauggugguugugaaaccuucugcacaaacucugaaggcagcuaugaauguagcugucagccgggauuugcacuaaugccugaccagagaucaugcaccggugaguagguucuagccucauguugaaucucucaguagguuccuaaguaaaguaguuuagggcccaggcuuuggagucaagcaggcuugaguccaaacccuuguuugucauauauuuuaacuguauccuuaaucaagauaccuauuauuagaauccucaucuauaaaaugaaguucaaauugccugcauaaaauaguauuuacagagcuuaccauaguaccuggcauauaauaaauggaauauaaaauacauuuuccuucauugaccagacuuuugaagaguuugauguuuuggccuaauucagugcaacuccagguuuauuccuugaaccauuggcaacagcaucaccugagaacuuguuaaaaaaauguaaaaucucaggccccauuccagaucuaccguaucagaaacuacugagguagaucccaggaauuuguuuucacaaucucuccaaaugauuuggaugcaugcuaaaguuugagaaccaguggucuaauuuacacuuccuuuuguaucacccuggcugcgagagcugugagccagguagaggugagaaacaaaguggguaauaacauaggcuuugauuuuggcuuggcuuaagaagagaauuuggauuuaggaaccaaaauuauuuuacugaccuagaaaaaugucccuuaaaaaaucuagauauaaauuuggcuacaaaaauuguugaaaauaaggccaggcacgguggcuuacacuuguaaucccagcacugugggaggcugaggcaggcagaucaccugaguucaggaguucaagaccagccugaccaacauggugaaaccccauuucuacuaaaaauacaaaauuaguugggugugguggcacaugccuguaaucccagcuacuugggaggcugaggcaggagaaucgcuugaaccugggaggcggugguugcagugagccaagaucgcgccauugcacuccagccuggugacagagugagacucugucucaaaaaaaaaaaaaaauuguugaaaguaaauauuauuacuaagagcaucuaaguagguaugguuauuucaaguaauucuuaccuuaaaauauugcuaaaacaguugauagaauucaggcauuuauaauuugacaauagggaaaauaagauuuauaauaauuuuugaaugauaaauuaaaugaaagaaagauuuuaaauaaauaauagacuuuuaagcagguguggacguugcccuugagcaguauauuauaaauauugaaaaauauuuuuuccuuuuuuaccaaggauaacccaaugggcuaguuuaugcaaagcuucauuuggauuugagaguuaauagucuuaugcuaguaggcuaaguuuauuugacugcggucaguuaauguuuucucacugaacaguggaaccaauaucaacaaccugugguuguugguuuuauucuuugcagacaucgaugagugugaagauaaucccaauaucugugaugguggucagugcacaaauaucccuggagaguacaggugcuuguguuaugauggauucauggcaucugaagacaugaagacuuguguagguaagcaaagaagacagaauuuuucaucuugucuuguuagucauaagcacuguuaaauuacauaaaguuaguuugggucagugauagaaagauuccauaggaaaaguaaggauauuuagaggcacaauacucauauuuuaaccagcauuccaaagagagcuuucuuguggcuauuaaaugguacucuugucagauauguuaugaggacugacuggccauucgucagcuccagauggacauuucuuuuaugccuauccauuacuuuuguccacuuaacccuccuucugcuuugacuaucauguaggcuuuuuaaauccuugacuaaaggcaaacaaaauuuacuucugacaagaaugcaguaaacuuuagaacugaucuauuuguuuuguauaguuucuauuguuaugccuucaaauuugauaaacuuuucuucuacgaucucuaaucugccuuuccucacauacaguguauuuuucaucucagauguuguaguuuucaccucuaaaaguucgacuuggguauuuuuucauauauucugugucucugcauaaguucaaucauuccucuagcuguuugaacacauggaauacaguuauaacaacuuuuagugucuuugucuccuaauucugucaucugcauugguucuaggucauuugaauaaauugacuuucuuccuuauuuuaggucauauuuuccugcuucauugagugacugguaauuuuugauuggauaccagauaguguaaauugugccuuacugagugcuagauauuuuuguauuccuagaaauauuuuugaacuuuguucugaaguguaaauuacuuggaaacacauggaucccuuucaaagucuugcuuuuaagcuuuuaagcuacacuuagucuagggguaauuuugcucuguuagugagguaagacccuucuggauauucuacccaauucccugugaauuaugaggcuuuccagucaggcuggugggaacaggcacaaucccagacccccugugaacuuugaggauuguucccucucauuuucuuggguagugcuuuccccagccuugaguaguuuguuuccuuauaugaaugugcuggucacuacucaucugaauacuugcagaagacucuuagcaaaucucuggcauugcuuucuucuguguagcucucuccuguccuuuacucugcccuaugaacccuaacuaccucagccuuccaggaugcccagauucaucuccucaacucaaggacagugccuggcuccaucugguaccuccuccuuaugccaugaaguuaaaacucuccuauucaguaaucucgggcaauuguaggauucaccuaguuuuucuuucucucagggaucacugucuuuuguugccuaauguccaaugucuagaaaaccacuuuuuaagguaucuauugucuauuuuuuuugguuguuucaucugagaauauaauuuuaauuccuguuauucuaucuuggccagaagcaagagucugguauugauuauauuuacauuuuuaucacauuuaucuucugaaagccuuuacugaaaauguuugaaguccuagaauuaaaaugaaugucauaaaaaaugaauaauuuuuaauuuggaaaagaagugaagucuuaaacuacuuacacuaagacaaccaguucaucuauccuuucuuucaaaauaugaaaacuaaauuguuaucaucaugcagacugaauuaaacuuuucauccugcaauagaguaugcuguucuaaaaaguuuucuagacugucacauaaacgagcucuaaacucagcauggagcccaucuguuuauuugauuaacuggccugcugcuuaugggccagaugaaagccagucugaauaaugagcuugcaauguaaagaaugaagagcaaauguaaauuggccucuaaaauuuaacauuguuuuucugagggaaagcauuuuaccuuuucuaauguauuugucauaguuauuaugucucgaggggaaaguacucaaugauaucaaauagcuacauauauuaauaguauauauguuuuacagaugucaaugagugugaccugaauccaaauaucugccuaagugggaccugugaaaacacgaaaggcucauuuaucugccacugugauaugggcuacuccggcaaaaaaggaaaaacuggcuguacagguguguuuguucaaguagaacaauaaaauauuaaguaguuaagagauugguaucauaauuauagauugauacauguuuuaaaacucauacauuuuaacuauauuauaaaacauuuugcauaacauuuuucauuaauuuagcuuccacuucuuugaaauuugucaucguuuauauuggauccaaguugcagguuuuuuucuugaccuguggggggaaaaagguguauugaauaaauuaacacuguaaauagcacauuuuuaugagguuaaaaaucacauuuucauaucaaauuagugaacaugcuaauuaccaaauauucauggcccuucaccgaagcaagccuuuuccaauaaccuccuuugccaacacuucauuuaagguuuauaacuggaauugcucuuuaaaggaaaacauccuacaauucauauauuucaucaauucucacuagucuuccagugccuuaaauaggaguacuuuugauguauuaagucauauuaguccaaggaagucuuuauucaugggacuuagcaaaucuuaugaagugauaaugaaaccauuugcaauguugucuguuaccaauagcacaugagaaaauguuuucacaauauuuguaggagacuauccuauuaaaugccaaauggaagaaguuacucugugcuaaugacauuguguuuaguuuauaaguguuuaguugguauuuucaaauaugaggcaaugacauuaaguccauggaaugauauaauaaaguuuuacucuaguuacuuauauuaauuugacagauuauggcauauaacauaauuuaaaacauaauggaaaccauggugagcuugaauuagguaacugaauaauuucuuaauaaauaacagucuuuaauuccaaaaaccaguuuggcaagcucuuaugacuuaaaacaaauauuaaaauauuugcagauuggcaguggggcaaaugugcagauccuccucuuaauuauaucaacauauuucaagaaaacaccaaaauauauuuauuauuguuucaaacuggccaauaaugcuauuucaaauuuauugauauguaggauaagggcaauaauauuauuguugguucaaaaauaacagaugcuagccaaauuaugagaagaagcaugaagcuggaauguuuucauuuucacuaugcuacuccuuacaugaagccugucuagggguccauucugauaaauggcacaguguuuaaacucucaacuccuauacggccucucgguacaaauggugccuagcuuuguaugucuaugguucaagcuuuauuuuuagcuuccaguauaaauauaggacuugguaagggaugauggucuggcaguagugaaaagaaagguaagauaguucuguauuauguuuuaacuaauagaggauaauacuacuguuuuguuaagcugagcacauugaaauucaacccagaggcagugaugcuuaugaaagaaguuaaucucauggaacaaccuucauuccccauaagaaagaggucucuagaauucaaugcuccaaauucuagcuaacugggucaugugcaguggcugauuauuuuaggccuuacccugaagaaagcuuaaauuuucauguuauuuaauguaguuuuagguaaaugacauauaauguauacaaugcuguuggcgcagugcuggucaauaaauaaaagcuauugucaaaugaaacauagacacagugucuagaggccauuuuagugaaagccauugcuucuagucuauaucuauuguccauuguuuuguuguuucauuugagaauuuaacagucuagcaaaaauuuuaugcuacuguuuacugauucaugcuugaacucaguuuaaagaaggaaaaucuuacucuuuauauugaaaggcuuguuuuucguaguugaauuugcacagauacuaagaccaugguaacagagcugugcacuacaguugcaugaagugacaccagcuuuacguuaagaacagcagccuuugagucaaucacaugaacauagauuugaagucaaagaaacauuugauccucuucaaaucuuuuucauagauuugaagucaaagaaacacuugagcucuuccuccaguuuugaaaauuacagccuaaaaugauuuuccaauuugcuaaaauccagcuagcacuguaggaagacuugaguuuuaugccccuuugauaccagaguaacauggcaugugauauucucaucugaaggaguaguacccugaauuguguucuuaguaaauccacucauucaugaucuugaacaaaucaccagggugcucugcaguuacucaaauguucuccuuggguaaguaacagcccugaccuguggaagggcaucacauuugauuggaaauggcuuaaccaaacaguaaguuugguauacuugaaaacguguuuuuaaaaaucuggggcaaaauguuuuuugaaugccaugucacuaaggcucuuuuagcugcuuuuaguuuaaaauucgugucauucacaacuuagaacaccgucagguuaccuuggugauggcuuugcuaauaauguuccaggcaacuaauguaaguagagauagguaucuugccuaauuggauaagcaagcagacaaaaggaauaugucuacuuauuuaucuauuuauuuauuuagauagauuauuguuuaaugaaaagaauuaugaaaauauguaugcuauuuuauaaggagaaauuuugcuucaugagaacuaagaaaaagaccucugggcuccauuacaguuuugucuaaauauuucagcucccugucauuacugaguauuuccauuuuaacaaauaaacauguuuuuucccccaaucacuuuagcaauguucagaauccacccacugacuuacauucccagcccacacagaugcuaaggguuucuuuuuacuccguaagcuuuguucagacccuggguauugccaagggggaauguuccauuuaauggagagagaacacauuugcuugaaacgcagaacacagcucuucuauccuuggcuuaagugggcuggauuacaauuuuucuaugacccaauguaaggcuucugcugcuuguucuacauaauuaaggcccugcuaggugucaucuuugaugggugguccuggcuuucacaagcuaauuuuaagacccuaccucccaucaugugcuuacuuaguuaaugaauaaagcaagcauaccauuaaguggaauuaaaucagacuuguuuucaguuaaaauagcgggauuucuggguaauuccauauuggaaacuagcugguuucuuucauaagagaaaugucucugguggaucuugguucauaggagagaaucauauauuucaaccaccaacagucagugagaauuuguguucauuuccuuccaguuucuuaucacugcuaauuuuccuucacuggcugucggccugugaaaacuccauggguguucaguuaauaguguuggcucaaauuuggauccaaauuaagaaauccaaguagccuucacguuuggccucuccauucaugguaacgcccucuuccucaaugccuaaucaaggaguuucugcagugcacagcucugccagguuaggauccaggagacagaugcccagauggcagagaaggcagguguuugugugggugauacagccucucccugcgugacuguaagaggaggccacagcagccccgggcacaagcccauacuuggaugacauacuugcaugggacauacccagagccugugagcagggucugcucacaccacacccuugcccuucaagagagccaugcaagaggaccuuugagucuuugugacaaagguuuggugggguuaagaagguugcggugucacuuuaaguuugaauuucuuugcuuuucuuggcuuaugcuauucuuaaucuuaaacaggaauuuucuguuugcagcgaacuugugcaggaaagagaacauuuuuacagaaagagauauucuuggcaaacauguacuauguuuccuucauguuauugaagaguguuucaauacagcauuuuuguuugcuuguuuuccuuauggcucacuuuccccuucuguuugcuuuuaugaugaauuacaguccaagucugccacagaaacaauuaaugaaugauaguuggugcaugcaugcacacacacccacaugcaaaaaccuuuuauuuggagaugcuuuuauacuuuaugaccacuugaagucucuccaauuguuacauacugagaguguaaaacauugagauaauaacuuauacaaauagucacaaaauggagaauugaauauuggcuccugaguuacucucuccuauuacccaaaagcccaugauacacagccuguuguaaauauaguuucuuuucaccuugaaaacauugccauaaaacugaaaacacuuucuaaaguuguaaauuucuauuagcauauuacugaugauuuuuaaaggagacuuuccauuaaaaagaaaugauaauuuucuuaauugcaagauuaaacauggaagguaaaagccauaugaaaaugauaauacucauaaaauaagaguaccucuggucauuagaaaacuggaaagaaaaagauuacagaauuacuagauuaauagguuguggucaucucugaaaauuaugcuuaguagaagauauuagugaguauuucuauaagucaguuaauauucaccaauauuuugguaacuccauaaagcaaggcuuagaauaaaauccugauaugacuaaagaaaugcgcucagcugggcgcagugguucacgccuuaaucccaacacuuugggaggccaaggcggguggaucaccugagguuaggaguucaggaccagccucaccaacauggugauaccccaucccuacuaaaaauacaaaaaaaaaaaaaaaaaaaaaaaaaagccaggcgugguggcaggcaccuguaaucccagcuacuagggaggcugaggcaggagaauugcuugaacccagguggcggagguugcugugaaccgagaucgcaccauugcacuccagccugggcgacaagagcaaaacuccaucaaaaaaaaaaaaaaaaaaagaaaagaaaagaaagaaagaagcucagcuaggcagcuguggcccaagggaaggagugccaaucaccagauggggaaacugaguuucaggagguccuggcucugccccucacugacuuguagggcccaacuucuuugucuucuucugagaaacugagauugggagaauggaauuacgaguucuuuccacuuagaaaauuccuugauucuauaacaucuggaggcuuugauacuuaugcaauugaagcuuuuuguguccacauaagauuauuugucagagaucaugacaaauauaggagagaaauuuaggcaaaacuccacaaaaauggugauuuguugcauuaccucugaggggagcaauuaccugaggcagaaagaaguuucgacagcccugcuugggaguauuugugcuaguucugcgggaucuguuaggucagguauggaaagacauacauucuugaauuccugugccuacuuagcacuguuaucccugaauuggccuuccuccucauuuccuuggaaugugccaugcucaauuauuuagcugguuaaagcucccagucacagucuaaagcuaugugucucucuugaccugcaguaauaacuugauagguccauguggcugccaagguuacacuaaaauccaccuauacaaugugucaugacugaaaggacauucuuccaggcaugcugcuucauuuuuaugaucauuagugauauuauaaaguucuuuuguaggagcaaucuguucuuauuucauuuuguguuugcucuagaaguuaugaagaagccaaagaucccaggaccauuucagagcuucagauggaacacuuggcagauagcauguuugcaaacacuuucaaaucauuuaauugggcuucauaaguaaacaaaaaggcaaacaugaauuacuugcccaguuucuuuuucaugccacuauucaaguguucacuggaaauucuugcaguguuuuguauggcaaaauuguucuucuugaccuaagauugguguuagauguugguuuccauauagaguaccauauuuaugaguucuuguucuuaguuaaugacaaaguugauuaugaggguaacccauuauagaaugggcucguuuuggaaaauuuucacuuaguacuuuauguucuuuucuguaacauauuuauguuagagagucuaucuuggcuaaaguugacaauagaauuuuggagaauagagcauuuuggaaaauuuggagucuuuuaguaaugugacccuaaucugguauuccuuauauucugacaaaauccccauuggauuaacuugaguuuuacaugaaauauacaagaaggcuuggcucuccaaugugcuaggacucuaagaagcuagggaaaagauggcuuauauacugucuuaaggaacauuuucugcaaaugcuuaaauuagcaauaccuaaaggaaagcuuuuguagaaauaaagcauaauuaaauaaguguuuuaaguuuaagaauaaaauauauuuuauauauagaauauaaugcaaaaauuuucuaauuugccaacaaguuuguauuuuuugucuauacaagauaugaaaauaaugugcaucauuacuccauaguugacuuacuaaaaauacuagcaaaagaaaauaugugacaaggaguauuaaaaccauagaaaauuaagcaacucauuuuuuauggucuucagcuguaaaaagucacuuugcagugacuggaaacuuacauuaaaauacggaaaauaauuagaguuaacaauagcuaguacaaucauauuguuauaucuuuauaauuugaaauuuaaagcuguuugauauauguagaguuuauauauggaugcaaaaccagucuauacuauaccaugggaaguuugaaggcaagucaacuuuugaauauuacuuauuuuaaaaaccaaaagacauuugugcugagccuuuuucuaaaucacugcucauuuuuccagacaucaaugaaugugaaauuggagcacacaacuguggcaaacaugcuguauguaccaauacagcaggaagcuucaaauguagcugcagucccggguggauuggagauggcauuaagugcacuggugaguaggaaaguaacagagguugcuuaucaaggacugcauagauuacacauaugaaaauauuaauuauguaaaguuauuuuaauuuguguauuauugguuuuaaauaccacccuuucuguuaauaaugauauaaccuuuuucuauaagaucuggacgaauguuccaauggaacccauaugugcagccagcaugcagacugcaagaauaccaugggaucuuaccgcugucugugcaaggaaggauacacaggugauggcuucacuuguacagguauguucacgcuggaaacaacugugucaacacuagucagagaagccaggcauuccacauuucucaggcuagcaauucuuuuuugaagacugggucaguuaauagaaaagauucaucauuuggcacuagagcucugugggaaaaaaaaaauuggaaccaggucaauuagggagaccucaaaagcuucucgauagguagauacguagguagauagauagauagauagauauuuaggugccauuaucacaucauuuacagugaucugugcucuaacauaaaaugauaccaaaaaagucauaccauucuccaccucaagucagcuaggccuuauaauaguuacaauuggcauauauaucauuauaugacuguauauaaugaugucauuaguuuaaacaaaucauacuuccuuuuauaugccuagccuuuauuuauuauuauuuuuuuuuugccuauuucucaccaaugacuuccuuucuguaccaacacaaggauaagcuugcuguagggaacuauguaaggagaagggauuagauguucuagauuagaagaacaguauguauuucucuccaacaggccaucaucaucaucauuaucgucaucaucaacauuccauauugguauaaguaaaaauuucaaaccugcuauggaauucauucacuuccaguuuugcaauaauauauuaaugaaauuuucuuuuuggcucuaauuaauagccauagaauuaacauaaacuucuauacacauguaaacauacaugauuagacuugucauuacauaaauuauacauauacuuacaugugcauauauuuacagacagcacuuuuuauaucagagcucuggaguuaaauaaaauaauaagauccauuagccauuaggucgcauagcugcuccuauaacuuaaaacauugauuuauccugagcacuuuguucauaaaaagucauuuaagcacaauagaggcuaaggcucauuaagugauuuaccuggaauuuuuuuuuauucccugaaaguuuuaucucagaugaaaucauuuuugccuaacuuauugauguuuugucaucaaaaaccucccaucauuuugagaacauauucaaauuccauguauuaggcaugugugguuuauguguuugauauuuaaaugccugugauuauuaagaaaacuagguagagauuaagcagauggaauuuuucuucucccuaugguugccauucuuuugcacuuuuggugcccaucuaagcuaagccugaaacuugagaaauagacacaaacaugaugugucauuuccugucaugggugugcccuccaugcggaugacccuucuugaacaggccuuaguuugcaugauuccuucggcuuauucauuuuauaucauucaggguaaauuaucauucaggauucugaaucagccacauguaaauuucauauucaguguuagccuaccaaagagaaaaauaaaugacuuuaaaugugucaaauugaaguuaugccaaaacauugcugcacuggaaaguugauagaccugaggaauuagaaagccccuaaccgaggaagaguaacguguguuucuuucuggcuguagaccuugaugagugcucugagaaccugaaucucuguggcaauggccagugccucaaugcaccaggaggauaccgcugugaaugcgacaugggcuucgugcccagugcugacgggaaagccugugaagguaacugauggggaagccacugggagccuugcugggcuugaugagauuagguuauuuaaacauuccugaugcuuuuuuuuuuuuuuuuuuuuaaacugagguguguuuuagcuucauuucuaagcuggucaguucaguuuguagagggauuagguuuccagcugaccauuucucuugcugcacagaaaaccucagcugacuggccacaagcuguacauccagccuuggccgcauggucugcaaggguguauccauuggucaaugaggguaaccaagugugguuaaaucagugcaacccauuuaucccuacggagggggaugcaaccuguuaaucccuacugagggagaaaagagcugaaagugcaaguucccugauaauguccuguugugggauuaucacuaaauauggaaacacagguuuuaaucuccacuguauuugguuuguagaaauaaaagcagagcaaauagucuuguccauacguagaaugguaugucucacauuugcucuaaauaucuaacauauaugaacauggaacaguuuugcaaaucuguucaauaggggacccuugggauacugccauauggcaugguaucgcucagcuuuaggcucugucauucugauaaguguuggucagacacgaagaguccugggaaccuguuagcuaaggcuggaucccauuagggaacacaagauucuucccuuuacccacauuugucaaauuuaagcacauucuccuucauugaaaagaagauuucaguagaaauaaacaaaugauaacgauugucaguagaaguuuaaacaagacccugauuaauguauuaguuaauaguuguuccuuguuaacaagacgugaacucaaaaucagucauuagcuaugacauguauacuaauucccucauguauuuuuaugugaauacuuuucuuuguuauggaaccguuggguguucuuuauacaguuuauauuaaauaugcagaguuugauauaaaacuccuuggagucaagaaaccagauuaugcucuugaucaugugccuaauaccuuguuuacuuuuguuacuccaaauauccaaggaaaacagguacugugccaccucuggugacacaaauagucacagugaaaguuuugcuucucuuauugcuauaagagaagguuuuguuuguuuguuuguucuuaauauaaaucauggcugguggaguggucauggcuauuuaaagcuagucucaagccugaaaaugugacugugugucaacugcacacgaagaauguuaacaggaggcagagacagaggccuggaagaagcgugugcgguuuuccaaucuccgucaacaaaggcaaacacaugccauaggacuagggacacuggagauuaugcaacuaauuaugacaguucccugaaagacauuguggcuugugaaauuuuaauucacaacaaaaacagugacuacauagauagauuaaaaaaaaaaaacgaauuuagcguaagguggcuugcuugccucuuacuuuacgaaagugauguggaccuacguggaacacuacaaaugagauauguaucuauaaaaugcucagcccgcugcuuggcauguaauagagacugaggaaaaguaaccucucaccuacgagacuucacugugcauggcaaaucaucuaaaagucuauaggagaagugcccagauugguguuagauacucugcauuuucuuaguauuuacauuaguugccuaauuauauuuggcagguuuuuuuuagaaaaauauaaguuaaguuuuuugcuuuuuucucccuccccccaagauauugaugagugcucccuuccgaacaucugugucuuuggaacuugccacaaccucccuggccuguuccgcugugagugugagauaggcuacgaacuggacagaagcggcgggaacugcacagguaagaccuccacuggcaucaaaaucagcucccuggugucccgggggacccagcuauuggagccucccugggacuacacaagggccgucacagaagacaagaaaagcaagggggaaguauuaagaaucacagauaccuuuucucagaccuggaacugauuggaggugaggauccagaggaaagagucuaagacaauugaaggagcacaguuuguagccuugaaauugaguuuguggcuacaaaggaauguucuaggggugcucuagugguguagcuucccagccauuuccuuuucuacuuggguacauuuuuggagaguuucguuuuggaggccaugccccgggaucauggguuuucuccuuguacuucguuguugcaauacccaccccacuccuuccuaccccugcccugcucguggucaccagaguacuggguacacagagcucagccaccuaucucuaguguauaaaucauuuucuuguugagccaaggacucucagggaacauuagaaaaagcuuagaaaaacuacaggcacccagcagacugacacucgguucucuuuggcacuaagacuuugaaagccauuugcauuuccccuuccuaauucaccccucuguucaaggauacugaagaaacaacuuauguucuguaugaguucaaauuuccggaaaaaaucuggucuuuucaaccaccuaaacaaaccaugacucaggggcucuccagaucaugaccaccaccaccacccugcaaaugcucuggauggaguauuccucuccagccacacauucuucccuugguuuuccuuaaagcuauuacgagaccaggcugggucucuugcaugccucaggaagucccccucuccauggccuguacccuguccugcgugccccagaucacuaucaacaucauucugucuaaucucguuucuguuacucuggcccuguccguccaaauucacaugcaauuugaacaaaaaaaucaucugcagcgcaacccgcaggaggguugccagauccaaggggaggaccaaggcaaagguguugucccucuucuccagucccuccucacagaagccguuugucuauucuugaguauuucaugaguguucaaaacagacaaaaggaauuguacagaguggaauuugccaaaacccauguccuaaauaucuggaauucuguacauauuuuuggaauagaaacugaaagggaaauauucaacucagcauggaugaugggagagacacuccuugccgaccucagggaacacacuaagccucacgcgugugugucaggggaagcagcaagaguugcccuucugaggguuuccugggacaucuugcucuaauuugaugaaauaacaagccacauauacucaauauauuuucuuaaaaccugugucugaauuuuugguugaccgaggucacaacaguguuuugccuucaguuaccuugacuggaauauuuuuccuagugccaaaguuauauauauauauguaauauauauuauauuuuauauauauauguaauauauauuauauuuuauauauauauauauuuuuuuuuuuuugagacggagucucgcucugucgcccaggcuggaguacagugguaccaucuuggcucacugcaagcuccgccucccagguucaugccauucuccugccucagccucccgaguagcugggacuacaggcacccaccaccacgccuggcuaauuuuuuguauuuuuaguagagaugagguuucacuguguuagccaggauggucucgaucuccugaccucgugaucugccugccucggccucccaaagugcugggauuacaggcgugagccaccgugcccggcccaaaguuauauuuuauccugaugacaaauuugaaugguaaauguguucuggggaaagaccaccaaagacuauaucauauuuccuuccugagguguuuuaucucugaaguggaagacugcauuucuagauguaguuauaacuaguagcuuuaaaauucuuguuuggagcucuagauugggcccuguucuuuuauggugaugucugccuacacuggcucaggugauaacuccacuacucacuguucgguuuuagaugugaaugaaugccuggauccaaccacgugcaucagugggaacugugucaacacuccaggcagcuauaucugugacugcccaccugauuuugaacugaacccaacucgaguuggcuguguugguaagaccuuaaaaacuuuucagagaagcaagcauacuguguauuauuuugaaaacagcaccaaacauuccauucucaaaguuugcaaaaugaaugauacagaaauuuaaacauuuccuaacucuacuuuagauucagauaucuuuuccauagggaaaauucucgguaguguauaauguucaugggcacuuuuuaguuucucaguaaaaguaaauuacgguuuuugaacaguuccugaaguggguuugaauuuucaaccccaguagaaagauucugccugaugcuuuuguguuuguauaugguaaauagauacccgcucuggaaauugcuauuuggauauucgaccucgaggagacaauggagauacagccugcagcaaugaaauuggaguugguguuuccaaagcuuccugcugcuguucucuggguaaagccugggguacuccuugugagauguguccugcugugaacacauguaaguggacauccuccuauuuauuauuauuucaacuccagccaguucuccuuucuagaucagaagacaaaccuuuucuacucuuagaucagagaagaaagaucaguccucucagcccuguagaggggaccuuauucccaauucgagagucagaaaauauuccugguuggcucacacuaaaagaucagguagggcagguaacaucucacuucuguguaagugaaaagcagauagcauuacuuuaaagauuuuccagacuaggguacuuucaccauguugcuuacguuccagggacacauugauuaucucuccucuucucaucuauugacuaguuuggaaggcuguacgccagacucagugucccgggguuugaagagaagcaauuaguuaagcaacuauaaaauggaagauuauuccauuguuaugggguggcuugaaagaaggcuuuagcauaugauuguaaggacauacaaacuaugucuccuaaaaauauaaaaggguuuucguuuuuccaagugaguccuguauuaugauucagaauuagauguagcuucuuuggcaaaauucaguggcuacugcuuauagcguauguugggauagguauggauucuuuuuuugcugaagggucauuuauucaauucuucuaaaaauauuuguugaguaccuagaauguguacucuggaugugcaaagaugaauuagacuagauccugcccuucaggagaauacagcauaguaggcaaauuaugaccuaaacauaagcgcuauaauucaaaauaggccucagaaagagaagaaagagcaggcacagugcuguguugguacaaagagcacaccuggugcacauuaggacuccacuaguugucacccauguaaccuugggcaaguuccuuagcauucauaaaauaccucauaggauuaaaugaaaucacucaugcagagcacccagcacaggggugagugcucagcuggcuccuccuucucucuucucuucagaaagggaggucaguucugcuugggagaggguggggacuuaguguguuuuuuaauugagccuucaagaagguugugacaugaaagaagaaauucaaaaaguauggaugauugcagaaagaggagaacaaguaaaagaggaggacuuuucauuucauuggugucgaagggggcaaacuaagacacuuaauuuggggagucagcuuuguagauuaaugacaguagcaaaacaauagauauccacaccacaccagaucuggaccagaguuagaacuggaauauauacauauaggcauguguacauauaauuucagggagccaggacagggauuagcagaucuggacagaccaugacauuaugaaagaacugaucuuauagcuccucacugggaugaugcagcagguuacagacauucuuauucacauguccuguacauaucaccguccuggugcauaccacugaaauaaauguuucuggguaaaauacuuggaugaaagaauuaaugggggaaacccaaggacacuauagaaaguuguuuuuggaaaccaagagaaucaauauugccacccauagaaacagaggugcaagaaaugucucuagucauuaaggagagaauugggaugggaaucaacagagaacagcuuuuccuaaggcucuauuuggaaaggguuuuggaaagaagccaauuaagauuauuaagggaagcuguaguucccagaaaguaggcugaacagaacauaaaaaugaagaugaaguuuuucagaaaauaaaaagggaaagaaaaucuguaaaaagaaauaagggaugaagguaagguauaaaacaguccacacacauguaagaccagggagugguuagaguucaaggacugaggacaguggccuugcacuggggacacauaauaaaaaccacuggaaaaugggaaguguacacaaagguguuaacuuacuucagacgggcagaguaacaacuaaagauuccugaaaaugaacauuuucaguuggauaugugaguauuucucuugaggauacuauuucuaaaaacuuuagauucaaaacaacucaauuugaauuuuuguuucaauagccgaguacaaaauucuuuguccuggaggggaagguuuccgaccaaauccuaucaccguuauauuggaagguaauuguguuuccuuugucuuaaagcacacacaacuugaauuuccuuggguuuauuuacaaugcuaaaggaaugccuuuguuuugauuuugauagauauugaugagugccaggagcuaccagggcugugccaaggaggaaaauguaucaacaccuuugggaguuuccagugccgcuguccaaccggcuacuaccugaaugaagauacacgagugugugaugguaaaugguccugguaggaugauaaggucuugcagauaucaagaacugaccugcaaaaccagaauaugguuacuaggaaaauagaauuuagcaguguagcacaauguucuaaacacgaacauagccagguagauaugucucacauguggcaauuuggacuaauguuacucaagugaugucauuucugguaaguccuaaaucucccucuuuuccugagaaaaacagaaucuuauucugcuggaccauagccucauuuaugcuuacaaaauauuuuuccaugcucuucagaaaagccauuuuuuacaugaauggcacagguccaauuucaguguuccuucucuauuuggaggaguucugggcccucuucuuuuaauccuucaccacuuaccauuggugcucauguauucaaauaagcuucuccuagaaggcggcccuuuggcuuuaugcuaugagugguggcccuuguucauccuguguuacuggaaagguggagaauauuaaccacuuacagguuucagagcacuucagccaugagccaugguuuucaucuacauggaggaaucacacaauuguuuaggaaagagaccuccuugugcucugcauaagaaauauuccccuggcucuuuaauggcuuauuaggucacccagacaauggcaaccuuauugaguauuaguugaacaucacaguguauauggcacagcucuaagacccauggaguuaacaaagauuagaaucaacuccuucauuuggaaguggggagaggaugugaaauaugcuccaugcugccuuaccaaugcagauucaugaagccagcuguuaauggcuucgggauacuauauacccuaucauagauuuugugagcauaagaagcguacuugucuuccuaagggauauuugauauuuuaauuucuccacauuucuaucucugccuaccuuugaggauauuauagguuaauuuauuaggagacucauuauuauauuugauaaugccucaugucagaaggcaagaguuccuuuucuuuuuuguuuuuguuuuuuguuuguuuguuucgagacagagucuugcucuguugcccaggcuggagugcaauggcaugaucuuggcucacugcaaccucugcauguagaguucaagcaauucuccugccucagccucccgaguagaguagcugggacuacaggugugcaccaccacgccuggcuaauuuuuguauuuuuaguagagaugggguuucaccauguuggccaggcuagucuggaacuccugaccucaagugauccacccaccuuggccucccaaaaugcugggauuacaggcaugagccgccaugcccagccaagaguuccuuuucuaaaacccucuuuccucaaaaggcacacauuuacacagagagaggacacggaugaaugaaauaccuauuuucguuaucuuauuugaaaauacccuauagauuuucuccucuaaugucaacauucauuaaguaucaggccauuccaaaaugugaaguuuucauauucacauaccacuuucucuuuggauuauagaugugaaugaaugugagacuccuggaaucugugguccagggacauguuacaacaccguuggcaacuacaccuguaucuguccuccagacuacaugcaagugaaugggggaaauaauugcauggguaaguccaagcuuuucucaguaaugcauguuugguucucaucuacaaagaggaagagagcucacaaguucaucaccuuagggugauguuacucaucagacugagugcuggcaucccuucacugucuuguuaggagacucuuccccuauaaaucauaacuuggcauuuuuucaccaccacgggugggugguugggaguuuucucuaaaauguauguuggaaaaucccaaacaacaguuaauaguacuucuuuuguuugacuuuuggguguaucuuuguacaauuauauuuacagugcugaccuacaguauuaaaacaucacgagucggaaacgagaaacuuauugccaaauggcaguagggaauuguuacuaggagacugggcagagagucauuuaaaguuuauuaaugcuacagcuauauaaugacuuaguucuguggcaugaaauaucagggaauguauuucucaaaguccuuuaucuuguagcagcauagguagcuagaaaguuguguaagagcaaguuuuuuguguccuuaucaaagucaagcuacaauacaauucaaaugaaacuugcuuguugaguauccacuuagaaauuuguugugauuucccacauggcaucaccaacccuccaauccuuuuuuuuaccucccuucuagauaugagaagaaguuugugcuacagaaacuacuaugcugacaaccagaccugugauggagaauuguuauucaacaugaccaagaagaugugcugcuguuccuacaacauuggccgggcguggaacaagcccugugaacagugucccaucccaaguacaggugaguuuuaguuucuccauuaucaaaaauauagguugaaaaauuacccaugaauuguuggggaaaucagucuuagcgaaggaagcaaagugugcauuguuuaucuuuacagggaaaaaaacggcucaugauuuaaauucacaguuggugcuggucauuccagccgaacacugagucacagaauauguuuucuaauguauacccuaauacguaaccagacuuguagacucagcauaucacaaaaauauaaacuauaaacaauguucucauuguuacugaauucuucauguaucuaaaagacuguaaacauuagacaaaucaaugugacaguaagggaaacauaauuccuugucuuuuuacuuauuuaaagcuaaacuuguuccaaaaauaguuaaaggcagccuacaaagauguaaauguuaaacaagaaauaagcauaaggcaaauggcaaacaagaauaagaaagagccaggagcaggacuaauacacaaaauucaagccgggaauucuacacacuugccugaaauaagcaauaauuuuagccccaaacuuucuagcagcuccuaugaaaagggagaugugaucaaguacaaaauucucaaugagcauaaagaaaacucaaaaugaaaggaaagugcaacuuuucuugauauugagaucgagauaaauuucuucuuauauucucauggagaaagaaacuaaauaauguuauuugucuuaaaaaaaaaaggcuaaauugcauccuuugaauaaauaaagacauuaguguacuguucuuauaucauaugguauaugcugugcauuauguauaugaugaugacaucauuugccaagauuaugauuuggguuaguugaaauuaucaugcaaggaauugauuaggguauucuauaaagggaauccuacaccauuuuccacagugauauauaaaauauuaaaucuguuguuugguacuaccugacauugcaugcaacagaaaauuguuuuuuaguaaaauguauuauuccauccauuguuuacuccagaaauaauauaauaaccaccacuuagaauucugauuuaccuccacccugcaaaauguuucuagaccagggcuuggcaaaauacaccccaugggccaaaucugucccaccaucuacuuuugaauggccugcaagcuaagaaggauuucuacauuuuaaaugguuggaaaaaaucaggagaaucguauuucauaauaugaaaguuacaugaacuucagauuuuguuucccauaaauaaaacuuuuuuagagcucacuaauuuauuuccauauugucuacuacugcuuucauggcaacauuaaauaguuuugacugacuguacagccugcaaagccuaagauauuuacucucugucccuuuauuaaaaaguuugcugacccuugaucuugaauaauggucuuuacaacuuuaggugguacuuaccuguugguaaaaaaucugaagcuuaugcacaccuggugugcauuuauauguaaaagucuauguauauauaucuauguauguguauauguauuuguuuucaauuauauugaaaaauacauuuauuauuuuucugagcuguucuaauauaaaguguacacaaaauuaauuuuuuuaaagauuagauuuuuccaaagauagauagaaguccucgcauuuucuuuuuuauccuaauggauuauugcauauuccucuggagaccacuuuggaaacccuuaauguagacuaacauuuacuuuuagaaaugauugccugaguuuugaauaucuacauacucuuguguaaaaugcaagauuucuucuugauguuggauauucaccaaauucagucauggcuuuucauuagcugugaaaucugcacauauuuuaagagucccuguaauuucuuuaggugaccaaugucagcuggcguuacaguguuggaagugaacacucauagauuaaggagacaaaacacaaggagaauaacaugcuguauuuugauuaaaauacuuccagaaaucuuuuacugauuuucacugagcgugaccaauaaggcaauggccaucugaagcuuagauugauaccauaccuuaccaguuacagucaugaucuggaaucacaaaaucucacaguuagaagggacugcugauagaauuuaguucauccuuuauuaucuguuaaauuugacuaauucaagugagagaaagacagagagagacagaaaaggagagagggagagggagagaauaugacagagcuguaccaaaugaaauccagcuccaaaaacugaaaaacuggugaagguugguugauugacccaaauuagucauuaauagaucugaugucaagaauguggcuagauuugcuauggucuccuauaaucuaccgagaaaauggcuuuuauacguguuccucaaacccuagaucucuaaaugcagaguagagagaggcacucuuaccagucccugaguucagagcugaauaacauccauauugaaauccaaacuccuacagguaaacucaugugaaugaguggcaugugaucuggggaucucuacuucuccuucauuaucacgucaacauuaggucauuuuuuucuucaauauuugucuuacaggcaagauuauaucuguaggaauuuucagguuuacuuuuuauuuuaaauucuucaaacuacagacaaauaccuuucaagaaugcuuacaaaauaauuuuuuucaguccaauuauuguucuuugcugaccccuauccucccaucccaccuuuguuuaaucauugcagaugaguuugcuacacucuguggaagucaaaggccaggcuuugucaucgacauuuauaccgguuuacccguuggugagucaugacggcauugucagaacuuucugguuuuuugccuuuguguuagcauuauuuuuucaguucccauuuuuuucuuaaaggaaaaaaaauauuaaacaaugccuuucacuuuauugaaacacugauucuuaguuugaaacaaacugugcaaacacccugugcagcuccaccuaauuggcaacaacauuuguuguucaugauuaaggggauuggaaagcuuuucccaaaauuacaaucaagcauaguuacaccaaccuuaggcaucaacauggggagagauucugggaguggggccaguugacauuugauuuaacuguaauucucaauccuuccuucugacuaagaccagguuaagugacuucacaccaauccuuacguguagauuguuuacauaaaguccuuucguggaucaauuuuaucuuacauggaaucuccucaggucaucugcuuugggaauuucagaugugaaauaaaaaucuuuucggucugaggcccugccugguaaaugaagcagagaacacaacauugggagagaugcuugugcaagaaucagaaguauuacacagcacucagccagugcaggcaaugcccuugugguuuaaaaccaaauaacauaaaaguagauggaaagcuauugcauucucugaguuuuucccuggugugauuuauaugcauccuuagaugcccucuuaagucugcacaguugugucuaguagcaaacaucaccacuugcuuuauuccaccuuauucauaauaaguaaacuaaaauccacaucagccuuuccagugaccuuguuuaagaaaacaagagucugguccagcaaucagccuggcucccuuagugccaaauccauauggcuccacagucucguccacguccaaagaaacuucaugguuuggaaagaaaaacugcuaaaugacauuggcauggaacaccuggcccuagcugcuuuguuuuuccccuucccaaaacagaucuuuuaaccucccuagaaucugugaucacaagauaaguggucuguaaugguagugguucuccacggaccaaccaggcauguaccccagcaaggcugcccuccaaguuuggcaguaagcaaagacuagaaagaacauuagcguuguccacuaggagagcuggaaaggcuucagacuucaucuaguccaaaugccuugcuucauauuugaggagacagaggcccagagaggggaagggacucacccaaggccacccagcuaauuaauaacagagcugggaccagaacacaguccugacucauggcuuaguuugcuucuagcucuugaaaacuggacaucuguuauuuagcuauaugcuuauuguuaccaaauuccagcaugacaaaauauuuagaugacugaaaaacuuuguuuuauuuaagcuuuauacucuccuuuuggaagaucuuaugauuguuggcauguggaguccauucauauaggguuaaaacuauagcauguuuaucaaucuugucuuaaaauauaaacuucacuaaguugaaguucaaauaaaauccugacaggaaaagaaaauauaauuuuuaauauauccuuuugcuauuuuauaccuaacaauggcuggaaauuagacucagcccguuauuguuaaacuugauaauaauauaucacuuauauuuaaaacgaaugugaauaugauguuucguguucuaacccacacugaaugaauggcaucugaauuuguuuuuuguuuacuuaugauacacaguugugauguaacuuuauauggcauuuucaugacaugaaugacaaaggugugaaagaucuaaagacauaauugcguguauucaaaauagcaaugaacccuuugagauucuaagcuguuucuuuucauuaaauaggucaauuuugccuucacacaaaaucaagcccuuuuuuaaaaagggucuaaaauaaaucuaugacaucaaauuucuccuuuaaaacagauugguuauagagugugguucuucuaaaauugcagcagcucuuguaggcuccacuucaguccgugaucaucuucucacaaguaugcaagcaaaguauguaccuugcaaaggcuccugacuauaauaaguaaacaacguaucucaacaacagucauagaaacuagugaauuggaagacuuuggauuguagaccaaggcuuugcauaccucccagcugagguguuucaucaaacccagccaaggggcugauggaagggcccuccaggauaacaaaaguguugaugacaguucugugaagauuguauuagggugaugcaggaaaucaccauaauacgaucuucccuuauaugauaagggaggcaggauggccuguuaacugagucccagugucaaauccugacucugccuuucauuggcugcuuggucuugggcagguuauauccuguggcuuggccucacuugcuucaucucuuaguuagaauagucauaguaccgagaccaucucaugggguggcugugauaauucagccaauaaauacagguugaaugcuugagaaauguaccagucaugcagcaaaugagauacugucacuauuaauacuauuaccauuauuacuacuauuacuacucuuauccuagagggcacuucaguggucaggaguucagaguggguaagacagagaugggaccacuccaggcuggggacauggccaagcuggugagguguccaaagucucuauccauagcuggccagcccugccuuagcagccuggauccuggcuguguucucacucuugguccuguuuuagugcucaccaacacacugccagacacuugcucuuaacugaacaaauuugaauugagcacuuacuaccugucauguagagugcuaaggaaccauaacacaguguuggagagccaagcccaacucccagucuuaggaagcacacauucuacugcgacaguucuuccuuggugcugaccucguuuuuauugucagccccagcccagcugacauccccacaccugacuuaccuccuuucuaaagccacaugaaguaggaagggggaguuaaacuggaauuugaaagaucagaguuccauaugaccaugugcuccucugugguucuuuaccagcucaccucugccuuuuucccuaaauauaggcacacuuggguggagaggcuguuuacccuugaccaucccucuauucuacucaucuggugcauccacagugcccagaggauacaaagauaucuccuaccuguacaaaauugacauucugaagcaaaacccagaacauauauuuaaauccaguuagacucaugucuggaaagugguuuaguuaucucaauuugcuauucguugaugucccuauugccaucaccaccaccccaacacaugcacgcacacacacacacacacacacacacacacgcacgcacuuuccaucuugucuuacccugcacagggaucaugugcuguccugucacucaugaaugacuacucugucucuagauauugaugagugccgggagaucccaggggucugugaaaauggaguguguaucaacaugguuggcagcuuccgaugugaauguccagugggauucuucuauaaugacaaguuguugguuugugaagguaaguggcaucaugacuuuaucauauccagaaaagagcuaacugaugagcuacuugauacacacuuggcgaauuucacaacauugaaauuucagaaaugcauuaagcucuagaaauaguaaagggcaugguguggaacaacaugaaauuucaugcaaaaaaaaaaaauucacuaacuucaguggaaaaaccaggaggcacauucccagccccuuucccccaacacacaguguguuaauauuagacuucccagcugauaugaaaaagcuuugaguuccugggugugucacauagauugcuuucguuucacauugcuggaaaaucaguaugaguggacagucauccuaguugacucucaaaaucauuucucuuccagacagagacuuugcuacucccaagugaaaacaagguuaaugcagauauuccaaaugcaugagagaauuccaaauggcaagaacagcaaauuugauuuuauaugaagaauguuggcaugcacauguacuuuuuucauuuucaaauuaccuccuguugccauguauauguacugugauucggagcauuccuuauagcacuucauauuuuuuccugcaucugggaaagauaguucucuuacauuuuaguaaaagggacauuacugguuauuaaauauaccaugugcccaggauaguuggaauaauuuucuauuuaauacuuacacuucaggccucuagcagaauuuuuauucauguuagaaaggguuauuaccccuuagagcacguauuauagcacauaugucaacauuuuaauguuaaaaaaaaaacuuuuuugucuauacugaagacaacuuauauaccacaaguaaaguuauaguccuaaccacauacuuguuaaguuccugucaccaggcuuucaguuacuguguccaagugggcacaugucccuuacucugccugcugugugaguuagugggaaugggguaauagcccuuccgagccuuccuaagaagauagccaguucagaccuuggcccaagucccugggcucugggaagccaucaaggaucagguaccuggagaggaagcauggaugugggagagggaacccacggcagaugaucuuacagugcuagaguuggcugccucccucacagccgcacuuuucccccucucaaacaugcucagcaugccugccaccugccuguggcauuuuccuccccacccuuccccucagagauggcuuugaugaugacuguacccagguaccuuuuaaccacuuauauuugcugaagcugcaggccuuggccagaacccauagacaagaccacccaugaccaccaagucaacuuagaccuugcuagauccaugagauuaaacacaugcaacuguaccaaugcaaggcauuuugcugucaggguagcauucuguggauauugagauaacuaagugcuccaacuucugauuuccauuucacagaauauccgucuucagggugaauguuuaauccagggucagcugcuuccuagcauacucuuagcucuuagaauaggaaaaugaagguugagugcauacaugccucagcaaugcugaaauuggaauggauuguagaggugauuuagggagcuuccacgccucugcucuugccaaguagccacauuaucagaugccacaucauagaagugcuucucugugacacuacucaguuucuccaguggcgcaaucugcccccuguguuucuauacauccugaauacaaagcagggcagaccuggugagugagguggugcugggucccuuguaacccaaggcagacacacuccugcuccugugucuguugcccagagaggcacaauccaccugccuuagacaggaacccccacugacugacugacaguccugaggguuuuccaccacagaaucacgcccaagaggcaucggcugauguauuugccacccccuuguaggaacuucuuuggucgagccaacuucuguguaaaagcccagaacugguacuaagggccaaccuucaccuguguuauaggccauccccuuuauuggacuuagucuguaaauuagauuguuccacuggagcagggaagagggaaacauguauuuugccccaugauauagcauggacauguaguaacuuuugugaugccaugaauuugaacuauauuaguaucuguuuuuuguuguuguuguuuguuguuguuguuuuguuuuguagacagacaacccccuaagcaaagucaaaacucuggaacacacaauauccauuauccaaaaucuuuucuguuuuaaugagaguugguuuguuuucaguaguuuuaugauaacucccauguuagguuuucuugauuugauugccuugugguaguaauuugagcaggugucuuuacagcccuguaccucaaagcacucucuacagaccaggagcaccugcaucagcugggaacuuauuagaaauucagacucucaggccauuuuccagacaugccaagucagaaucugcauuuuagcaagaucccaagugauucauguggacuuuaagauuugagacauucugcucuugcagccuuucagacaauagcaaccuuauugaaucauaaaauccagaucuuugaguaaauacaaggcuuccuaggauauuaaucuauacccaugucaagugcuggcccuagcagccaaguuucaugacuuuuuuuuagaugugagcaucauuagaguccauauguggucauaaaucaagccuugcauuuauaaauauuacuaagugggaaaguuuagauaauggacuuucggucuuccuuucuuucuuucuuuuuuuuuuaauagacuuuauuuucuagugcaguuuuagguccacagcgauauugagaagaaggcacaaagauuuaucauauauucccuaccccuacacaugcacagccucccccaucaucagcauccuccaucagaguggugcauuuguuacaauugaaucuccguugacaucauuaucacucagaguccacucugaugauuuacauuagagcucgcucuugguguuguacauucuauggguuuggaaaaauuuauaaugacauguauccaccauuccauaacuauucauagaauaaucucauugcccuaaaaauucucugugcuuugccuguguauccccuaaucuccccuaaccccuggcaaccacugauuuuuuacugucuccagaguuuugccuuuuccagaauguuauaugguuggaaucauacauuaugucgccuuuccagauuggcuucugauucgcuuaguaauauacauuuaauuuucuuuuuucuucuuuuucuuuuuccuuuuuuuuuccuuuuuuuuuguguguguuuuuuuuuuguuuguuuuauuuuuuguuuguuuguuuguuuguuuuggacuuggaguuuugcacuuguugcccaggcuggaaugcaauggcaugaucuuggcucgcugcuaccuccaucucccaggcucaaacgguucuccugccccagcuucccaaguagcugggauugcaggugcccgccaccaugcccagcuaacuuuguauuuuuaguagagacgggguuucaccauguuggucaggcuggucucaaacuccugaccucaggugauccgcccgccuuagcuucccaaagugcuaggauuacaggugugagcaaccgcaccuggccauauuuaauuuucuuccaugucuuuucauggcuugauagcucauuucuuuuuagugcuaaguaacauuccauugucugaauguaccacaguuuauuuguuaauucaccuaucgaaggacaucuugguugcuuccaaauucuggcaauaaauaaagcugcuguacacaucuauguugucuuuucaauagaacagaucaaaauaaaauauaaauuuguuuucaugugagaggcuuuguugacuggacaccagauucuguucuccuucaaauucaguucucuucugcucguagauauugacgagugucagaacggcccagugugccagcgcaacgccgaaugcaucaacacugcaggcagcuaccgcugugacuguaagcccggcuaccgcuucaccuccacaggacagugcaaugguauguagugccccacaggcuggacaugccuacccaagaguuugucuucaugaagcuucagauaucuggauuuauuuucagauaguuaagcugaagaauauaugaguuaagauuuagauugaugaacucuaauauuaaacuaaauuggaaaaagggauauugucaaaauaucuaaacacuuagcuuuuuaauccucuuucuggaugagauauuuucaaaacaagaaguaaaucauucgcauacauagauuucguauuugccugucugcugcccugccugcaaacacucacccccacacauuacacacacacacaauuaugcauacacacauuccccuaagcaacauuuaggaccaaaugauuuuuuuccuuccacagaaucccucucagaaaggugagguuuucaccaucuuggcugcauaccccaaaucuagacagugaagcucuccugagcugggucagauuaaucugcagaaacagaacaaacaaagccaucgcuuuucuucccagucaucuuacagggaaagggucacucacugaaggcagcaaacaucaacagccuuuauuagcuauuuauucccaugaccccuagagauuagauuuuuuugguguucacuuuugucagggaugugauagaaauaggaagcacguuggcauguuaucaacuucaguguacggugaaguuauucaguaucugaugguaucuuguagccaguggugugaaaauuuaaaagacugcuguuucagcccagaaacaaaauaauaucucagaaugauuuucuuguaaguuuuuaaguaauucugaaucuguauauuuagcaaaaaucacuguauauuuagcaaagcaaaucauuguauauuagucaggaagaauguguuauuuugcucacgguucauuucacgggggguuuccuggauauuuuaugcauuugugaaugaaacaacacaggggaacguggucagauuuuccuuggauuuccuugccuaccagugauuaagugguaggaagugcacuguucucuuuaggguauuuugcauuguuuuaugagaccuuggugggaagaggguguaauugccaaacaaaaaaaucgcauugagaaucaagacuuguuuuguugaguuuaaaggaaaauguguaaguauuuagcauuuugucaacagagcuguugcuauccauguauuaaaaauacaggacaggaaaagcagggacgucucugauaugaaccacaauacccuagagaaacuuggcauugauaccacuucccugcauuuugcucauaauuuauauuucuuuagaacuggaugaaauaauuccagucaaaauaaagaauugcugauaauauagaaugagucauuucacaccauuucacacucagguaagaagugggacagagcuauuuauagaucaagauaagacauucagccauagccugcuggagcuuaagucauuuacuguuuucuuguaggagacuaucauacauaaaaugcagccagccauaaguguugugagugagcaucauuugcagccaaaagcuugauuuccuuuauucauugaaauccucagaagaaagggaauuaacuugaguuuugcaaccauucagccuguuggguugaagaccucauucuagaaaugucuuuauuuaugucuuacuuuuaaaauaucuuuaaaugcuauucuauacuuggcauuuuuuuuuucaggcaugcugcaaaguacuccuuugugcaucuguuuaaaaugaaaauaacuaaaacuuucucuccaucaugagauccuuauuugaauucauaagcacauuauuucaaaucccaaaucacaccuggccauagcacccacauuauugcugagagagcugagagaauaauuagauaucugagcucaggaugcuagucugacagcagaagcuggauaguuagaacaaaugcaacccccuucugaaaugucuugccccacaaaagacaaggaacaguuucuucccagcuacuuccuugugguuuccucucuuucucuguugacuauuuggguuucuuuccacaguagccuguucagaccuccuaucccaaccucaaauaugaucaucuaagaguucaaauucuggugcuuguggaaaccuagauuucugcucuaguuuuaccaguagaacuccaaaguacuccccauguuucauuuuucauuuauuuaaaccaucaugaaauagggcaguagaugaaaggaaauuccuaauuggggaucccuuucuaauaagauccuuaaggcucuccauuuccuuguggaacucagauaugagacagaccucguccccugcauaccuccagguccaguccuaccugaaggugccaaaguuuugggccaacuaugguaggaccugagacacccuuccucaagaucggaaaucagucuccucugccuauacugggaagcaguuggcucacuuuaaauucauuuucucaaaagggaauaaucauaauuuguuaaauagcauuucugcauaggcuaguaguaguuccuaagcugcucuauuucaauuuccccucauaaugauauacuccacuucacuuggaacuucuaaaugguaugaugauucaucuacuaaauaggagauaaccauaacaguggcaucccggacacaugaaauggaggagauguccaugauucuggcacagggaggguugcugugugcagcaaaaaguguccauucaugauuacuguguucugaguagacauugcaggcaaacggcaagucuggauuauuuaacuaagagcgaaaugccaucugcccuacagcaucugcagcaaagaugacacuccauuugcuuucuucugugacaguaggaaaaucagaauggcacagugcucuucaaaguacauuuacucuaaacauagagcuuuaaaaaauuagagacguaaguuggcauauaauuaugucauaugugaauucaugcauuaaauucugccccucagauaaucagauuucaggaaagcaacaaagauucaguugaugauaaauauaauuuagaacuuaaagacuggcagaagcaagaugagagggcuuccuuuugaauggaugagaguaaaaagaaagagacaguguucagguugucacaugcuaaaaggagcccuguguagacgugaauacuuggugaagauggaacaaaaaguuacaggcauaagacaaaacaaagagaugcaacuugaacaagcagccauguagguuguccaucaagaaaaacuuaaucuuagucauaggauuugacuuugauauaaauuuacaaaggaagccaugaacuauccaugacuuaaggcaccaaaucuuaacuagacaaaauacuucaauuaauuccacagucuguggugcugcguaggccgauaaucaaacagaaaauccucccggcuugaauccccccauuuuacuucuaaguuuucucaucuuucagaauauuuuuugauuacuuacccuuauuuuuuauugugucaaguauuguuaacauacucugacuaugccugguaaaugagaguaaguuuuaauccauuuugaugcaaaaauaaauauaucuguuucacuaacuuaguuuagagcuaggauuacuccugagaaugauagcuagaaguaaguuauucaauuauauuuugucuucuaaguucucacuuaagaugcuucuuauuuacagaucguaaugaaugucaagaaauccccaauauaugcagucaugggcagugcauugacacaguuggaagcuuuuauugccuuugccacacugguuuuaaaacaaaugaugaccaaaccaugugcuuggguaaguaugcaauuauuauuauuuuuuucauaugcuguugaaagcuucauuugauucuaaauauggauaaaauuuaauacuaagucuuuuaguaguauuuuugcuauauacaaaauaaaaacacagacagauaugcagcagugauauccuauuuaaucuuuggcaaucugaacaugauaaaccucuuccuuuguuauucauuuggcugucaguuuagaaaaaauugacuaagggguaaauugaaaaagauauuaauacaaaaauauuaauguuaauaggcuauuauucauauguaauauugauguggauuuucuuuugaguuuuugagugugagaugaccauuuuuuuggaaggguuuauaguguguaccagauucucaaaggcaaauuuauaaauccuacaaaggcaaagaaaaguuaaucauuuuucuagaggaaaaagagcucaggauuuuaaaucucuuuccugauuucucuauuaucaggaugcugauuuagaauaaacuucaguguguaaugaaucauuuucuucuuuuccuuccuuuauuuuucuacuuuaaagcaauaccauuaagucuuuuugggacauuaagaacauaaaucagauucacagcugaaagaacaauuaauauaguaauguuuaaguccuugacuuuggcuaugacuggguucauccauuugggaacauuucucauaaaguuguaucuucuccagaguaaugacaagagcacugacagcccuacucaucacugggcagcuaaccuguguaaaagcuaugaugauccugcccaacuuucuuucuacaucucucaucugaauuuucuggagcccccuaacauagaaccuucccaaccaaagaacuucaccaguuuggcuaaaaaugaaucaaggcaaaaauucuugauuacuagcaaugacucaucuggguguagucuucaaccacagacacacauuagagucccuuuggguuagcaauagcuuccugauucaggaaucacagaucauuuaucuucauguccaaaaugugaaaagaaagggaauccuagcucuaaucauuacauuuugcuauucuccguuguuaccuuccacucucucucucucucauuucauccuugucccucuucauggugccucauucuuucaaaccagcaguaacaacuuucuuucauuaaauuuuuuauuacuuccuccuuaauauaaugugcaucuacucuuuauaagaaauaugcuagcugcugugaugagaugcaaagacauauaagaugucagaguagcuuuacaaaaucaucagagaaaaguacggaccaaucaaaaggcgaauaagaaugcaagcauguaugaaaagaacaaauuaagugccaucucuuugggguaguuuagaaaagugagagaagucaucauugguggaaguuguucuauguuuuuauggguguagggaaaaaggaaaaguugucugaaaugacaggugagcuagaaagcugaguuauuuuguugcugauugugggguaaugccaggugagucacugcuuuuugguaaacuggagugagaaucuugaagguugaaguuugccaaagguggcaacaccucaagacccagaugcacacagaguuuuuuccauuuucaagugaaaauauuugagaaaaguggcaaggguggagaauucuagaaguaaauagaauaaaauaauucuuguucaggucucauguccuuagcuugccuccuuucacuggccagccaaggaaaccauuuauucccaagauuuagagcuuugccgcugccugguaucuugcagggaugacugcugcuggagcugauaccaacaucaagaaguucucagccuauggaugaggccuggugaacccuaaaaugcucuuuagccacuguaaccguguaaccacuuuuucuacuuauaauuauguuucuuuauggccuuucuuccuacuagacauaaaugaaugugaaagagaugccugugggaauggaacuugccggaacacaauugguuccuucaacugccgcugcaaucaugguuucauccuuucucacaacaaugacuguauaggugcgugugcaaaauugugcaucagcaaaggaagucaguuuuauauguguucuuuguaauuagcaucaucucuaguguuccagcugucuuuuaaaaauguaugcuaucuuaugcauaacaauugguuaugggacuugucaaauacaaugugcucaacaugaaauauauuacagaagucuccccuuauccgugagggauacauucugagacccccagcagaugccugaaaccacagauaguacugaacccucuauauaccauguuuuuuccuacacauacauaccuaaaguuuaauuuauaaauuaggcaugguaauagauuaacaucaauaacuaauaagaaaauagaacaauuauaacaguauacuguaauaaaaguuauaugacuguacuuucuugugcacugucucucucucucucaaaauauuuuauuguacuauacucaccuauuuuuggguagcagcugaccuuggauaacugaacccccagaaagcaaaaccauagauaagagggaaccacuguaacuauauccauuacuuuuauuaaaaugcuuauuagcagcuauaauuuuuaugucuacuuugcuguaaauuaaauaaauuucaaaauaaauggaauuagauuaagccaaaaaauuuuuaaauauacaaaagugauucuuuguauagaaauuauaugauucaggacuaugaaccuucuggucuagauguuucauguagccucucuuaaauaaaucauugaaucuacagaaucuccuucuaaaacauacuaggcaagaguaauaagccaaauucuuuaaauuuuauugugcuauaggcuaauuuaaaucuaauugcaagaauacaaaggaaugcccuuagcugaauuguguauuaggauuuuauuuuuuaaaucaaaaaauuuuuaaaucuaaaauuuaaaaauaaaaucuaaaggaaaaucaaggaaaaacugauaggaaauuugaauguaaauugucagucucuaauauaauaauguaaucuuauuguuaaauguguauaggugcuuaaagccaguucuguuguugcaaacuagaucuucauuggcauuucuuguuuggcuaagccagcaaaggccacuaaaauucagaaaaaguauuuuuucuuuuagaaguuuugauuauugcugggauuaugacaucuuuggaauauauuaaaggauuguuggggauuuuucugcagauguugaugaaugugcaaguggaaaugggaaucuuugcagaaauggccaaugcauuaauacaguggggucuuuccagugccagugcaaugaaggcuaugagguggcuccagaugggaggaccuguguggguaaguacaggacuuagaaagaccuggaaagaaugcuuccagagaccacucaaggaaucaugcagucucuguucuaaugcuucuuucuggaaaccuggaggaaaagucagaguagaauuauauuaauccucccuauaaaggcuuguuuuuauuuaaguauauauacacauauauauauguauauauauauacauauauauauguguguauauauauauguauauauauauguguguguguauauauauauauguguauauauauauauaaucacuuuuucccuuauuuuaaaaauuaagcuauuguacucaccaagaauacucaaacuauuaaacagugaaauugcuaaauugcucuguaagcaauugugauuucccuucuuaaauauuuuucuuuaaaauacuuuuguaguaagcucucauaucuuuugaguauccuuaaaaucuauauacucacugacuuuucacaugcuacaauuuucuggaaacauuuaauuugaugcagguaaaauaaaauaugguuguuaugcuauacauuuuugaaagcugauaaagcuuauuuuuauuauugcuuauuuuucuccaugguggaauuuuaugaacuuuaauuugcuuuauguauuucuuugauucauucuaguuuuuuugaauuuuaauuguuugauggaagucaugccagugggaaccucuuccuuauuuuucccuuuucuuugcagauaucaaugaaugucuucuagaacccagaaaaugugcaccagguaccugucaaaacuuggauggguccuacagaugcauuugcccaccuggauacagucuucaaaaugagaagugugaagguaggaaagcuaucaguuguagcaaaugaggagugucggguguccacuggacuuagcagaaugagaauuuuuguaaugacgucuucauuuuggaauacuuuaucagaaacaaaugcaagggcauagguaugacauggucucauccuucuggcaagacaagaagcacuaauuaucaugcuaaucucuaaugaaguuauuuuguucugugcauaugacugaucauaugauccugacucuuuuccacugugcuuucacacauuuguuaggaaugcuguguccuacucccaguauuuccgaacuacauuuuuuaaguggcgauucuuugcagcuaaaaauagcuccugauuccauuuaaaaacuuuaaaugaccacauucaagguuggaugaaugugguuauaucguuugucuauuuuguuuuuaccuauagagcaguggaaaugucuuauuucaaauaaauucucagcaaauuuuacaguauuacauuccuuuuuguuuguuuguuuuuaauggagacagggucuuacucugucaccagguugaaguacaguggcacgaguauagcucacuguaagcuugaacuccugggcucaagugaucauccugucucagccucuggaguagcugggacuacaggcaugugccaccaugccuggcugauuuuuuaauucuuuguagagauggggccucccuauguugccaggcuggccucaaacuccuggccucaaaugauccuccuuccucagccucccaagggccuuccuuuaaccucaacaaauaugucauaucauuaagugaaggacauuaauugcuagaauuucauaaauaaguaggguugaaaggauuuucaagaagucaccuaguucacaccccugacuuuaaacaggucugcaucuaauccacaaugagaauuuucucuacuuuuaauaucgucaauuagaaauuuuauuauauauccaauuuaaguaacaaucaaguggugauauuuaaaauggaaacaccuuauugaaauugucuagaugcaaauuuuuuaagcauguuauuuuacuuuuauuaaaaauuggcuuuauuaucaauacauaaguucgcuaaauugaacagaauauauauagaaagaaaaauaacugcacagucaaugaaugugcccauucuacaauauuuggcccuauccuaauaaguuggcauguacaggcuaauuucuaccauaauauaaauagucauaguaauaauuaaaaacaacugaaaacauuugagcauuuucacaaaaguuaacuuuuauauuaagaaaagguuggauauagggguggaaggagugucagaauggaguaauucaaucggcaauagaagaucagauucauuaauaaaccacagggaacauaacacagguauaaaugcaacccaauaacauggcaugauggagaagcugauuuugcguugcacagaaagagaaucacuuggcauugcacauuucuagaauauuuauugugugguauuuacaauauuaagucaagauaauaagguuaauuucucaacuuuuccuuaguugggccucuugagaauaaaguuguauaaugcaaguacauuuuggugugaguagaaaccuuugcacaaauauaaaaauaaagagcccaggauacaaggauauuuuguguuuuguugaaaaaauaaaaaaguauucucauaaaaguagcauggcucagaauuaagacuuaccacuuuguucacuaaaaauuccugcugaaagucaggaggaaagauaagugaguuuguuggaauagagugggcauauuuuuccauagguaaucguauguuuuauugaccaacccaagccaauuuugaaaguagaaaagggcacuauuaacaauaaagucaggccaacuggcaugagcuggggcucccccaggcaaacuaggacauaugguuacucaagccauucaaacuucuuauuggcuacucuuaacuaccacuguacaggagcuaagauguauaauauacuaaagaaaacaugccacaauucuaaguguacaguuuccuauugucuauaugaugaaagaaaaagccuguacaagaaagguauuuuugugucuucagaaagauuaacccacaaaucaggagcgucaucuucuaugauaucguuaguuugcacuucauaggauuauacuuauuuucaugagucuuaguguucuuguaaaauucacaguuuuagggcuauagcauaggguauugggaaaaguucugugggugguuggaggggaguaaauuuggaucaaaggccuagaucucacauugagugagucacuagcaaugugcuuaaagucucagcauuucugcuuccugaacaauggugcagugugacucuagaauuucaugcuucuuuccuggccuaggguacuaugaaauuacucugacuuuucuaguuagccaagcaacucagucuggguaagagacguuugucacugcaccccuuagaaggcaguugcacauuccauuuuuauaucaauaacugucaaaacuaauucuuuugaagucaugacaaccuagaaguccaguccacaguguuaugguacagaaaaauaccuuuauuauuguaagaguuuggaaacucaguugcccuuuguguguccacauuguguguuugguaccugaugaugucuccaucguguuuugacuuuguuugacucaugugauucuuuuagauauugaugagugugucgaagagccagaaauuugugcccugggcacaugcaguaacacugaaggcagcuucaaaugucuguguccagaaggguuuuccuuguccuccaguggaagaaggugccaagguaagugucuuugaaggcuuugggcuuucaaugcugcauguuuauuugugguggucuuauuuuucaaacauggcaaagcucuguuucuuugugaacaggaagauggagaguuuucauucacccagaggucuaaugauaaccauaugucagaagguucauuuucacuuuuaagguuaaaaacucauccaucaaguuaugguugcuuauacaauuguacugacacauaaaccucucucccacuaagaacacaaaugcugauaggcccaucaguggggaaacaccuugagccaccgaaacagcaaagccugggggaaguugagcuacauauccccuaccucugaagagauaagcugaaaaauguggguccaaaguuagacuugagacugaaaaacugcacauuaacccauuugcccccacaauaugguaaccaucccuuauaucacaaauucuccaagaaaacaaaaauaaauuuaaacugaucaggauucuugcugggccauuguucauuuuuaggaauaauacuugucaacuauuugaguaaagauuuucaaggguuugccaaugacuuucaaauuuuaaacaaaaaucaaaaggauccugaacuuuggcauaacacaguauguacuuaagucccagaaaacuguuuagacuuuucuaaacaauacaguuguguauggauaucuacauacacaaacuaguuucaugaauuccggggaagggagaugaaacaaacacauguauuucuuuuuuuuccacuuguagcuuuuguuguuugguuguuacuguuguuuugauguugaguuggguuuuuuuuuuuuuucaugguuuuuugguuuugcuuccguauuaccaaauauggaagaggcacuggauaucauuuaagguucaaaaaauugaguuuggggucccagcccugccauauuuagucuagagcaagucauuuaaucuuuuggaagcucaauuuccucauuuuaaacaacaauaauaucugcccaaccagccuuacugugacaaagcuuuguuaguuucugaguccuuuguagacucuuguuguuauucuaaugaucugauuaacuuuuuacuuuucaacuaguuauuugggaaguaagaaggagaggguugagaguucuccgguugauuucagcuuguugguaguugucaguggucuguguggauuucaggguggugcuuaauucgaacagauauucugcaugguacagaccagucagauaaauucuaacuccuacucccuuguuuuugugugccuuuggcuuggccugaauuuggaaagaaagcagugagaaaccaggugugaaucugccgauguggcaggccagaggaaacuccuaggcuauuaauucaauuugcacuggcccaucacagagcaagcuaacgcugcaggaagaaucagcccagcugugagcagcccugccacaugcucagcuccaggaggcagagccagaacugaggaaugcaagcagggaaagugacuuuuguaguucugaugaaauuucgaggucauuaagggcucuuugcagauggacugguaaacaggcaucccagugaguccugaaguaugugggcaagcacagcucucuuccccaaugcaagacacccuugauuaauaagccaauucuagagaaucaccacaagcuaaaguaagucuccuacagagcacagauuuugcuggagccaggaaauugagagcuggguuuuucuuguaagaugacaaauuaggagucagacuucuauugcucaugaaaugagaaaauuccacagaaccguggauaauguuuuuuaaaaagcgaaugccaugggacucagguggacagagccuggcacaaaagaccacagguguaaaugagccacucccacuugcaaaguucaacgaagagaauuugccacuuagacugacucaagacuucgugcauuugagucucugucuaaugccaagauuuuuuuuuuucgggguggaguggugugggggagauagagcuggggucugggacgaagucagcuauuaaaggaaaagagaaugagaauuuuaauacaccaauauuacaacauacauauuuaaagaaacacuacaaacuggaagacaaagcagaguuaaguuuucauauauuuguugagacauuuuugugaguagucacugaauuauaucuaaagguaguuggaggcauaaauaacaaaaacaagacugauaaauacaaaacauuauaugugacaaagaacuugaagaauaaaagagaucaaaaguguucuccaagaaacaagaauuuguucagucuugaaguuucucagcaaagcaaacauuuggguggcagagaugccgcaggauugacuuuuauugcucuugaccuucagaaggauaauucauugaaaggugcuugccagguccuugccacaacagauggggaaguggaauagaaauuagagagaugauuuaucuggaugaguugguagccaugaaagguugagcagguuuacuggggaggcuaccugaauuugauuuacauaacuugguaaauauaauagauagauagauagaaacuuuaauucaugaaaaccuuuccuuuguuaucucuggcaacucuguuauuccuacauugucuucuuugucaugaaauaaaagcuggugagacugucuuaacagaagugcuuaggugguuaugauaguaugguuccugggauugaaaaacagugauggaagugaaugaaaaaggcagagguggucagauauaaagaaagaagaauaguacaauauggguaugaaagcauuucuuuuaaaccugcagauuguggccucuguguaaugagaggaguuuuggaaggcuuuaagaagucaaguucgagggaaaacacaguccauaccucugguugagcucacuuuuuggagucaauguguuguaugagaaauggaaaagcccguuuccaaaauuaugucaagcaauguuggagaauuuuauaggaaguagaucccaucuucuuuguuggagucaucaaagcaauaaucaauauugaaauauauucuuucaaagaaagacuauucuguucccacccacccacagcccugcccuccucuuccuucccucucuguguugagcuaaacaagcuucuuuuaaaaauuuaacauugacacagcucugcauauguguguguguguaaaaucuacaaaaagccccacuugcauuuuguagccagcaucuccgggaguaucugcuucagugaccaacccuuguguuguauuuuugcccaucuacaaaguugccacuucuguauuuguucugugccugugaucugggauuuuauuuuaguuccagaguuuaggggacacagaauaaaccacaaagugugauaucacaguaaauauuagaacuaagaggauucucuuacucuagugugcucauuaaacaugauauugcaagcagagcuaucaaugaaggaaucuugugaaugauuccuucuguggacuuuccaauccugaagucacugacagaugucaguuuugaaaacugucaguuuuggauuuuauuggauucacaucggguuacuuugaaauagugacuaaaaugagaaguaauaaauuuaaguucauagaguuguucaucagaucucacuauacaaaagauacccaugacuuuaacaaucucagcucaguuaccauuagaaucacguaaggaguauugcugugguccugagaggagaacauauauaacauaguggguuguucuuuauuugcuauggugcaauacggacucaguaggaaagcaacugaagggugucauaaauuuaugcugcagauuugcgaaugagcuacuguuaugcgaaguuugaaggaggaaaguguucaucacccaaauccagaaaucacuccaagcaggaaugcugcugugccuugaagggagaaggcuggggagaccccugcgagcucugccccacggaaccugaugguaugucugucaucugcauuucucucugggccaugcagggugcagacuggccaugauguaaguaagacuguaggccuuaaagacaguaacacaauuuaauuuaauuguaagucuaauuagaauguucauuaaaaauuauuuuaucucaggagcuugguaguuauuuucuuuuuaauuaugucaugaaucacagaugcccaaggaguagacacaacaucuuagggagucucguuaaauaacuuccucugguuucugggcuuguuuuuuccaucauuuaucaauaugcacagcauguagcaauuuucuaccucaaaauacuuguggagaagcuuguaaugaauugcuauuguucuaucuauuaaugagugucuccaccacagaggccuuccgccagauauguccuuauggaagugggaucaucgugggaccugaugauucagcaguuggucaguugccugugcuggauucucagcauuucucaguauucucaaucugcuucuucucuaguuauucuuauuuuucuccaucuaucuuggaaaauuaagugcuacuuuuuugucccuucauuuagauagcaauuauauuauugcauuauuagauaaucuuuugauuaaacacugaaaugaucauaauuuaucuucacguuuaaaaaauaccuuguuauucacuauuuuuuuucucuugcuuaagauauggacgaaugcaaagaacccgaugucuguaaacauggacagugcaucaauacagaugguuccuaucgcugcgagugucccuuugguuauauucuagcagggaaugaauguguaggugaguaauaaguuuucuuccauaggaacuuuacaaauuaaaaauuaagcuauacaguauucacuguauagccaugaauauagguaccaagauggcacugaaauaaguuuuauccauccacucauacaucauucauuuagaauacuagugagucaccaucaggucccaggcacugugcuaggcucuggagcugcagcacugaaccacaaagacaaguuccuuccuuucauggaccuuacagccuaauggugaaggcagacacuggacauaucagaagagauacuagaaaggacaacaucauaaugaaagucuuugugaaauuuuuuaaaaauuguuaauggucauaaucuuauucccuuaucaaauaaaaauuuuaucuggauucuuuuacauuuaguaagaugaaaggcuauauaaccaguacacaaucuuuuuuuuguaacccuguuuuuaaaaugucaaauaauggcuccucuggcuggccuuugacccuuaaucaacacuaacucuaacuuaaauccaaggaucauauuuaguuaucuaagaauuccagagugauucaauauaacauaauuaauacuagcauaaaugcugagaguuugucugugugaauuagaaaguacuuuuuccauacaagaaaucagguuaugaagauuucagcuccagcuauggcugugggaguuuaagcaguuuuuuuagcuuuucuaggccuuagaauauaauauuaugcaaguaaaauaacauuucuaauuaccuuugcagcucuaaagaucaaugguaucgggauuuuuauuaacuugaaacagaaauaauauucuugacaguaauugaauauuauaguagaacaaaagcaaauauuucaauguuuucuccucagaaucuucaguuagugcuaauaugugcauaugaaaugagccucuucgccuaggagcuccccaccauagccucuugccuuuacuuuugacuuaagaaccucagcacaagaaacaacuguugacaagagccauuacucuucugugccuuagauagcuaaaauaucaauguuauuucucaaaauuauuucuuuccuaaggggagauauucuccccaagggaugugucagaauaagaauggugaguauucuagguggauggguuagaaggcauauauacacacacacacacacacacacacacacacacacacacauauacacauauauauacacacauauauauacacacauauauauacacauauauauacacacauauauauacacacacacaugcacacacacacacacacacacacauuuuaggucucuggucaaagauuuguucucuccgccuguguuuuagagcggucauaaccuaaacauauuuuuuucuagccuuuccucuuccuaauguaaaccaucugguuucaacagaaucaacacaaucuacuugaaucuugauuuuauuugauguauuaauuuuacuuaaccucuggucuuuuauuuuacguaaguuuagucuuuuauuuuauaucuggcaaaaauccaucauguuuaaggcuucuuggggagugauguaauguaaggccaaacuguggauguauuucugcuuuaaacaagcagaaacuuuugacgagugauaggggccuuuuuuuuuuuaacccuuagagcaucuacuccaaguagaagauuuaguuuauaaugugggaggcuggagaaacucauggagaagagcacuguaagggcuauauguccaggcacugucauucucacugucauugccacugccacugagcaagucgaauuucacggcuauaaaccugagauaauaagacaugcacacucccuuuuugcaagaacagaaugagaauuaaacauuacagaucaggcugggcuugguggcucacaccuuuaaucucagcacuuugggaugccgaggugggcagauugcuugaggucaagaguucaagaccagccuggccaacauggcgaaacccugucucuacuaaaaauacaaaaauuaccugagcguggugaugugcacccauaauuccagcuacucaggaggcugaggcaugagauucacuugaaccugagaggcagaguuugcaugagcugaaaucgcgccacagcacugcagucuggaugucaaagugagacucugucucaaaacaacaacaacaacaaaauuacaguuuaaaauccucugauagaauaaaagguauuaucucaauucaucauguuuuggacacauuccugguuucuugcagauacugaugaauguucuguuggcaauccuuguggaaauggaaccugcaagaaugugauuggagguuuugaaugcaccugcgaggagggauuugagcccgguccaaugaugacaugugaagguacaucucuuaaacagagaacaguugauuacguguacugauccugggaacaauugguugauuacaagucuuaauauuaaauacaacucaggguguauauaauaaagaucaucuaggccugaugggccauuugaucauucuucuuuuguggccucuucucuguagggaaagagagauauccaagaaugauacaguuguguguucauggcacaucuacacuguauaucacagagaguucucauugguguuucccuaccacuuauauuuagaugcuuccguguuguuuaauaccuucuuucuuacucucacuuucuccuucuuucugucucucauacucccuuucuuuuucuuuucucuuuuucucuucuuuucuauuucuaggagcacugcacacuaagauacccaccaucauccuguagccauuuggaggcaaucacagcaaaagcgguugccuguaauauauaagcaucugaaaaguguccauccguaagccugguggaauguauggaaagaaggaaagggagggagugucuagagcaguggcucucaaagggugguucccaggagcagcuguaucagcaucaccugggaacuuauuagaaaugcacauugugaggccucauccaagaccuccuaaaucagaaacuccgagagugggguggagcccagcagcccucuaggugaucugauacacucucaaguagggauucacuggccuaaggaaagaaugaaggagaggugaaggcagagaauaaaguugguagcaaagagagcucuucaucagauaugaucuaucaaaugcccauugucagaguugugguaaaucuuuaaagguugugacuaagucaugaucugggcucucacucguguucuuagucagcacuggccuuggggagcaacaugauaguugagauggucuauuuuaauccugcuuuuccaaaacacauucugaugguuccaaacucugcagucugcagaaaugacuuuuuuuccauuaacaguaaacucauucccaucuauuuaagguuugaacaugggcaucuguguaaacugagugucucugucaguauaaaaugaucuggaacacuauuugcuugggcagaagaauugcuguuauuucacaggagccucuuuguuugggggaaagagaggugguuaacaauauuggaggaguugguuucuguucugaccacaauuguuuuggcggaauggggcaaaacugauucccacgccauguaacuguugggagugacaaauggucaaccugagccuucuaagccaaaauuucagaagagccccucaaauguuggguggccuguaauuucccauccaccuaaauaaucauuaauaauuauaccaggacaacaaacauaaacugggacugugcugggagaaccgggauggagagucacucuguuuauaccaaauauaaaauaaucaacccauuuuauaauuuccgggaaaugggagaccacuugauccauccauguuuaugacaaugaagcauugcaacuuuugguaaaguuuuagaguuuuaguucaauugguagguucccuuuuguugcuguccaugaucccuuauuuacuuacucuccucugcugcagauauaaaugaaugugcccagaauccucugcucugugccuuccgaugugugaacacuuaugggucauaugaaugcaaaugucccgugggauaugugcucagagaagaccguaggaugugcaaaggugagucaucguguucaaggucaucuaagccaggaagcuuuaucugugaggggagaugucccucaaagcuucccuuaguaggagaaggcugggaauuggaauauaaauaguccguggacaauacggggguugucacugccacguuucccccuaaauuguagcuggaagcaucaucaagccaaguugaggacugcacugcacauccuuuauuaggucucacugugcaucgcaugcucacaacacgccaguauuucuacaagauaugggaauagaaagaaaaagacauuuccccacguucaaaaaacccaauaugaagagauugagacagauauaaauacguucucauaauacagugugauaaaugcuauggugauuauauauacaaaaugcucugagaacaccaaaggauauucuauuucaagaaugggguaacacguggaaucuacuuuagcuaaaccaucuccauuaaaaauaccuccugaacaccugcaauuuccuaagcacugaacuaggcucuauuucacaaacugcaguaaucauagaguuugcucuugaagagcucugauuugcuccugucaauaucuuaaaugaacagacaccuguucucucaagauggcguaaauauaauuuugcuuaaggguggggaaauuuccuaaaugaaagguccuaaucauaugcagaauaaauuucaaauuucucagcucagagcauguaaacgggaaagauagaaaaauaaagaaguacaauaggacagaaaguaaagacugaggaaggcccaaccaaguccagaaaaggaaaugaaggagggaagaaccaguagagaauaagauauuugagauauauaauauaaaauagucauuuacuauuauauccuguuuacuaauauuaucauauaaaaauaaugucauauuggccaggcacgguggcuuaugccuguaaucccagcacuuugggaggccgagguggguggauaaccagaggucaggaguuugagaccagccugaccaacauagugaaacccugucucuacuaaaaauacaaaaaauuagcuggcgugauggcgcauucuuguaaucucaccuacuugggaggcugaggcagaagaauugcuugaaccccggagguggagguugcagugagcugagaucaugccacugcacuccagacuggaugacggagugagacuccaucucaaaaaaauaauaauaucauauuauaauauauuguguuauuauuauaauuauugcauaauguaagcuuugguuuguuacucuuacaauccauuaugauuguaguacuauuauaauuauugccuuaucauauauugugauuauaaugcuguuauaauuauuguuauauuaagauauauccauuauauuauaauuacaugaggcccuuuuaguucaauuagucaacaagaauuagaaaucaugcuucaacaaaggaguauaaaacauaaagggacagccaggcacgauggcucaugccuguaaucccagcacuuugggaggcugagguggguggaucacuugaggccaggaguuugagaccagacuggacaacauggugaaaccccaucucuacuaaaaauacaaaaaaaauuagccaggcgugguggugcaugccuguaaucccagauacuugggagacugagguaugagaaucacuugaacccgggaggcagagguugaagugagcugagaucgggccacugcacuccagccugggcaacagagagagacucuuucaaaaacauaaauaaauaaaaauaaaaauaaauaaaaaauaagggaaggagaagagagaaaaggcaugaucagaaucaugcuucuugaagaggucaucaguugauuagggagcaauuucuucaaguucaaaggugguuagaagauuccuuuccauucuuuagagaucauacucaacagagcagaaggaaauacagccaguagugaaauaacagaugaaaauugguuacuuacuaacauuuuauguuuaaaagucagguaauuaaggcagauauaugcauuuucuuugacaaauuugugauuguacauuuuuuacagaugaggaugagugugaagagggaaaacaugacuguacugaaaaacaaauggaaugcaagaaccucauuggcacauauaugugcaucuguggacccggguaucagcggagaccugauggagaaggcuguguagguaagaggaucccuguggaaggagcuuugagugcaucagaagugacaguggacagaaggaaccugggcucugaguucuugggauacuguucuuggcgagacccauuuuguucucuuaaccgcaugucaggacucuccauggugguucccuugccucgugaucauuugugaauuccaagagcacugucauugucccucugaucuggccuuugucugcuuucuugacccauuugcugccaggauuugaacagcaugccuuuucucuauucuccuccuuuacuuuccauacucuuuuguugauuugggggucaauucuccccaucacauuggaaugcuucccuauugacuuagcuuugcuacaaaugccagguaccucugaaucaggaauaucucaaaaccauugggaucuaccuccagaaaaucuggucuugucuagaguagcauccaggcacugauauuuuuuuaaagcuccucagcugauucuaauagggauccaacauugaggacuucagccuuagaccaggaguuggcaaacugccuacaggcuaauuccagccugccagcccacuguguguuuuuauaaauaagguuuuauuaaacauagguauaaccauucauuugcauauuguccauggcuacuuucaugccacaauggcagagcuaagugguugcaacugagaccauaugacccacaaagccuaaaauauuuccuauuugacccuaacaaaaaguuuccugaccucugcuuagauaauaauuacaggagaaaauuauuaaaaccuucucacacgcauucucuuucuuuuuaauaauaaaugguauuauaaagauauauuuuauguugucauucaagaagauuaagaaucccauugcccuuuuacucuguacaauacagauugaagcaggaauuaaagaacagauucuaaaagcacagaaucagaaaauauguagauuaauugucacacacuggauccuccuggaucaguaauucucaaccucugcugcacuuuggaaucauuuggggagcucaaguccaaccucagauauucugauugaauuguucuggggguggcuggggcauugcauugggguuuugaaccuguuuuaacacuguucuggauucaccuuccaacuuucucucuuuccuagugagagcuccaucugagggacccugaacuauucucaaaggaagggaagcaccucagcaaauuauuuuugaucuuucuaaauaaucaucagauaauucuaagaaucuguagauauuuuaauguuuuuuuaaaccugggaaacugaguuguaguuuaugauuucuuaauaauauuguugaaauauuacaauaaaugcaaccuauauuggagauauaaucuagguuaaucugaagauuaaucuagacaaacucccccagaucaauauugaccauuacagauauuauucuaacauguauuaaaauauuucuuucauaugcugauauucacauuuuucccuccuucacuugaaauaacacuuugagaguccuuuuuauguccuaauaugaaaagauuuaaauuuuacuaagugaaaaauguaagugugcauaaaaugcuaccaucuauguuuaaguauauaaaaugcuaucaguuaggcuuuuaaaagaucugaagugcacacacacauacacauauuauguauguauuugcuuuuauaugcauaauccagcucuggaaggauacauuagaaaucggccccagaauugguugcuuuucaggaggggaguuuggugucugggaaauaggaaaugaaggggguacuuuugcugaaucuccuuuuguaccuuuuuaauuuugaaccaugugaagagauaagcuauuuacaaacuauauaggaaagaagaaaaucuauucuucuauaaaagauucagauggcucuuucuguuuucagucuuucaaugaaaccaaacaguuaagaaugaauugaagucucuuuuauaccuuuuaaauuuugagccaugugaacagauuagugauucaaaagcuaaguuaagaaggaaagaugugagagagggaaggaaggugagagggagggaagggaggaaggaaaggagaaaggaacaaagggagggaaggagggagggaggaaggaaggaacgaaggaaggagcuccauccucuauaaaauggucagaugacucuucuuguuuuugguccuucaauaaaaucaaacagaugagaaugaaugucagacgaagccagggaucugugagaaugggcgcugccucaacacccgugggagcuacaccugugaguguaaugauggguuuaccgccagccccaaccaggacgagugccuuggugaguacaguuggcaccgcacuuuccuaaccucagccuccacacugggaugcuggaaacccagacuucuuauuuaaaauacaagaaaaugucaaaaucugaggaaggauaaaaaauguucauauuuuggagaugccguaaugacugugauuguccauugggcucagcaccacccugcagcuaaauucuuccuuugcuaauuggauccugaaucacuuguuuggaauuucuuggcugccuuugaagcccuuggugaucaggauccacuuccguauguuucucugccccucugucuguaagcauggcuauuccccuguauuucugggagcagagagaguuauaagcuugucuaggccaaugucuuucugccuacuuacugaaugucuuauuuguuucccucagacgucauccuuucucuuuuacugcugucuccagcuuuccccucuugcuucuucucacccaggguaaaguguuacauccuuuuuugguuuuuauaucugaccaaauuuuuaauauuuuguuugcucuuaaaauuuccugacauccccuuugccauauaaugucccuuccagacaaucgggaaggguacugcuucacagaggugcuacaaaacaugugucagaucggcuccagcaacaggaaccccgucaccaaaucggaaugcugcugugacggagggagaggcugggguccccacugugagaucugcccuuuccaggggacuguggcuuucaagaaacucuguccccauggccgaggauucaugaccaauggagcagguacuucauuuauaguccaaaaauacuugcagggaaucuauuuauuuguuuuuugugugaaacacagaugaaaauauggaguuugcaauaugugccuagguugaauugcacagcugaggccaacaaaaauucuucauuauggaguuuuagacauuugaggucaugcugccaaaguggccuugguccacuugauuaagcugugugugcuuaggacccucccucugcauuccagcgagucuucaacuuuuuaaaccguuuacuauaagucaauuggcuacucagaauauaauuuuuaaauuuuuuagauaaacuuugaaauaaaugauuauuaaaugugcaaaccaguccaccaagauguggaacuccuaaaacuggccaaacuguauugcauaaaagaaguauaaaucaugcugauauccuggcaauuagacacaauugcaucuggaaaagcacaagcuccuuaacuagagcaggaugaggaagugucagacugucuaaggcaacucuagagauaucuaggccugucaccaauaugauuccuguguuuaucaacuguaacuacaauugguuuuuaguucauaaaaggacugagaaaaggugagagcuuuuuugagcuucuugggagggaauuagaagugaaaggggaagaaggagguuaagaaggauuuguguuuguauuggaaagauguggcugaaggcagaauaauggaacuggaugugauuuaaaaaaaaagaaaaaacagaccuagaaagguaagauggagugaccaaaagcaauuuaugauucuuuggaggauguagcaauaagauagccgaaaaaacucacuucuggagaccaauaagagugugcuaaauugcacuucagaguagacuuguaaaggucagauacacccagcuguugguauaaaaugguuauuuggcagucaagggcugagaacccauguagaaagugcuuguaucggcacuucgccaagcaguaaggagguaaaaugggucaagauguggaagacagugguuuuaaugcucaacagugcauauugacccagucuuucucucugugguacagccaugagugagggucucccuuccuuagcaggcugcaaaaacccagcacugucauccaccucagagcccugguuaguuuccccccucaccagaggacagaaguucaucucauuuccccaauauuauguaauuugaacuuuuucaggauuaaccacaaagacaacaaaaauaauguaaaaacaaaaaacaaaaaaccuuacuuauuuugagcaugcaauacuaggggguggaaaugggguuuccucaucaaaaggaucugcuucugugauucauuuauuagaugucagcaggaggcaagcuuaauggcaugagaugacacaaaaagccaaauaugucuagaugggguggcuguucuauggauccagaagagaaaaauauacauuuagaagaccaguuguuuuuaaaguuuuucuguggcugaauuauuuuaucaauuguagucuaaugaaguuauuuguuuaccuuuugauauagcuacuguuacauauuaaauuuaugcugucaucuuacugguuuaauuucuuaggcccaaaauauaguaacacaauuuauuaguauuuacacugaagugacccccuacauauuaauguugucaauuuuaugauauauuucuuaauuuauauuuguuaaauuacagauaucgaugaaugcaagguuauucacgauguuugccgaaauggggaaugugucaaugacagaggaucauaucauugcauuuguaaaacuggguacacuccagauauaacugggacuuccuguguagguaagugucuauuucugauggcuuauccucaaguggaaauuuuagauuauggaaaaaaaaaaacccaaagcuaaaaaucuaaaaagucugugcaguuucauaggaaagcacaggacaaucaucaaagucuacacagaguuuccuuuuucuuuccccgaaacuaaaauucuucguuagacccuguggaaauugagcguguacacaucauuuuuagaugcacagucacgcuguauuucuuugaucauagaucugaacgagugcaaccaggcucccaaacccugcaauuuuaucugcaaaaacacagaagggaguuaccaguguucaugcccgaaaggcuacauucugcaagaggauggaaggagcugcaaagguaaaguagaauugaccauugccccucaccuagcuccugacacauggcugcauuccuuugccuguaagaacuccacaggcaagccgaaagaccugcucuacaggcaggaggugcuucccugggguuaaugccuccaugggaccuaccuccugugcuggagggaaggaggcuaaagccagggagauuguggaggaagcagcuguccuugcugcaugcccccugggcauccaugguggccauccaugacugucucagagauagcagggccagcuucaauggcucugguggggcagauucuuaauuggugaccuccucucugcuuucuguuuuuuguauuuauucuuuauagcuauauaguucagguuuccaggaagguccugccucggaauaaucagugccaugaucguagaggacauugugccuaaugaauuagaugcuguguccagauuuuuguucugcagaaaaagucuauuucugcccuguaggagcuucccugagacauaaauaucacacagaauuaagaaccagaaaagcucugggcagaaaucccuucucaaccagaaguuauccuuugcaaaauuuuuuugguuuaauuuuacuccuguaaacaucuuccuccacaauaagaacauuauauuuagugaauagcacuagugagucauacuuaacaauaauuugggaaaucagagauuuggagaagaaaagauagaccaagugguagagcaagagauaucaugucaugccaugaaacuuugaaggaaauuuauagaaacauacagaaguaaggaagguaaaggauagaguggagucuuuuuccuauuuuuucucauaaagcuuaaguucuuccacuuacuugguauauauaacuaaauaucaaaugaaugaugcagcuguguguaccacugaacugagaagaggcuagaaggguggagggugggaccagcacauccccacggaggauccagauuggaggagaggagaggagagaaguggagagcagagagaaguugggcucuugaccucuuuccugugucugcugaaagggagaguuaagagacauguaauaguggaugacaucaugggcaagugccugaggccuuccugugcagcacaaagccuguauaauccuguaguuuggggagaggaaguugagagaccuacuuacacauucuaaacaucuuaaaugaagucgcucauagcuuuguucuucucaaauguggaacuuauuuuacaucuggggucacugugaguucuaggcaaugugaagcuauaacucagagccauaaauuuauucauauaaaugaagaaccaaauucaaggggaaaauaucucucauuguauauauuaucuguaacaagcaaaacaaauuuauagcauuuuuucuaaccucugggggcagaaaauucucaaaaguuuccagcaauuaaaagaugaaaaaugaaaaugcaucaauaaaguucucuuuauggcuuuaggagugcaaagagcaacuguaauuuuuacauguccacucacaacuugucccuuuuccuguuuuuucccauaagguucaaauucuuccacuuacuugguauauauaacuaaauaucaaaugaauagugcagauaguugcaccacagucacugagaaggaggaagccagaaggguggccgugggagcagcacauccccagugagagauggguagaaugcagauuagaggggagaagaggaggaagggcaucuuggaggcaagagcagcaagugcugcuguucuucauguguuguacucaugaaaugguguuaggagaaaucacugagucaucuuccucaccuguugcaggugagcuucagcaaaugugucaugaugcuccagccaagcuccuugggccauagacaggggaaaccaguccacagacucugagaaagcugaacagagagugcauaucagucaagaucucagcaguggaaagagcacaggacaggcagcauuauaagagaagccggaacuaggacaggucucgggagggucucucaguguagguccacuccagauguuacucuagccaggaacuggcccuguggaguggaagcagucacuggcaaagcuggcacugaucugcagcuccaaagcaguugugcagauggugagggcauagugguugaauuugugauaaaauaaagucacuaauguuuuuuccugaauaugcgacaauuuuaaaauuaucauuaaaguuuagcuagaagcuagaacacaacauuucaucucuugguauuuugaaauaacauuggaguugagaaugcaacuuagaaguugaggcguugagaaaagaggccuggucaaagcagaggguuuuauugagaugugggaaacaauguuggauaaacacugcaggcaguugucaguuuuggauuuuuguuuuuuuuguuuuuuguuuuuuguuuuuguuuuuguuuuuguuuugagacgaaguuucacucuguugcccaggcuggagugcaguggugcgaucucagcucacugcaaccucugccucccagguagcugggauuacaugcacacaccaccacacccagcuaauuuuuguauauucacuagagacagguuuugccauguugcccaggcuggucucaaacucgugagcucaaagugaucagccugccuuggccucccaaagugcugggaauacaggcaugagccaccacgcuuggccuggaggcaguuuuauuaaaagugccuuuagcuauuaaaaugaauuuuuccuuugcuuuguuuccuuccugauugcucaauuuugguuuauccuaagaagaaucacgacuaaagaaaucagauuuuguuuuugaugacuucauuugaguagauuaaaaacagcaaacagaagagaacuaagccagcaaauucauuuccagcuucaacauuucucuuuauguuuuaacuuaaauagaucuuuucaaagcucuggaaaauuugcagaaucauucaucuuucgcuucauuuaaaaauuuguuuaaaaugucaugauuuauuugaaauuccuuuguugaggaauuccugcauuucuccaauuagaauuguguuuucuuggauccccuaaagaucucuuuauauuuuuuugaggggaggagggucuaaauugacaccuuguuuuaucuuucagaucuuuacccccugugucucuccuugccuuuugcuguggcuucuuucuagucagggucauuugagaccuccaaaucaaacguggagcugcuucauagggucagcuucccugauccuguuuuguuggcuugacucaaaugccucucuugcauuuucuuguagaucuugaugagugugcaaccaagcaacacaacugccaguuccuauguguuaacaccauuggcggcuucacaugcaaauguccucccggauuuacccaacaccauacguccugcauuggugaguaggagaggaaaaaauccuacauggauuguagcgauucuuuuaagggauuauuuucuauuuccucugcuguugggauaagaaaauaaaagcucaaagaaauauaugagugcauguaugugugagcacaccuguacauguaugugaagcguuguuggccuuauuuggccuuuuccgaguuauccuucuaauuuucuuuuaaaugauacaaagagagcuuuggggaauuuuaaccccucuuugcccccacugcuucucauagauaacaaugaaugcaccucugacaucaaucugugcgggucuaagggcauuugccagaacacuccuggaagcuucaccugugaaugccagcggggauucucacuugaucagaccggcuccagcugugaagguggguggagacuucagcugcgauccagcuggugaauccuuguggagguggccuguguggcuauuggcaccuucaucaucagccucuaugagauagcagaucugagcccaggggggcacucagcuaaaauagugugcacagguccuguaucuuagagagucguguuuuguuucaugcuugauugugucuaacacacaugccuuuccuaaguauaucaagacuuuuucugcuaaguuuuuaauuuaaccuaauagggaauaacucagucaagaaaaauauacuugauuuugauucauuaauuuucuggucacuggguccagagccauaaagggauuucccccauguggacuaaacauaugaggaauagcucuucugaugacauuuaauuagaaguuuaaaugauauuuuuagaaguugacuguggcuuugacacguuuugguuucuaauuguggcaccaaaaauaaaaaaaaaaaagagcaaacacaaauaacuuauaacuuacagagcugucccagagagugcuuugggcuuugcacuaauuuccugacaauuuuuauuuguagacuuugccagggcucucugaaugauuuucuccuuggacuuagcagcaguuccagaagagagauucuugaaguuuuuggugguagaauaauguguaggauguguaggggccagauuucuuauuagaauccaucuggcuucagagagagauguugaguuggcaucaugguggcucugcuucuuuuucagacguggacgagugugaggguaaccaccgcugccagcauggcugccagaacaucauugggggcuacaggugcagcugcccccagggcuaccuccagcacuaccaguggaaccaguguguuggcaaguaacuuuuccucacucucaagaugcauggcuaucagguccuaugaagcaaaacacugcuugcuuucugaagcuguaaauguguuauugaagcaacaaauacucauuuaaaauugcccuaaccugguugaaacccgagguaaguaacagucuuugcaaaacagcaaacuaagaaaaaaaauuauaauugagggugcuuugagagcaucugaaaugaaaugcccccagaauuucuugaagcgcaauauccuccacccucccgcugcacugcuagucaucagcccacacuugaguuauguucauaucaggggucaaaaaaucuuacuuaugacugaaaaauaucagccagccaaaggcuauuuugaguggcuuuuggccugaagaugccaaaguaguucuguucagcucuacacauuuugagacagagcgcaagcaggaaacacagcaagguuguguuuuuuuguguguuuuguuuuguuuuguuuuguuuuucaagauugcuaaauucuuuugauaauuaagggagaucuacugacucucucauuaaauugaaaugaugucaucuuugauucuacaaugucaugggaaaauaacucuuaaugcacaucagagaaucaaaacauugugaguuuggagggauaccagaagccacuuagcucaggcacuuuguuuuacagauaaggaccuagaaguccagaaagggacgguaauauuuccuugcccaguucuuuugugacaugcuuggaacuagaacccacaacucuuaacuuucugauguagagcugccuuucaagugucacauucacuuguuuauguucauucagcaagcgucugugaagugccacugcaagcuuggugcuuugguaaccuguucuaguugccacauuauucuguacagagcccuccuuagcaaaaacucaaagaauuacugcuucccgggugcaggcucugcauugcagggguucacuuucaugcagaugaagacauauuugguguguuuucauuuaucaaaaucaucucugucaucuaguuugauucuacacaagacaguuuugcaguggcauguaggguugacugaagugaccccugugcuauaggaguuucgacugcgugagucucuggcuagcuaucugguuuuaauaaaaaugucuuuguucauuagcagcucagggaggucuuugauuuuaaucaccaguuucugacauuguucacagaacuuccagagugaacuuuguugauucaacacccaguuuaugagccugucuguucucauuauuuaggucauuuuaauaacacuggagcuaagugaaaaaaacauaagagaggaaagguaugucgcuccuguaccuuauccuccuccuccuaccaucagucugaggaugguagaggcgaccaggccaugcacuaguguccuggagauucugcucuggucucgugaagaucaucuccuggcuggacacucuaaaaaaacaaguugauuuagaagucagaagaaguuugggguucuuaaugucuccaaaugccaaauugcucucaucaaucuugagaauuagaguuaucuagaaugagcauugccgugggcuaaaauagcuuccccagaaccacaagaaacagagcagaucucuuagaccagcccucccuggauccucacucccagguggcuggaaguucacucuuugggguaagagggccacuaauuucauugcuuucuagaaguaaauuucaaaaaauucagcuugcagauagauagaguugacccauuuuccccuagagaaaaugaguaaaagaaagcccauccugcauuugugaaguuuccuaucgguacucccuuaaggccacagcuaacaugaacagugcaagcuggaugcugaaaccuuugauuuuagaggacagagugguggguuucaauccacuuuuaaggaguaguuuucagacuuuaaugcuauuuugguaaaauucgaauugucucuuuuuauaaaacaaacaaaacccucaccaaucuaaguaccaacuggaagaauaaaacaaauauuuuggaguguaaaaaaauuccuuguggagucauuugcuccagagugcagaggaugaaaaaggucaggaaaagugcaaaacauguuaaccaaaucgugguguuuguauauugauaaaaagggcgagugcacaaacaugcuguuuucaaacuguaaacacugaauauuugccaauuucuuauuuuaaucugugcucuacuccauccuaccucuccaaccuagauaagcaaguuuaauuuaaacuuuauuaaauucucagggaagggagaaaauguaaaauaaaauuuaaaagaaugugaaaggagagggggagaacucuugauaguuguaguaacacagauagaugcucaaaguuaaaaagaaccuuagagaucuagccuucucucuuuccuaauauauaaauccuucucuaacuuccuugcuuaucccaguuuggcuuaaauaccaccuugaagggugcccacuuucucccaagauagcccaaucuauguauagacagcuuuuaauacuuagaaaugucuuuuuuugcuauaaaaaaaaucauuucuccucccucuaauuucucaccauugguccuacuucugcucuuuggaggaaaaaacacagaauaaaucuaagcuauagaaugacaagucuucccccucauauacccacgccuugcagguuuuauuagucagggucccagcaagaagcagauggcugaggccaaccaaaagugagggacaggggagcagagcuugcucaugcuccauagaucagccaccuggggccaagagcaaguggagaggauggaggauggacguggaggagcaagaagacaucagcccagggguguucucuccaaugaaguaaauaugcuucguucuucauucuuuguuugacauggagcuuggugccagugguuucuguugcucucuauugcacacuucguccucaauuuaaaauaaggagaaagaacacagauaacguguugagcacagaaagagaaagggaagaaugagaaagauaaaauuauuauuuauauuuuaagagcccuggagccuaagugaccuugggugaagacuugaaggucuuuggauacaaaagauuuucagacaggcaguuaagaucaaagaccuguagcugaagggaaggagggaaagagagaaggaaggaggggaggagagaaggaaggaaggaaggaaaggaaggaaggaaggaaggaaaggagggaggggaggggaggggggaaggaaggaaggaagaaagggaaggagagaaggaaagaagguaggagggaaggagacauggaaggagggaaggcaggcaggcaggcagguaggaaaugugaauauauacuaaguauauacaagugagcauccuuccccaccacuuuuauccaccuguuuucuaauuuaaaaaaaaagaaaaaauagauuuguugagaaacauuauuuuucuuuauaaaugaaugugccuuagcaaagaagguaaacuaauuacaggagaaaggaagcaccagcuuaaauguggagcgucucuugagaggcacugugguauaaaggaaagcgcauggauggccuuugcaguccaacagaccuggcugugaauuucugcccugcugcugcuggcugugagaucuuggaagagcuuucugagccucacuuucuucagcuguaaaacagagaauauaauaccucuuucucaggauuguuaggaaagcuaaggaaauggucaauaccuguauccuaucuaucauaaaauagguaucuaauaaacauucauucccuuccccuuccucucuuccauaggaagugguuauucgcuaagugaagagaaggccaaucuaucuacauucaaaugaacguaugccugaaaauggacuauggcaguuaagaaaugucuuaccagcaacuuuccaaccugcccugcaaaggcagaucuacaaaaauauauuagagacuuccaaaaauuauaaaucagaaauaaugagaaacucaugguuuucccccuucuagcugauuuuuuuaaaguaagauuucuuuuuccugcuucuuagcaucagacuuggcaggucccuguggguagccagcccugcagcuucugucucacuuguggguuuuccccaauuacugcuugugaagucugcaccaaaucucuuccagccacacuuaguuuuagacagggcucagacacucugggcaggaggcugguuugaauaaggagggggccgauucggugaugggagcagacauaccagaaggcauuauucaucucccagaacagguaccugggggcuuuugcagaauuuugaaaaggaaguccaaguggggcagacacguggggcagacacuuggggcaggauaucagccuuugccagaucagcauauccugaaauaggcugacagggaaagcagccugcgggaaaaugguuggucucugcuuuugagagauuugucuccucgcugggcacuugugaagcaaguacgcagagaacugcaagauuccuuuccuccccccuugaacccuaaaucuuagcuacggaccagccccauguugguucaugaccggauguuuacauggagcagaagauaccaguguugacuucugaugagaacuggagucugcugguccucagaaugccauccucuaaugcccucugccuggugcauuugacuucaucuuccauguuucaucuuccauguuuacucacaacauagcaagaagccacauccaugcccgcaucuuucucugcuguugcucuccccacccagccaccucugccugucuuaccuuccugagagccuagcugagggccagcuggccggcagcaaguggccagauccaauguccucaauagaaaucucuggcugcugccacacaugccgcuucuuauuuugccugcagaugaaaacgaaugccucagcgcucacaucugcggaggagccuccugucacaacacccuggggagcuacaagugcaugugucccgccggcuuccaguaugaacaguucaguggaggaugccaagacaucaaugaauguggcucugcgcaggcccccugcagcuauggcuguuccaauaccgagggcgguuaccuguguggcuguccaccugguuacuuccgcauaggccaaggguaagcagugcucuuccuggucaugguuggagauucuuucauucguaauauaauuaaguauacugaacucaaaauuaccuguccuagcagaggagaaccaugcuuuuuguaauccuaaaauuaauuccaguuagcuuggcaaaaguuuuagguuauuuuauuuggaaggaagcaucuggauuucuggaaacgucaaacaaaguaaugaaacuacauuguaaauaucucgcuauaugacuucucuaucuuauucucuugaucuucacaucuuguugggaagugauucaucucucuguaaauacaccucucugccaacccaugacagaacugggcucacccugcacacgacugauccacucuucuccuggggcagggaggauucuaucuggacuuaaaaugccuuuguaucuagcuccuguuagaauaagucaaagacaucccuuuggguugaaaauuauuuaggguuuuaaauuauauuuuacauuucagacuugaauuuacauuaaauuuuaccaaaggugcauugaaacacuuacuguauuuuccugguuaaaaaaagaaaaacaaaaaaaacacuucaccaaauuauaggugugucugugugagaguuggggcagggaaggccuuuuuuuuuuuuuuuuagacggagucuugcucugucgcccaggcuggagugcaguggugcaaucucagcucacugcaagcucugccucccggguucacgcgauucuccugccucagccucuggaguagcugggacuacaggugcccgccaccacgcccggcuaauuuuuuguauuuuuaauagaaacgggguuucaccguguuagccaggauggucucgaucuccggaccucgugaucugcccgucuugaccucccaaagugcugagauuacaggcgagagccacuguacccggccgggaaggccuauuuuuauuuuacccagugauuuaaaaguuuaguguuaaguuuucaaaguuuggaucuuuuuuccugcugaauuaaucuggacucggguguccaccuaguuuuagcuauccugagaggaagugcacauuuuaacuuuuuaauuaggaacacauagacauuaaauauauauauacauuauguacuccuccacaugcguguacacacacacccccacacacauccacacuuauaccaaauuauuaauguagcagucuuugauuucuugacauacaaacaucaagugauucauuuuggaucuggguagguagaagaauguuucgugggaagcacacagaaugccagcaaucagacacaaauucccagauguuugugucuggcucucaguagacucauucuuuauaguuuaaugccagaaccauuucuucccagcaaaaauugugacacucuaaacuggcuuuuggccagugggauuuuguagucacacuucuuauaaguggugcucccgggauaugaaaauacuggaaaggaguucugagaaaggaaccaaagccugcaaauuugcaguuuaccuccuaauaauuuaaucauugugugaauguauacgcaugcgcacacacccacaggaugagcauuuaucacuucauccauuguauuguuucuacauauuucauguugcaagauaaagaggaaaggaaauguauuggacucuggcaagauugggggaaacaguaggaaccuauaaacugcuuugaaauacaacagauauucuguucauuggcaacauauuuugaauccuaaggguauauaggaaaauuaguucuaaagagcagaucagcuauuacagaaaaacagauaaauaauuuuuggucuauauuaugacccauuguuagaaaucuacccauuuaaaacaguuuuggccucuccgaaucacuagaauggacucugcccccaaauaaagauucuuuuaaggaccauucaaauguuucaacacauuuggaaagaggagcuugauaaauacacauuccaaguggccucugaaauaguaagcagaauaacaaaacaagguacuugugaaacauucgagccucccuccguaacuuggcuuugauaacugaaaggcaaagaaaaacagcugaacgaguucucucuugggcauggguuuguuuauccaucuucacaugagucggagccaguggcccuagugguuuugaaugacuugaaacaguuucccacaguugggcaaacucugauacaugcauuuuauauacggcauaucuucauaguuuauuauuaaauuaaccuucauuaucaaccggagcuuucuucuuauccucaguagcauaagcaaaagugaaacgucaaggaauaggagcaauugcuccaaagcuugagugaggaaaaguaaugauggaagugggagaaugcaagaaacucaacagugaugucucacaccuugcucacucccauggagccuguuucauaaaaagaagccauuuuuauuuagccucccaaguuacauggccucccucaucuacuauucucuuguuuccacucugugucuccuccccaguauaaguacugcaaaaugcuuuccauguuagguuugggaaugaagagauaaauaaauauccaagacagggucuugauaggcaguagaaggaaaucaauacauucagggaacugggaauuagaggccaaacagaggaccucaauguaguucucagaacuagcugauccuccaguggacaagcaagggcuguaucucacaacugcaaggaacaggcuucaccagaacucuuguaccaccuaccuugucuucccauucuaaugaaaaacaucuaugcuccccuucugcugcaggcacuguguuucuggaaugggcaugggccgaggaaacccagagccaccugucaguggugaaauggaugacaauucacucuccccagaggcuuguuacgaguguaagaucaauggcuaccccaaacggggcaggaaacggagaagcacaaacgaaacugaugccuccaauaucgaggugggucagaaguuaguuucuccugaugucuccugugguggaaagcccuuccagauuccugugguuuccuccaaggaugcuccaaagugugaaaaagcuccccagggagaaacuccagacauucccugagcucuaggcuguauuuuacaagaggcuguggggcuuucuggaguuucuugcugcuuuucgggaguggccauuugaagguuuucacauacuugcucauuuccucugucucgccaaaaaaaagucaaauacccacccaaagucugcugaaaggauaaggucugagauccaggacagcaagugggcagaauagcgaagugacauagugcucccuacauaggaaugccaaguucugaaagcuagaggcuccucuacugaaaagagccauguggagugugagggaacuuggauuguagacaaaaauaacguggagcugaagcagccugguuuccuuugccuacggcugcugcagccuuucagucaacucagaagugcacagauauucacccagaccucuggcucugggcccauagaauccagcacauguggucccagagaggcaaguaagaagccaggugaaaagcauugaauauuagcagaucaucacagucaggaaguaggcucauagguguguccuuaggagaagaugguuuuacgucaaugaaucaaauugaaauagucugguucuucguauuggugcugcaacccaucugcugucauuuaagaaaugagauaagucuuuggaaagaacauaaucuauuaaaacagugguucucaaacuuuagcaugcaucugaaucaccuacuaggucuuguuaaaauugauuguugggagacaucccaggguuucugauucaguaguucuggggugaugccgagaauuugcauuucuaacagauucccaggugaugcugaugcagcuuguucagggacuacauuuugagaccuccagauacaaaugauuucaaccugccuuucuuccugacaucaguuaauauuuucaaauauuacaaauaugugccaauuuaauacacuuguggucuaaacaaaaugcuuucaauauuguguaugcagcauaaggcagaaaauuguauuagugugaaauuugagucauuuuuucuuuaauaugagagcuaaguggcauauguacauuguauuuaacauauugccaugugucuuuccaggaucagucugagacagaagccaaugugagucuugcaaguugggauguugagaagacagccaucuuugcuuucaauauuucccacgucaguaacaagguucgaauccuagaacuccuuccagcucuuacaacucugacgaaucacaacagauacuugaucgaaucuggaaaugaagauggcuucuuuaaaaucaaccaaaaggaagggaucagcuaccuccacuucacaaagaagaagccaguggcuggaaccuauucauuacaaaucaguaguacuccacuuuauaaaaagaaagaacuuaaccaacuagaagacaaauaugacaaagacuaccucaguggugaacugggugauaaucugaagaugaaaauccagguuuugcuucauuaauucaccauccagagaccaaauaauuaaaagaaaaacaaauauagauagguagaacuauauuuucccccaaucagaaucaucauaucauagguacaaucuuucaccaaguaaauuuguauaaauaagcacuauucuuuguauuaccaaagcaagguacaggugacuacccuaguucaaaacaaccacuuucucaggcuucucauguguguagcuaagcuaccuugucauauguguugauucuugaaaacugggacguguauuuccauuggggguuggccauuuaugcugacaugccauccuuccagcaaacguacgggaaugugcuuucaauugauggacuacucuauuuuuugcaaauuuguaaacuuugcuucuccaaauacaaguacuagguuguccauuuaugguaccuauuuggugcuaguaaauuuucaaacuagauuuauaaaugcacuguaauauguacacaacuuagaaaccaaauuacaaguauucaguuccaauacuucauuaauuucaaucaaccaaaguuaguucaguagcuuaucucaguuaugaguauaauacauuacauguaaauuaaguguguguauacuguaaucgugcuauuuuuuaucauugaaacauuuauaaacuagaauaauaaugcccuuaaugugaggguuuguaauggugcuuauuaagaccaaagacuuguuaaauguauacaccaagugguaaugaaauuucggugacuggcccacacgugcauagaggucugggaggaccaggaaacagccucaguggccagaggaucaccagugcauccuucaucacagcaugugcaauaugccaagauuacccucggucauuccugucaacaaggggucaaugucauaaaugucacaauaaaacaaucucuucuuuuuuuuaguuuaccccuuggcuuuguguucuugcauggauuugggguuggaggggccauuccggaggcuaaauaaagucuccuggauuuaaauuauccugggucucuuacuuauggcuuaugaaaguaccaaauguauaaccacuagaagaaaauuuaacauaugagucgaucccuuguuuuauccauugaaaguagcagagucuggugucauuaaccugacuugcuugugagaaauuuagauuguagagucauuucugaaacaugaccuaauucaucuugugacuuuuaaauagucuuaaauaccaaguucagucauugucuuagagcacaugaauuucauuauaauagauuuaucaugccccccucucaaauauacacaguuuuggcaagccuuagguguucuguuccauuuuuuuuuccccuaaacaucuuucguuagucaaugcucaucuaauuacaaagggauaaucccagacuguauccaauugcuguaacuuuugguuucuuaaugucauaauuuuuaaagucuguuuuauuuuaagugcaauauugaguauuuagcuguuaggcucaauccgucgauaugaaauaauuuuuuaaaucccuaagggcaggaaagcauuucgugguagugaaaauaagaggaaauaagauggcaugaagguggugggcggagaaacuagguaggacacaggaaagugcucucaaaaaucuuugaagagcucagcugaaaaaaauggaguagauuuggcucauacuauuccggaaggcaaaaccagggucagcugaugucagccccaguuuaauacacacggucccaauuauagagcuacucacugaaagaauggguuuccuugcauuguggugagcucccugucacaagauagaagaguuucagucuaggcuuaauggcaaccauuggacaaagaugcuuucuuccaccuaacaggccauuaacaucuua

SEQ ID NO: 13375 - RNA, 3292 nt, Homo sapiens
cgggguggaguggugugggggagauagagcuggggucugggacgaagucagcuauuaaaggaaaagagaaugagaauuuuaauacaccaauauuacaacauacauauuuaaagaaacacuacaaacuggaagacaaagcagaguuaaguuuucauauauuuguugagacauuuuugugaguagucacugaauuauaucuaaagguaguuggaggcauaaauaacaaaaacaagacugauaaauacaaaacauuauaugugacaaagaacuugaagaauaaaagagaucaaaaguguucuccaagaaacaagaauuuguucagucuugaaguuucucagcaaagcaaacauuuggguggcagagaugccgcaggauugacuuuuauugcucuugaccuucagaaggauaauucauugaaaggugcuugccagguccuugccacaacagauggggaaguggaauagaaauuagagagaugauuuaucuggaugaguugguagccaugaaagguugagcagguuuacuggggaggcuaccugaauuugauuuacauaacuugguaaauauaauagauagauagauagaaacuuuaauucaugaaaaccuuuccuuuguuaucucuggcaacucuguuauuccuacauugucuucuuugucaugaaauaaaagcuggugagacugucuuaacagaagugcuuaggugguuaugauaguaugguuccugggauugaaaaacagugauggaagugaaugaaaaaggcagagguggucagauauaaagaaagaagaauaguacaauauggguaugaaagcauuucuuuuaaaccugcagauuguggccucuguguaaugagaggaguuuuggaaggcuuuaagaagucaaguucgagggaaaacacaguccauaccucugguugagcucacuuuuuggagucaauguguuguaugagaaauggaaaagcccguuuccaaaauuaugucaagcaauguuggagaauuuuauaggaaguagaucccaucuucuuuguuggagucaucaaagcaauaaucaauauugaaauauauucuuucaaagaaagacuauucuguucccacccacccacagcccugcccuccucuuccuucccucucuguguugagcuaaacaagcuucuuuuaaaaauuuaacauugacacagcucugcauauguguguguguguaaaaucuacaaaaagccccacuugcauuuuguagccagcaucuccgggaguaucugcuucagugaccaacccuuguguuguauuuuugcccaucuacaaaguugccacuucuguauuuguucugugccugugaucugggauuuuauuuuaguuccagaguuuaggggacacagaauaaaccacaaagugugauaucacaguaaauauuagaacuaagaggauucucuuacucuagugugcucauuaaacaugauauugcaagcagagcuaucaaugaaggaaucuugugaaugauuccuucuguggacuuuccaauccugaagucacugacagaugucaguuuugaaaacugucaguuuuggauuuuauuggauucacaucggguuacuuugaaauagugacuaaaaugagaaguaauaaauuuaaguucauagaguuguucaucagaucucacuauacaaaagauacccaugacuuuaacaaucucagcucaguuaccauuagaaucacguaaggaguauugcugugguccugagaggagaacauauauaacauaguggguuguucuuuauuugcuauggugcaauacggacucaguaggaaagcaacugaagggugucauaaauuuaugcugcagauuugcgaaugagcuacuguuaugcgaaguuugaaggaggaaaguguucaucacccaaauccagaaaucacuccaagcaggaaugcugcugugccuugaagggagaaggcuggggagaccccugcgagcucugccccacggaaccugaugguaugucugucaucugcauuucucucugggccaugcagggugcagacuggccaugauguaaguaagacuguaggccuuaaagacaguaacacaauuuaauuuaauuguaagucuaauuagaauguucauuaaaaauuauuuuaucucaggagcuugguaguuauuuucuuuuuaauuaugucaugaaucacagaugcccaaggaguagacacaacaucuuagggagucucguuaaauaacuuccucugguuucugggcuuguuuuuuccaucauuuaucaauaugcacagcauguagcaauuuucuaccucaaaauacuuguggagaagcuuguaaugaauugcuauuguucuaucuauuaaugagugucuccaccacagaggccuuccgccagauauguccuuauggaagugggaucaucgugggaccugaugauucagcaguuggucaguugccugugcuggauucucagcauuucucaguauucucaaucugcuucuucucuaguuauucuuauuuuucuccaucuaucuuggaaaauuaagugcuacuuuuuugucccuucauuuagauagcaauuauauuauugcauuauuagauaaucuuuugauuaaacacugaaaugaucauaauuuaucuucacguuuaaaaaauaccuuguuauucacuauuuuuuuucucuugcuuaagauauggacgaaugcaaagaacccgaugucuguaaacauggacagugcaucaauacagaugguuccuaucgcugcgagugucccuuugguuauauucuagcagggaaugaauguguaggugaguaauaaguuuucuuccauaggaacuuuacaaauuaaaaauuaagcuauacaguauucacuguauagccaugaauauagguaccaagauggcacugaaauaaguuuuauccauccacucauacaucauucauuuagaauacuagugagucaccaucaggucccaggcacugugcuaggcucuggagcugcagcacugaaccacaaagacaaguuccuuccuuucauggaccuuacagccuaauggugaaggcagacacuggacauaucagaagagauacuagaaaggacaacaucauaaugaaagucuuugugaaauuuuuuaaaaauuguuaauggucauaaucuuauucccuuaucaaauaaaaauuuuaucuggauucuuuuacauuuaguaagaugaaaggcuauauaaccaguacacaaucuuuuuuuuguaacccuguuuuuaaaaugucaaauaauggcuccucuggcuggccuuugacccuuaauc

SEQ ID NO: 13376 - RNA, 73148 nt, Homo sapiens
cgugaguucgguugugacuaggaaggagcuaguggacuagagccaggguaaggggaucugcuagaaguuggucuuccgccaggacuagaguuuccucgcgguaacagccuccguggccuccgguaaguucugauucacgggugagcuuggaccugggguuagaggaguugcgggguccucgggaugcuggcugaggguuccugggggggcugaccugcccccuccccaaaucccgcggugguggacugcccgcauguugcgggcucagcuuuuaccuuaacgugucauuuagaccucuucauuccuccaauauccuacuuagaagugacauaugggaagcccgccucguuuccaggcugcuggggucgcccugagacccuacucugcggaccccgccuuggucacccuggcgucacgccuggcucacaguaggugcucugugcacguguguugaccgaguacaagugacgcuggcacccgaagccaguagccccgggcauccugggccccgugcggcuuuggucauguuuguagugccguagcugacgccaaacaguuccucaaggucauucgcucagccuguggaugcuuauuguguauuagcauuacucgcuccgcccucugggcaacuugaaucaauuuguccaaagugcuguuauuagcacugaucacaagauguugugaucauuuguuuauaugucuauuuucuuucccuucaucguguccuguuaaacuuuguaaucuugaacagugcuugguaaauugucgaaugaaugaauaaggugucuccaccagguguugcaagucuaaaccgggcuaugugcucuggcuauuuccauucuagaaggcgaguuaugucagcaaguaaguagaauuucccaacuccaagugcaguucuuagaaaccccuuuuguggggguuuauaacccuuccuauaucguagucaugaacuugagucugauuuaagccuauuaucaccuuauaccuucauagugcgugacaaugaacaugcacucccuagacaggugaaugcacucaacuaaagagaagcugaaguugaagccauaagaaaagcauaagaaauacagucugaaagugcaaaggaguggccagcuccaugggggaacaggcuugggagggcaucuugaaggaggguggcauuuuuguuccauaggagguugcauuauuagaagugacauuucucauaggcugcacauucaccuuuucucagauaugcggaauccucuuuauucccuaaaccucuucgguagcuggcagacuccuauucaucaguaauaaugucauaauaguaauaaaacuacaauguauugauugguacauagugcuaauuacuuuacauguaguaucuugugaauccucagaaucaaucuuugaaguagguauuauuuuuacccccauuucuuuaacguagaagcagaaacaguuugcucaagauugcacugcugauaaauagaagagccagaauugagcccagguugucugaaugagugcccucauucuuagaaccacuuauagccauauuguguccuuuaagauuuauuucuaaucuaaaagcucuuuuuuuucuguaaaacuucucuaaacuauccuuucuucuuaggaaaaguaauuugugcuuuguacuuucaucuacuacggaauuuauuacaauauguuauuguaacuguuuauaucaguggcucuaucuaagagagggugagcagagacagugagcuccucauggcugguaccaugucuuaggugcaucuaggauaugaucuggaacacaguggguauucaauaaaauuuuauugaaguaaugaauucguauaagguaacaugccuauaucauauucagucaacaaauauuuguuauguacccaccaugugcaagcaggcagauacauuuuaauucugccuucagggugcuuauaguuuauuagaugaagcaaaaacaaugcuacuuuugcuuuguaaucuuuuguccaaauacccauugcuuuuguugcaaggagggcagagaaaacaaccggggacaacaaaaggaaugcugggucagagcauccaucugaguguaacaacaagacauacuuuuuauagucuuguuaaggguucagaaaaaguuaucuaggaagaaagucuaccagacugcuauugaagaagaaaaccaaaacauacuguauacuuaaucugcaucuugauuucucaaguggucagccuugagucaauagauauagaaaauuuucaguauuuuuacuaguggcauaguauugacaaauuaauucaaaauaauuuuacuaguguaaauguuaauuuucaauauauuaauauugauaguuuucaagaugguuuagcaguugauauuuucaccagcaacucaugagccauacaaaauacaaaauagucaccacugggugauaacaaguuuuuuuuuuguuuguuuguuuuuucaaucuagugguugaaaauggcauauuguuuaaaugacacuucuuugaaacaucacgagcuuaagcaucuuuucaaacuaauugauuuacacuuuuuaaaauaaauugucaugucagucgcccaauuuuauauuggauugucuuuuucucauuucuuuguaauaauuuuauauugggacuuugucaggugcuuugcaaauuuuuuuuauucuuauuuuucuugacuuuguuauugauguauuuuuucauauauaauauuugacucguuaaugaugucuuuugccuuaaacaaaauuuuauuuuuugugguuagguuuccaucacauuuuucuuuauggcuuuuggauuuacuaucuugcuauuuuuuuuuuuuaaagaagucucuuuuguuguucugaauauuauacuaaagucucugguagcagugauaaugaguggugauuaauaaguuaagguauuagcuuuuauuuuaagucucauuuaaaauauguauuaccuuuuuacuauauauauuuuuaaccacauuaaguugaucagguuucccuuuaugucugaaaucauuucuuaaagucuuuuauaguuuauaguucugauaaggaaaacuuauaccuucuucagugggggagauuuuggucuuuucagguauuuuuagaugucuucuuuaaugacauguuuugaauuuaaaauaacauuaaagauauauacuuugauauuuuacauucucuuuaaaaacaaaacccuaaguauucucuaucugagaaaaaguagcugucuauuuaaaauauuaguagcuacauuuuuagcaauaggcucuuauaaaucuuaauguucuuuuucaauaaucaacaucaguugauggcagguuaauaaaggaugggaacaaaccucucuucucuaacuuaaugaaggagaaaguaacccaaauuccauauuucgucuuguauuuauauuugaaugaaagaaagguagaagacacagaauucagaaacagaaaggauuuuuucugccuggaggauucaggaauuucuuuaagguccagcuuaauuucaucucuuuuuuuuuuuuuuuuuugagacggagucucgcucugucgcccaggccggacugcggacugcaguggcgcaaucucggcucacugcaagcuccgcuucccggguucacgcccuucuccuuccucagccucccgaguagcugggacuacaggcaucucuuuuaaggacauaggauuuaauugggcuaguauuuucaauauauauaguguucuguagaauauuaagucuauuugcauaguggaaaaaaaucuagagacaugagauuguguguuuuucccucaccauuucauguuacaggcuuuuuaucauauucauaucuucaucuuauguugacauacaaaaggauucuuauagauagauuuauuuuccucgauaugcaugucucuucccccguuuagcccugucacaaggguagaaaggaauagguguggucugagaagcagaggcuggaggguuuuaaguugagguauagucugaguugauaugaguuuaaagggacggguuggguguagggaccagagaggaagggauuagaagguagacugcaaauuagagguuggccaagaaacauaacucagucuuugaaaaacaaaaacuugucauagggggauuuuuaccacugaaguucauauguauguuaaucuuuaauaccauauucaucuauucuagcuugcauauuuucuuuucacacuuuaauaucuacaacauagacugcguccuaaaauuaauguuaugucauaauuugauuggcuacaucucguuccuacugcuacaaauggaacugcaucauagaaucaaagacaucuuagaucugaugaaaugggauauugucugcucuagagcuauuggcuuccacaaaaguuugugauauaguucguaucuguuaagacgagggagcuaaguucucuaugguaaaaugcauuuggauugcugggucuccaugcuucugauuuuacuuccaauuuaaugacauuuuagagcuugaaagguguagugaaugaguuguggcucaggcucacauccaagugcguuucauuggcaugaacaacaguggacugaauggagggcaguguuaggccagguaauugaugacaccugccuacuuuuuuguugugauuguucagagcuuugaaguucugaggaguuuauguauagugucaggaucccuaaguacaaguuaaaucagcagcagcuuuuuugaauguaaguaguugaaaacccauuuccugcugcugcuucugccgcagcagucacugcuccccagggaacucuugcuguugcuuuuggaauuggaaguccacagugguggagcuucacagccuucacuucuguuuuucccgaguauauugccagaaccugauuuuaucaagcuuaagaggaggacauuuaagacuuauauuuuguugugcacucuauggcauugacugaauuguaaaugguuucuggguaguagucauucacucaugauuuaggggccuucuucuuguaaagcaugauauuuggauuucugauauuaaaaaaaaaugaagcaauaggguacugccugugccauguuuaauauaucacauuugaaguuuuguuugagcuuaagauuuuuacauuuggcacauuucuaguuuauuauuauugucaucuuauuuuucaugucggcaaaaaucuuacuguuuuauacucuucagaccacuagaaaggucuauucauagcuuuauuaccuauuugcauguuuucuuuuccaugaauugcugucauauagcuauuuucggugaaucaccauuauuuuuauuggccauaacugaguuauacauauuuucucccagucuguuucugucuuuucacuuuguguauguauggcaucucuuauguaguuuguccuggggagauuuuaugugguguccagaaaccaaacaucuuucccuucccacaggaggaccaugucauuagacuuuggcaguguggcacuaccagugcaaaaugaagaugaagaguaugacgaagaggacuaugaaagagagaaagagguaaguuguuaaaaaaaaaaaaaaaaagagacacuaaacccaaucuuuaacaaguuuuauuucuugaucaaaauuguaucaucuugugucauuuugaagggauuuggauuuuuuaaaaaaaaaacaacccuaaaaucugcuugcuauuuagacugaaaaggugaauaaguggaaugcuucuguuuuugagacaggaauaaaacacaacugugaauaauaccaucagauaaaugguuaaauuuuucuuuucauuuaggagguaaugguuggcuuuggaaguggaagguuaguuucuaggugcuugaaacauugccaugaacaagucugacaaggcucuuugcuuuggguaguuuacauccuaguggaggcagacaauaaacaaguaaacaagugaguaaaguaauuugagugagugauaauuuaucauugauaaaugacagggaaacaaauuggagugcuaugaaagcaauugauaggggauugcuguagaugggguggugagggagggucugugggaggaggcaauauaugagcugagacuugacucaugagaaggaaccagccaugcagaagccugaggaagagcagucuacgccaaaacaccaaugaguguaagcugggaaguugggaagagaccccguguaugccacagaucauguggagcggccagaaggccaugguauuggguauauaugagccaguguugggugguggaugugggugucagaucauggaaagccaugauaagguguuuguauuuuauucuaagaacaaugggaagccaguggaggauuuuaagcagggaaaauugauaucauauuuuugaagaucuuucagaaggcugcauggugaauagauuauagaaggaaaggaauaaaagggagagaccauauuauuuauauguaaaguguuuagcagaauucuuggcacauagcaaauguucaguaaaugguggcaauaguaauagcagcaguaauaguguuauugguggaagucaauuuaguuguuuugguuguuuuuaguguaagucaaauuucuugauugucugugauaaaaggcuucuuuuguccugacgcuauuuuuuauaugacccauuuucuaacauguaaaaaagucuuuuuuaauaguuauuguggaccaugaguauuaacaggaagcaaggaauagggucaguugaccauugcucauguggcuggugguagaauuaaggcagugauagaaaacuggcaacuugcuggauuugguucagacagguauuguugguugcagagugcuuuuaaaaaauugaaucuguauuugaagaugggaaaauuuuaugcagcacugcagagucucuggcuuaucuaaaaaacauccaaagcccuggccacaccuggccuguauuugcacauggcagcaggcgggcuggaacugagcaguggcucuccuuccccagcuggccacaguccccacuucucacacagacaugggcuuaugcacucagaccugccugcuucacucugguaaauucucugccagggcccugagggcauuugaguuuaugacccuggugaggguuuccggauuuuggcagggccccucacaacaauuguggcaaggaugggaaugaggauuuucuguuacuuugaaccugcagcaugagguauucaugacugggcuuggauaguuggcugggguuuagccacugggauucuugagaaggucaguuuaaauaaucacuacuguaaagaagaaaaaauauuuugacaggugauuuuucauugagaaauauauuagagagauaggucugccaguguauugugugguuaaaauuuuagaggggauacuaguuaaggaggcaauuaauucuagauaauauagaaaacagcuauuugggaucaccucuuugauagauuguaugcugggauagggaauuucaggggaaaaguuguucuugaaagaucaaguaucuaagaaugaguauuucuagcagaguggaaggauauauagcugaauugacucuaacaugaugauuaugguuaaauuuguaaaaaacuucauguuaauaaaaauauuuuuacuuuaaaaaauaauugcugcaagggaaaaagugagaugagaggcuagagagguucaaauuuuaguaacaaacuucggaacuguucacaaaucuucagcuguauguauacuuugucacuacaaguuaaaguaauaaauuggguggucaaacccaagcuugaaugcauaucuagaagguuuuuuuuaacugucucagucuuccugacccagcaauagccaaaugguucacagccuuaagagauuaaagaaaaaaagcuguuuuauccugucuaccugguugguagcuuugggacuguggcuuugggauuguggcuagguuauaacuguuagcagugggcuaaugcauauugcuuucucuacuuagugaaucacuuuguguucaaguugcugaugugggaggaaugccuuuaucccugaugaugugcuauaaggcuuaccaggcauaccacaucugacucauagucuacccugcuaaggguuugugagagccugucuugguacaugguuggauaguccugauuuucacugccugggaugaaaggcuaguugcuaauacagcauguuuuuccaagcuguguuuaauuuuguuguuuuggugccaguugggauuuuguccacaugggcccauaucccaaugaauacaccauuccaaccuucaugccauccuaaugagcagcuuuacaauuaugauuuugcuuuuuccauuucuauucucuccauuguuuguauugaaggucaaagggagaaagugccuuuaacauucagaaaaaggaaaggauuuaguaaauacuuuauucaauauuuagaggauauuuagaccaguggaucucaagccagagaccaucacaaauauacccauauuuugggaaaaaaaaaagcaagaauuuuuuagaaacguccuauaauguauuucuaaagugcuacaacucuuaaugguacauuaguaaaaguuggcccacugugagucaaggcauaaaggcauaguagagagguacauaaaccacagcuucucacaguguuucaacugaaacucucaucucuuaaaaauagucgacagagcagauuaggguguagaucagugagagugaugacaucauagagauauguaucgucaguuaauaucaauuaauugucacacauuacuuauguuucuccuaacuaacuggagggcauuauuuucugauuguaccacuugagagcugcugguaauacuuguccuucuugcuaagaaggagauaucauccaaagcaaacuuuucuuuauaaagcugucccagaaaauaauucagaagcucuuguauuaacucacucauaauguaacaauaugacuuugcaaaaaugcuuuucaccuaagucucuauacuugugauugcacaguuggauauuacagagauauaguucuuuuuuuuuuuuuuugagauggagucucgcucuguugcccaugcuggagugcaaucacgggaucuuggcugacgcugccucccggguucaagcgauucuccugccucagccucccaaguagcugggauuagaggcaugcaccaccaugccuggcuaauuuuuuuuguauuuuuaguagagacaggguuuugccauguuggccaggcuggucuugaacuccugacuucaggugauccaacugccucggccucccaaagugcugugauuacaggugugagccacugcacccagccccagauaaaggucuuuuuguaauaggcaugcuuguuauaagccucucaguuguugguaaagccacagcuuaaacaagauugccauuuuggacucucacagucagcuggaguagacauguacuuucugcagugucaccagaaguagcucugugauuguuguugguuccagauaguaaaauuaucuauuuauguguguauauauucuggagcuggugauuuggggcagaaauacuugguaaucuaugauaucaagauaauauuugcugaugauggaucauuuaguguugacgggucauuuagugaugacauauuugaaaaugaucuugaguagaaagguagaugguuuagguagcagguggcagauagaaacuugcacuuggcaauacugacuugguuuuuauagugguacuucucuaauagaauaauaaagcuccauugagcucagcaucauguauuuuagaggcaagguuuccauugcauagccuuucuuccacuuuuuaacugccuuguuugauguaauugcggaagcauuuugauauuuuguuuccacuagagggaguuguaaagcuaguauuuguuuacauuuagcguguauccaugaaagcauuauuuaauaauucauauuugaaaauaucagaaucuuuuuagaagcguacuaagaggucaccuguucaaagggaauaugaccguuagguauuccauuugcuacccuuucucuugggagaagauuauuguaugguuuguaacuugaggccucuugccuucaugaauauugaggauuauaggcucugaagauaaucuguuuaguuaauuuaaguugaaaauccuaacaaaagguuuacauguucucuguuuuacauuugccccugaauguaggcuuuuguauguucuacauggguuauugcaaaguguuuuguuaacaaaguucuuugaguaaaaugcucucuuuuuuuuucuuuuuaagaaagaaacaugaaguagaaaaggaggggaguuuauagaaugauucugaauuuauuucaacugaagccuuagaguggcaaauuaucuuucuuacagggaagguaucuguuaaauuuuuaaacucgguuaauacacaguaauauccuguugagauugcugcuugcugccaaaaagcagucugaugaauuuuaaauuaaugagugguauuaaaucuuaucacuuauaaggauuguuauuucuguucuugaaucuguauuuggaaguuugauagaucuuuaaugaggaaaauuuauaguuucuaaauuucuguauuugguaacaugcauaucuagauacggcaauuuuguguuuuauugcacaagguuagugaccaaagggcaauuugacaauguauaugaggagggcacacuuugauccugggaaauggaaacacuggagguggaauuuuguuccugaauggccuuauuuaggaggacuucauuuagcuuuucucugcccugaaacuuacagaagccagggaauaugacccagcuaugccaaagaacuugauggauaaauuuuuugaagaucaauuuuaaaauguuagcauauauguaaaauaucuugcaagacucugaauacuauagggaugauuuugcuaguugauguuuauguauguauccagaagcauuuugauuagcugauugcuuauacucaaauuaauuuuucucuguggaugccaauuuuguggugucacaaagcuacaauaacugcugaauuauuauguaguuuuuuguuuuugugcggggaaaacaauguacucuucagaugucccugucaaggcgccccugaauuuuaaggcuauguacuugaaccuuacugaagguuuacaagaaaauauucuuucuguucaggagucuuuacuuaauguaaguauaaaagauuuguuuuauuuuuccuuguguaacauguggggguagucuuuuuccuuaaagcagugaugcauaauucuagacaacaaguggugcuacuuuuaaaagaccucauagaugcaacuuuuuucucuagugcauuugugucuuuguagaauugcuuugcuaccuuucauuugaggcaugucuuguacaaauauguugauguguucuguuuuguuuuucauguugugucuuuuguauuucuuguuuuuuauaucucucagucaacucugauauggcuaauucucaaaaugauuuuucaaguaccuugcauguggagaugagcauuuaaugagggucuuguguguuaauguuagcguuaaaagauuuaaagaugaagauaacuuuucauugaagaaaauaucuuucucuuguugcaucuuuagaugacaaauggauugagaaacccuuuaaaaaaaacccauccagugaauaugagaaauaaauauagagugaggaaguauucccacccaccuccaacauacucuguucccauucccaaauuuuauuucaccaaagcucaguuaagaauuuggggcauuccuuucagaccuuccauaaaauauauuuauuuaacuuuuacuauacauauuuuguuuaagaaacuuuuuuuuuugguaauucuuaauauaauacucagauauguuuuauggacacauuccauuucuuuuguacuaaugacagguaaaguggaaaaaaaaugcuauagaccagggagcaucucauuuuuuuuuuccugaaagguuuuacaaaguauuuaaagucuuuaaaauccacuugcacaauguuaugggguuugauuuauguccuuuggagggauuuaaucaagcugucaauuaaacuggugcuuaguuucuuaaagagaaguaauuagaaacaguuucccuaaaaaguauuuaguaacauaauauuugaucuucuaauuguuacauaauuuaagaaauacauuauauugggauuuuuaggguaauauuauuauauuggguuuugaagaaagacaauagcagacaguuauugaaauccuaaauguuauugaauuaugucuaacagacuagcuuauuuacucaucuuuuuaucacauuugaaauuugaaugaauuaauuuugucuaucuaguuuauauaauaagcagaaugcuaaaacugauuuuuuucuagaaaauaauaggagagagaaaucaaacauuuaaugucagauguagugucaugcuuuugcaugugcuaucuauagaaaacagucuuccaacucuucuuuuacucagauguuguaugagagcaggguauuauguaucuuuucaucuuuggaauuagauggcucucuacuaauuagugacucccacggguuucuacauuaucagagcauuuaagagcuucuaggccaccugcugcugcugcuguucucaucaccuggccagagugcaucuggcuacucacauucccugugggaugccuaauugucaauuccccaaggucugauuacugauaaaacaggauucugagacuuagucugccugcccugugauaacauaaugcauugauuguaccauuauugugacuugcuguguuuccauaaaaaaguuuuugaauucugcucuauguguauuuaaaucugagaucuucguuaaaaaaaaaaaaagccuucugauauaaauccuaaaauuaugcauucccuuuuccccaagugaaaugaugaauauaauuuguguggaacuuaagaaguuaauuaaaggagggaauuaugaacuucuuugaccucuacaguaaaaaaccacucguuccaaggcagcuuuggcuuggugucuuguguuuaaguugguaugauauugaugcagaccuuuugacucaguugcagcaguuacucacagaccuuccccaugacaugcuggaugacgaccucuccucuccagagcuccaguauucggacugcagcgaggauggcacagacggacaguaagcaccugaagucacuuucacuuguauauugcaauucuauaagucuuuuucuuuugaugaagauuaauaauuacaugauuauaaaauuguaaauugauucuuaaaauuuugggugaagauuggaaggaaaaagguuaaaaucuugggguucuuuguguuaucuauguacaaauaaaugauacgcuuuaaaucgaaaguauuccuuuuucucgagaccacaucauccugagcaauuggagaugagcuggaaugagcaaaugcugcccaaaucucaaaguguaaauguaaguaucuggugugaugaugacuuuggugagggugggacuggaucuucgugcuuuuguuuuacucuuguuaucuaauagggcuauaaugaaauucagaguuuauaugcuggagaaaaaugugguaaugucugggaagaaaauagaaguaaaacugaagaccgacauccuguguaccauccugaagaagguggagaugaagguggaagugguuauaguccuccaaguaaaugugaacagacugauuuauaucaccuuccugaaaacuuuaggccauauaccaauggucagaagcaggaauuuaauaaccaagcaaccaauguaauuaaauuuucagauccucaauggaaccauuuucagguauuguaaaaacuugacuuucaagaacuugugugugugcacacgcauuugcgugauguuuguguguguucaggaaauguaugugaguacaaugguaagaugauuuaaccacacgaaguucugagagggcacuuauucagguucauggugaauuagucaugguauuuucuguuuacagucuaauacaaucaugaucuuaagucagaaguuuaaaauagaggcucuuuggacauaguugauuaaacauuaaaaguuaagucugccaaagaauaacuauccucauuuacugcugcuucuaccacugcacugugcuucaaugagaagcuguguucaggucucuuauuguaguuuuuaaagcaguaauucuguguagguggcaacauuuaauuuccucaguuuucuugcucaccacccauaacaaauuuuagguuaaacaugucaaagcugauaucucuauuguauggugauauaacaguagacaggaugaaugugaaggaaaaaccaaaaaaccuuguuuuuccugggggggaguuuaaugaaguaagaccucaggauauaguuaguugcuucuuagaauuucucaaugacagcaaauaccucaacagcuagucugugucacgcaaugacaggauggauuuuuuaggcuguuaagugguuauuuucucuuaauucuaucuccguagaauguuauuauucaucccauaagaguuacuauuuauuagauaugaggcaccgugguccauguucauguuauuggauaugugcauuuuuauauucccaagauguuggcauaaucuaaaucauuuguaauaaaauauuucuauauagucuuauuggaauucuuggguuuuauuuauaaaauugccuucauugugugcucaaaaguagaauuuaggugucuauaaauuauguauugcagacuuucaauuaauaguguuaaauaacaauacgugcuacuuuugagcagauauauauauguguguguguguguguguguguguguguguguguauauauauaaacaacuuugaacuguaccaaaaguaaguucuguaacguaacauuaauuuaggugucuaauucagauaauuuuggaagaaaaggccaaaucuuaauugucaguuucauuuguuaucacagggucccaguugucaagguuuggaaccguauaauaaagugacauauaaaccuuaucagucuucugcccagaauaauggcucaccagcccaggagauaacaggaagugacacauucgaaggccugcaacaacaauuuuuaggagcuaaugagaguagguaucaaguuuauauuuauuuuuuaauaccacauaauuggggaaauuugaauacacaaugaauauuugagcacauucaagaauuauuauuuuuuaaguaugacaauagaauugugcuugauauuucaaagagcccuuauuuuuagagauauauacuagaguauuuaugaauaaacugacaugaagucuaggauuuacuuuaaaauaauaggcuguugagggguaauguugggugggaauauagauguggccaaauuggccaugaguucauaauuguugaaucugggagauggguucguggagauucaucauauuauucucuuuacuuucuuauauauuugaaauuuuucguaaugaaaaguuaaaagacauuuuuccaacuuuauauuucagucauucuaguuuguuaagccuuuucuccuuauuuguauaguguuaaguauccucgccuaucauacaggauaccuggacuuauuugaaauuuaaaaaaauuuuaaaagacuuuuuaugaacuuuauauauuuuuuugacugaagccuaauuuggaaaaugaaacauaguuuucaaucucagauuuuugacuauauagaaguguaauuuaauacaucagcacuaucaucaacuuuuuucuuuugauuuuacaguuuuuagucaacucugauauaaauuaguuuauauucagaauuacuuagauaucagguucagucauguggcauuugccaguuuuuuuuguauaguauguauauaaauaugagaaugaaaaaagugcuuauagguacuagagaauucugagaugaaaugcuaguaucaaaaaacaaaaaucccaaaauauaaacccguauagugacuguacugaauuacucuugucauacugucuggcacacuaaauagcuucuaauuauugugcauauugaagagccaguguaauucuagaguguggcagcaaguguuuuuguuuuacuuuuuguuucccuuuaauuaguaggggaaaggucauacuggauauucuggcuuaccugggcuauaccaaagagaaaacuggacuuuuggguugugacuucauauuguugcuuccaucguacacugggacggcaggguaguuacagggggaggcccagaauucauuuuccccugaaggagucaacagcaaauaugaggauggccucucuuuguucuuaaguuuuuuguggaaugaggaaguggacaguguauaugacauaacugguuuuagguugaguaaaugaaccucacagcaguggccugacaucuccuuaguguuuacucuuucaguucccuugaaaaguuguauuuguaucuccuggucuuucugcauauaaaaaccuuuccuuaccuuucuuaacacucugcacuucuucaaguugagucaguuacacauuugucuaaauuugacauuuggaaguuaauuaaauaacuuaaugguagugccaaauuagugauuauaguuucuuagcaacaguaauuuaaaaaauuuggagauggggcuagcucuacuauaagaccuaugaggaguuugacuuguauaaacuuuucagucuuuaauuuucuuuauuuaaccagaucucuuucuaaaaagaggacagaauuauuuaguuagcaagugguuaaaacucaguaaaugcauuuauuucugauuguaagcuaacagaaacauuguucuaguaguaaguagaauauuuaucauuauguaguugaagcauaccuaccaauccuuuuuuccauuuuuuuucucuuuuuaaagugguccccaaaugacuaauuguuucuaaaagaagacuucaaaaauuuuuuuuuaaauuauguauucguggaguagauuuggagguuuguuauauggguauauuaaauaaugcugggguuugacuucuagugaacccaucacccaaauagugaacauaguacccaauggauaguuuuucaacccuucuccccugcucccuccccaaaauucuugauuaaucuauucacuagcuaauuaauucaguuaugugccagcaucaauauaaauauaauauuuuccccacuccugccuaaaauaaaauauuuugaggcugucuagaaauuuucuuuaaaaaugauuuuauagaagcugauguacuuguuuuguuuuuaauuuucugacagcauauuacuuuauuucauugcaguuguuauauacugauuuuuaacuggcuaaaaugguaguuagugauucaggguuauaacuuaaaccagugacuuucaaacuuuccuaucagugacccacuguaagaacuauauuuuuuuacauugugauaugguguacaacauguaucuauaugaacagguauauauaaaugaaacaaguuucacaaaauaagacuguuucuuacuacaugaugcacucugauauauucucucucucuuuuuuaauccuagucacaauucacugaauugauuucaugaugcucuaaaagguuguagucacaguuugaaaaacacugcuuuaaaugacuauaaauuuauauuuugguauguuuuuaucuaauaaauugucuuuaauucccagacucugcagaaaauaugcagauuauucaacuucagguucuuaacaaagcaaaagagagacaacuggagaacuuaauugaaaaguuaaaugaaagugaacgucaaauucgauaucugaaucaccagcuuguaauaauaaaagguaagaugcuggaugcugucauuuaugagguacacugaguuagauaucuuguuuccaauaaccucagauuacauacgaagcuuagagaguaaaaacacuuggucagagggcucauagugagugaggcauagcaaaacaaaacccaggauuucugaguguuggccuuggauuacuucucuuuggaacacgcuguuuuggagaccaggcaugguggcuuacgccuguaaucccagcacuuugggaggcugaggugggcggaucacuugagaucaggaguucaaaaccagccuggccaacauggugaaacccugucucuacuaaaaauacaaaaauuagcggggcauaguggcaggcaccuguaaucccaucuacuugggaggcugaagcaggagaaggagaaucaccugaaccugcaggcggagguugcagugagccgagaaagcgccauugcacuucaggcugggugacagagugagacucugucucaaaaaaaaaaaaaagacacucuauuuuggagucccuauauuuucccuuuucucacuuaggcuuuuagaaucauugaacauuauuuaacuguacugauggcauucuguccuaaaaaguuguugauuccuuaugucugauuccuuaugucauuacucuggaugaaguauuccagcuuucagagugauuuguguuuaguuugcacugcagcguuuccugaggcuacaaauuagcauaaacguuuuaauccaaauaagaguuagugauugugaagugccaugucugggauaaacacacagaguaaauacagauucaaauuauaauugcuuacuccuugugcuuucucuaguuuugguccacguugaacuuucauuugcagaauacuuuugugauugaacucuagcucauuucaaauuuaauugaugguaaaaaugucucuuucuguaaugcucauaacauuuauuuugagagaagaacuugugagcuguuauagcaaaguaugugggaagaauuuaacauuaggugaauuuaagaguucauuccaagugggucgggcacgguggcucacuccuguaaucccggcacuuugggaggucaaggagggcgggucacgcggucaggagaucgagaucauccuggcuaacauggugaaaccccaucucuacuaaaaauacaaaaaauuagcugggugugugguggcgccaguagucccagcuacucaggaggcugaggcaggagaauggcgugaaccugggaggcggagcuugcagugagccgagauugcaccucugcccuccagcuuggcgacagagcgaaacuccguuucaaaaaaaagaguucauugcaaguauguguaggauaauuaguccucagauaacuucuuugauuagcagggauuuguccccaaaagggaugcaauaauaguuuuaaaggaaguaguucugcuucucuaaaaaaauuuuuuugguaucagguuuguuuuuuuuuuuaauuuuuaauuuuuaauaauuuauuuauuuggggcugggugagguggcucacgccuguaaucccagcacuuugggaggccaagguggguggaucacuugagguuaggaguucgagacuagccuggccaauauagugaaaccccaucucuacuaaaaauauaaaaauuaucugggagugguggcaggugccuguaaucccagcuacuggggaggcugagguuguagugagccaagauuauaccacuguacuccagccugggcgacggagugagacgcugucucaaaauaaauaaauaaguaaguaaguaaauucuuuauuuaguuuucucuaaaucaacuaaaguucauuuuucugaauuaaauuuaauucaacaacauuuauauaugauacagacgugacaucugauugggauugugacauuggggucccucuacaggaacauuauuuauauaaacauuuuuaauaccguagaugaaaaggaugguuugacucucagccuucgagaaucacagaaacucuuucagaauggaaaagaaagagagauacagcuugaagcucaaauaaaagcacuggagacucagauacaagcauuaaaagucaaugaagaacagguaccuauuuuaacuuauguaugguaaaaaaauuaaaaguuuaguuauuuaacaaaacuuuuuguaggguaggacuaaauuuagaagaacuuugaaguuauugacaaagcauuagaacuuaaauuuccugacugcaauaguuugcuucagaauugguaucccgagaagcuuuuauuuuuauuuuuccugcugcuucuccauuuggagaacuguuuuuuaaacuugaguuuaaaguggugacacauucacauucuuugauuaaugagauagccauuugauuuuuggaaauagucauaagucauugguagcuaagccugguggugguugauucauuuuuuggcagggggcaggguuaaaaaugaaagugauggccggaugcaguggcucacgccuguaaucccagcacuuugggaagccgaggcggucgaaucaccugaggucaggaguuugagaccagccuggccaacauugugaaaccccgucucuauuaaaaaguacaaaaauuagcugggcgugguggcagaugccuguaaucccagcuacucuggaggcugagacagcagaaucgcuugaacccaggaggcggagguugcagugagcugagauugcuccauugcacuccagccugggggacgagagcgagacuugucugaagaaaaaaaaaaugaaagugacuaugaaauaaugagcuugguuuugagugagacuuguagcuaagucugaggaugguuuaaugaaagaguuuaaacaguguugucucaugucuggcuucuccucauccuucaggucuuagcuaaaaacaauuaccuuuucagaggacuugcuauucacuuuauauguaagguagcccauagcuccauccuccaacucaccuucaucaugccauauucuauuacucuauaacuaucugaaaugaucucauuuguuuacuuguuauuuauugucucuucccacuagaaaguaguaagagcuuagaccuuuucuguuuggucauuauguccuuagugcuuagaacccugccuggcacaaaugaucugugucauucaguggauggaucucuuagccaugaaagcaguauuggaauaaauaggcaaucucuggaauagaaugaagaauaauucucuugaaauuuuaauuuuuguauguaauguagauuauuuuuaacuuuuugaaaaccaauaguuauuagauuaaaaaguuaaguugccuuuauguaguaaaagguuauaacuuuguaaucuuuuuuauguaagcagcagaaucaccaaguguauuaguuuccuauugcugcuguaacagaugaccacaaauucagugguuuaaaacaauacaaauuuaucucacaguucuggaggucagaagucugacauggaucucacuaggcuaaaaucagggugucaacaaggcugcauugcuuuccggaggcuuuaggggagaauccauuuucuugcuauuuccaacuucuagaggccaccuguguuccuuagcuuguggcccauuuccaucuucaaagccagcaaugaauggcugauugagucucucugguucugacuuuucugccuuaguuuuucucauuuauggacccugugguuacauugggcccaccuggauaauccaggcuacucaccuuauuuuaaggcaaucuaauuagccauauuaauuccacauacaaucuuaauuuucccuugccauguaauauaacugauucacagguuuuggggauuaggacacggucauuuuggagggcuaugauuuugccuacaauaccaacugugcaguuacagcuuugaaaacuuuguuuuuaguaagugaccauuggcagguuucaucagucuuucaaggaacaguugucauuuuucugugaccuaacaauuggguuaccccacacuuuggucauagagcaaugcaaacagcacuggggccaucacggcaucagcagauuccgugccugauagccacauccaucaugcugcgcaaaauccucuuucacuccccucagguaucuaccaaauguauuuucucagggaacauuguuuccaacaacuaugggccuggagggucccagcuaggguuguuuuaaggagcuugagccaugaugagcggagaccccuucucuacucucauuaaaacaugcuugaguuuuauuuuauaguaaaaguaaaaguuuauagacagcacagagcuaaaauacucuguguauauuuuaaacauggauauccuguguguauuuacuagaugaucaagaaguccagaacaacugaaauggcucuggaaagcuugaagcagcagcugguggaccuucaucauucugaaucacuucaacgagcuagagaacagcaugagagcauuguuaugggccucacaaagaaguacgaagagcaaguauuguccuuacaaaagaauuuggaugccacagucaccgcacuuaaagaacagguugggaugauuucaaaugagcaacuguuaucaacaaguaaagcugguuauguuuuguaacugauauuuuaugguucaucauauagaagucuuggauguuuguaguaaauguuagauugugugugaggugagugaaacuuaaaagccagugauauuggcuggacgcaauggcucacgccuguaaucccaguacuuugggaggccaaggcaggcggaucaccugaggucaggaguucaagaucagccuggccaacuuggugaaaccccgucucuacuauaaauacaaaaaaaaaaaaaaaauuagccgggcgcaguggugcgugccuguaaucccagcuacucgggaggcugaggcaggagaauugcuugaacccgggaggcagagguugccgugagcugagaucgcaccacugcacuccacccugggcgacagagcgagacuccgucuccccaaaaaaaaaaaaaaaaaaaaaagaagccagugauauuuuaaucugagaauacauccuaaagguauacuuuuggaaacccuacuucuuauacgauuauuaguacuuucucaacuuucacauuacuuguccuuuauuuguaggguauuuguguauguuguuuauaugguccuagaauaaauccagaccaaaacaaaugagucugccagcggcuggcuagaacuugagagguuaccuuggaagcuuaaccaguagaaaaccuuacuugagucucccagcauuugguaauucaccugucaauacagcaauacagucuguugagaaaugauucuugggaagagaguaaauuuugaggacaguauaauuuauaaaauaagacagucugaucuagacuuaaugagauuugcaucuugagcauauugcacagugaauuuuuauuauuuucacucaagggggaauaaaauauugaaagcuaaaugugagucagguggugaguuugcuugugcuccauaacucuagguaaucacuugagugaauaacauuucagaauuuauuuuucuuaauguaauuucaaaauugauuuaacuuaagggaaggagagaagaaaaaucagaugugaggguauggaaaauuucaccacacuuaaaauucaugcugauuuggguuauuucugaccuauauagcugccucuaauuuuuccaugcuuuuagguagaacuauauaagagugcauuacuggcaauaauuauuuaucauuuuauuuuauuuuuacauguauuuauguguguuuuuauuauaucuauuucauuauguauuuauuuuauauaaaaaaauugugaauuugaucaauguggaggauauauaggaguagggaaagaugaaggccaguuacgguggcucaugccuguaaucccagcacuucgggagguugaggcagguggaucacuugagcccaugaguucaagacuagccugggcaaaauagugaauccuugucuuuacgaagaaaaaauaacaaauuagcugggcaugguggcaugcgccuguagucccagcuacuugggaggcugaggugggaggauugcuugagcucaggaggucgaggcugcagugagccaugauugcaccacugcauuccagccuggguaacagagugagacucuuuuuccagaaaaaaaaaaaaaaaaaaacgaaggcuauaccaaauuauugaaaagucuacuuuauagaauauuuaaacagaauuugagauguagcuucauaaauuuuuauuuuauuuuauuuuaaaguuaguuuuggccaaacauaggguaacauugaaguuaguuggacuuggacaguagcccuucuuggaugacuggagaagaguggauccugguggcuuuuccuuauuggguugggggucuccauucucuguugacuuaaacacaguuucauuagggauggauuggaaggaauuucuaguguuuucuaccccugugcccacugcauuacucuguuguccacugccccacccccuucaauagaagaacucuacaguaaagucagaacaaauucuugauucugugcuggguggguuucagaccccggaauccauaaauugaagguguuaaggucuuuucccacuguuacguucuuugccuauuuuuacuuuguuuuauuauuauuuuuuuuaacagagcauggcacugauguuaggcucugcauauaauugcauagcugcuuugcaaaguggugauuccaaagcgccuaacagaagcccagaccucggcaucaugccacauauccauguaacacaccuauacacauauccccugaaucuaaaauuaaaaacaaaaugucuguaauuaguauauuuugagaaauuuauggauuguaaaauuauuaguguuuuucuuaagacagcagcuuuucuggguagaaaagauuguaugcacucacaacauauuauaauaguucuuuuuuuuuggcugauuuucccuugaauuuguuuagugagacagaaaaggugaaagaaaugggcuucuuggagcucauaguguuccuccaaugucauaauucucuccuaguaaacuaucgccuggacucucuccaccaaacugacuuuuaccuccucccauucauggaagugucauguuaagaucucugauuaucuccuuguugguauauuacuuuuuuccuucugucuccuugaaaacuucagcuuuuggugaagucauggacuuugguuucuaugucauaaccuuuuaccuuuucuuuaauguuauauuuaaaggcuccacuuugaacacuuucuguuggcuuagagacucccacagacuucucugugugugguccaguccucauuuuccugugugcuagaacccuguccaguucuuuuucccucccacagauucagcugucaucucuaucaucucucucucucucucucucuuuuuuuuuuuuuuugagauggagucucgcccuguugcccaggcuggaguucagccgucaucucuuuaucauuacacuugucucagucuugaaaaaugucugcccauaucagacuugaacuacucaagcuaaucauggcaaacauugagcuacucaaucuuuuuugauuuuugguauuaaaacuuuaaacuuuaaaguuuuaugaguaugaucuguuuuccugaacuugucaauaggauacaccauaguuuaauugauuuuuacauaaaaucaaauuauuggcagagucugccuuuucuuuacaauuuuuuuauaccuaccuuuucuuuaacuuuguuugcuaguucccagucccuuguuaacacuauugugaccuccccagaauauaaauauuagcugucuccccaccccuucuugcugucauuacugucaugcugucauuaauaugagcucauucauuguuuuugccacguuacuuuggcgcuuuagaaccagguuucucaagcuggccuggaauucgcagcagugugccaggagguuugcagugcugaauaaacauggacuaguuuccagaagcuucauuuugcucaaaaauuuaguagaaaaaauuuaaagcaaacacagcuucauuaugaaauagaauacaaaauucacauggauuuuuaagcuaaaaugggagacuucagagucucuuugcuucaagguaguuauguauuggugcucuuaugggauguaccuuguguuaguauccuuaagguauuauugggcuuuagguuauacuacagaucaggcagcaaaagccuaaggccuuuucucuacuucaaagcccuuucucaguauucuucuuauuucuuauuuucuuuagguuuucuuggguaauuucaguuaaucaacuuaacucauuccucugccucucccaugcucugccauuugccuggaauucagccuguguagccuuuuuugaaagaaaggugaugauuucgacaguguguuuguucuaccuggacucaggacucccgugguuuauuacacccaaacauauuuucuuuuggaagaaacuugaguauauugcauacacacucuauauuuuauguaaucccauauaguuacacacaugcacauacacauuuacccuauuuuucuuugucauuuauuuuucaaguguuucuuacagcacuugauaugucuaaggcacugcagaagcaccuucaagggggcuauuaagagaaauaagacaucuaaaagguggagaaagauaagaaagaaacagaucaaguuuaaaagaauuucagaggagggaaagauuauuuuuuggcugcucuuaauggaaugaacuuuuggcugcuuagaauacagugaguuuucauguguuuaucuauauccuuacuguuuugggauacaaauagcaugauucaaaguagucugccuaaauauauauacauacacuuauacugacaauauaaaauacgcauaggaauguaauacauuuucuuuggcuugaauaaaaucuaauuuuugaauaacucauugucuugugaauauagaguugaaggagacuuuagaaggcaccuaauucaaccuuuauuagcauaauuacaaaagaagaaacagacugaagaguugaagcuucacccaagcucuugacucccaguucugugcacuuuaccuuguaaaagaggugaugcucccaugugaugaucuuguguuugacaucaaaucuaauuauguaucauaauuuuuaguuuacucuuuauuaaaacucuuuaugaaaaugacuuccugaacuuuuuuucuauuuaggaagacauuugcucucgucugaaagaucacgugaaacaacuggaaaggaaucaagaagcaaucaaguuagaaaagacugagaucauuaauaaguugacaagaagucuagaggagagucaaaagcagugugcccacuuguugcaguccgguaggugucugguagguccacugucuccccagaagguugguucaauaugcagaaagaauguaguaggauccaugacuuguaaaaauccagaagggacagaaaacacaaucagcaauaaauuucuuuaaaaaaaagaaauauauauuuuuauauauauacagaaggcauauauauauauauacauauauauauauauacauacacacauauauaaaaaaauauauaaagguuuaguuuguuuuuauuaaauaauuuggaagcuggagaccaguauaaaguaccaaauaaaaauaaccguaauucuacuacugagauaauuauuguuagcauuugaauguauuuccuucaaaugaaaugaauguacacacauagacaauguccugcuucuuuauguaaugcauuucugaaaacauacuaaagcugaacaugcaaaaauugaacaauaaaauacauuauaggguaauuucuaucccugaaaacuaaaagugauuauaaaaucccauuauauuuugcuuuuuuaggcccaauauuugaucauauaguucuauccuuuguauaacuucuuucauauuuuuccccucauaauggaauagugacuuaccuagucaguugaggccagagaguuacauuuuugucaugcuucagauuucuaauauggucuuuauaguauuaaguuugagacauaugcuuccuaucauuuuaguuucagcaguuguuuuauuucuuauuaauuuuuauaaaaugauauuagagcaaagaacaauaaaaugaucacguuuguacaaacaccgcuauauagacaaaacuucccuguuugcugguaaguagcucacauugugaaaacaggucaacaguuauucauuaacugauauaugaaagucacacuuuggcauaugaaagguaauuuagacuguugguacaauaugugaaagggugggcuauucaaaagcugaaaauacuaaagucaaagacugccuaaauguauguguauauaugucuugauagggggcaaaauuuggauuaugcuuuauuaagggccccucccuguuuaguuuuauagccuuuguuuucauuuggcauuacuuggugagccuuuuuccuggcuguuaaaugcuuugaaaauauuauuuucuuuaugccaucauugcuucacuuaaucauuucccagauggucauuuucuuuugaaaccuaauaaugucccuuuuaaauugggaacaguccccccaccaccuugcccaguacauuuaaaauauuagguuucuaaaguuucagaauuauaacccuaauacacuucauuuacauguggagguggggaugcuggauagaaaagcaucuacaaagaaguuaaaggcagcacgguauaguuuucuuauugcaggguagaaauggguuccaaagaauuuuuucuuugacuuaccaugaguuggaguguuacgcuccuauuaaaggacuuccggaauguuaaggucuguaaaugugacugauuugauucauaaaaaggucauaguagcccaugccuuuaacugcccaaggucauaugggaugccauacuaaaucugggaaaugucuggcccagaccuaugccuucugggucccaugggcucuauguauucuaaagagacaguaguaguaaagcagaacuuuacuuucuguagccucaguggauucaagucuucuguagaucauaagcacuuuguccccuuaauuuuuucaguauauccuaugguucuuuccucugcagggucaguacaagagguggcucagcuacaguuccagcugcagcaagcacagaaggcacaugcuaugagugcaaacaugaacaaggcuuugcaagugaguguugccacuuggaagaggcucuauggguaucugaauuaggcaguaguuacaucaccuuuuugaaucuuggguuucucuguauaauagaggugguuggaccaccuucaaaccagcccaugggaguuguucaccaucuccuucacacaguuggcaagucaaacucaggucugucuaauugcagagccaaggcccugcacuuccugccagcuugccugccaccuccuucaaguggcauguccuuucaucuuuggguguaucccagagaucaguucaucuauggggguggggaauguugaauuuugcugcaauucugucauauccuccuccagugcuauuuacauuuuccacuggagggggaggaaaauaugggagaagaguuccauuauuaccuccaccuuuucaccaccggcaggcuaaaguacaaccuguucuuggcaaaccagcguacuuuguccuguacucuaguaagccagaaagcgccgccaucagcauuuaagcccaaggaacacaccacuuuccauggaggacaaaaucuaagagacagagaugugagaggaaauccuuauguuuguuuucucauucauuuauucauuuaggcuuuacuugaaaaccugauauaugccgaccuuuauaaaguauaauguguacuaauaauauauuugaagaaguuuuuuugccuccuguugaucauuaaaacaaauuuugaaacagaaugacugauuacuucauauaggaaaauagugaaaauuauuuuuaauaauuuuguguuguaggaagaauuaacagaacuaaaagaugaaauuucucucuaugaaucugcugcaaaacuaggaauacauccaagugacucagaaggagaauuaaauauagaacucacugaaucguauguggauuuggguauuaaaaaggucaacuggaaaaaauccaaaguuaccagguauggaaagaauauuuuaguuuacuguagaagaaccaacauuaguaaugcugaugaugcaugguaucuguuuuaaggugagagcguauuauuuucauauguuaacacuguguauugaaugcagauaccuugcauuuaucagugauaguauaaaaaauauacauuaauuuuuccuagaaaccuuacuaugaccuuacuuuuaaaguagagauucugucuuuuauauuacugcuuaauacagauauuuuagcaaucucauaguaggaaguauuuuaucacuccugcuagagacugacuagggagggaguaguggugguuguagaaggagaauuaaacacuuaaaggacuucagaagcacuugcugcguggaaggugcuauacaaggcucugggaauagaguacaaaagaugagauaggaacuguccuucccacagggagcuuacguguuuucuggucagggagaaagaaacauuguuggaaacaacuaagugcuaugcauucaauguuauguuugauguauagaggugggauuuacacauuuccuguacugguuuuggauagggaagagagagauacgguguuuggaaaagauuguauuuagguuaagaaaagauuuuuggaugcguuuggcccuuaccaccacccuuuuguuuauaguuuaagauggaguucgucaucauuguugaauuguaguuuccagagaguguuuaauacauguuguauuucagguauuacacaacuaaauacaaauauauaaauguccugaaaaguuugcucuacgauagguuuuagaaguuacauauuuugagacugugaucucauuuuaagaacaguaagaugagauucaguaaguagaaauauaaagugaucaggugauacugugaaaguagaugguauuauucuaguuuaguaaggcuccauuuaucuagaggucugucuucagggacucucaucccuacaaaucacagcacugcuauccagaaggaagcaaagaagaaaauaucagaacuggauuauaugauguauuuaguaggagccaccuucaaguucuuaucccaggaccauauugacuuagauuuauuuguacuccaugaauugucucauuuccuaaccaacugcagagggcuagggcaaggguugggaaagacaguauccauccuucggccagcagcucagccuuagcaaggagaaaacuauggaaacccaacaggcuagaguugcugaguaucacagcaaauagcucuacacauuuacguguguuugauccacaucaaaauguccacaguuaugaucccaaguugucaaagaaaggcuuccaguuugguuaguaaauuaaagcaaaaaacgaagugcauuauaucuuuuuuagacagauuuacauaaaauguuaauauagucaccuggaaaauucacugcugugaaugccucauuuccugcuaaugccagauuaauucuaaggggcuacugggaagagcgugggcuuuagauccagauuguuuugaauaauaguuuugccauuuuauuaccagcuuugugagcuugggcaaauuucuuagcuuuucugagccuguuuucuuaucaagcuuaaaaucccuuggagguuaaacugaggaauaaaauaaugaauauaaaaggccuuauguaacacguucuaacauauauuaggcaucauuugauaaaugauggcuguuacuauuguuauacaguagaugguugauuaaaacauaucacugaucagauuuuauauuaagucacaugaauuuuguauuaauucaacacauacuuuguaaauguucuugauucucaaccuugugaaaaauaucaaauccaauaucaacaugugagaguuggaaaaaccagagugaacuccuuugcuuaguaaggcagacaauuaguagcagaaccaguacuugaacccagacuccugagaaaggcucgguugucugucuguucauauuuacaugucaguuaaaccuuuuugccuuaaacuccuuucuucaugucuuuuauuuuugaggauuaaagauguaguucaugacaaaaaagauuuuucuccaauuugugauuacuuuuaguuucugcucuaguuggucugggaauuggauaaauaauacauuauguauguuuaucuuuucaaauaguuacuucuucaugaugucuauuaaaacauauucugcuaccuuuacacuuucuauuuacuuagugcucauagccaaaauccuguauucaucuuuuuuuuuuuuuuugagauggaguuuugcuuuuguugcccagaccggagugcaauggcaugaucucggcucacugcaaccuccaccucccagguuuaagcaauucuccugccucagccuccugaguagccgggaauacaggcaugugccaccaugcccagcuaauuuuguauuuuuaguagagacgggguuucuccauguuggucaggcuggucuugaacucccgacuucaggugauccucccaccucggccucccaaagugcugggauuacaggcuucagccaccgcgcccggccuccuguacucaucuuaaagcacauuccuauagauaauaaaccugagacaccgcaucauuauuauaguaaaaggaaugauggacgcauucagugggaaagugaagaauaaagcacagugugauuagucacugaggcucggcaaaaagacauccagugaagcacaagauaagcgaagaaacguuuugcuuguagucaucccacccaccagcaguuuauuagaugauauuuuggcuucguggaaaacuaaaagcuauuauacucagaucaaauucaaaggagauaaaggagagaagauauuugucucuuuccccuggucuacugugauuccuagaauaaggggaagcaauaauuuucauguguugggaauuuuaguucuuuguugacuugggcugcuuucaaaucacugacucaaauauugguggcuacaagcuuuuauuaccaacuaccuccucccucaagcuacugccuaguaaauuuuaaggguuuagccucaauguucuauuuuacauucauggaauuugaguagcuaaaucugcaugcagcuugcagacagcuuccucucucccuuauuauaguuggcugcuaagcucaaauaauaaacauuuaacaaguggaaugccuuuucccuuuggucuucucagcaggcuucauaagggacuacaguuuauuuggauuuaggagaacugacuuccaugggacucaguagugagccuuuuucaggauuggucacuaccacugauuuuuuuccccuuugaggaaagaagagaaaauuauuuuagcaagcacuuucucucucugacuuggcucccucuaggaguacaggaugugcuauuucaguggucagcauucaguaagaaaagaaauuggggaugcauaauuuguuaaccgagcaaaauaaucauucugcuuaagguuaguucaccaugucuuauggcacaggaaguuauauuguaaaauauuuuauauuucuuguaauuuauauuuucuacuucaauggaaauagaagugguuuaaaugagaucuauguauauagacagacuacuuacaaaauauauauauauauuacauauacaaauuugcauuuuguauugcaaaagcuccuuuuauaacauuaaaaagccuaccuaauaguuuguucauuuucucugucucgcacacccauacacacagacacacacacacacacacacacacacacacaauauucuaagauuuuauuuggaaucaucuaaaacugaagaacaguaaacauuuuaacucagguaguauuuuuguuucuaauaaagguuuuuuaaaaauauauuuuuggaacaguuuuuaauuuacagaaaaauuuguauuacgcagaguuccuauauacgauaugcugcacccauuuuucccuacuaauaccuuauguuaguaugguacauuuguuacaauuaaugagccaauauugguauauuauuauuaauuaacauccaggguuuauuuacaugcccuugguuuuuauuuaacauacuuuuucuguucugggaucccaaccaggcuaccccauuacauuuaggggucauguuuccuuagauuucucuugacuuuacuuguuuuugaugaccuugacagucguaaggaauacuggccaaguauuuuguaggaagcuugucuauuggaauaugacguuuuucuuaugauuacguuuuucucauggguuuuguggagaaagaccacagagacuuucaucaccucaucuuaagggcagauacugucaacuguuuauuucuuuucaaaaguaacuuaauccuccauuaugaaaaaauuagaaaauacagacuaaaaaagaagaaaauagaagucaccaauaaucucaccuuacuucccaugaagaaaaccacuuuuauauuucaguauaaaacuuccacaucaccuguuuuguauguuucuaaaagauaaaauaauauugauaauauuucuuuauaaugucauuuuacuaguauauucugaaaucuuugaauauuagugaauauuuuuauagauuacuuuuagugacuauguagaugaaugaaccaguuuagcuacuaaaucgcuguuuaaaaguuuuacuuauaaauaaugcaauaucauuguuauaagcauccuuguagucaagucuuuauucacaucuuugauuacuuccuaaagaaguagaauaauugucuugcuagagggugugcacuuauuugagggcuuugaugcauauuacuaaacagcccuaaaguuuacauuauuacccacguccugaggcugucccuauuucuugguaaccuagccaguauugagaguuaucacuuuuccuguuuauaauuuuuauauaguuagaucugucacuguuuucauuuaugguuucuugauauuuaaaaauaagguauuucucuaguacuuucuauaguuuuauuuugcuuuuuaaaucuuucaaauuaugaaauauaccauauaaaaaacauggaacauaaauauauagcuuaaugaauuauuugaaagugaauauucguaggaccaccacccaggucaagaaguaaauauugccacgagcugcccauauucuuucuuauuguaaccuugaggcuaacuacuaucuuaucuauuagggcaaucauuuucuguuuuuuuuuucccuuagcuuuuuaauacccaguuauucacaccuaagcacuacagauuauuagauuugccuucauaugaaggaaacucauacguuagguguuuggguuuucuuuucuuuuuuuuuuuacuguuuuauugagauauuauuucacauaccauaaaagacacccacuuaaagaauacagcucagugguuuuccguauauucacagaacugugcagucaucaccacaccuaauuuuacagcauuucaacauccccccaaagaaacuccaugccuauuaccagucauucccauuaccucuuccugccuccacagcuccagacaacuaaucuacuaaucuacuuccugucucuauggauuugacagcucugugcauuucauauaaauagaaucguauaauaugaucuucugugaauuuucuuuaccauuucuucucaagcaugucugcugcugacagagucuguuuccuuuuaugaaaauauccuuauauuuguuuauuauacaauuccugaccaauuguucuucuauuucagcacauuaaagcuauguugguccacucucucuggacucaaugguuucugugaagaaauucauuguuauuugaauuaguguuucugucaguaauguauagguuuuucuuuugcugcuuuaagaauuuuuuucuuuauauuuaguuuuugguacuuugauuaugauauguuuaaguguguuuuucuuuaguuuaucucauuuuggguucucugagcuucuugaauauauaaauuuauuaugucuuuuaccaaauuugugaaaaugucagccauuaauuuccuuaaauaccuuuucugucucugugucuuuguucucuccuuuugggucuccaguuacauguauguuagauuuuuugauauuauacuacaguuucuugaggcucuguucauuuuuuucuauaguuuuucccuuuuuauuuugcauaauugcuacuggacuauuuucaaguucacuccuuuuuuucuuguccucuauacucuauugagccuaucuagugaagguuuuguguguuuuuauuuuaacuuuuguuuacuuaauaacauuucuauuuuguucuuguaucacuuuucuuucucuguuaagaauuccuguuuuuuuucauucacuucaaguaucuuuuucuuuacuucauaaagcagagauauaauagcuacuuuaaacuuauaaaacucuuuuagugacaguuccagcauuuggaucauuuguugauugucuuuuaagauuuggccacauuuuucugguuaguugcaugucaaguaauuuuagauuauauacuagacauugugaauuuguaugaguguuuuaaaucuguuugguucuccaagccuuugccacauugcuuugaauccaaccuguguaugcaucccuucggguuuagucauugugagacuugaaugugugguuuaaauuucaguuaaguuuuuaaaaucuuugauaugcugguuugaggguugcccuguacaugcauaguucagggcuuagacugaggcuuguacaaauuuauacacagaauucaggauuccuuucucugguucuuuucucuccgggagucuuccuacacucucuuuuuaucacuggguuucagcaaucugacauuggugugauguaugcugguuuucuuuguguuuauucugcuugagauucaccaaacuucuggguuuugugggguuuucauuuucaucaaauuaggaaaaauuuggccauuauuuuuucaaauauguuuuccaucccucuccucuucugggaguucaguuacacauguuggaaaauguaauauguucuguguauuucuguuuuagucuuuuuuaucuuuguuuuuaauuauauaguuuuauuucuauaucuauguguucacugaucuuuucuucugcaguuuuaaauaugcuauuaaccccauccaguauauuuuacauuucagauauuauaauuuuuucuauaaguuuaauuugagucuuuucuguaucuuccauuuuccuccacauauucauaucuuccuuaaccuucuagaacauaugaaauauauuaauucuauugucugugucauugauggguuaguuucuauugauugguuuuucuccugguaugguucauauuuuuuuccuacuucuuucuaugccugauaaauuuugauugaaugcuagacauuuugaauuuuguuuuggaugccagauauuacuguauuuuuaaaaauacuguuguacuuuuucugugacacacaaguuacuuggaaucaguuugauccuuucaaggcuuucuuuauaggcuuuacuacaucagguuuagaaaaggcuuuaaucuggggcuaauuuugccccacuacuaagguauuauuugaugcccuuuaaauuaggaagucuuugcauuauggcucauugaaacauaacauauucccagccuuauucauuuccuauguuuuuuucccuagccacucauacagaacagaucuccagagcucuuuuucugugcagcuucuuuuuccccaguauuucuucccuucauauucuagccacucuggacuccccaaauucugaauucuuucucugaaacucagugagauuacugggcucuguuuggguuucaccucccugugcuauggccuggacacucuccaggcagaaagcugggguaaucuuagagcucaccuuguuugcuuuccuuuucucaggaaucccuggccugugcugccuguugucuagugauugaaaacuauuauuuuauuugcuuuauuugguuugcuaguuuuuuaaggaggaagauaaagguuagucuuguuaauucauuacggcaaggaagcagauaaucucucaaucuuuaaauuuauugaaacuaaaauuggguuuaaauuagcaugguuuuauuuuuguguuuuucuaguuacucagauauucacccagacuuguguuuuaguaaguugaaaaaaauaacagaaauuguugguuaggauggcuaguguuuaguauucuuuucuuccuuaauauuuauguuguuucuguuagagucauaaagggcauguauauacagcaugcaguuuuccaauaacacaaauguaaauuaugucaaaguucacauuucuaagcuacuuacagugagcagcaggacuaagcuugagaaggcucuuccugugaauaaacguauuucuguauauagagacauggcaaaggugauaauccuuguguaugacaacauuuaaaauuguuuugaaauacuaguauauaauuguauaggugacaaaacauguucaccacuguggucagugcuuuuagggaauaaccaugucugauuuauuacuugauuuaauguuaaaaaucacaauuucuccauuagcauuguacaagaagaagacccaaaugaagagcuuucaaaagaugaguucauucugaaguuaaaggcagaaguacagcguuugcuggguagcaacucaaugaagcgucaucuggugucucaguuacaaaaugaccucaaagacugucauaagaaaauugaagaucuccaccaagugaagaaggaugaaaaaagcauugagguugagguauguaaagccuauagaguuaaaaaaccauuuuuaaaaggcucaauaaagaaaacuuuuacacuuuuuuuuuuuugagacagggcgucacucugucuuccaggcuggagggcagugguggaaacauggcucccuguagccucaaccucccaggcuaaagcgaugcucccaccucagccuccugaguagcugggaccacaggcgcacgccacuaugccuggcuaauuuuuaaauuuuuuguagagacagguucccacaauguugcccaggcuggucucaaacuccugggcucaagcaauccucccaccucaaucucucaagguguuggauuacaggugugacuaaccacauccagcccuuuuacauguuuuuaaauuaauaaaccuuuggcuuucaggaguuuauuugacauuuuuagaaauaaaguuuaaagaaggaaaugccauuuuuaaagggauacugacagucccugacuuaggaugguuugacuuacaauuuuuagacuuuacagugguggaaaaguuaugugcauucaguagaaaccauauuucaaguaccuguaaaacaguucuguuuuuuacuuucaguacaguguucaauaaauuucaugagauauucaacaguuuauuauaaaugaagcuuugcauuagaugacuuugcauaacuguuggcuauuauaaguguucugagcacauuuaagguaggccaggcuaagcuaugguuuuaauagguuagaugcauuaaaugcauuuuugacuuaaugauauuuucaacuuauaaugauuuuauuaggugauaaacccauuguaaguugaaaagcaucuguauguuuuuucugguuacucuuggcaccuaguaaaugagauaccaauuagguaaaauuccuuuaccauaaauacaaggaaguauucucuguaacaaggaaucugcauuucuuuaagauuggcuuuuaccaauagugcucuaaaaucuaguuaaaauaaauccuccauagaaauccuguaguauuuucuaugagauuuuccuggcccauguucuuacaacaaaagucauucuauaugaggacauuaauuauauagugaugaugguacagauauuauauaguggucgugguacuaugggaaaguacacaaaaucugguuuugucagucauugaaauccaccucuguauucuucaguucggaaaaugaagcuggagcacuuugugacacuuuugaauuuacagagccaauuucagacaaauugaaacuaaacacaugacuaauaaguaagucaaagauauuucuguaagaucaugcuaucacagagaucuuuagggcugcucuccuuuauagauccuuuuuuuuacccuuccauauuucacaaaucaucagccaucuauacucccaauagaaaauaauauauaaaacaccuaauaacuaagaaaagcaaaagaagagggaaaaggaauguggguaguauacuccuuuuccuccuggguggagauaauuguuuacuuccuucuuuaguacuguuuuaucuccuauuuaaacuaggaguuguguucauuagaacaguucugcuaaaguauguauaauauucugugcuaauuauuguggaauuuugauugugguuaauuuuuauauuuuggaaaaacaguguuuuugcuaucaaaaucuuuuccagccugauucccucuucugaguaacuacauuugaugacuaaaacauagauuuuaauauuaacagcaaaugagagagacuccuccccgcccugcccccugcacauuuaacaucuuuaaaucaagcuguuuucauuguugcccuacauuucuuuaaaaggaugggaaugaaagcuuguuucucaauuugcauuaagacauuagaguuuauuaguuuaagcauuuuggugggagugcucuaggauuuaggauacuagaaaccugauuuugagucugaaccuuagcucagauaucuuggugcuuucuuuguucuguauuaaacuugcuaauggcauuugcuauacagauacacuuuaucauguguagcaguagauaguggucaugcauuguacuguuuuuuagccuucccauuuuccucuguagucugguugaucaauagaucaaaggaauaacuaucucaucuuugaguauucuuuuuguccagcuacucuauugccauagugaauucucgguaguguacaucuaaacuccaauuuuucucaaaguuacuucagcuguggacucaagugaucugcccaccuccaccucccaaagugcucggauuacaaggaugagccacuguguuguggcaaagagcucagaguccagguacacaacaagugaaacggaguagauauauuuuuaaaaucuuuguaacccccaucaaugaauaaaaagaaaaguagauaaggaaaacucucagaggaaaauaugcaaaguuaaaugaacagauaaaucugggaagguggaaaaacaaaugaacaaugaagguauauaagagguuccacuuugguggugacacaagaaauacaaaugaaagcaauuguuagauauucuuuucccaucaaagauaauuauuuaaagauaaucacugccauuggaggcaaagagagaugggcagacccauguacuaccugacaguauacauuuggaugacauuucuggaaggcaauucgccaaagucuaucaugagucuuaaaaauuguauguauugaauaaaauauauguccgugagugaaugcugacauaaaugaauacauacagaaauagaauaaaugcuugaucuuaguaggagaacauaugaugagaaauaggauauuuguauugucucaaaguauccuauaagauacuuaucauuuauuauaaaacaaaaaauaguaaguuuacaauggagaugacagaucccaccuucaauugauuauuaccaguggugagacauagugauaucaugugucuccugcaaagagcacauaucaguucuugacaugcaugccaaagaugcauaaccugauuuuaauaaaccuaaaaacuccaaauugaggaacaucccacaaaauaacggguuaguauucuuagaaaacaucauggguuugaaagacugaagagcuguccuagauuggaggagacuaaugaaacaugacaacuaaaugccacucagaaucauggauuugaucuuggaccagaaaacagacauuuggggcaaauuggagacauuuguauaaggucuguagauuacuugauaguauugcaucuguguuaauuuacuaguuuugaugauugugcuguaguuauauugggggaagaugaguaaaagcuauauggagauuauuuguacuguuugcaauuuuuuuaaaguauggaaguauuucaaagugaaacuuagaauuuuuuaaaacuuguaaaacuuuugaccuuuuaauauucagacuaaaacagauaccucagaaaaaccaaagaaucaauuauggccugagucuucuacuucugauguugucagagaugauauucugcugcuuaaaaaugaaauucaaguuuuacaacaacaaaaucaggugauuaaaaauauuuuuuauauuuuaugagaauuuuuauuuccucauuaaauacaaaggauauaauagaguuuuugcaaauaaagaggcaaugugaguuaguagacaaguauauuagcaggugauuaugaguuccaguuacuucccuuugcuagugaacuguugguuaguaguuucauuggaagguaaguuaguguaguuccaguucucuuucucuaugguagcauggcugacagagguauucuuuccuccuuagccagcucuugacccagaaguaaaacuuugcuuauuuagaugguugcugaagauuauugaauucugagacuuauuuuaaggcaucagcuagccaauacuucucugguuaaauauuuucauuuuauauauuucaaaguaaauacaaaauuuaaacguuuaguccugucagaaaacuacuugucaaauaaaugaaucuauguucuuaucaaagcgugaagagacuuuuucuuuugcagaauuguaaaaauaauaugucaaauauuguuauaggggagagagaaagcauagaaaauauuaaaaaauaagacaaaaucaaucagugaaaaugauguuuauuuucuguaaguacuaaguuuauucuuuugugucuaggaacuuaaagaaacugaaggaaaacugagaaauacaaaucaagacuuauguaaucaaaugagacaaaugguacaagauuuugaccaugacaaacaagaagcuguggauagguaaggucuauauagaugccugacgacugucuccuggguacccuuccccucuaagucccugcccuucccugugacaaaaagauucaaaaugauugagugauuucuacccuguugagaucuuggauuggcagagaugagucccuggcuucucaaauuagaauuuggaacacauuuuccauagaaacaguguuauguaguggguuggguucuauaguaucauugaaacuguaguucacugaaauauuauagguuaauauuuuuuuaaagacucgucugggaaacuauucuuuauaaagaaaaaagucugugagagggaauaugucuuccaaauaccaaaucauaaacuuggaaacagacuucuggaacauaacuuacuugugaguuggggacugcuaguauuuguguuuaauauagaugacuugaaauuuuggagccacacccucaauuauugccauuaauuuuuuauaaacagaaguccucaacauagauuacuaucucuauuugaaggacuggggcagucucacauccaaguuucuaauuguucucuagaaacauuugaagaaagaaaauuuugaagauucucauaagauuguugguuauuaauuaauuauuaccacuuucaguuggggaaaaguuaucugaccucaauuauaauuugcauuagagggaagaggugaggaggaaggaaggaaaccaauucauuuugguguucguagugagacugggcauugccuuugauuccgcucuguuuccaggugugaaaggacuuaucagcagcaccaugaagccaugaaaacucaaauacgugaaagccuauuagcaaagcaugcuuuggagaagcagcagcucuuugaggcuuaugagagaacucauuugcaacugaggugagaauaaagaguuuagcugccuuuuaagcuguagagacuacauuccccuauuccauaauuuagaggaaaauuguuuguuaugcagcucuuguauuuuuuugugguuaaaucauuuaguugcugguuuuguguauccaaggucugaguuggauaaguugaauaaggaggugacugcugugcaggaauguuaccuagaagugugcagagagaaggauaaucuagaauugacucucaggaagaccacugaaaaggagcaacagacucaggagaagguacaguacaaguuuauguuguaucgacauccuuucacucuucaagccucaguauuaucauuuaaacgaauacauuuguucuagagaagugaauggagaagguauucauauguucucuuuacuuuuggcuguaucacacucauauagcucacaaauaaaauacaguaauuacugaaaugauuauuaaaaccuuaauguacaauggcauauagauaggagaaagugauuuuuuuuuucuugcagauuuauucuaaagggcaaaaaaaaaaaaaggaucagugucacuuuaaaucugaaaaucacagauccucauuuucgguguugacuguucaggaaacccuauguaguccugugagcgcugcacggagcauucguucagagcccuuuuucucggauccauuucuuucucacuaccucauugucauuuuauucuucuggggagaagaguaggaauuugaauguuggucucgugauagggaaagugaugauauggaggauauggacagcaaggucagcaucuucguaugaccuccuucagggaagcuggaggggcuagaguagauucuccaacucugccugauucuucugagucacucuuggugaguguccaggaguaaaaucacauguaaacagucacaccuccucuuuucuucccuguccuggcccagugccuuaacaggccugacuguccuucacacuuuggaccagcggcaaaccacaguuugaaagcuaucugccucaagauuagaaaauauuuuuaaaugcuuaaauaaauguucuauacagagguuuuugaauaaguuauguuaaagcaagcuauuacuaccacacacuuaaaaagaauaguaaagagcaggcgaggaauucaguucauucaauaucuugauuauuguugaauagauuaauauggugaaaaaugugccauguauacauaucaucuaguggaaaaagaacuucuaaagggagcuguuuuagguagggauggcaguauaaaagugagaaaggaucuuauauuaccuugaaauugaggacuuagcuuucaguaauguuuuaaaaauuaaaauagggaaaucacuagugugauucuuuuauauguauaaaaauuggcggccgggcacaguggcucacgccuguaaucccagcacuuugggaggccgagacgggcggaucacgaggucaggagaucgagaccauccuggcuaacacggugaaaccccgucucuacuaaaaauacaaaaauuagccgggcaugguugugcgcgccuguagucccagcuacacgggaggcugaggcaggagaauggcgugaacccgggaggcggagcuugcagugagucgagauugcgccacugcacuccagccugggcgacagagcgaaacuccgucucucaaaaaaaaaaaaaaaaaaaaaaaaaaaaaaaaauuggcaagaacauaagaggaauuuucucaaagaggucauuccaggaauauuuucugauacuuuuaauagaaucaauuugacuauaaaauaugaucucauauaaugggucaguuacaauuaguaucugcuauugacugauauuuuggcucaugaguguuuguacacaaguccaagaagaaaaguuaaacugcuauuugauccuucaaaaaaaaaccaaacuuagagguuaaauuuuucacguguaucccaaaacuuaaaguauaauuaaaaaaaaauuuuaauuguuauacaguaaaauugacuuccucccaccacugggcguauaguucuauaaaccuuuaacacguuuauaguuuugucaggauacagaacaguuuuaucacccuaaaacgcucccuuuugcuaucuuuuugugguuacacuccuccuccaaacccaccccucacuuaaagggccaguguacuuaaagcauuagaaguuuaauuucuucccucucugggaauucauuaguuuuuuacuauagaauuauauaagcccuuaguaguauaagccagucagaacugaaacaucuuuauauuuaggagacugucuaaucuucucacauuuuucagagguaggcaaaaauacaccuuuuuuuuuuuuuuaaaggaaauguuucacauacaugggagaauguuacuaaacucuagaacaagugagggcacuucugggguagcucuuccaugcaggacauaagccauuuuacugcagcuuagcuuuagguagggaauuuaaccuggauacagaauauaugagucagguaacaauaagaguuaaaggguguuuuuuuauguuucaugcauuguuuucugaaacacuugcugagucagguugcagguuaaauaggagcucaauuccaaguuuuaaagcuuuuaguagcacacagaacuuuccucacauguuaaccuggcucauugagagaaagggggaaaaaaucauauacacggaauccuucagguuggguaguaaucagugaagccuaugaauuugcagacaaggcaaagauggucaacauucccauuccugaugccauuucuaugcacauuaaggcuuauuuauacaauuguaauaugaguuagguaggugcauuuuagaaguuagagggauuuuuuuugcuauccaagacacgcacaacaaguucauguuuuaacuuggagacuguuaguguuguagagagauguuuauuugaauuuuguuuaaagagacagcuauuggaggaaagagaagaauauguaagcaaacugcagguggaacuugaaaaaaaguaccaagauacacuuaugauggaaaagagcaaguggcugaaagaucaagaaacugauauuaaacagcaaguugaaagugaagugaucuuagccaaagcacauugggauaaggaagagcaagagguguggauuaaaauuucuuucuggucaccacauuuuuaaaaugugguacuaacuuuagaagacaauucuucuugaaccagauacguaauuuuuauuugccaggcacuuacauaaucauccauuuuaccuuuuggaauugagcuauuagcaguuaccacaccaguuuuauuuuuaggaauuuagccaccucuugacuuuucgacccaacucaggauauaacaaguuuuuugggcacuucuuugauuccucaaaaugaaaccaugaucugauuucauauuguggaaugauuauaacucuagacuaauauuuauaacuaacaaauaagccauaucauggauuagaaacaaagaaguaaugggcagucucagaagcccauaauuuguuaccucuauuacuuaaauagcaaaugagauuaggaaaugcuaauaguucccuagcaaguuagggaacaaaguaugauccuaaaagcuuauuuagaaaugaaaacaaaaaagaauucucaagcuuauuuaaacuaaauuuuuuuuuuccuuuuuugagacggagccucgcucugucuccaggcuggagugcaguggugugaucucggcucacugcaaccuccaccucccgaguucaagugauucuccugccucagccuccugaguagcugggauuacaggcaagcgccaccacacccagcuaauuuuuauauuuuuaguagagaugggguuucgccauguuggccaggcuggucuugaacuccugaccucaggugauccgccugccucagccucccaaagugcugggauuacaggcaugagccacugcaccuggccucaacuagauucuuuuaucuacaaaauggcuauuaauugcuauugaucugguagccagggaaacaguaggagaacuucagauacccagguggugaacagaaaaagggaaaaccaaauugugcaguuucauaguuuugccuaagacuguguuuagcuccaccucacuguacuguuaaaguggaaaaaucauuaagauguucuuccaauaauacugccucccuuuugaauguagucuacuuaguaaaauuuaacacuauaacaaauaagauucuaauguguucaagugaguaaaacuauuuuuuagauuguucagguuuugguucguuaauuagauuuacucgguccuuuguggagagcaugguguugauggcaaaacacauuaacuguaauuuuuuuuuuuuuaaauccugccaucuuuguaguggcaauaggaaagauuccagaagguuggauauuaagagcaagauauccugacuuuacacaacauacuuaaaucuuucaugugauuuuugucauauaguuaaguucaaagaguaacuuucaaguuuuacuugagaguguauuuuaauugacuaaauuucuaaaccuuuuauaauuacuacaacaauaucuagaugguuuucaaacacagcugugguugcuuuucuggcuagcuuuuaauucuaguuuuuacuuauuugaaaauuguucuucucguaugauuuuucuucugaaaacagaucaaagaaaaacucauucaacagcuugaaaaggaguggcagucuaagcuggaucaaacuauaaaggcaaugaaaaagaagaccuuagauuguggcagccaaacugaccaaguaaccaccagugauguuauuuccaagaaagagauggcaauuaugauagaagagcagaagugcacaauccagcaaaacuuagaacaagagaaggacauagccaucaagggggcuaugaagaaacucgaaauugaauuggaacucaaacauugugaaaauauuaccaaacagguaaaaggcagauuuauucuaguaaauuuauuggaacugccugucucuuaaugaaaacccauacaaugcuaucauugaacucguucauaacuuuauacuuuuaagauuuugugcauuucuaggauagaaaaccugucauguuccuaaauuuuucuucauaauauuucugucauaaagcugccaccccucgguuuuucuguauauucuuucgguuuacaaaauauuugcuccuuugagauuagucuaagcauuaagaugcccaagguuaaagagggugcuuuuuacaucugaaugaaucacaguuuaauuauuaaucuuucauaucuaauuuuuuagaaaauauuccacuaaggugguuauagauaaguaaaccuaagcacauaagguauuuaacaacauuguguggagacuugaugugguuggaucugcaggcgugcccuuaaauggaacuuuaucuaucauucccaucagcuuuccaaaaguggugccaauaccuuuccuuugaggcacucacaaaacuagcuuuuaacugacacaguuacuugauuugaaagaaaugucauacugagaaaaguacagccuauugugacagaauaaagaugaguuaucuguuauaucuuucuuaccuauuacagugauucucaaaauuuuggucccaggacuccuuuacaauuuuaaaaauuggggacucuaaagagcuucuguuugugugguuuauauuuacacuauuggaaaaucugagaaauuuuuaaaaaacaaaaauacccaagcacacauuccacugacugucagaacaaugacaugaucacagcaugcagcuuuuggagaacugugcuguuuaugcaugagagaacagcaauaaaacagauagugucuuaauauuauuuuggaaaaaguuuugaccucacagacuaccugacaggguuucuagccucaagaguuccuuggacuuugauacauccguuauguaguuauuuuaauuuuauuacuuauuauaaacucuuaaacaagauagcacucaauguaaaguuuuugaaaauacacucuacuuuugauaaauacuugaaauucugcuuauuuguuacauuguucuacgugauuuuacagggcaccuuuaaagucuggaaauacaggcaaauauauguaauggugccaaggauaucuucaguuaguuuaccgaaauguuuacugaaggggguuucaaaagaguuaagaaaacguuccacagacaaaaaguugaguuuaaaggugcugcuuugguauuuaugaaauuauuaaucuuaaauagcauaauacagcagaaaggaaauauuucauaauaacuuuuuaaguagauaaauuucuacaggagcuuuaucuuuuccccauuucuuaacuccuuggaguuuguacguagacagaguuuacacauugacauauuuagcacuuuaacgagaaauacagccucuuauaucaacccugcuuuuguguuguauguacguauauauacauauaucugcauaucuguguguauuuuaaaauaaaggaauaagguaaaauuauuuaacauaaucuucugguaacuaguggcagauuuacaaccagaugacccucauaauuaaucaagucuuaauuuuuucccuucagagguaucacccucauucuuuaguauaaacucauucucgacaguaggaaaguucgcagguguagggcucuaaacuagaucaguguauguguucaugcacauguguagagcaugaggagucaggaaggugguggguguagugauuagacagcaguuggcaccaagcaguccuccaggaggccuucucuuucccaggauaaauaggaguuguuagaaaugguaauugguaccucguaugacacuuucuaagauaguacuggucaucaaacauucacagauucccacuuccucuguugcauuuguaugggaugcuaugggaaguuuacaacaaaaggauuagaauccacuguuugggauagguaggguacuugcagucaguuugacuuuauuauguagugauauacaguauaaaauacugaaaucauaauugcuguuuaaaaaugggaucuuuuuuaaguuuuauacuucccuuuaccucuuucuuuugcaauguccuacagguagaaauagcugugcaaaaugcucaucagcgauggcugggagaacuaccagagcuggcagaguaucaagcacuugugaaggcagaacagaaaaagugggaagaacagcaugaggucucugugaacaaaaggguaagagcucuucugcaaagacacuucaggaggcugucuuaccugaccccuucucuuaucucaguccuuggaauuuguaccuacucauagaauuguugaaggauaaacauguugauacauguuaagcaauagcucaaagccuagcaaguguucuugucaucaucaaguuguucuuagagaaagaauguauuuuccuaugaggauaacuuagaaacuauuuaauaacucccauucuaucuugcccuaucuuuagaugaaauugagaacagguauauauuuguuuauuauuagcuauacaguauccuuucacaugcuuaaagauuguuuucucuguuguguuaguagucuuguaacauucuucuugguaaauagccaguucuccuuuccagaaaugucauguuucuugacuggaaaauacagauauuauaaccauguguacucuuccaacuuaauuacugguuuaaaccaauucuaaucaaaaugccaacaaacugaauguauuugaaguugacaaaauaauucuauaaaauguuuuuggaaaaauaaaaggacuagauguuuuuuaauguucuggaaaaauuauagucaagcccuaacacauaauggaauauauuggaaagcaacaacucagacuguauugagucacaaaaauagaauucauuuuaauucagugcaauacagguuucagagguaggcccuacuauaaauaaaagcuuaauaaauuguuuuaaaacaagggaaugaggaauuauuucauaauagucuuaugauagccagguaacacuuuggaaaaauuaaguuuacccaacguguaucacaauaaauucuagguuaaugaaggaguuaaacauuuuuaaauaaaaguguagaaaaauuaaaagaaaauugaagauuucagaucuguaccauaauaacaacucaguuuugaggcaacauauccaauagcaaagauaaaguaauagguugaaauauguuuuguuuuuguaguaaaaaguaaagggaauaauaaaaauaagaaaaauggauaacacaugauaaauuauaaucuauauuuuuuaguaugucugaaauauuuuaaaaggaaauuuaagagggagagagagaagaaacaauaugauugugaggauaugugucucagagcucagaagucaaguagaauaguaaaguugaguacaauguagaaaauaaaacaggccaagagaucuuuucauaagaacauagaaggcuguauguuugugaaagcagacauauagaaaugagagaaaaguguuuuuguugcuucucaaacuucagcaggccugagaaucacuugcaggguuuguuaaagcauagcuaucugggcuuuccuccuagagauaaugauauaguaggucuggaggguguccugggaauuugccuuuuuuuuuuuuuuuuuuugagauggagucuugcuguguuucccaggcuggagugcaguggcacaaucucagcucacugcaaccucuaccuccuggguucaagcgauucuccugccucugccucccaaguagcugggauuauaggugcccgcuaccucgccuggcuaauuuuuguauuuuuaguagagaugagguuucaccauauuggccaggcuggucuugaacuccugaucucagaugaucuugcccaccucggccucccaaagugcugggauuacaggugggagucaccgcaccuggcuggaauuugcauuucuaacaggcucccagcuggucuuuggacuacacuuggauguaaguagcacuauuccagauaauuauaucagccacaaaaaauaaugucaacauguugugcauccuuccuccaaaccaaaagagguccagaaagggccgguuccauagcauuggcuauagaguuauuuuaagauuagagugauuaguugagaucugugacagugugaagacaguuucuagaauucagaaguaguuaaguugguucagugguucucaaacuuugcugcacauuggaauaacuugaggaucuuuaaaaaauacuguugccuggccccuacccuuaaacuuuguuuuguaugggcccuggccugggcaucaggauuuuuaaaagcugcucaggugauucuaaugugcagcaaaguuugggaagcacugaguugaugaaugcugucaaauucucuuuguaaaacuucacaugagaaaaugcacauuuugguaagguugggcagguuauaaaaauucuguggaauccaucaccucuauccgagucaccugggaaugacuuccaggcauccauugcaacaugaccuguuuucucuaaaaacacuauuuaaacauguuucaaaucacuacugaauuauucugcugguagcaaaggaauuuugcagugaauucuuuuguaaagcucaccuuagauaguggguuccuuuagcagaaaauuuauuuaguagguacucuaucccaucaucccagccauauauauaguauugaucaaugguaaccaccauugucuaggccaagccuuuggagaugcccaguucugucuuuugacacuagugcguccuugugccuucuuugaauucaguuaggaauucagucaggaauauuaaaagugaaagggacucaaggccauuaucuacucuacuccuuuauauaggugaagauguuagugccaaagagauuaagugacuuuugcaaggccaugcauccaaaaguaauaacuacauaagauuuauugaguccuuaucaucugccaggcucugggcuaaguacuuuaaauggauuauguccuuaugucauuuaauccuaaaggaugcuaucaaauuggcauuguaauuauccccauuuuauagaugaggaaauugaggcucaaagaaguugaggaaugggccuuuaguucuucagcugguaaguuaauuccagcaguuugucuccagauucuguucuguuaagcaucugugcuaggcuuccucugcaaauuggugucaggauuggagcuuagguuuuuugauuucgcuauuacuuuuuaguuauguacuaccuguuuuuuucugugauccacuaguucuauuauucugucauacaaacaaauuagacuaaugaaaaaugacuuuuucuguuugguauuguccuuuaaugaacuguucuagccacuaaaagugcauuaaaauacaguuacacuuaucagcaaguaauuaugcaggugugugcuauauuccuaaguaauaguaaaaaauccuuaugaguccgcuuuugcuuuagguaaaagauacuuaauuuguugggggcacagauaaaauuugagauuguaucuguauuaagaaaaguaauaugaaauuuuuucucacauuaguuuuggcuaauuauauaauuauaugugugaguguuuaugugucuauacauacauauaaacauauuuauguauauauuuugaccaauuuuaguguaaguauaguuuuuagaauaaugucuuaucuaaaaucauguuuccuuuuaauuuugauuuuacauuuccuagcuucagagguuaaccaaaauaguuaccuuaauuuuuuugcgaaggaggagaaucauaaagacuuucaaaaugcauguuguuauguucuuuagauaucauuugcuguuucugaagcuaaagagaaauggaagagugagcuugaaaauaugaggaaaaauauacuuccuggaaaggaauuggaagagaagauucauucucuucagaaggaacuugaguuaaagaacgaagaagucccuguggucaucagggcugaguuagcuaaggcucggagugaauggaacaaagaaaagcaagaagaaauccacagaauccaagaacaaaaugagcaagauuaccggcaauuuuuagaugaucaccgaaauaaaauuaaugaggugcuugcggcagcuaaagaagacuuuaugaaacaaaaaacugaacuacuucuucagaaggagacagaauuacaaacuugucuagaccagagucguagagaauggacuaugcaggaagccaagcggauccaacuggaaaucuaucaguaugaggaagacauccugacuguacuugggguucuuuuaagugauacccaaaaggagcacaucagugauucugaggacaagcagcuuuuggaaaucaugucgacuuguucuucaaaauggaugucugugcaauauuuugaaaaacuaaagggcugcauacagaaagcauuucaagauacacuuccucugcuuguagaaaacgcugacccagaauggaaaaagguauguuccugagagugagagaagguauugaacaccaagaaugauuauagaaguuguauauaguguuuuuuccuuuuuuccuuuuaaauuuuaguagauguaagucuuauguuuuugucagugguuuaaaaaaguuucuguagcgaaauccaaagguuugcauguuucguugccaaaaaacuuuacuacuucauagugucacaaauacaagacaagauuuuagccucuaaauaucuuuuuccuaaagaauauuuaggacaaauaccuaaugcaugcggggccuaaaaccuagaugacagguugauaggugcagcaaaccaccauggcacauguauaccuauguaguaaaccuucacguucagcacauguaucccagaacuuaaaauaaaauaaagaauauaugcuguucuuucuaagggccugagauuucagaaacugaaaauuuuuuuuucaaaauucuguuuucugggccugaccacuucaugaaauaugcauaauaagaguuucuuaaaagcuuguaaagaguuuggaagccuauuuauugcccucaauaaauuuaugucucauuuaggcaaaaaaaugccaaccaaguacaaagguauugauauagaaacaagcaaauaaauacgacucacucgcauaaaacucugaagcccaguuucuggauguacuauauaugugcauauagaauuaauuauauucuuuuaguuauauaaguacucucugagaccagcuuuuaauuuguaugaaaguuucaguaaaaccaaauucuugcuaccuuaugaucaaagcaauuagguaugcaugaaagauccagaaugauauucugagcauggugauuagccaauuucaacauuugggauuagaggcaggaaaaaaaaaaaagccaguauuauaagguuugucuaauagaguugagacuuaagagugaaguuccaucaaaauauugugauuaaggaguuucaaggccaggauugagcauuugguauuaauaccuacuugggagaguuauaaacuagaaaaaauaaccuugaguuucaguuccauauucgaugauaacuagauuauuauauugggcaaucacauaguugcucacuggaaaaauaaaauacaaauccccggccuaauuccuuggguuuggguaggauaugcauggcacagcuuagccuuucuggguccugcauuugaaacaguauagaauuuuagagccagaagggaccugaaagaucagcucacuccauccuacuucaccccaguugauauuuuuauccuugaccucacaaagauguugcuaccgaguaguugccuucaauguaaaauuuacugggcaagaucacuucccaugaauacugcuucacacuuaauugagauuuuuuggagaaaauaauuaaaauaacuuggagaaaacauauaauuaaaaaauuauagcagauuuggagaugagaaaugaugggaaaaucauguuuacaugcuuucguuuguaagcauguuucgauuuuuauaacaguuauaaaaucuguuauaaaaaucaagaaacuaugacaccuuucuccuaccauuaauauauacauauaaaaucaacccuggagucuuuuuacagggcuuauaauugugcaagcaguauaagaucaucugugugacuuaaugaggcucauaagucuauggagacagaaucacauaaucuggcuaagaauuuagauguuuacggcuuuuguugggugggucagauuccauuccugagaaaaggauggcuuugaaaugccuaaucuggaauuugucauagaaguaauacuugaccuucugccauuuucgagcuaucuucacucaggaccuugagguaaagcuaugauuauagagcagugauuuuaaauuuguuacauaggugcuguaaaugugaggaacuauaauuuauaauuuauuaacucucuaguuuuaaaaauuguucauggaaauuaaaacaaaagaugguuuauuaauauauaaaaacaaguccucauuaaaauaacugagacaaucaaaaguuuuuuuaaauggagaggaugcaaugaaugaaaaauauagcuuucaagaaaaugaaugccauaucaaaauauauuaauacaguaguucauaacagauaaaacaaauaucaaauggaacaaaauuuucaagcaaacuuaaggauguauguugucucuuuuaccaucaaagucaaguuaaaacugagacaaaaagguuguugcuuuucucccuuuucuguuaucuugacuuuucuuccccaguuuugaguaaaaacuggaagcacugacugcauuuugguucagcuuuuccuacuccuuuugaccucaaacccauagcuucuugauugccucuucucuauaauugcuaaccucugcuucuguuggacauuguaaguagguuuucugacagucaauuaagugguuucucauaaucaaaaucaaggcuucuagaaucaggcauauauaguauguuuuaaauaaucaguaagacuacuuucuccauaccaccuauucuguuccuuuccgauuuaguagucaucuuaaaucugaaaacauuaccauaaaaauccauugauuuggcugagcgugguggcucacaccuguaaucccaguacuuugggaggccaaagcaggcggaucacgaggguugaggcaggagaaucgcuugaacugggagguggagguugcagugagcugagaucgcgccaaugcccuucagccuggccgauagaggaggacuccaucucaaaacaaaaaccaaaaaugaaaaauccauugauuuaguagcuguauugcugugacaaggacuggaacauaaaaacguucaauaaauauuagugaagaaauggucuugugcaagauguuuaauuuagcuaagccucaguuucuguccuuaacuuuggcauucagcuggccuuccuuacaaaauuacuguguauguuaaaguauuuagaagcauaugaaguacuauauaaauuuaaaaugauuuuuaacuguuauuuucaauucauaggaggcagaggguuagcauuauacuugcuaauuaacuuguuccuugcuguaguaaaaauguucuagauuuucaagaacaauucugauuuuauauugucuuucaugugguuuaaucacguaaaccauugaaaaaucucaaauucacauauauaaugugcaaaccauaucuucugucugucucauagcugcccaccagucgccugucagacaguguucuuauuuggaaaguuucauaggaagcuaguuccuaguacagugacaguacuuauauaacacccuaagaaaaauauuggcgauagauaguucaggcaagauuuuuuucagguaguguuuucucuuuguauuuuuaauauuagcauuuuaaauauaaaauuguauaaagauuuuuacuaagcauuaacuuugaagauacuuuauuucagagaaauauggccgagcucucuaaggauucugccagccagggcacuggccaaggagacccuggaccugcugcuggacaccaugcucagcccuuggccuuacaagcaacagaagcagaagcugguaauuggauuuuguucccaccagucuuuguagcauccauaaucacccaucugaaggguugcuuugaggauaaaaggagaucauagaugugaacaaauggguaauaaucgucugacuuaauguccccucuuccuagauuucauuuuguauuuagauaagaggguuaauuuaggcccucuucuucuauuuaugguuuucccuucauucacaacugauucuuguuacaaggagaaucaugagaguuuuaauggagaagucauguuuuuauucccugaaaucaaggguuucacaucagagaauugccaaguaauacagacuuuuucauucaaauuacugaaacuaauuucaaucacuuuuuaauggaaaucuuucugaaauguauuagauguuuucuaauugauuugugaguuuuucugagggccugggcaguguuuuuaaucucuuccuuuccaacguauggcagagugaugaauuaauaguuuaacuuuuccuuaaugacuuagacucuucaucaugacaaaagaauucuuauacuguacuagagccgcuuguauucagagcuuacugaggaguauaggacuuauauugccuauucauggagauuucagagcuagaaauuugcaaauccuuuauuagcucccaucucuuuuagcuucuugacccuuugcagccuacuccuuuccuccccacacaaacgcaacagccucucucugcugcuuauuugcuguuucuaauguaaccuggaaaagaacuaauaauugccaaggccagucauaccuacuaaguaaauaaccucaguuugcacacauuucuaauucagaaggcaauguuaccagaaucuuagagaaucucugccuauaccaucucugccuuucucauuguucacaaacccuuuuccccuacuucuagguucuagguggcugagaauaucuuacugccaauucaguggaugauaauauuaccuuaauuuguauuuugcauuguacuuuuuaugcccuguuuggaauagccugagaauucuaucuuaaucugugaaaugaauggguagaaacaaguuuuggauguuacuuagcuuuaggaaguccuauaaauauaaaagcaauuaguuuuggccaaagaaaaaucagacuauaaaaauauuuuucuuuagucuuuuuucccuuaaaaacaaacacauuaauaaauucauuagaaaggauuaaauaauacaaaacauguauuaagugauaaaguccuuuaaaauccuaccaccagagaguaccacuguuggauguuugguuauguuguccuaauaucucauuauuauuugaaguacuuaaaacauuaauuaugaaauacuuaguucauucaaagaauauauguaugcaucuguaaguuaugaagccuagcaaccaggaacccauuauucagcuuaagguacagaacaucaccagugcuguugaccacaguucuaugccugcaaccucuccccagucugagcuaacaaauauucugauuuucaaaaauuacugucuuuuuuaauguuuuaauuauguguauguacccucaaaaaguuguugccuuuuuguguuuuaacauuauaaaaauaguuuaauacucuauauucuuuguaacuugcuuuuuuccuguuuaacagcaugcuacuaagauuugucuguguugaugcaauagcucuaguucauucauuuucauugcuacauaguauuucaguguaugaauauacuaugaguuaucuguucucuuguuagugguauuugcacgaguuccaauuuuacaacaguauccuagaugaaaaauauaaaugcaauuuaugguaccauugugauguuucauuaauccuuuaauguucauuaacauaaauggcaccacuuaaaucaaacuaaaaugucaggagagagcuaagaauaauuuugcuggaucaaugacuuuacaguaacauuuuggccccugagccugugcuaacuuguauuccugcuuuauuauaucacuuauguuaauagucuacuuuuuaaucauuuuuguauauuuuaauuuuauaaauuuuauguauuacuaaugacaaugucuguuauuuauuguguacuugcucugugccagcuacugugccaaacaguucuuauauauuuacgucuucuaaaaguuuuaaaucauuuuuuaaacuuggaaauaauuucaaacauauagaaaaauagcaaaaagaaaaauaguugcgaagaacauucacauacccuuuaaugagauacaccuauuauuaacauuuuacuccauuuugugcucuuauguauauauguguaugugaauauuucauuuuuuuaugaaccauuggaggguaaguuauauauacauugugacuuuuauggcuaaguacuucagacuguauuuuccaggaauaugaauauuuucuuguuuaaccuuaguacaguaaauuuaacauuaaaguauuguauuaaucuacuguuguauucuaauuuugucaauugacccaauaaugucuuauagcauuuuuuuuuucucuuccaguacagacguuugucuagggucagcuguuacauuuaguuguaauguaucuuuagccuccuuuaaucuagaacauuuccacagccucucuuugucuuucaugacauugacauuuuugagaaauauucucugcuuccaccuucauuuuuuuuuaacagaacuuuucucauuugggguuugucugguguuucuucaugguugauucagguuguguuuucucagcuggagcacugcaaggggugauauguuguuacaucuaaaaauugugguguccauaugucuuauuggugagguuacuuuucauuaccuagugaauauguugucuaauuucuucacuauauaauuacuguuuuuuuuucacccuugcuuaucaguugauaagcaaucugugggagacacuuuuuaagaccaugcaaauaucuuccucucaugaaaaccuucucuuauauuuggcaaccguugaugauucuugcuugauccagucuuuacuauggugguugugaaauuauaauucuuccaacuuccucccucuauuuaucccaguuggcacuaagcauguugaaucaagaauccuuuccucucauuuguguauuuauuuuaucucucuguccaucgauccaucuaccuaccuacuuaccaacccacuuaccuaccuaccauucauaaaauuauugguaugacucauaaauuccuauuuuuaauacuuuauaauucauuacuauauuucauuagugcucaaauugucccagauucagcuaguggagcuccuucaaacuggcuccuauguccuugugacaugccuguauuuuugaguacuuucuuacuuucuggcauaggaagauauuucagucuuauuuuguauauacccuccccaguacuggagucagccauuucuugaagauccuugacucccuuuaguagggaaugguauucaauaccaagauccagagcaauagguuucaugacuauuuuuaaaguagaugguaguauccaguagugccuuagacaaguuaauuaauaugcuccaagucacacagccaguaagcagcagaaacaauauguaaacccaugucucucuaucuuaagcaucacacucuuucagucgugcuguagccuuuagucaugagucaucugcuuuucuuucugucuuuuuuuuuuuuuuuuaaugauaguucuuggucuaaacugauauaaaaguuuucugucauuuaauuuuugcagauaagaaaaagguccuugaaauuaaggauuuaugcuguggacacugcuuccaagaacuugaaaaggcaaagcaggaaugucaagaucugaaaggaaaacuggagaaaugcuguaggcaucuucagcauuuagaaaggaagcacaaagcuguaguggaaaaaauuggagguuagcauuuaaaguagcacugcuaccaauaugaauuucuuugauccuuguugaaauguucaaaugugacauuuuaguuaaugugugcacugauccucuuuugggauuaauauaaacuaauuuggaucuuauuuuuacuaaucaaauuauuauuacaaaacucaaaagaggaagauuucagcucugauuaaaaggucacauuccuuucuuccuuucuugauuaaacagauauugagggcccaguauacgucaagcaggcuucuaagcacuggggaugcagcagugaauaaaucauacaaaauuccaguucugguggagauguguucccuuccuucaagaagcuuuugguuaagugaggagaucuaacaacagauuaacaaauaauuaaacguugaaugcuguuggcaguguuuuccucagaaagaggauuguuaauucuaccucuuauuaaaguuaagaaagguuugacuaagccuugaaaaauagagguguuugccaaggagaacaacguuugagauagagggaaaaggcauaaacaagggcgugagggucuggacuggccuccuucuaguccauucaucacaaugcugugagacauuuggaaagggauauuuucuaccauuucccagugccccucugaagaagggaaguuuuggggcuuagaucgcugcucccucuucuuaccuuucacuaucgcuuauagccuauacgcuauacucuacauuugaaaugcuuccgauuccugagcugguccuauuucuuuuacugcuggaccuucauugcauaugauguuuguauucuguccuguacuuuuccccaacauucuuuuuagucuuacucucauccuuuaggauucaacucagaagaugcuuuaucugcaaagcccuucuugauuuucccuagucagggugaagugggcugcucuugugcggcccuguagcauuggcucuuccucuauuaucaccauuaccauucuguauuguaauuguuuggucacuugucagauaccuucuccaaauucuccaagaauuuucugaggagaaggaauaugccauaucuuguucauccuaauagccauggugcccaccacauaccagauaauaaauauuuaaauggacaaaaaacaaaaugccaggguccuaaauaauggugucauucagaaaagaccagguuaauaaguuuauuuuguacauccacuucuuucucuugccuggacacuggcaauaauucccugacucuuuaugcuucuagucuagccccucuaauccauucuccauaggguagcuggagcaaccuuuuuaaaaagugaauugaaacaugacacucuuguuuaaagcucuucaguggcuugccauggccuucaguauaaaaccaaaaacacuuaguuuaacgggguuugaaaaguucuugauccagcaccugccagccccuucaaccuugucuucccccagcucucuuaauuucucucaguagagccauagcauggauuucauuguuuucucccuucaccaaaacauccugaucucauuuggcuggcuaacuccuucucaucuuuuccccaauacauuacuuccucagggaggcuuuccuaaccacugcagaccuguuuaguccuccuguuauacacuccccauaguuccuaugcuuuuuauaacauucaccauccuuguaaucauuugcugucuguacuucccuuuggaguguagucuuuauagcaauaaggaucaaguccuguuccagcacuuagcacaccuggcaccauagcacaacucgggaaauacugcuaaaagaagccaccuguaacuaccacugacugcuuauuacuaaggcacuuauuacucuuaguacuuauuacuaagagauagauaauaauuacuuuaagaccagaaaggguuuuaagaauuuugagauuaaaaauuuaacaacugcaauucauuuugugauuacuuagcucuuuaguagaggccaggagaguaaaugaguuauuuguccaacuguaguauauuuaaaacauagauauguuaaaauaugaugaaaaccaagacaauuuguuuuacagaauauggcgauaagggcaguuggauaugacuauuauuuauaaauaauaauauuuagcaccauacuauucuacacaguguuuuuugaagcugauaucuucuaaaacucguagacuugcaaauaaucgaagaaaguugauauaucacucaaaacaaugaguugauacaaagggucugggucagaauuuaagucaauaguuuaauugaaauuuuuucuuaauauaacuuuaguagguuauuauaucuuugcuauugagauugcuucuuuguuucuuaaauucuauuuuuccacuuucuugguagcguuuauuaaaaaauagauggggugggagugaguuguuuaaaacaaaaaguuauauccaucaccagggggaauagaguaauuuuguuccucaacuuacggaguguugagaggguagcaucacaggaaacacgagaugccauguucacauuuauauugguauuuccaggccuuguguagguguugugcauuuguuguuuuauuucuauuauaaucuguaaguuaacaugugaagaaaaguucagaaagguuaauuuuuccuaggcuuaucaaccuuguaagcagcaaaguuagaauguaaacugaugucucugacucugaaauucauguguuuuccuucauaccacauggacucuuaucaguuuccucauccucuuuuuaaaaguucaaagaauuguaaucuccccacccuuaagaagguucuuuguaacucuccccacccuugagaauguacuuugugagauccacccccugcccccaaaacauugcucuuaacuccaccgccuaucccaaaaccuguaagaacuaaugauaaucccaucacccuuugcugacucucuuuucggacucagcccgccugcacacaggugaaauaaacagccuuguugcucacacacacacacacacacacaaaguucaaagaauugaaaaucuuacauuauuucugaaaaagacaccuacuuaagguuaacuuucuuuuuguuuuauaucgaggugcauguucaaugaucguuuauaugagcauaaacugucuaccaggauccauagggaacauggaauuagaaaaccuaguagguuucuacagagcuucagcacaguuggaaaacaaaacacaggcaucugaaacaguugaaacccaauuccaggacaguguguaacccaaagcaagaagaagaugggauacagauuuuaagugcugagaaaacagagcaagggaauggucugaguaggguuucuaaggggaugaacguuacagaaaagcgacuggaaauugcacagucucuucuauaaacauuuguauugggaacuuaagggaaaagaaggcuuaaaaaauuuuuaacugucuaauauacuauaaacuuucuguuauagaagagaauaauaaaguuguugaagaauuaauagaagaaaacaacgacaugaagaauaaauuggaagaauugcaaacacuuuguaaaacaccaccaagguauacuuuuacuauuuuaaagugcuauuuuaaagaaaucuaaguacaaguaucuuuaaauuuuuuuaaguaucaauuuuuuuuguuauacagcaaaaaguauaaaaaagaagaaaaucccccaaaaccuuauuuccugaagauacccucuagugaccucuuguuuuauaucauuuaagccucuuucuacacauacuccacaugcacaauguguuuuuaaaauugaggcuauaguauaagguauuuuauaacuuuuuauuaauauuacuagauaagcauuucuccauguuauuagauauucuccuacauauguuuuucaauaccugcauaaauuuucauguggauuuacuguuauuuauugaagcaaccauaacauuuauguuguuuccauuuuuccccuauuuuaaauaacuguauaguggagauuguucuagaugagauuuuuagcacuucucaguuaacuuuauuagaguauauggauacauauauauuuuucaaaugaaauuuuucacuuaccauuucuguuuuuguaaucuuugguuuguuuuuuaggucauugucagcaggggccauugaaaaugcuugccugccaugcagugggggagccuuggaagaacuucgugggcaguacauuaaagcuguaaaaaaaauuaaauguaaguuuaauucugaagauuuuaaggauggcuugggccuuuuuuauuaucacuguuaaaguaaacucagaguuuaccagcaguaguucuucuagggaauuuuccaaauuaccuuuuucuucaaucuuaaaagagauuauugauaccuuuucaaaauuauguagucauugaucauuuuucccaaauaauaucuuuuggaagugaugugagaaucgucuuauguuuauauuguugauuuucuuguuucuuuuuggacacuaguauuaaacugaaaaguuaauaaucuuacaacuuaacuaauuuguaguaaagaaaaugucacauggguuuuaaaugagcaauuaacuauuacuuccuaccauaaacuuuuuuuuuuugagacggaaucucacucugucaaccaggcuggaaugcaguggugcagucucggcucacugcaaccuccgccuccuggauucaagcaauucuccagccucagccuccugaguagcugggauuacagacaugcaucaccacacccagcuaauuuuuguauuuuuaguagagacaggguuucaccguguuggccaggcugaucucgaacuccugaccucaggugauccacccgcuucggccucgcaaagugcugggauuacgggcgugagccacugugcccggccuccuaccauaaacuuuuaaggacuguagaaguggaucuaguuagcaauuguucuguuguuucugguuauuauuucucauagcuauaaauuuaucaaguccuugucaguaccagguugugccagcauauccuguagagcauucuccugauguguguuuucccuguuuugaauacuucuugguuucuaauucuaauaugcauagaauggauauaugucccaaaacaauaaguaguguuuauauaggaaaaauguauauuaacuuccuaaaauuacauuucuuuuuaacaaaaagagcaggaaaagucugaaguuucaaauauaauugguagauucagaaucacguguagauguucuacaaagcucauucgguauuuauaagggaauuugcuucuccguuguuacuggugcuaauaaagggcauauugcuacaagcaacgcaacuuuuuguuaauaauguauuaauugggaaguggaauuuuaagcauguuuucauccuaaugugauaacuuguauguauguguguauauuauguuuuaguuauuuuuuagaaaguugguuggagguuuuguuuugacauguacugcauuucauuuuccauuucaaauaaugaaaaacagucucccaguuaguauuuuugcauagaaccacuaauuuucagaugcuuacugacauuaacaggaagauuccuguaugaauugguauccuuaauauaacagagauggugaaauucuagauguaggauguagucuuggauuuauuaaaaaaaaaaauaaaaguuagccuuagcuaauaguaguccuaaucaaagauauauugaguuaaaaaaaaaaacuugaaagcugugggcuauguuuauauguaaauuucagaggccaacuauaagucccaucacccuccuuguagucucauuuuguacauaucucuuaugaauuguaauauuauauuuaguuagaugcucaaaaagugcugcugaaagaauuuucaauaaauaauggaacguaaauuuucagagcacuagagaagaaugagucucuccagcucauacugccuccuuuucuucugucuuuguguuugcuuuuuccuuucuuucugcuuaaccuuuucucuauauuuuauuuuucucuuuuccuaacuggacauaauguacaauugaaauacuaaguuucuguaccucauauuuacaguauuuucuucgcuaaguguuuuagaauaugacaaaauuuagcuggggaauaugccauguuuccuuacuauauguagcugucaucauuccgaaagaacuuauagaguacuucucauuugagucuaccaaaaugaugaucuaaaauauuccauuuuaaugacuguggaaaguauaauguuuaaacuauacuuaaaaucacuucaucuaccagaaaauugaucugaagucugccccuccuguuucugaaaaagugcuaauaaacauacauucugugggcauuuucucacuucccuauaggugacaugcuucguuauauucaggagaguaaggaacgagcugcagaaaugguaaaagcagagguacugcgagaacgucaagaaaccgcccgaaagaugcgcaaauauuauuugauuugccuccaacagauuuugcaggaugauggaaaagaagggugaguucagucugaacaauguguccugagauuaccaggacaacauguuaucauuuuuaaagcauuuuccuuaaccacuaaauuaacuauuucuacaugaucagccauaggggguuaagagagguuuauggcugugcuacccuaaauguuggcagagccaauaggaaaacagaaaccauggggcuaaggcaacucauuuuuuccuuuaaacuauauuuuuaauauucuggaauuccccacagggcugagaaaaagauuaugaaugcugcuagcaaacuugcuacaauggcaaaauuacuggaaacaccuauuucuaguaagucccaaagcaaaacuacacagucagguaugucaaagugagucgccaaaugguuuuucuaucuuuucuucuuuagcuauuuaauauuuucaguaugaagaaggcagggaagguaaggagugagaguuaauuugugaaguuuuguauguuuuacuuaaacuagaaguuuacgcaaaaagaguacacaguuuccaauuuaaguaggcagacugagcaugcccaucaguuuccuauugcugcuuccaucccucgaaaugauagaaaagauuuuaaacagcaaauaaagaaugagaaaaagaagaaauuauaaguggguuuuaaaaaguugcagugggccaggcaucauggcucacaccuguaaucccagcacuuugggaggcugaggugggaggaucccuugaucccaggaauuugagguugcaguaagcuaugauugugccacuguacuccagccugggugacagagugaggcccugucucaaaaaaaaaaaaaaaaaguuugcaguggauagaccagaagcuacaagaaaucccugagagaaagaagacaguauaggauggaagauggaaaccucaguucaaaaccaccgggagaugacuauugcaauuaggagcaauaucaaaacuguuccacauaugagggugauauguuccaggagaaauagagggccuaggggauaugaaugggguaauuaguugguguucuaaaccaacagcaaccaggugggguuaauccucucuuuauuucuucuucuccccuccuuuccccaaccucaauauugagcugggcaacaacaacaggaacaaagaaucugggagcagggcagugcuccagguggcuagccauaucaagcaggaacugggagccgacuugccuugggaggcugagaugggaggaucacuugaguccgggaggucaaggcugcagugagcugugaucgcaccacugcacuccagccugggaaacagagcagacccugucucaaaaaaaaaaaaaaaaaaaaaaaaaaaaguaagaguaaccaacaaaaacauagaacguauaacuuuaaaacugguaaaggaaaaacuuggaaaaaaacauuuucaaucuaacaaaaucaggaaagaggaaaaaaaccuagagagcguggguaaguaggacauaauaguaguuugaaacaucaacaaucacacuaaauauaaguagguuaaacucauauaaguuauuaaaagaccacaacuuucaaauaggguuuuuaaaaauguggaaauuugcuauuuuuacaagaagaacaucuaaaauuaaaaaucaggggauggagaaugauauaccaagcaaaugcaguguugauauuagauaaauuauagagguaaauaaaagauuagauaaauuagaguuagcauuaaaagggacaaagcugauaguucauaaugauaauggaauagucucccaagaaacuguaauuguuuucuuucuguagaucauacagcuuuauauaaagcaagagcugauagaaauacaugaaaaagacugguaaauucccaaucacacugagagauuuuuaacauaucaguggggaaaugggguucuugaaccucuggaaaacuugaagcugagauuguucagggguccaugagucugauguugguaaacauuccucauguacaagccaaagauuauuuguauaaauuuuggaauggugaugugaaccuuagguaugaaaaggcaguaacauauaacaagaaaauaauuuucuagaucuggggcaacagugugcaaauaauguccccaguagagaagcaaauccuuuucauggacucuagggcuugcuacucugagauacaaugccucuaauuucaugcuauguggcugcuuugucuuugaucagauuuagugucuuagguaauuaaaucagaaagucuauuuagcuauucuagaaguguauguguagguauugggugggugggguucuuugagcgaacuugucagaaacuccauucuuaacaucagaaucagggcaggauugaaaacauuguggcuggaucuugaaauugcuauaacaucuauugcagaaaaugauaggucagauggauagcaauaauaauuauauaucagaucuuaguaacaaaauuaccaagcuuuaucuaguggauauauguaaaagaauauuuuuaaauguccagcauugauguauuuucuuuaagaauuauuacaguauauaagcauucuuugggaauacaguauaaaaacauaaauuuuuucuuauuuuuaauuuuuuuuauuuuuuuguucaaggaugaaucuucccuuuaaauauuaauuuucucuuaauuucguguuuccuugcacauaauagcacugccccuaacuucagagaugcugauugcaguuaaaaaaucaaaaagaaaugaugugaaucagaaaauaccauguuguauugaaagcaaaucaaauaguguaaacaccaucaccagaacucugugcgaacaagcucccaagaggagggcagcuuguaacuuacaaaggcuguuagagaacucagagcaucagagcauaaagcaugugggauccaaagagacacauuuggaauuccaguuuggggaugguaguugcaagcaccuaaacaguuugccaaggaauguuucuccugaguuuguuccuugugaaggugaaggaggcuuugguuugcacaagaagaaagaccuacucagugauaaugguucugaaucacuuccgcauucagcugcauaccccuuucuuggaaccuuaggaaauaaacccucaccuagauguaccccugguccuucugaaucaggaugcaugcauauaaccuuucgcgauucuaaugaaagacuugguuuaaaaguauauaaaugcaauccacuaauggaaagugaaaaugcugcaucugagaaaagucaagguuuggauguucaggaaccuccaguaaaagauggaggggaccuuagugacugcuugggcuggccuuccagcagugcaaccuuauccuuugacagucgugaagcaucauuuguacaugguaggccacaaggaacuuuggaaauaccaagugaaucuguuaaauccaaacaguuuucaccauccgguuaucuuucagauacagaggaaaguaauaugauuugucaaacaaugaaaugucagcguuaucaaacuccauaccugucagaagaaaccacguauuuggagccaggaaagaucagugugaauuguggacacccaucucgucauaaggcugauagauuaaagucagauuucaaaaaacugagcaguacauuaccaucuucagugugucagcagccuucaagaaaauuaauuguuccgcuaucuagccaacaagauaguggcuuugauagcccauuuguuaaucuagacuaauuaugguacaguauuuaagaagaaucauuaauauauuaacaaaaauggaagggaagaccucauacugaaaaaaauugugagcccugccucuuuugagauguuuuaauaacaucuguuauauaaguaaagcauucuucuaaaauugcuugagauauuuauguugccuuaauauuccaaaggccugaugguguauguauaaucugcuuuuguguggugcuuauuuuugguuucuaaaccaucuauuuuuauacuuauaaauugacucacucugcaguguuaacuuauuuaaauaaacuugcauauggucuguagaa

SEQ ID NO: 13377 - RNA, 16618 nt, Homo sapiens
gaaaagcaauccuagagaguagcuagucaaaccucuuuacuugauaaaugaaaaaacugaggccugagguuaagugacaugacugaagucacacagcuaauuggcaucacuaagcucucaccuaguacuugcaggaagagaguaccaucauagaccaguaguucugaguguggucccugagccagcagcaucagcagcaccugggaacuugcuggaccaacaaauucuuggacccugaaaaauucuagaccuacugaaucagaaacacagaggguaggcccagacaucuguguuuugacaagccaaagcccuccugguguuacugauguggacucaguuugacaaucacuggcuuaaagcagugcacaagcuuuacugugcaugagaaucacuuggggacaccagugcuuugagugcuuggagugcagugagugcuuggggcacacacacugcuuugaguagcaugucaaucuaaagcagugguucccagaugucccugcacauuagaaucaucuggggagccgucaaaaaucccaaagcccaggcccaugccauaccaauuagaucaaggauucugggagugagaaccaagcaucaguauuuuuuuaaggaccuccaagugauuccaguaugcagcaaagcucagggaucacuaguagagaacaaguggcuaguuuucagcuuuuggccaggugcaguggcucacaccuauaaucacagcauuuugggaagccaagacaggagaugcucuugagcacaggaguucacaaucagccuaggcaacacagagagacccugucucuacaaaaaaauuuuuaaaauuagccaggccaggcaugguggcucacgccuguaaucccaacacuuugggaggccaaggcaggaggaucaccugagcccaggaguuccagaccagccugggcaacacagggagacccugucucuguaaaaaguuauaaaaauuagccaggcauaguggugugcacucauagucccagcuacucgugggacugagguggaaagacagcuugagccucagaggcugaggcugcagugaacuguguucacaccacugcacucacagaaugagaccccaucucaaaaauaaauagcuacuugggaggcugaagcaggaggauugcucaagcccaggaaguugaggcugcaguaagacaugauugugccucugcacuccagccugggaaagagagaaagcacuagucucaaaaaaaaaaaaaaaaaaaaaaaaaaaaaaaaaaaaaaaaaagcuuuaaacucuuaacaaagauucuuuucucgaccaaacucuagcuaagcuccuccgagcccccuucucaacuaggccucaaccuuugccuauaaagacuugaacaaacacuaacacaguuucucacagcucaaggccacaucccuaaguugauccuagcucaccuuaaagugccugcuuaagaaaacucaaagcugccgaaagaauuaacuguuuguuccagcgaaccccugaacacagggcccugacucccagucucugugggaggguaagagucuuacuucaaaaagcaccaguuagcaaacccagagggguuucacaucaaccacuuuccgcuuuuuguaauuuuucacauuccugacucuucuaagucuaggcuggccuucucccuauucucccauucacgcugugaaaugccuagucaccuuugcacaaauccaaguugaguucaguucacaugggacccuuuucccuauugugauaguauauuacuguuuaacaucuauccuuaaaguucuaacuaaugcccagcuuuguuugucuuuaauacucuuuacauaacccauuucagagucacaaccuaucaaaguaccaucugaaauggaaauaaaauuauguguuuggccucugaacuaauuaugggcaagccacuugugagcauagcuuuuauuugacuaccggguccaggaaaauaaggggaaaaugcacaaguuccaaaccuagaaaggaaacauuuaaauguacuggaggaccagagcagccugcugggcugugagcuccuguucagguccaaccuugagcaguacugcaugguggaaacagccugggcuucacuggaagccaggagaccuggguuugccuauuuaaagcugugugaccuaaacguugguuuccucauuuaugaaccaugagccacagugccugacucauaauugaugcuucaaaaaaaguacauauguuuaagcucccagacugguuaaucaauguuucagcagccaauuaagugacacaggguauguuuuguuucagggacaagcauaauuuauuucuguguuauauaucaugucacaagcugaaccacagaagcugccugucuacccucggcccuuucucacugaccagacugcugaacccaucuggaucaugcuggcuuaaacucuucguuuguauccuauugugggucaugaaccccuaugagaauuugauuaaaauuaugaacucgccccaagaaaaaugcauguacacauaagcacacaaaguuggcauacaauugugagggguucacagagucccugaaguauauccucagacucuggcugaaggcccugugucuaaaccauggccugcagagggcaacagggcagcuggaguccacauugagagcugcauucaggaaagcuggggacgcuguagaauuugaugaguuuuuugaaggcacuuuucuucagcaucaucaugucuucuggaaaccuggaaaagauucugacccuggaggagcccccauucuucacagaggccucugugggcaguggcuucugagcacucacuggcacacuguugcaacugagggagcgcaccgucuucuucuuagucugcacagacaaguaacugaacaggaaggaggacagcuugugcuugguggcaucuggggccucuucugaaaagcagucaucaacuggguccagcaggguuucaagauggaggccauuuucccuuuucaugggaccggcucccacacgcugaggcugcuugaugaucuuccuggccuggacuggaucaucuccugccccacugacagacugaagggacguuccacaggcccaggcucuggcaccccugauuugggagaugagguucccaacccgagggcuggguugggaaguacagugcugacucaggaugagaguggcagcaucucgaaugagauuccagucucucaggaugucaucccuagugguaaacugggaugucacagugaaacggaugauuaacuuguccuggauaguggccgggaugaggaagagacggccagcuuuagcuauuuccuuuaacacauuuucugugagacaauuaggacccuguuugaaaaauaaaggaagugaagucuccaucgcacccccugucagcauccccagagcccagcauuuguguuuccgagaggcucuggagcaccacaagacaucauucacagaggggcuuggaagaugguauuaccuuuagacgaaaaaccaccaggccaaggugccucuuggcaggaauuucaaaggaagggucguuucugaccagagauucaaaauauuuagccauuucaguacccuggaauugcaaguauaaagagaacugagauuaaucaucagacaagagacuaugcauaaacuuucagacugcuaaaugguuuuaaaccagggccaucuucccgucacagccguuguaagcggcuucugccucauugucaucuccauuugauuuugcucauauuccaagcuggaaaauuuccaauggcgcccuguuuccugucacaugggauccaccucgagaacucaucucagggcccucuuucaacucagccccagaacccagaaggcaugugcuuugcaguccaggcaacccggccucaacuccugauuucacagcuccuugacuggccaagugggcaagugagggccaaaacccaguccaugcucugcguucccagccaggugccucaugcgagcugcgugugccuaaaggaagagaugccuguuuguagugcacaucaaguugccauaugggcuaguggcggcccugccccauccuaagccuacaugcuucacuugccucucaaaccucuucucacccuguaccccaaaugcccuuuucauccccuguuucugacauuccauagagaacauauuuucacaucuugucuccacccaucauggaaagguuuuggaccugguuaauggauacagaguuucugcucgggaugaugaaaaaauucuggaaauaauggugauggucacaccacauugugaguauucuuaaugccacugaauuguacacuuaaaaaugaguaaaaugguacauucuaugguaugaauauuuuguuacaauuuuaaaauguuaaaggcuuuguauuauauuaaucuuccacugaaguucauaccaucuuuuuaaauguccugggguuuuuugcuuuuuguuuuuaacccaggauuacuaacuaaacaaggacaggacuugccuucucuuuucuuuuuaaaaauuucuccaagcauccagaagaucucaauaaaauauuugcuaaguaauucuaucaguuaguucucauacuuacugcucuauuucaagagagggcaagggaguuagcugaaccucuuuuuuuuuuuuuuuuuuuuuuuuuugagagauagggucuugcuuugucacacaggcuagaguacagaggcauguugcacaaucaaagcucacugcagccuugaacuccugagcucaaguaauccucccaccuucaccuccugaguagcuaggacuacagacaugcaccaccaugcccagcuacauuuuuuaauuuuuuuguaaagacaguggucucacuagguuguucacccugguaucaaacuccugggcuuaagcgauccuccuuccuaggccucccaaaguacugggauuacuggcaugagccaccaugucuggcccugagccugucuuuugaccauaaugaaaugaguuucuccaaaucuuucucagagccccuuucuccccugcguggucaguuucaaacagcacaggaguuuugaccugcuccauuucuaaccugggccccuucaccccuccuuaggcaaccuggugaucccuugcuccugggaggucaccauauugaugccgaacuuagugcggacacucaauuggcauagcacaccauagcccagaacucccaccugggcuauggugggagcaauugagcuucccaccucagccucccaaguagcugggacuacagacacgugccccugugcccagcucaaucuuuccauuuuuuagaaggaaccaagggaaagugacuuucccaagguacaagugacaguagguagaucuccucccacugugcuuuuaucccuccuacaacacaugcuguuugcaauaacagaagcagaggucaggggagaggagaauacagagcacaggcagcacugccaccuccaaagccccacuuuacaggucaugaaagcagagcugcugccagugcccugcaccgcucuaggucaagggcaggcacagugcagccauggccaaauauagcccccaccuguguuuguaaaguuuuuuggaacacagcauucccauuuguuuacauauugucuacgguagcucuuguaguacagagguaauuacaauagaguauggcccacaaagccaaaaguauuuaguaucuggcuuuuuacaggaaauguuuaccaaucccuauuguaggugauaggagaugaggaugaugaugaugaugauggugaugaugaugacaauuuauuauaauuagaugaagaaggagaugaugaagaaggggaagaagagaagaggaagagguacucauugaguacuuaacugaguaguagguagacccugugcuaagggcugcauauauauuaucucauuuaauuugagagagguaguauccuuuucucauuuuuauaaauuaggaaggcauggccaggggugguggcucaugccuguaauccucgcacuuugggaggccaagguaggcagauugcuugagcccaggagcgugagaacaaccugggcaacaugacaaaaccccaucucuacaaaaaauacaaaaaguagccaggcaugaugguaugcgccuguagucccagcuacucaggaggcugaggugggaggaucaccugagccuggggaggucaaggcugcagugagcucugauggcacuaccgcacuucagccugagcaacagagaccucaucucaaaaauaaauaacaauaaauaaauaaggcagacaaauauagaaagguuaaguaauuugucuaaggucaucaaacaguaaaggguagaacuaaaaauccauucuuuaaagcacuucucuguaacacagaaauaugaaauuuaauuuuauauaacuuuccaagagcucaguguaguagaaagcagcccagaacuaugaagaaaggauuuggaauugggaggcuucagggaaagucccgggccuucuucccucaagcagggcaauuacucccucugagccuugccagguuagagugaccaccccaggcacugugcuaaggaucuaaugaagaacuagaauuuauuuuuguauugaaggcauuacgcaagugucaauaauuaucaucaccgucaaguugaagagauaaaaucaaaucauaucaaacaacuuuauuuuaauuccauuucuucuauugugggacauuggaagaacuuugagcacaguuuuguaaagguguuugaguaggugaucacaggaaugcuaaugaagcagaaaccagaacagauggaauaggcagaaaagcuucuaguggaagcagaauuuaauccauucacaacauuuggagaggagaggguaguucaggugaaggacacgggugaaggugcagagauggacugagcaugaggucuggaugggucgaugaaaugcccaagcuaagguaggagcuaaucgucaaguccuugaaagccaggcccaggagugugggccucauaugguaggcaaugggguugcuaauaggaggaauucagggguuugauuugcaaacagaagugcuaagggagguuagucaggaucugcacauugaauauccagucccaaacuguaagcaaaaaaauguuccuaauuacuuguaaccuccaccaaccauuccccgcccacaacccuccagucuugagucugcauuucuagaaacagcacaaagugccuaaaguuccucaauauuguugguggcagcugcucauugguaaacaaccaguggugauuacaaagguaaaauuaccaacauuaaaaccagucauaggaaacuggagaacauuauguuaagcaaaauaagccaggcacagaaggacaaauuucacauguucucacucaaacgugggaguuaaaaaguaagcaaacugagcucguggagacgcacaguagaaugaugguuggcagaggcugggaaggguagcagggaaugggggauaaagaggugauaguuaacgggcgcaaaaauacaauuaaauagaucuaauguuaggcggcacaauaaggcaacuauaguuaacuauaauuugcuguacauuucaaacuaacuuaaagaauggaacuagaauguuucuaacacaaagaaaugauaaaugguugagugguggauacccaguuacccuaauuugaucauugcacauuguaugccuguaucaaaaccucacacauaccccauaaauauauacguaauuauuauguaagcauaauaauuauuuuuuuuaaauguuaaaaaaaaucauaguuaccgcuuccaccacuucauuuugguuuguguuuguuuaaccaagaaggaauucccuagaggaaagguggaaggacaaagacacacauaggcagaaaggacagugucuucagcuucccccacuacuuuuaucaauggcuuugucuugcauguggacucuuguagaagugggagaacaaugccaguggccagaguucuuaguuaagucccgcuucuuccaugaagaacaugggagagaggcugcaccugucucauuuaccucugugucccuuucuuagcacaauaccuuguaauuguugaauugaauagaaauaaauuaagcaaaauaggccuucaauaaaugccuguugaugcagggagguuuguuccagacuugguaggucuaccuguccaagccaggggagcuuuauuucaggcauaaucauaauagugcuaaaauauucagccagcugugaccauugagguaauuccaaagcagauaggauccuacccuggccacacacacuuccccuugauuuacuuucucuuucucuuuccugcaaaccagacucuggggccaacccuccccagugcucagugacagcaaggggaacggugagacacucagcagaggacaggcaucaggcagcccucagggcauguugugcucagcgcuccucugguuaacaaagagaaucaagucccaggagcugaggaacaggcccagacaccugaaccacacaccgcaagucuccuaggcagaucugcaaaguagaaaccagccuuccucgccaugagaaaacagaggaacacaggcucagcccccacagcagcaugcuacauacaugucugacaugugcuugaagauucuucaccccgaaggaccgaaucacgaaccagaguuuaacagagcgaaaccgucggcucagggggaucugccagugcuagaaacaaaggaacacagugcccaagguuagagacaagggugccccacucccucgggcauuucugggcauuaucuguugccugcccagcccuccagggauggacgaugucaccaugacucugggagcuguugcuaaggaguaagccaagcuccccaaggguugccccaucgugugaccaaaucacugaugaagguggccaauagucacuugucugagagccagacaaguggaagucaaguccauuacccugaaccaaugagaagggcacuuugcuuucaagugcugcuuuaaacauuucaucccggcccagaaacucaacauaagggaaauacauuuuuacucuaaaugaaucuuuauuccuugaauagcagaaaauaaaguucuauuuuuauuccucccaaaauguaaaguaugguaguuagagcacagacacuagagcccugcagaccuagguuucgccuccagcugugccacuuacuagcugugugaccuuggguagugccaccucacuggcucaucaguccgggacauaaagaaccaauugcaccucccgggcaaguggugugaggacaaagaacgccaagagccucagaagaaguugucaguagguguuggcuauuuagauuauuuuaaaaugugagcuacaaaucacaguagcauuucugucuagagccaagaugaccccuauuuaaccuuacacugccuuguucauuuuccugugagauuccugugaucugagagccaucacuccagcugucagauuucaaaugagcacccaaauuucugccgcuguuagaugaaaauugacucuuugcuccugguggccaaauucaacagagcuuaaaguucaagguugcagucaccauacaucugaaaauuuccaaaucaauuucagacugauuucucagaucugaaaauagagcagaggauuuggaaaacauuuacaguuauucuaaugagucacgugguuuccuaaugacaucucccucaaacgucagaaaguuucuaccacaauuucuguugacuaaaaauaaauguuugucccacugcguauuuaucugcccauacacaagauuaucaaauccucacaaauguccucaccuucacccuucaccccaguuuccugagccaggcacaguugggauguuaccccuuuguugauggacaauguuuccccagcagaaaacuacuaagccuuugauuuccaagcaaaacucuguugugcuggggagcagcuugggggcuuuugugccagcagaaggcaucaaaaccugaaaauggaacaaaauugcuguaacaaggaaagugucaacuccaccucuuguccaauggacacuccaagagaauaaugaacggaugauagggaucaucugucaaaagguucugguuuccagauaguuauagccaauuuauuucauauauagagagagcuacuuuauuuuaccagcaaauaaaccaggauaggcagaggugauuuuauuuugauuucuucacaaucuuccuuauucccaguugcuccuuuucuugucacuauuccaaaacugauccaugcugacucagcagagugguucuagccaacauuuucuguuggaucaaaaaaucuggacguauaaagccugacagggcucuucuuuaccuugaggcaucuccagccuccucuguguccuuguaagguccuugcagggcucccuugccaaggcuaagguaacgcucccuccacuggugcucucuguccagugagaggcagaaaacagggagcuucuccgcugucagagaaucuagcccugauuuuaggugauuccaggaccccagggguuaagcaccuaagucuucucuccugggaugcugcccuguuucuggcucaucucagagcaggacugagcuucuguucaaagcugcagccaccugggugggaaagacauugggcccaggugagaguagcucugaggacccucaggaucaugaaaaagauagcaacuucacuuuucuaggaguuucuucauggacuugaaaaucaaauccauaggauuaaaggugggggaaggguaaguguaaggcagugccuucuggguggagagguaaaaauaauaagguuccccagagcagggcugggaagaguuuacucuaacauuuuuaugaguuaucuggaagacagagagcacuguaaaaucuccaaacuccuaggaaugaaccccgggaagauccugaggcacugugguaaaugaauuuaaacgguaacaugaaauucaaaagggcaagggugaauauaaugcuccucaguuaugaugacccaaauacacucauaggagaaugggcaucaauucacacucaggaagcaaaccuacaguuaucccuaaagauaucugacccuugggcuguucuggaauuuuuuuaauuuuucauuaaaaaucucugaaaaccuaccagaaagagcaguggagauaaagaaccauuauuuuucuuucuuucuuuaccucuagagggucuucugucaccaccaguaagccgugaggcuuaccgcugcaauucuaauccaaaagcuucaaauaucuaaagaggguguggacugguccaagggagaauagccaguauaaucaagugaugacgaagcuauuauuuuaagacuaaaagggcaagacacuucaguuguccaagaagauaagauaaaaccaucucuucacaaggaaggaugcuuacaggggucagacacugcucucagcacuucaguguauuaauuuguauaauccucacagcaagccuaagaagccagaacuguggucaucagccucauuugacacaagaggaaaucuggacacagaguuuaagucacuugcccgaggucacacaaguuaguaaacagaaagccaggacuccaacacaugccaucuggcuuuagcaccuacaugccuaaccacuguccuaacaaaucucugcagcuucaaagaagagcuuucagaaauacuaugccuaccauauauugagcacuugccacacggcuauuuugcuaggugauccacacguguucccauuuaagcuucacaauacccuaugaaucaaugccacuauucucauuuuacagauaaggaaagcaaggcucagagagguccaguuaguuucccaaagggccacugcuggaauggaauuccaaaccaagcuugcccccacucugcucugcugccuccguuggccagguuauguguaauacauucguuuacaucccugucuccccuacaaguaaaggaagggcucauccucaaacugcggagucaauuuguuaagaacucguuucccucaggcaaaauacuggcugaggauguggaaucaagagaguugagguuugcugggcgcgguggcucacgccuguagucccagauacuuggaaagcugaggcaggagaaucgcuugaaccuggaaggcggagguugcagugagccaagauggcgccacugcucuccagccugguugacagagcgagacucugucucagaaaaaaaaaaagaaagaaagaaagaaagaaaacaaaagaaaagagagagagagugaguuagagaguugaggcgcagucaguugggaaagucaggaaugcuuggaggcuuccagaaccucacacaaguccugcagcccaucacuaccacagagcugccccacagcgccucugucagggacaaaaaaacaaaagcgauuucagcaagaaagcucuuuccccaccagggaaauucuccacccugcccugcugcuggguaagaaacaaaaaagaugacccgagauggaggcagaaggaacugguccaccugugguaggaagagcauuucugggaauuaaaaaaugccacaaauauucaggaaaugugcacacugccucaaaggcuggucucauuuucuaggguuuuuaaccauuuucuggguuucauucuauauacuuaggcacaauuagaaaccaagguaugcauuggcaguauuaugagaugagcucauagugugcugccuucugaagggagccaccguacagauuuuggggggucagacgccuacaguucccacuggccacccgagcccaccaggcugcccgucccuggccacucaccaugaagucgguggccacgccugaguuggcaugccugagguagaugggauucacacugaaggucugcugcagcuuguacuuguccuugacccuguggguuuccaaaugggcauuaguggcugaggucucuccagaggaggcaaggcguuccugcgugcucggagcugggcugcuacacucaccagaacccaguacagucaaaaugcaccaucauccacuuggaaggauuaaaggugaaggagucggcauacucaauccccuucagaaacccccggaacucggggcacaggaaggcagugccugcauaagcagcaucgauguggagccacagccccucacgggcaccugaggaggcaaacaucaccuggccggaggggagguaugaaguggggaaagaugucucgcaccuggccaagcugaguggugggcugcaaggaugaugugcuuuggcuaaaugagaaacggagggguguggagaugggagcagguggagucaguuugaagaaguggggcugaaggaggcaucauuaccuccgaaugggaaagucuacaaagccucacccuugccuuuuucuuccacuggguaaagggccagcacccucuuggccucagccuagaacauccuggcacagaaaucaauuucccaccagcacagagagcaaugucagugcaccgaauacaaaaguuagagggaagguaucucucuuuccuagugguuucuugcuuggggauuaaacagucccaucuggguuuccucucugccuuuaaucucucccaugauuuccccuacccuacccuuuuccuuuucugaagguagaauagaaagcauuucuauucuagccuaauucacacuguauuuuggauauagccugcauuaaguaaaguucaacauacaaguaagaggaugagaaaaccgaaggcucuccuacugucgccuccuaggacaggaggcaagguaggccaccucuaacucuugucacaccacugggaaaggcaauguccagggaucccuggaagagacccucaugaccuuuggugguucuucccaugucucugcauugaccaaagaggaacaagaauaaucccauagagcugguuucagguccuugcuuuaggagacauuuaaaaauguauuccuugucuuccuagccacagagggaagauacuuacagauggggcccagcucugacaggcagucaaaugcacagaccccaguggucccuaguguugcacagaccuaggggaaaauuaaggcaaguuaacacaggagggugggcucgugugacacauuuggccugagaaagauuucaccacagacgugaucuacucccauccaucccaccagaacaguguauauuucagacuguguuuuaccauggcucguaagaaacacauuuuauauaacaaucuaguacauguauacguguguauuugaaaaaaaaguuucauaaaacaauacauacucuggcuauaugugugcacucuaauauuuuauacuauauuucuuuuuaaugcugguuaugacccacaaaauuuauuccauaacacaccuauggauagcaccucaugauguguaaaauacuguaugggaggaccuuucugcuuuugugugcagcauguuacuuaccugaauucugccaaaauuccuuccucacauccaaguucuaucauucuaagcuuaggcauauauccugacuuacaaagacgggcaccaagccccgcugcuugucuuccucgauggccuucugaagagcuuccccucggagugagaaguugucauccacaggcagaaauuucaucuucacaagggaaaucaaaccagccuuuuccacagaggagugagccuagaagggccacagaaaccugucagcaaagagucauccuggaaugaucaccccccagaaacugcugaagccuaagacucgggaaccaaauaugaucauuggaagcuugucuucccuacaguugcuggagacaagcucccaugucugagcugcucagaaccccagcguacucacgucuagaaaaaaauugcucaaggaccaagauuccagaagccaagcaccaacccgaagggcuguccugcgucgggcaacucaccuggucagaggcauaggccacgagucgggcauuuaggcaggacucaucagcaucgggcucagacguuuucauuuccaggauuuuguucuuccuugcugccagcagggcaaucaaaguggauucacugaccgugcucugcaggggaaaaggauuaucauggcagccuuucuguauucucuugccaaauuuccccaggcuuucuaguuuuuucucucucucucucucucucucucucucucucucucucuguguguguauguguuuguguaugugugugucauagcuauucacagaaggaaauacacagcuccuccugcccagggugcccaugucccuccccaacuuucauuccuauucugccuucuaaaauaaguuugcaccuaauaccagccucucuauuacagaggccacagaaaccaaaaagagaauguucugucccuccuggauguguuugcuccccauguaaaacauauuuaaaagaagaacucucagcuuauuacacaaauggauauggaguuugaguccccaggaagagaggauccuggccugugugagaggcuggugacuugggcccauuuaguugucaauagcucuugugaccuugggcuaacauuuccccuccagaagacucuuuucugucuaugaaauggagagcaucccuuuaacugcuucccaggaugggaguauagauuauccaaacaaggguuggguaggauuuugcucuggccaugauuguggaaaucuucggggccaccucaggaacuucacaggagucuuuaugguuccuuaucauucauucacccagucuuugaugucuuugcuucuugaaaucuucaagugaccuacagcugauagaauccugcuaaaaaugccuggcagacacugucauggagagugguguggaccagaucccacagauauuaagugccugggaguuacuccauaaaaagaaagcuauuuauguaaagaaguauguagcauaauaauaauaauaaucagcugggugcaguggcucgcaccuguaaucccagcacuuugggaggaucccuugaguccaggaguuugagaccagccuggacaacauagugagacccugucucuacaaaaaaaacaaaaaacaaaaagccagguguaguggugcacaccuguagucccagcuacgugggaggcugagguuggaggauugcuugggcccaggagauggaggcugcagugagccaugauggcuccacugcacuccagccugggagacagaaccaggcccuguuuuuaaaaauaauaauaaugguaacaacaccuuccaucuguauugcaauucauaguuuacaaaacacuuucuggcauucuacuugcuccucacaacaccucuuugagauaauuaugauucuugucacacuaagaugaggagagugaugcucagagaggugaugggacuaacucaaguucacauggcugacgauacaggagaaagcaugguuuggauuuagacaggcaucaguuugaauccucguucuuccgcuuaucagcuguguaagcuagggcaaauuauuuaaucucucugaacuucagugcucuuaucucaaaacauuggggaaugguacuauucaccugcaggguuccugagauaaucagaugaaaagcaagaucauguaccgcagacauuuagcauguucucccaaauaugauaucugaaguuguaacuauuugcugacaauccaaaauguccacaacaugcugcaauuugucuuuc

SEQ ID NO: 13378 - RNA, 9335 nt, Homo sapiens
ugcuuucccugccgaggugaggggagcgacuacaacucccagaggguauggcggccgcagcagugggcaguugaguuuccggggcgacccagguccuccggcggaagcgggagccucugucggccgcggaagccuggagugggcgguacgcagacgcgcgcggugagacccgcugucugcucagcggacucugcccgcccccaccucccccugcgucgggccgacaugaaggacucgcuggugcugcugggccgugucccggcgcacccggacucccgcugcugguuccuggccuggaaccccgcggggacccugcuggccucgugcggcggcgaccggagaauccgcaucuggggcacggaggguaaggcccagccugguugcgcggcccucagcgcugagggcucagccugcgcguagugcaggcgcucagccugcaggggaggcugaaccuguuccuggcggagggagagugggauguuagccacgccgagaagggcuuuacaggcaaagaagucugcgacuguugggaggaaaaacgucagcagacaagcugaaaugucaagggaauuguguuagcugcagaggcaggaaaaugggaaaagagagguguuaggaaaguggccuucagaguaacuugcgacuggauggucacauuuuaucccgagggcauuggggaaccaauagcaauuuuagaucagauuuguuuuagaaagaugccuccagagguugggcgcgguggcucacgccuguaauccuagcaguuugggaagcagaggcggguagaucaccugaggucaagaggucaagaccagccuggccaacauggugaaaccccgucucuacuaaaacuacaaaauuagcugggcguuguggcgggcaccuguaaucccagcuacucgggaggcugaggcaggagaaucccuugaacccaggaggcgaagauugcagugagccgagauugugccauugcaccccagccugggcaucagagcaaaaacuccgucucaaaaaaaaaaaaaaaaaaaaaaaaaagcuuccagacgaaguagauucauuugcaucuuuguaaaagcugugaaauacacucccugagcuuucccccacuagcuugauuccagugcuagccccugauauugaauggcuucauggugcugcacccagcuccagagccuggccugcgcuccgccuuuaggugacagcuggaucugcaagucuguccuuucugaaggccaccagcgcaccgugcggaagguagccuggucccccugcgguaauuaccuggccucugccagcuuugaugcuaccacuugcauuuggaagaagaaccaggaugacuuugagguacccaggcugguugggaccagaauuauugccuguuuccuccccagggcugguucaggaaccugagccaaccugcgccaguugggcuguacccaugggaaggggcuuagggguguuagcugcuguuaauucucauuuucuuuccccuuucacaguguguaaccacucucgagggccaugaaaaugaggucaagucaguggcuugggccccaucuggcaaccuccuggccacuugcagccgagauaagagcguuugggucugggaaggugaggccaggucccuccagguggauugggaaccaccugacagcccccucugugucccugacagggucggcucuuggguccccuuuuucucucccacaguugaugaagaggaugaguaugaaugugucaguguucucaacucccacacacaggaugucaagcaugugguuuggcacccaagucaggagguaagagucaagcagggacucuugugggaagggcucuggugugcaggcuugugcccagccuuccucugcuuuucagccuuaaucuagcuuuuacggagaguuccaucugugaacaaaaaacauuagucccuuuauaaaaacagauccggcugggugugguggcucacaccuauaaucucagcacuuugggaggccaugguggguggaucaucugaggucaggaguucgagaccagccuggccaacauggugaaacuccgucucuacuaaaaauacaaaauuagcgggcaugguggcacaugccuguaaucccagcuauucgggaggcugaggcaggagaaucacuugaacccaggagacggggguuacggugagccgagaucgugcuauugcacuccagccugggcaacaacagcaaacuucaucucaaauaaauaauaaaauaaaauaaaagcagauaccuggaacugaccuguccuuugcuuccugggccacacagacacauguuggguuuccuuucacucuucccccagcucuuagcuucugccagcuaugaugacacagugaagcuguaccgggaggaagaggaugacuggguaugcugugccacccuugagggccaugaauccacuguguggagcuuggccuuugacccgaguggccagcgccuggcgucuuguagugaugaccguacugugcguaucuggcgucaguaucuaccaggcaaugaacaaggugagguccauuaguagagcuaaagaagacccaucucucaagggguucacagucugcuaagacacguacaugagucagagcaaauggggguaaaagguaagaugugcuacaagagggcucuggauagagugcuggaagaaucaggaaaguuuuguagaauggguuguuucaucugaauuuaaaaggguauguaggauuuuaacaugagaauuucacgugagaauucaagugaaaacucaacagugugaguaaagauaacaauggcgggaaugcuuagacugaggggugguaaugcauuuaaauggggcauaggacgucugggguuuggagaggaauaaaguggguugggucggcugguggguggccuucacaggcacgcaaaguaguuacauacagucugcaacagaacagggauguuuccucggaauucugcuugagaaacgccagucuggcuauaguguguaaggcagauaagcagggauggggacacgaacggagacacagacucauaaucaguugaagaugagggugagggaagguaaguuagguucuccuuugaggugcccaggacauaggaacguuuaagggcaagagaagucugucuugcagggguggcaugcagcggcucugaccccaguuggaaauguaucuguacuuuguccggcuuccacucaaggaccauuuaugacauugcuugguaagacuccauccccccaccccaucccauccccauaaaucagggauuuuagagaaggcauacccuaugcaguccucugcaacccugggggagugcuugggaauugagggcagccacccccauuccuuaucaggccugacucuaccaugcugguuuacagcuggcugggcuggcauucacaggagcagagaacagucccaggcugugaggguagcaccagcgcuagagguucgcacagcucgugcuguccagaaguuauuauugaaucugcauucguggcugaggguuuuuuuuuguuuuuuuguuuuuugagacagagucucacucugcagcccaggcuggagugcgguggcgugaucucaucucacugcaagcuccgucucccggguucacaccauucuccugccucagccucccaaguagcugggauuacaggcgcccgccaccaugccuggcuaauuuuuuauuuuuaguagagacgggguuucaccgcguuagccaggauggucucgaucuccugaccucaugauccgcccaccuuggccucccaaagugcugggauuacaggcaugagccaccgcaccuggcaguggcugggguuuuuauagguaacacugacucuggccuuguggaagcuggaaaagcugcaccauucauauaggagaguagguuagaggguaguucuggcccugagaauugaucccuaggaaauccaaaacagugaaaaaaacugagcacuuaagcuugcuuuauauuagcaaacauuugggaaucaccuauucaacaaaagugaacuuaaguaaauuaugguagaacucagcuuguuguaucacuguuuaaagaaagggguuaagaauacuuuaugauggggccaggcgcuguggcucacgccuguaaucccaacacuuugggaggccaaggugagugaaucaugaggucaggaguucaagaccagccugaccaacauggugaaaccccgucucuacuaaaaauacaaaaauuagcugggcguguuggcacgcacccaaucccagcuacucagaggcugaggcaggagaaucgcuugaacccgggaggcggagguugcagugagccgagauugcgccacugcacuccagccuggugauggagcaagacuccaucuaaagaaaaaaaaaaaaaacuuuaugauggcugggcccaguggcucauggccuguaaucccagcacuuugggaggcugaggcagguggaucacuugaggucuggaguuugagaccagccuguccaaugugauaaaacccugucucuacugaaaauacaaaaauuagccgggcaugguggcacaugccuguagucccagcuacucaggaggcugaggcaggagaaucgcuugaaccugggagggggagguugcagucagccaagauugugccacugcacuccagccugggcgacacagcaagacuccaucucaaaaaaaaaaaaaaaaaaacaacuuuaugacaugggaaacugcuuaugccaagugaggaaagugcaguucauaauugcaugucguuuuuuaggauaaucauaguaggggaaagaacuagauugcagcaucugaagauauaagugggugauauuugugacuccuuauuaguuaaggaaacauuuuaauaagagguuuuuagcugaggccugaaguuagggaagagaacaggccaggaacuauggaacaggucucucuggccuaauuagucagguauacccacugaugucacuuuccuuccaggugucagcugacaggggcucuggccacagcuuguggggaugacgcgauccgcguguuucaggaggaucccaacucggauccacagcagcccaccuucucccugacagcccacuugcaucaggcccauucccaggaugucaacuguguggccuggaaccccaaggagccagggcuacuggccuccugcagugaugauggggagguggccuucuggaaguaucagcggccugaaggccucugagcuaccucgacuuuggacagaguaaugacuccccagaaaacgucauauaagacuuuaccagccccugagaggaccaggaggagcauccuugaccuucauuuaacuuggcucacuucucuucagacuuggguagaagugcagagccacagaauugcuuuccuuccccgccuuugacaugaggccuucaguaaagagcuacagaacaugaguacauuguuauaccacagauuuuucuugcauuagggcacaguguuaaauuuuuuggagguaaauauacuauuuauaaucacuauauauaguaggaggggguaugugucucaggcuuuucugaaguugcaagacuuaaagaaauaauccaucugcaucccaaguccuauuuuauaaggauauucauaaaaauuccauggugaauccuugucugaaauagguccucccuucccaguuucuguguaagucuuugcauuuaagacauccaaucaauaaugaaggaaauuuuuuucugaauguagguuugagugaggggcaccucugcuuucccuuagcaacccucauauaccucccugcaccguuacgcugugauggcaacuggggauagaaaaaaaauggggaaagacaggaauccuaaaagggagaguuauuacuggccacaagcccuguauucucaacagggaugcaaauugguucuucaguaaggauaaaaaaaaaucacaagcaguuguuuguggcccuccuaaggcccacagcacauauagugugucugugauauuccauuuucauggcagggagugaucaggaagaaggcuuccuaggggacuggcgauuuaaaccaguugagaaacacugccaucagcaggcaguuucagacucacucaaguugucucuugacagucacuucuaaauggguucuaaugugacaauggccuccaaaacuacagccuucccugaaguuuaagcugugaccuuagauuuuagaaggacaguggggcuguaccuagaauagugguucucgaagaaugcggccugcagauccugggagucccaagacccuuucagggaggaucugugaggucaacuguuggcacuguggcaugaaucaaggugguggcagcaaacuucuaguaguuuugauauguccuugauagaacaaauagcaaugguuaacuauuaaauguugaccuagccagcgcaguggcucaugccuguaaucccagcacuuugggaggcugaggcgggcggaucaccugaggucgggaguucgaggccagccugaccaacauggagaaaccccgucucuucuaaaaauacaaaauuagcugggcaugguggugcaugccuguaauuccagcuacucgggaggcugaggcaagagaaucgcuugaauccgguagguggagguugcagugagccgagaucauaccauugcacuccagcccaggcaacaagagugaaacccugucucaaaaagaaaaaaaaaguugaccuugagaauuuauaauauucugagaaaacuggaagcaugcauaaagccccucugcugugcacugaaguaugggugccuugaggaaaagcaguuacacaguugaguugcaagcugaauuggcuguguucaaggcaugcccuuuagaauugaaagaacuagcagauuacgguauuuagacuugaauauuuggcugauauuuucuggaaauuaauggaaugagccucucaccucaagggaaacaacugauaguguugccagugauaaagcuuucaagcaaaaauuggaauuuccgaaaaucuguacuccaccaugagcuuuauuguuggggauauuaacaaaugugauuuguauaaugaaaugcauuucauuuggaagaauucaaugaaccauuuuuccaagugaccaguacgugauguuacaaaaucaugcauggcucaaagauugauucaaaaguguaagacaggccaguggauuuuaauguauuaacaauauaagagugcauuaaguuuucggagucuacauugccuuuaagaaacuaugacuuguaguaagccgggcgcgguggcucacgccuguaaucccaacacuuugggaggccaagguggguggaucacaaggucaggaguucaagaccagccuggccaauauggugaaaguccgucucuacuaaaauuacaaaaauuagccgggcgugguggcagaucccuuguagucccagcuacucgggaggcugaggcaggagaauagcuugaacccgggagguggagguugcagugagucgagaucgugccacuggacuccagccugggugacagagcgagacuccauuucaaaaaaaaaaaaaaaaaaaaaaaaucacuuguagucuuggugugguaucaaagaauagccacaauuagcugaaaaggcuauuuuaaaaacuuuuccaacugcguaucugugugaagucaacuuacuucaacaaaaaaguuuggauguagaagcagcuguaagaauucaacuguuuauuauaacaagauacuaaagagacuguaaaaugccacccuucuccuuggauuguuuuggaaguuauucuucauaaaaaauguuaacgugggcugggcaugguggcucaugccuguaaucccagcacucugggaggcugaggugggcggaucacuugagcucaggaauucaaggucagccugggcaacauggcuaaacucugucucuauuaagaaaaaaaauguuaacauuaugauuuaaaagugcauuaaccuuaaucuagauaauaaaagcuuuuuggggcaaccuccagaacugugaaaaauaaauuuguuauuuaaaaagaaaaaaaaaaaaacaaaaaccugaguuucuuaguuuuuaguaguguaaagagguccuaagaccaaaucauuugaaaacugcuacccugaggaaacugcccuucagaaucaucuuucaauuuugugugcauuuaaucuaaagaacagaagguaagaauuugaagacagucggaagaucuggauuagaaaaccuguuuauuaagacugggucacauccagcuaguacauuucagugcccuuucuggugcugccucccaggagcagacacugcaaauuucagaacccccaucuagagaaaccccuaaccugugaucuagcuuccgaggcucaguguugguucuugugguagugcugauguguggguaccacugaggccaggccacagucgcauguacccuccucugggcugacucacgaggcuacaggggacagcacaccuaaugagcaggucuguccuccagacauacucauuaacaagcacguuccuggcuaaaaaauaaccagaucuuuuuggccgugcccucagguuggagaaagaaaacuuuuaauuuggaaucacuacaaagacaaaugguuucuacaaauuauuuuauuagaaugucagacucaaaagaacuaccaggaacaugccugaaaaugcuauauaugauuuaugcuugacccaugacaccugcugucacuggauccagagugagcaagggaaaggaaguggagguaggcggggacagcaccagcccuggcuggccagaccugaggcccacagaccugguccccacaaccaggauuccuacaauguacacauuccuaauucaggcucaacucuccuuuacccaaaaguaaaugccucaggacucaaucugaaucacugucugucucagcuucuuucacauccacgcugaauuuguacuccuggucacaucccauguaagcgucacucaugaaguacagaguguaguugugggcaccaguggcuggggccacaaaguccaacuucaccuagaaagagcaggcagaaaucaagaugagcauggacacaggaagcauucucacccuucccccaugccagaacaaaugcuagggccaguggacacacucaccuuggccuucugcugcaaggucagccucuugauggagaugaggcuauuggacuuggcaucuccaaucaccacccaccagcccucuucacguuucugcagugauccaaaaccaagaauuucagcauguaaaacuugaugaccauaggcaaccaugaaaaugguacaguuacaaaagagagaacaaaaaucagauagcuuuccaaa

SEQ ID NO: 13379 - RNA, 17263 nt, Homo sapiens
cggggagccggaggaggcggaggcagaggaggaggaagccggaagugcaucggccccgggucuguccgggcguugcgggauuggggccugggaacgcucggcccccggcagccgagaagcccgugacugggcugagcagcaccaucccagcccuggggccugcugacuggugaggaacagugggcggcguggggagggucuuuucugcgcacaggucgcaccccaaaccgccggucccagaucacggguccccgauccccgcggcccagcccgguccuccgccccucggcauccucuggcugagacccugacuccgggucuuugcucuagcaguagccgauccccgaucccuccgccccccacucgagucugcccagaccccaucuggccccuggcccucuucgguugucgucccgcagucccauuccggagucuccugucuccgccccccgaauucccgcagcccuccccgucuccgucagccccgggucccaccccccuauccucuggugucaacccugacagcccagucccggcuucaccugcagcgaacccggagcguugcuauccuccaccggacugucaggcucugcgcgccccgcggaggucggcggcgaccagcagcgacugcggagcgacggcgggcggccccgggcauguacgcccccggaggcgcagggcugcccggcgggcgccggcggaggagcccgggaggcagcgcucugcccaagcagccggagcguagccuggccucggcccugccuggcgcccugucuaucacggcgcugugcacugcccucgccgagcccgccugguugcacauccacggaggcaccuguucgcgccaggagcugggggucuccgacguguugggcuaugugcacccggaccugcugaaaggugagggugcugcgcgcuggcccuuaaagccucggugggggacagaauguguucuggcugaagcagagauagccagggaccagacacuugguugaaggaaacggccccauaacugccugguguucaugcccaccagguggcucuguuugggguccggccccucauuaauucugauguuauucagcuaagcaccuacuccucacagccauguuaauccggacugcugcuauuuuaggauucugcuggaggaaggacgcuguguaucgagaaaagauaagggugcuagguaucacaguuagcuggccucuucuaaggauccugugaaauacggaaaagcuucuuuggggcagacugauuaauggagaaaaaggaacuuuuaauaugacuagguuuuaaaagauaucuuagaguucuaugguaaucggaugcguauuagagaagaagggaaucuguggcauuuuagguaaucggaagaccguuccauugccacccgcaguacaacagucggaauguggcucuuggaaccauuauaggugugccugacagaggcaagguugcuuuguucaucaucaugcuuuccggccagauagacagcagacgaugggaggguccuaugggccccauaguuuauccugcccauucuugucuccaguaaaaauugugaagugugaggacaggacuggacuguaucaccugcuuuuuacccuaacaaugaucaauguaccccaaacaguccuuaguaacagcauaguucaucaaccccaaggucuuuugagccaucuugaaggucuuauauccucucugugcuauccugucugugcuauucccuggcugugaugcauuccagauguuuacugcaccgccuaucagaagcacuuccuguuagauaucugcguguuaccuccugaagaauucaggcacugggauuuggugaaaagguccaaguuccccgcugugcaucggaccauacucugcuucugcaggucuaggcugaaaagccucauccuuguggccaaauguugccuuucucugaguguucucuuacuguuuugcaucucucuugaguuuuagaagcuguagggugauuuuguagaagguuggggacaacugguuguuuccagauuucaccuuaaugguacucuuugcuggguuggcucauuaaagccaaaguuaugcacacgacagaggccuuauaugcagccuuuucucugucauguugcuaauggcacaaagagcauuaagcuugagugagucuuggugguuuuucuuuuagcacauugcccuguacuugcuuucuuugaagcacacauaccaccuucccaccacuagacccaucagaucuagaaagcuagaucuccgaaaucuagcacugcauggggugugcuuagcuguggcucagaaaaaugaaggaucuccccaaggcuacccaguuuaggguggcagagcugggacuaccccaccucuguugaugccaauauaaaaugaugccgugucauuuauaguuuuuauccuuuguuuuacuucagcugucauaaggagcaaucucauaauuauuucacuuuggugugcauccuugucgaaggcauguuaaaaauaaaaguaaauuuuugagccgggcgugguggcaggcaucuguaauuccagcuacuugggaggcugaagcaggagaaucgcuugaacuugggaggccgagguugcagugagcugagaucgcgccauugcgcuccagccugggcaacaagagcgaaacuccaucucaaaaaaaaaaaaaaaaaaagaaaggccaggaacuggcucacacuucugaucccagcacuuugggaggccgaggcggguggauugccugaggucaagaguuggagaccagcuuggcuaacauggugaaagaaacccugucucuacuaaaaauacaaaaauuagcugggugugguggcacacgccuguagucccagauacucugaaggcugaggcaggcgaaucgcuugaacccaggaaguagaggaguugcagugagcccaagaucacaccacugcacuccagccugggcaacagagcagagcaagacuccaucucaaaaaaaaaaaaaaaaguaaauucuuggugcagguucuucuuuguucacauguguauuuacccuuucuaagaaauuauucgggccaggccaggcauggaggcucacaccuguaaucccaguacuuugggaggccaaggcggauggaucaccugaggucaggaguucaagaucagccuggccaacauggugaaaccccaucucaacuaaaaauacaaaaauuagccaggccuaguggcuggugccucaacuacccaggaggcugaggcaggagaaucgcuugaaccugggaggugagguugcagugagcccagaucacacuacugcacuccagccugggcuacagagugagacuccaucucaaaaauuaaaaagaaagaaauuauucaggcuccguuuugucuuuugcaaagcauguuuucuuaaccuuuacauuacauuugcucacauauuuagagaccuuaaccuguguauaguuucuacuugcuugccuguggccaucuccuaagagcaguuugugcccauuaauaggagaguuggcaguggugccucaugagcuaucacagaagaaucaguaaggaauccggaaguccuugauugcaucuucucucccuuuucuuuguaccuacugguuuuuugguacccagugggccuucagacauguaguauccugugugacugugcugauccucagggccuaacagauauccugaccugagagccuggaguauuccacaucucaagagggagcagagcugucaagcacagauguggugcauauagaguuuuuuuuuuuuuuuuuuuaaaugagacagacucuugcucugucacccaggcuggagugcagcggcgccaucucagcucacugcaaccuccgccucccggguucaagcaauucuccugucucagccucacgaguaguuggaauuacaggugcuccaccaugcccagcuaauuuuuguacuuuucguagagaugagguuucaccuuguugaccaggcugaucucaaacuccugaccucaggugauccacccaccuuggcuuccuaaagugcugagauuacaggcaugagccaccgcuccuggccacauguagauacuuccagagggagaacagacccugccaggucucugccggugaugggaguugggcagccagcaggcccuggagcagccuuaccauuucucagccccugccugagugccacauuuugacauuaugcuaagcacaccccaugccugcuuuuuuccuccuaaacagcaucuuuauuugguagguacuguuucagccccacuucaaaaggucccagcucagggaagcuagguaguuugcucagcuaaucugaguggacauugacuccaaaguccauacucuuacugcaacaccuuagugagcuccgaguuuauuucccaucaaagcugccugaggcuuaucacuuuccuauucuaguugaguuuuaucauaagcccagccaaagcugugcuuuuugucauaacuucaucgccucaguguugaggcuuuaguuggugaucccagggcaaagccacucucccauugucauucacaaagcuucagaggcuuuagccaaugaaagcuggcuccaaagaacccauccugggcuggguguggugguucacuccuguaaucucagcacuuugggaggcugaagcaggaggccagcaggaucacuugaguccaggaguucaaggcugcagugaacuaucgucgugccucugcacuccagccugggugacagagugagacccuuccuuuaaaaaaaaaaaaaaaagaccucauccuggguuuucuccacugccccugcaagcggugccugcuucucacacagcucucaaccuggcccuggguggagauagacucacaccucuagaccccagaaagaggggccgcagauagucauuucuucugagccuuucugccucucaaguguggccaccaaagggcacuggcaacagccccaggaagcaucuuuggagaaugaggaaguuggggaguagaagucaggugaaucacaauugacagcagccacuggaagaucaagggccuuccagggagagccugugugccugauagguggugacuggggcagcugacacugccaggcccugcggggccuguuggugucugugggauaaccuggcugggcacuagagggcucuguuaagaggccugugucgcaggccugucuggaagcuaaaaaggucacagugaggagacgcugagcagguugcacagaugcauaaagagggauuggggcauuggggaagugucucuaauucagagggacuccagcaagaagggaggcggggugggacagaaguccuuuuaagccuuucugccugcagacuguuugggucaggagugguuagagcaaugggcagauagacaggaagaggcaggaccuucaaaacaaaucuagccuggugacucaccagugaccuugagcaaagucaguuccaugggauccuauuacagcugccuacuucccugaugacuagagggcaccgccaagcaguguuuaccaaaaucaacaggccagagcacagcuggaagguaggagguguucugugucuagccagggcaucguggacugcaccacuggcuugaauuucaaguuaggguccugcguugcaugccauuucucucucgaauaaaauccuacauacauaaccuucagggguuuucuuuagcaauccccucaugggagcaggugcuuguugccuucccugcuguaccgacgucuaggaagggaggagagaaagacauugagauacugacuccagaagagucucugagcugggcuccaagccugucuaggauaacugccuguucuuccggugugcucugagacccucugaggaaaacccaccuguuacauggggcaggccccugggguaucuguuaacguuacccaaagggaauuucauauuugguuuucucacuaacccugaggguuuacucacagcuuuggaguggggaaaggcaguuauauugaaacaaaaccuauuggaguuuuaggucaaaagucucuucucucuaucauauugucauacuuguaggguaggcccuuagucuggcuuuaguaggccuugguccacacgggcugacguguggucaaggaagucuugguagaagaaggaaaggcaugcugaggugacacacuggcccagcugaaacagccucugguuaauaacagcacagguggcugcucuuucaugggcacggugucagcugacccagcaugcccuggugguggguggggcagauguuauuguuuucauuugauagaugagagaacagagguccagcgcacucaagggacuugcucaaaguaacacagucucugcuagagcuaggauucggcgccaggucccaagccuuuccgguguccugaccacuuccuagagcaggcucugaugguugcaaugcugcaggagcuuagacaccaugccuggcagguuuugcccaauaauuccccaugugaggacuuaaugacccaaaccuuuuuugcuucuuagagagauuucauugcuucaagcuguuccucuagugagcuuagcagcuggcucugaggauggcuccaacaguauuccuguuagcuucugaccccucauucacgcacaacucuuuaggaauugauugauuaucuccagggaaaaauacaguggccgagucugguacuuagugauuccgagcagcacaguguaggggagccugaucaugguuuggaaucuagcucugcagcguguggccuggaggaagccacuucaccuucuggagcccccgacuccucaucugagcugugugguaaaucccccaggggggcacuucacccaucugugugcacaggcuguuccaggagggguauacaaggccccuccaacaauauuugccuuuggagaggagcagguggacauccgcaaggggagggauguccucuuggaagcuuuuuaucaugugcaugucuccuuacuaguaaaauucauguauaaugaaacauaagacaauaggaguauaugucauggauguacauuuuuaaggauaaucaaaugaacauccuugugcucaccauccagccaaagaaacaauacaggcuccuugaagccugcacauauuacuuuucuuacuccaacugccuggccucaucaguaaugugaguggaaucugacacggccuacugcagagcggcaugugaccucugguagguuauucuuggaagcacuauaagaacacugccccaucccugccacaugccacguggaccccaagaagaacucucuuagcuuuuaauaagauuuaaaauacagccaggagauagccccugucuccuagagcuuuucuuucagugaggccccaugcacuauggcucugcagggcuggguucaaugaaggcuggucccaguugcuggcaggguucacacacaggcaggcuuucuggcaguagacaguuacccaggcuggaugcuugggcccaaaacagauggucagcagacaagagaucaugacagauaguucugagggcugcuucgugggugacccaaagccagacagagguguaugagccuugucugggcccagccagccucugcugggcgaacucugagccugaggcaggguaugcgugcucaauccuagaggcucagggcuucucucuacccagaaccugugaugcuggcaucuguugggcugagucagcuuugcuggguuuagguccccuccccagguuccuggacuuucccccaucaguccaccuuccucugaggucuggaaccaguguuucuugaaguguggggcuuggaucaccugcauggggauuaccugggcugcuuguuaaaauccagauuccuaggcccugcuccagaccuagaacucggacucucuggggaccugggaacacgcuuucagccagugccacagugauuuggguaugcccuagagauugaugaucacaccccacacccucucagccugagaucaaguucaggaaaggacgcuauauagccugagucuugccagcccuuuccaaauuuuccuaaaucacuuggugacccauggccuaaauaaaagaagaacuugccaguggcuguaacagaagaaggagaggaaguuaaggcccauuuccuacuuuuuuuuuugaggcggagucacucugucaccaaggcuggagugcagugaugugaucuuggcucacuguaaccuccaccucccagguucaagcaguucuccugucucagccuccugaguagcugggacuacaggugcacgccaccauaccuggcugauuuuuuaaauuuuuaguagagacaggguuucaccauauuggucaggcuggucucaaacugcugaccucaggcgauccacccaccucggccucccaaagugcugggauuacaggcgugagccaccaugcccgaccccauuucuacuuuuuaugaaagcuuaaaauacuuaaucauggccugguuucuuuuugguucagccuuuauucuacccuaugcuucugggagcuuuugcaguuugcauaguuaucaaaggagacagacaguaucaucuaguuuuuuguuuuuuuguuuuguuuuuuguuuuugagauggagucucgcucugucgccaggcuggagugcagugacacgaugucggcucacugcaaccuccgucuccaggguucaagcgauucuccugccucagccccccgaguagcugggacuacaggcgcgcgccaccacggccggcuaauuuuuguauuuuuaguagagacgggguuucaccauguuggccacgcugaugucgaacuccugaccucaggugauccacccgccucggccucccaaagugccaggauuauaggcgugagccacugugccugguagugucgucuaguugaaauguuuuuuuaaagaauggcuaaaguacuggagggaaauacaaguugcugugugucugcugcgugguuguugucaugggcucucccugcaccaugacccccaggaaccccuugagugcugugucuuuucuuucagccucuuccuuuuccuucauuuaugcccuugacgugugcacguuggcacuguccaaggcuucuggggcuuuugugguauaaaugugguggcuuccuagcuuuuccuguugauggcuuguccccagcucugccgagucugcugagucccuuuuagguaggucuauuucccuuuacuuuccaguuuuuggaaccuuguuuuauaccucccuuucuuuuuguguggguugccuuuuaaaagaauucuuuuguucucguagaguucagggagggagcuaaacuaaaugugauauagucuaccaacuuuccuaaucuauguaauacuuucuuguagcugcacauuucucuaaacugccgcaacuuccuucuuccucuuuucuuuauuuuacuuuuuuuuaaaauugugguaaaauauacauaacauaaaacuuagcauuuuaacuuuuuuuuuuuuuuuuuuugagacagaguuucucucuuguugcccaugcuggagugugaaggcgcaaucucggcucaccgcaaccuccaucucccagguucaagcaauucuccugccucagccucccaaguagcugggaucacaggcaugcaccaccacgcccggcuaauuuuguauuuuuaguagagacaggguuuccccauguuggucaggcuugucucaaacuccugaccucagguguuuugcccgccuuggccucccaaagugugggauuacaggugugagccaccgugcccugccaacauuuuuuuuuuuuuuuuugagacagagucucacucugucaccaggcuggagugcaggggugcaaucucggcucacugcaaccuccaccuuccggguucaagcaauucuucugccucagccuccagaguagcugggacuacaggcgcaugcgaucacacccagcuaauuuuuguauuuuugguagagacgggguuucaccauguuggccaagauggucucgaucuucugaccucgugaucugcccgccucggccucccaaagagcugggauuacaggcgugagcuaccaugccuggccaauauuuuguuuuuuuaagagacagggucucucucggucauccaggcuggagugcaguggugugauuauagcuuacaguaacuccugggcgcaagcaguccucuugccucagccuccuaaggagcuaagacuauaggcaugcgccaccaugcccagcuaauuuuuuuuuuuuccucaaagagacggggucucacuauguugcccaggcugaucucagacucuuggccucgagcaauccuccugccucagccacccaaaguauuaauaaccauuuuaaguguugaguucauugauauuaagcacaugcaucaugacuaucuguuuccaaaacuaucaucauuucaaacugaaccuuugugcacauuaaaugauaacuuccuguucuccccucucccuaccugcuggcaaccaccauuauauuuucugucucuauaaacugauuauucuagguaucucauaugaguggaauuauaaaauauuuguccuacauuugguugauuucacuuagcauaguaucuucaaguucaacuucuuuuuggaacaaaaagggaaugaaugagugaguaaauggagaaucagcauuaauugaccuguauggucuuagccucucuggcugucucagcuccaaagucaggcuuuuccugccagcucaaaauauccuuuagcagaaugcauuaacaugucagguuaacugucagugucuuuaaaaaugguuagaagggcauggcauacacagugaaguagaauccugcacuuaggcuaguccuguuggaaagagaaggacuugagguacaggagagcaguggccucugcuaauguggaauuugcuccagcuacccugcagaccacccaggagcaggggcuaagacagcguccuccagaacugcccuggcucccaggacugugguggaggggaaucaaacuccuucuagguggggacuuccugcaccaaguguuacuuggggccgugaaaauuugguucucccucuacagauuucugcaugaauccccagacagugcugcuccugcgggucaucgccgccuucuguuuccugggcauccuguguagucucuccgcuuuccuucuggaugucuuugggccgaagcauccugcucugaagaucacucgucgcuaugccuucgcccauauccuaacggguaagccgugagccugcucacagugggagaggaacugcuacagggugggggcauccugucugaguugccggugggggcucugguuucucugagcaggcacccuuccaggagcucaugugccaagcuccagucuuucccagagugucagggugucagcagccugcuccagucuagcugcuaacuugccaggaucacaaacccacucagcccagcuguagaggggaaauguugcuagaaauuccacaaggaagcucacagcucucuaaaauggcauuugaagcucagaccugacaugagugaagaaggaaccaggcagucucccgugucuccccuggagcuccuggucagauucucuccucuccaccuuccugcuucccuacagacccgccuuuucuuguauguagcugcuguccucccucgugccugcacugcugugcugguuugaauuguggugugccuacuccagcucccaagcugcaugacccuauuugcuccuuaagacagauggaaucugacuggccuagaucaggucagacugcuguccccaaccucaggccaggaaucccauggucaagagagcuccuccuugcagagucuggggccaggcagguucucugagaaugggguuuggguagagaggcugugauuggguccucaagcauccuagcuguggagugcucacuaauuccccuucugugcugucccucugucuccuaguucugcagugugccaccgucauuggcuuuucuuauugggcuucugaacucaucuuggcccagcagcagcagcauaagaaguaccauggaucccaggucuaugucaccuucgccguuagcuucuaccugguggcaggagcugguggagccucaauccuggccacggcagccaaccuccugcgccacuaccccacagaggaagaggagcaggcgcuggagcugcucucagagauggaagagaacgagcccuacccggcggaauaugaggucaucaaccaguuccagccacccccugcuuacacacccuaaugccagcccugggcucucuuccucggcagccccucccucaacucugcagcuccucucgcacccagaggagcuccuuuccccagcaggccucacugguaggauccugaccaucuucuccaaaccuuccccaggagagacucugccuuuagggucauccaaguaucccugcucucagaaccggagguccacugguuuucuauaauguacucuuucccuccugccacauccugcccccuucacauucacgagucauuaccagccagggaaggucauccaaguuuccuccagcaugggcgauaucuuugggaccgagacuuuccuuggagagcugcugagagcggacagucccaaaaacaagugucaaagggcccaagggaaaggggacugugcccuggaggcucacuucacagggaucaguguuugcuccacagcuguagcucugggcugacgccccccagaccccuuccuucucggagugacccgcccccaggccaccugcuccggggaguucugugcacuuuacucuuuggacuucuccucacgugugcccugguuuuauggggagagggaaucgcuguugggaaggcagagcaguugcaacccucucugcccuugcuucauguggcuggagcccaggcaaggagagcaggagccagcgugagacugaggcccccuggugccuaucaaggaccagagugaaggggacuacaucucccagcccuucaccuuuuaaauaugagugguuuuaaaaggaaaaaaaugaaaccaggcaacagcaacaauauucuguuuuuaaaauagggacaagacuguugucacuuuuuagacauguaucccauuccuuuuggcucugcaauauuuggggcuguagcuccuuccaagcccaugguagucccuccccgagucucucccaguagaaugcagccucccuucccuggccccuucccucucagugacggugacucccuggggccuucucguggaacccagaggggcugaggacuguggccuggcuggcgggccagcguggugcuccucaggacugcagcacugagauggaaccuggccucaguuuaggaacaggggccacaacagggcaggaacccaccacccuccacauaggaauacaaccaguggggccacaucaugugaggcaucagacccacacugucagcccagcaggccgggcuguguccuucagacccagugcugcccuagacucugacucgggacuccagcuugccacgugcccucuccccucuugaauguacucuggucuugcagugugcugcugggacuuucuugcucagccaucacucuggucaccuuguuugcucugggucuggcugaauuuucugcccugagaucugggcauaaaguggaugaaacuugaaagaccuucaguguagauccagauggccaaccuguccuuguuaaguuacuugcuucuugggaaucaguguccccugcugagcugaaaaggaaauggauuccaaucucuuccaaccuuuaaggugauagauaguuugagcaagacuggagaauggacaacacuaugaagcuguggcuagaaagggacugucaugucccauccuuuggccagauugacuggggauguccggacagaugccugcauggguggugagggccacaucugcacacgagccaguggcugcuugcaguucacugcugugaugccagaguguguucaaaggugacucuccugcucuucuggacucuucucucaggcaagaaaggcugcaggcugccugcuaugugaugccugagcacaaagccaaggaacugaacuaagucuuucuguuaaguccugaguuugucauuggcagguuuacuuguggccagcucucucugcccuugggugucugagcaggcagaccagaagaccaggcacuggaccugcaugccaaagggacuggucaucuccugaggaccuguaaaugacccuguggacuguuccgcacgauccggaacccacuuuuuauucacuccccaugucuuuggccuuccucuucuuucucuuucccucugccauccugacacugauaguuugucauauaaauuccccggguuguguuuuuuuuucuagaaaaaaauuaaaagggaaaacaaaaccaaaaaaaccagaaaccacgaauaagaauggaaaugacaauggcugccugucauuuuucugucacgauuuuccugauuugguuuguucccuuugucucagagaagcaggagauguugaugaggcuguauuuuuuuuucuuuuucuuguuuuugagacaagagucucgcucugucacccgggcuggaguguaacguggcaugaucucagcucacugcaaccucugccuccuggguucaagcgauuauccugccucagccuccugaguagcugggauuacaggcaugcgccacuaugcccagauaauuuuuuuguauuuuuaguagagacaggguuucaccauguuggccaggcuggucuggaacuccuaaccucagguuauccacccaccuuggccucccaaagugcugggauuauaggcaugaaccaccgugccuggccaaagauguaauuuaaaauaguuagaagggacuuggcaugggccagcuccgugcauggcauuuucacccccagagcuuccuaauccuguuuucacacaggaaguuucuaggucuuucuagaacagcuagaaauaguagcugacucccgcccaaggcccaaccuucaaacccugagcucuucaggcugcauccucuggugagcuauagaggagaacguggcuccuaaacucuagccauccugugggaggaaauagacuucuuugggcuguggcuugcagaacaaacuacacuuuuuuucccucuauuguuuaaauuuuauuuaauaauuuguguguuuuucugucuuuauuuucuguauuucacguguuccuucacucccuagaaacugcacuuucuuugaaaccauagguaaugaaucuuacuaggagaggcauggggauagagacaguucugggagugugaccuguaagccuccuguagggcagugccaggccuugauugcccacguucucuccguuccuucuuccuucauacauuugaucacacagccuacacccagccccgagugugcaucacgguaaaagagcugagggcucucuucagggagcagcccauuuaggucucuuuuguuguuguuagggagaauacacaucuuucuuggaagcugggaguguguucucauuucauguccauucagacaaagcaccauuaggcaccaugaaauauacagugacggacaggacccugucugcaaggauuuuauguccuuaguucaggagauggacuuguccacagaaaggcagagugaagugggcggccggcucggaaaaguccugugcccagaagggagccaguucugaccugagugauaaugaaaggcuuccuggaggacgcagcuugagccacacuugaugugggagugaacugggauagggacacuccugcugagagaauggcaagagcaaaagcacacugguggccaggaggugguaagagccgagguuagaaaggugaggggugcucauuuaaggcacuaacagcagaaggagcccaggaaggauuuucagaagggaagggagggaugcaaccuuauuuuaaugacuggugacaguaggaaggguucugccuggccuuaagugaggguguugaaagugggagacaggaccugccaaaggggaagagggcggucacagucaaucccagggcccagugucucagccaggugcuggaguugggaaugcgggagccccagucucugcccaccugucacguggcagcuggaagguggcaucaacugcacaggcgaagaggggcccgcacacgagaagccaugggaugugaagggccgcaaggagaggacccugggacacaggaagagguggugcaucuggggcagggcggcuuucccaagaugacuagagaaucuucagcuggcaucuugccugaaauauccacgcucucagccacuacacuaauggaacacagaugcuauggggagacagaagggaacugacaaacuucaugccccuguuuucaaauagccugcaaucuuaccucuuccucugcauuuuuuggggggagugacauuuuaaugggaggcaggagguuuguggagaagagaaaauguuuuuuuuguggggguggguagagacagucucaccauguugcccaggcuggucucaaacuacuggcuucaggcaauccuucugccucccuucccaaaggguugggauuacaggcuugagccacugcaccaagccugaaaaugucguuuugaaugagcccaccugaaacgaagacgcuucauuaggguuacugguuugagaauuaagaucaguucuggccgggugcgguggcucacgccuauuaucccagcacuuugggaggccgagguggguggaucacaaggucaggagaucgagaccauucuggccaacauggugaaaccccgucucuacuaaaaauacaaaaauuaaccaggcaugguggcaggugccuguagucccagcuacucgggaggcugaggcaggagaaucacuugaacccgggaggcagagguugcagugagccgagaucaugccacuggacuccagccugacagagugagacuccaucucaaacacacacacacacacacacacacaccacacacacacacacagguuccucaccauaagcuuuggggaaaauucuuggcuuuuuugcugggggagagagcagugcccagggaagauuggcugaucucagagcuggaggguuuaugcgggacuggccagccccuucagcugagugggacagcaacacagugggugguaaggggcuucauaagauguacaagaugagggagaggccccuccagccaacccugugucuaaagagucagguaacgaagaacuuuccagagacagcugugaguccgucuggcuuaagggguuguacaggugucugagaauggggccuga

SEQ ID NO: 13380 - RNA, 621 nt, Homo sapiens
caucugucucugcagccaccgcugaggaagagucuccucugaggggagagucggucauggcagcagacgccgggauggcuccgcgacugcuacaccaggcacuccugggcccgggcagcagaccagucagcccuguggcuccucggcgaccuccagcgggcgcccggggccgggaugcagggcgcgcggacagaaacgagacagacagcucaggcccagcagcacgcaagcucccgcgccuuccgcgacugccacacgcgcggcgcgcgcgcacccuacuuuuucuccgccaccugggccgugauugggcgcgaccugggcuccugggugcucauuggcgccgugaagugcucgucaccgcccccuccugccccuucaugcaugcgcggaggccgccugcuagcaagguagguggcucggcggcgagagccgucaagggcgcauuggagagugacccucggacccggcugccgccgucgccgccaucuuccggccgucccagccccgccccgcggagaaaccuggccagguuccuguuagaauccugccagguguuaacuuguuuuaagaggccggcacgcuggcccccuucuuuauuagagugcagggugggggcggggc

SEQ ID NO: 13381 - RNA, 2276 nt, Homo sapiens
uuguuguuuuuuaaauauaacaauauuuuauugacauauccugaauguucuguauaaauauaaagugcuaaguuuccaaccccugcccacagggcuaggaggaagcgggggagggaguguuaaaugucagcugagcacaaauaauuuuccagcgccagcacaggugugaaaggcucacagacagacacacgcaacaugacacacccaucacuucccaaguccccagcuuccccaggaacacagggcuugggcuccaggcccugggcagacgaacccacagacagggcuccugguugucacagcuuguuccuuggagcucucaggcugccaagggcuucaacauggugguggaccagggagaguccacgguauagcgucuagcugauuucugccagaggauggggagggaaagagcagacacacccuugguucccgaccccgaaugagggccagccucagucccccagcagaagagcaccaggucggaaagaccagcaugccggcauuccuagagcccccaugugggggcuucugaaacucugaggagguagcagcccugccagaggugaggggacugugcuggcccagaggggagcccaccaguccacagucagcuccugccagcacaguggggcaggcaggcagaggggcaccaccucagugacacagcaccugggucucaaacugcagcagcugccccaugaaacugaaguugggggagaugaccccccggcgcugcuuaacgaagucaaaggccucguccagccgcacacggcgacucugcaugagguaugccagacagaugguggcagagcgcgagauacccgccuggcagugcaccagcacccggccuccgcuguucuucacccagucugcaagggagaugggggaguggugucagacggaaugugcacagcccaggagacaggugcccccaguccucuccucuggagccccucgggauuucugggcagaggugcccccuuaccaaugaagccuauggccuccuggaaccaggcacugaucuccaccaucugguuguccuccacagggauacucuuguagcggaaaaggcccucaaagugguuggggcagcuggcggacacguugaggacggcugugaugccacaggccugcagccccugcaggucugacgagugacugcagcugcccaggaacagguagggcaagaucuccacagggccacccuggagggaacagaggggcggugaggccuuuccagcccagccccggagagcuggagcagcagcggguggagaccccaugggcuggccgagacaagaggacuccucagccaguccuccugaccugagacaggucucaggaaugugcggaggacacaccgggacauacauuucccuucaugcucccaacauacacaugcaaacauacacagacccauacaggcacgcgcgagcagccaugccccacccccucccccaacacacacacguauaaaaguguguguauaugggcaaacugcucgcauccccaaauggcaggcucuuucccuagaggcgcccaguccgcggcggggagagagggagguucgggggaggggggucaauacucaccuggucguagacaggagcccuggagucggagcggcugguuuuguccccuguuggcggcagcgcaggggcgggggccucagagcacagaucgggacagcagcccuggaagccgucgaagccuccugcaaggaggggaagagcacgaucagcagggaaagccgggcuggagucggguggggcgggccaagggcggccggcuugcucaccucgcaggaaguacacggcagugggccccgcgcgggucucgugcagcagcgcggccagcagcacaugagccgggcugucgggccggagcuccgccaccgaggcacugcccucguccagcaccacggcccgcgccagcuccccgcggaccaggcgcguccgcagcgcgcggucgggcagcaggcaggcgagaacggcggcaggagggccgcgcgcgcggcgccgcagcagcgcguuccaaggcacuggccgcgcggcgcgcacguggcgccggcagaaggccaggaaggggcggcaguccagcagcagcgugcguuccgccucccgcggaucccgcagcagcgugcccagcgccgcgcacuccagcucgcgcgccgccuccagccccauggccaccggugccucuuccucuuccuuucggucuuucccgcgucccgggcucucguggcgguggcgcugcccgagcggucgacuccg

SEQ ID NO: 13382 - RNA, 32990 nt, Homo sapiens
agccguggaagcugcugacuguuccccccucguuuuucagccuguuccccacuguucauguuuggucuacaacaucaaacccauuucuuuuucagcugaucucauuucuccugaguuucugaugcucugaguccaaagccuaaacaaccguauucuuuucacucuccaaauacaaagcccucucacccuggcucggcgguuggcucccugcucugagccagcucaccugauccuuuagaggaagaauguucgaagcacaggcuuuaaaaauguccuuccuagcuugugcauauucuauuugcacuuccccacucacucaagaagaugccauuucccccacaaagcugggagccuuaaugcccuucuccagcacccauccugcccaccguggcugaggucacagcucugggcuuugaaaugcacaaacacaaucagaggucaacuccugucauuugaggaucccugauuagaaaagagcuugauauacaagcaggguauguauggaaauaaaaaaauuagaaaaaagagaaauaaaacuggacacacagaucagcagggguuagcggucuccuugucauugucacaaacaaaccccuguucugguucaugccagccacugccacccuuacaaccaaaaguacagucacuaggccugugcuguccagggcagcagccacuaaccaugugugccugaugagcacugaaaaggagcucagaaauguugagaugugcuguguguaaaauauacacugaauucuaaaacuggggauuaaaaagaaugggaaacaccuucucaauauuuuguauauugaugacacauugcaaugauaguauuuugaauauauuggguuaaaauauguuauugaaauuaauuuuaccuguuuuuuuucuuucuuucuuuuuuuuuuuuuuacauggagucucgcucuguugccuaggcuggcgugcaguggugcgaucuuggcucacugcaaacucugccucccagauucaaguguucuccugccucgccuccugagcagcugggauuacaggcacccaccauaacuccuggcuaauuuuuguauuuuuaguggagacaggguuucaccauguuggccaggcuggucucgaacucccaaccucaagccauccacccaccucagccucucaaacugcugguauuacaggcaugagccaccacacccggccucuuuuucuuucuuaauguggccacuagaaaacuuaagauccccauugcagugcauguuguauuucugucacacaccguugcacugggcaccacucugucacuccugccaugcggaguccugcucuuggaaugccguguuuuuguuucucacugcugcuguaacaaauuaccaccagcucaguggcucagaacaacacacaucuauuauuuugcaguucuggaggucagacucugaccugggugucacugggcuacagcaaaggcgucaucggggcugcguuccuuucuggagacuguggagaagaaucucuuucugugcuucucugagcugcccacaugcccuggcucacagcccccuuccauuuccaaagccagcaauuguugugaggcuuucucacacugcgcacccucacgcggacucgccuaccucccucuugcacaucccaccugaauaauucaggauaaucuccugacaucgaggucagcugauuagugaccguaaucccauuugggcccuuaacuucuccuugccauguaaccuaacauauucaugggcuccagaaauuaggacuuguacaucuucagggcccuucuucagcugcccacaugccagugccccgugcguguguuuucuuguucugugcuaacuggccagcucuuggaaaugacuggugugggaacacuugcuucauuuucucccuguucuugauuauaguccagagaucugcugggggauggugugagcccaaagaagccgauuuccuucuugaagggggugagaagaagggagacugugacuugaccaagccaaucggcaaacuaccuucccucccaacagaaguugauuuguucaggagggggcaugugacaaaagcugggccacucagagcccaucuaaggacuucacugaaaugcugacauaaagcagccacuugugccacagggggaaagccagccucaaaugaaacugucucacaaagaaauagagaugaaugacuuguagagaacuggaaacagaaacaaaaugaaacuugcagagaaaauauugcaaguaaauguugaaccucuggaucgaaccaugccugagucccuccuggcucugacuuuucaguuagguggguccacacauucccuuuuucagccaagccauuugaaugggauuuucugcucuuugcaaaauaaagauuugcgaugacuuagagagggguuaaagccauauuugaucuggacacaugagaguaccugaagccuguccucacccagcugucucuucccacuggucuuugaggcacaaguccuaaaggaaugcccugucucucuuucccccagaucuccaagaggacccuccugccucugcuucucuuccuccccugaagucaauuuugcagugugcuggucagccucauccagccccucuuuucugggaacugcucuaacucgauggcuggauugacuggccaagagacagacaucagggugagcuggaucaucagacagucucuccuaggaaugugaaauacgaauucagagaggcuggcagcccauuguucacgggaaugcagaagcugugaggcugagaaaccccuuuccauccagagggaaagaagguauagugggugaggggagaacagcagaggcaggcaacccuggggccggggagccagaaggaguggcugccucugucuccaagggcuugcuagcuugaggucagguccuuccugaggucugacugcuccucuugcccauugggucugaaauaaauuaauuaucacccgcccuuuuucccuauagaugaguugaaucaauuucuaucacuugacaucagaagagccuugaauaagccacacuucccauucccaugcuugcccuaggacccauugccccagauggggagaaggccaagugagcacccggccuucaggaacccucauggaggcaguucucuucccccacuuucugccaggcaggagaggcugcugaggcugcagcaaugaccugggcugccugggguuacugaaggcagcaggaagcaguguuggguugagucccagguuuccggacuccacaccugguggccgacgcagcuagcuaccuaguccacagccauucuccccuuccucucccucaaagccaaaggugguuacacaacacaguacagcccaugacaggcaucuucagaguggggcuuccaggacagcuacugcuuuccuguugggccugguggcucuucacuguaccuuuccccuucccuauauuccucccuggggcacaaaguucugccugaagguguagcagcagguauuugugacccugaggaugaaggcaccuggugaggaugucaacacagggagcuggaaggacccugguccccuauagccucaccacagccccagcagugggaccaucauggauccugaccuuugggcuucucauuacucaaggaauagaaaaaccccaaaucguguuugcuuaagacccucuugucagguuucuaagucuuuauuauuugcaauuauaacugauaauuuccuauguccucugggaauuugggucauggguggaguuuucuggcgagaagaagggcucagggacucucuaauuucaucauuuugcccaggguccaguuuccucugaaguuugcaaggacacauggaaggucagcagaaacuuggccaucucaguguccuggugggugauuuuuacgaggauuucucaucacagaggaugggaacccaaaggagaauggccgccauuggagccuuuccugucccuccacugcccagaacaacugaacucugugucaguugggcugcaaguaaagaaaacucaacuaauggaggccucauugaacaggaguucauuuuacucacguaacaaaccuauguggucccaggauugucucacggcccaguaaaggcaaagcauggcguuagcaagucugagauguucuugaauuuccccccauugcugcaagauggccccuacagcuccaaacaucacauccucaauggugaauaaagcugaucuccaacugggaagaacuucugucuccugguguggugaaggcuguuggagcaucugcaggagcauccaaacccugugcuauugggguaguccaugcccuucaagccagucauggcuuuccuguuuccucugucaaauacuggcuaaggauaggucugugaugcaauucuggccagugagacaugauggaagagcugcugggugaaauucugggaaaaguucccuuacucuuuaaaagauggauccaggagaagagagucucuuuugcuggguguugucauaucuggaggugaugccuggaacuguggcagcugucuugugauuaugagggaagcuggccugaaaacagacuggcccacugaagaggagggcagcauggaauguggaauaaaccugggucccuguuggcuuccugcggcccugaucuaaccagcccugagcuguccuaccucugcacugcuuggcacaggagacacaucuugauuguuuaagccccuuugaguuggguuuucuguuccuugcagcugacagcacucuaaccaauccacacauuucccucugcucgauuuccugcuccagagagacaggcacagaccaguaccgggcagccccacucuggggaaaaacaacagugcuuauuguuugccggcacagugggagcucugccuccuggcacagugggagcucugccuccuguggcaggcuggccauuccaaaaccacacugccugccacugccauaaagaggccaggacuguguucaaaaccccaggcagcaggaggagugguuugugggagguguugugguagugcauaaaggaaggucauuuccugacccucagaacccacacugcccucagccccacacagcccuacccagcccagcaucgcccccagugccccuggagacaauaauggcagccacccacuggcugcuccugugcgggcagggcaggaaagcuggugguuaagugcuggagaacccccaggcccuggggcuuggccggaaaggauuucuguagagacagcguggacauucuguccucugcaggccgccugguacaggaugaaaacaggccggcucaguacuuuuuuggcaaccgauuauauagauuugcauccacaugagcucccucuugcaaugacccagacccccacgagggcucuccccacagucauuuguguugagaacgcucugagcccuugagccuccuuccucucugggaaagggacuuuuuggcagugagaaggaccuggagggaggcacuucuggaggcauuuccuuucugggaggaaaugcuccagggcucuccuccauccaccaacagccuccaaguugaguaaguggcagcgaaggucacgccugagcuggcagccauggaaccucaccuccugcuuuuccagcuucguucccaaagacgucccuccacgagcuugugcucaugccaugccucugcuggaagcccuugcugucugcagguggcgaugugacccgggccuggcccuggggauuuguucaggcgugucacucuuucugaccaaaggggaccagccuuggggcuuuuguggaaaccucugagaaagggagguccacaauucugguuuccuagcuggagagaauacgccuggcccugcuggcaaccaucuuucccacccaagggagucagccuggacauuuuagucacuugagucaauaaauucuguuugcaaagaaaaaaaaaaucgcuuugagccgggcuuucuguggcuuacaguggaaacucauuaguaauauaaaugcagauaucccucuuaggccaaaguaaucucuccuuucuugcuugcucuauaccacacacaccugcuucauuggcauuuacuguuuccccaccugcacgggugaccuuagccccccugcacaaaggccuggacgucgcugccucugcagcugccccagauccaggugccguuaauuuuacccucaaguugcgcugaacuacucagugaauuauuguugguccaauaaaaccacuuuuguuuuauuuauucuuuuaucuccacacucacucccauucccuuccccugcaugggcaacaugcuccccauagauucccccaccuccugugcugcuuuaaaaaugcucuuucaaaagagauacagucuuuauguguuuuuuaaugucugcaaaugguaauguuuggguucccauguugcuucuuccuuuuuaaacucagcccuguguucaggcccauccauguggcuaugugugccuuucaucucuccuuguggcugcauaauucuccaugguguggaccauucccauuuugucucuccauucuccccaggauagaaacccuagggugccucccgcagcccccauccccacacuaccacaaagaacucugcagugaacaucuuggugugcauguuugacgaaucugugucaauuucuuuuacaucucuaccuagaaauggaauagcagggguguaagggaugcauacuauugaucaaaaucccuccacaaugguggcucuggucuauacuccacaagcagugcccucaucaacuuccccacuuccccacccaacaugaagacuucuuuuuuuuuuucuuuuugaggcagggucucacuuguugcccuggcuacuuacaggugcgaucauagcucacugcagccccaaacuccugggcucaugggauccucucaccucagccuccugaguagcugggaugacaggcaucugccacugugcccagcuccaauacuugucucuuccuagauuaguuuugccuaaaagauugcauuaguuuucuacagcugcagaacaaguuaacacaaauuguguggcuuaaaacaccauuuauuuuucaucucccauuuucugugggccaggauucugggcucggcuuagcugggugcucugcucagacuguaacccgguguuggccaggcugcauucucaucagaggcuccacuggagaaagaucugauuccaggcugccucagguggcuggcaguauucaucuccgagugguuguagaacucaaggagacuugcuucuucaaugucagcaggagagauagucucauaccuuuacauccuuuuuuaaagggcucaccugauuagaugcacccuggaugauguccuuuuucauuaacauaaagucaacugaucagggacuuuaauuacauuggcaaauucuuuuccccuuuuccauauggcacaucaucaccuuuguuagaaucuauuaauuagaagcacauuuaccaggagaggauuacagaagugcuugccuauuggaguucagcugagaauuuugccuaccauguauguauaagguuguaucugguucaaauuguaguaaagcacacagaacauaaaauuucccaucuuaaccacuguuaauuguacacuuuagugguaucaaauacuuucacauuguugugcaaccauuaccaccauccaucucaagaacucuacuuuugugaaacugaaacacuguguccaauuagauacuaacuucccauuccguuuuugccccagcccuuggcaaucauucuauuuucuguuucuaugaauuugauuauucuagguaucacauguaaguggaauacugucuuuuugugacuggcuauuccacuuagcauaaugcccucaagguucauccacgauguagccuaucacaggauucucucccuuucuaaggcugaaucauauuuuauugcauguauagaccacauuuuguucaugcauucgucuaucaauggacacuugcuuccacuuuuugguuccuaugaaugcugcugcuaugaacuuggauauacaauaucucuuuaacauccugcuuucaauccuuuugggaauacguccagaaguggaaauucuuggucauacgguaauucuauuugaauuuuuuuuuaggaauggccauguuguuguccacaguggcggcaccauuuuacauacccaccgguagugcacaagggucuaaugucucacuccucaccaacacucgguauuuucggguuuucuugacaguagcuauucuaguggguaugaagugcuaucucacuguaguuuucaucugcauuucccuuauucugggugauucucagcaccuuuucuugugcucauugaccaucuguguaucuuuuuuggagaacuauuuccucauauaucuuauuguuagaauguguauuucuguacuaaugaucuuagccacuuccucauaugcuuccuggcuuuugggguuuccucucccaaaaacugccugcucguguccuuugucuauuuauuuuucuuguuaauuuucaggaguuccucguauauugaggccacuaaucucuugucaguuuuagacugcacauaacuucucucauuuugccaugugucacuugcaacagaucuauuugauuguaacaucaugaaauccccuccacuuuuucugccuuaugguuucugcuuugaaauuuugucuaagaaaucuucuacuccuuuugguaaguuccccuguguguuuuguuuucuaacauguuauaaucuggcuauucaugguggucaucgugaaaagcaaucccauauaagguggaugcucagauuacggauuaaagaaucaauuagucacuuccaagauggccaaguaggaacagcuccguucugcagcuuccagugagauugacacagaagaugggugauuucugcauuuccaacugagguuccugguucaucucacugggacugguuggacaguggaugcagcccauggagggugagccgaagcagggcggggcauugccucaccugggaagugcaagaggucaggggauuucccuuuccuagccaagggaagccgugacagacuguaccuggaaaaacgguacacuucugcccaaauacugcacuuuucccauggucuuagcaaccagcagaccagaaaauucccucccgugccuggcucagugagucccaugcccaugguccuuugcucucugcuagcgcggcagucugagaucgaccugcgagguggcagccuugugggaggugguggaggggcgucugccauugcugaggcuugaguagguaaacaaagcugccaggaagcuugaacuggguggagcccacugcagcucagcaaggccuacuaccuuuauagacucaaccucugugggcagggcauagcugaacaaaaggcaucagacaacuucugcagacuuaaaacgucccugucugacagcucggaagagagcagugguucucccagcauggcguucgagcucugagaacagacagacuaccuccucaagugggucccugaccgcuguguagccugacugggagacaccucccaguaggagccaacagacaccucacacaggcaggugccgcucugggaugaugcuuccagaggaaggaucaggcagcaauauuugcuguucuacagccuccccuugugauacccaggcaaacaggucuggaguggaccuccagcaaacuccaaaagaccugcagcugaggguccugacuguuagaaggaaaacuaacaagcagaaaauaauagcaucaacaucaacaaaaaggacauccacaccaaaaccccaucuguaggucaccaacaucaaagaccaaagguagauaaaacaacaaacauggagagaaaccagagcaggaaagcugaaaauuccaaaaaucagagcgccucuucuccaaaggaucgcagcugcucaccagcaacggaacaaaacuggacagagaaugacuuuaaugaguugacagaaguaggcuucagaaagucaguaguaacaaacuucucugagcuaaagaauauucuaacccauugcaaggaagcuaaaaaccuugaaaaaagauuagacaaauggcuaacuagaauaaacaguguagagaagaucuuaaaugacuugauggagcugaaaagcagggcacgagaacuucaugacgcaugcacaagcuucaguagccgauucgaucaaguggaagaaaggguaucagugauugaagaugaguugaaugaaaugaagugagaagaguuuagagaaaaaagacuaaaaagaaaugaacaaagccuccaagaaauaugggacuaugugaaaagaccaaaucuacauuugauugguguaccugaaagugacagggagaauggaaccaaguuggaaaacacucuucaggauauuauccaggagaacuuccccaaccuagcaaggcaggccaacauucaaauucaggaaacacaaagaacaccacaaagacacuccuugggaagaacaaccccaagacucauaauugucagauucaccaagguugaaaugaaggaaaaaauauuaagggcagccagagagaaaggucggguuacccacaaagggaagcccaucagacuaacagcggaucucucagcagaaacucuacaagccagaagagaauaggggccaauauucaacauucuuaaaagaauuuucaagccagaauuucauauccagccaaacuaagcuucuuaagugaaggagaaauaaaauccuuuacagacaagcaaaugcugagagauuuugucaccaccaagccugccuuacaagagcuccugaaggaagcauuaaacauggaagggaacaaccaguaccagccacugcaaaaacaugccaaauuauaaagaccauugaugcuaugaagaaacugcaucaauuaaugggcaaaauagccagcuuacaucauaaugucaggaucaaauucacacauaacaauauuaaccuuaaauguaaaugggcuaaaugcuccaauuaaaagacacagacuggcaaauuggauaaagagucaagacccaucauugugcuguauucaggagacccaucgcacgugcagagacacacauaggcucaaaauaaagggauggaggaagaucuaccaagcaaauggaaagggaaaaaaagcagggguugcaauccuaaucucugauaaaacagacuuuaaaccaacaaaaaucaaaagagacaaagaaggccauuacauaauguguaaagggaucaauucaacaagaagagcuaacuauccgaaauacacaggcacccaauacaggagcacccagauucauaaagcaaguccuuagagacuuacaaagagacuuagacucccacacaauaauaacuggagacuuuaacaccccacuaucaacauuaggcagaucaaugagacagaagguuaacaaggauauccaggacuugaacucagcucugcaccaaguggaacuaauagccaucuacagaacucuccaccccaaaucaacagaauauacauucuucucagcaccacaucacacuuauucuaaaauugaccacauaauuggaaguaaaacacaccucagcaaauguaaaagaacagaaagcacaacaaacugucucucagaccacagugcaaucaaauuagaacucaggauuaagaaacucacucaaagccauacaacuacauggaaacugaacaaccugcuccugaaugacuacugggcaaauaauaaaaugaaggcagaaauaaagauguucuuugaaaccaauaagaacaaagacacgauuaccagaaucucugggacacauuuaaaggacuguguagagggaaauuuauagcacuaaaugcccacaaaagaaagcaggaaagaucuaaaauugacacccuagcaucacaauuaaaauaacuagagaagcaagagcaaacacauucaaaagcuagcagaagacaacaaauaacuaagaucagagcagaacugaaggagauagagacacaaaaaccccuuccagaaaucaaugaaacuaggagcugguuuuuugagaagaucgacaaaauagaccacuagcaagacuaauaaagaagaaaagagagaagaaucaaauagacacaauaaaaaaugauagaggggauaucaccaccaaucccacagaaauacaaacuaccaucagagaauauuauaaacaccucuaugcaaauaaacuagaaaaucuagaagaaauggauaaauuccuggacacauacaccuucccaagacuaaaccaggaagaaguugaaucucugaauagaccaauaacagguugugaaauugaggcaauaauuaauagccuacaaaccaaaaaaaguccaggagcagaugaauucacagcugaauucuaccagagguacaaagaggagcugguaccauuccuucugaaacuauuccaagcaauagaaaaagagagaauccucccuaacucauuuuaugaggccagcaucauccugauaccgaagccuggcagagacacgacaaaaaaaauugaauuuuagaccaauaucccugaugaacaucgaugcaaaaauccucaauaaaauacuggcaaacggaauccaggcaaacugaaucaaaaaguuuauccagcacgaucaaguuggcuucaucccugggaugccaggcugguucaacauacacaaaucaauaaacguaauccaucacauaaacagaaccaacaacaaaaaccacaugauuaucucaauagaugcagaagagggcuuuugacaaaauucaacagcccugcaugcuaaaaacucucaauaaacuagguauugauggaauguaucucaaaauaauaagagcuauuuaugacaaacccacagccaauaccauacuaaaugggcaaaaacuggaagcauucccuuugaaaaccggcacaagagaaggaugcccucucucaccacuccuauucaacauaguguuggaaguucuggccaaggcaaucaggcaacagaaagaaauaaagaguauucaauaaggaaaagaggaagucaaauugucccuguuugcagaugacaugauugcauaucuagaaaaccccaucgucucagcccaaaaucuccuuaagcugauaagcaacuucagcaaaaucucaggauacaaaaucaaugugcaaaaaucacaagcauuccuauacaccaauaacagacaaacagagugccaaaucaugagugaacucccauucacaauugcuacaaacggaauaaaauaccugggaauccaacuuacaagggaugugaaggaccucuucaaggagaacuacaaaccucugcucaacgaaauaaaagaggacacaaacacauggaagaacauuccaugcucauggauaggaagaaucaauaucgugaaaauggccauaaugcccaagguaauuuauagauucaaugcccuccccaucaagcuaccaaugacuuucuucacaggauuggaaaaaacuacuuuaaaguucauauggaaccaaaaaagagcccacacagccaagacaauccuaagcaaaaagaacaaagcuggaggcaucacacuaccugacuucaaacuauacuacaaggcuacaguaaccaaaacagcaugguagugguaccaaaacagacacauagaccaauggaacagaauggaggccucagaaauaaccacacaucuaaaaccaucugaucuuugacaaacuugacaaauacaagaaaugaggaaaggauucccuauuuaauaaauggugcugggaaaacuggcuagccauauguagaaagcugaaacuggaucccuuccuuacaccuuauacaaaaauuaacucaagauggagugaagacuuaaauguaagaccuaaaaccauuaaaacccuagaagaauaccuaggcaauaucauucaggacauaggcaugggcaaggacuucaugacuaaaacaccaaaagcaauggcaacaaaagccaaaauugacaaaugggaucuaauuaaacuaaagagcuucugcacagcaaaauaaacuaucaucagagugaacaggcaaccuacaaaaugagaaaaaauuuuuacaaucuacccaucugacaaagggcugauauccagaaucuacaaagaacuuaaacaaauuuacaagaaagaaacgaacaaccccaccaaaaagugggugaaggauaugaacagacacuucucaaaagaagacauuuaugcagccaacagacacaugaaaaaaugcucaucaucacuggucaucagagaaaugcaaaucaaauccucaaugagauaccauaucacgccaguuagaauggcgaucauucaaaagucaggaaacaacagaugcuggagaggauguggagaaauaggaacacuuuuacacuguugguaggaguguaaauuaguucacccauuguggaagacagugugguaauuucucaggaucuagaacuagaaauaccauuugacacagccaucccguuacuggguauauaacuaaaggauuauaauaaaucaugcuacuauaaagacacgugcacacguauguuuacugcggcacuguucacaauagcaaagacuuggaaccaacccgaacguccaucagugauagacuagauuaagaaaauguggcacauauacaccauggaauacuaugcagccauuauaaagaaugaguucauguccuuuucagggacguggaugaagcuggaaaccaugauucucagcaaacuaucacaaacacagaaaaccaaacaccccauguucucacccauaggugggaauugaacaaugagaacacauggacccagggcagggaacaucacacaccagggccugucgguggguggagggcugggggagggauagcauuaggagaaauaucuaauauaaaugaugaguugaugggugcaccaaaccaacauggcacauguauacguauguaacaagccugcacguugugcacacguacccuagaacuuaaaguauaagaaugaaaaaagaaucaauguaugauucuuuaauccaucaucugagcauccaucuuauaagggaucacauuguuuuucuccauauaguaagaguuuuuccaacaagaacagcaacucuuucccacugacuugugaugcaccuuuuaucauagaugaaauuucccucuaaccagggaucuccccucuccaugcugaguugucuguugguucacugucaccauacugcuuaagacaacaacagcaccuuuagaguguaccugaguaucuggaagagcuuccugccuacccuccuuuggcuuaggcaucuguggaccuuuaucccuccucgcaugauucagagugaguuucuaaaacuggaaucuuuacugggacuacagugaagugauggaugaauugagggagaacugacaucuccauauaucaggccaccccucccaggagcaggagaugacuuuaccuggggaguaucuacacccccauucuacucccaccuaccaauuagucggcaauugauggaguugcucaaucaaugcuagggagcagaucuccagggaggaagacagagugggccuggaauauucuucagcaucacugcuuccauucccagccacgccuggcaagagggaggaaacauccugucacagaaccuauguuuucuggguggacgaaaccagguguccuggaggaagcagguauggugggaaguuggggcaaggggcaaggggacacagagcaacagaacuucuggcuuucccuagcaugggccaacccucccggccagcaucaugaggcggcacuggcugcuucccccuugucccggggauugggaggauuguugugcuucauucagccugucuaccucaugacuugacugagcuacaccucaacauugucaaguaaguagacagauuaucauccccauucaagagaagaggagaagucaucuccugcuaagguccacagagaaggaaguucacucauuaccugaaaaacauuuauccagaccucacagugcagcagcuucuuggcccugggauguggcagagaccagacaaauggucaaauggauccagucagcauuagacaccaugguggacauguuguucaugucagccagcaccauucccugagaaaaccaaccccgugcacuccguuucuccuaggcuggucaaucauggugcccccucaccaaagacaggaaagggggcaaugguguggguccagucacuacaucaggacaugccacacccccuagccacagggauuggucaagaggguaugaggacgauccuugcaguaccggagucuucccugggguuucauguguauguugagggacagaaguuucuuccuacuaagguugaugaggaggguggauauaagucuugggcgguuggcagucagguuuuuauagaaaagagccuucaggaagaacaaaaccaagcagagacaagcaguauggacacaugagagagaaccggaggccugacaauguugcuuuagcacuuagguccagccaugccuagaguuaacacauucauacuuucucguuaugugagccaacccaugagcuuuuggcuuaugcauacuugaguuggaauaaguggaaacaaagaguaccacuggacagagccccuaccaacaaauccaacucucugcccacucuacggaacuuuccccucagguuccaccacacucuuucagguuggggcuuauuuugaucauaauuccccuguucucaaauugucuuugaauccagauucugucaguaaguacccuuuauuccuuauugguuuaugacaucugcuagaaggccaagccugccuucugugucaucccccaaguugguguugaagauaccgauguggaggacagaacacuguagcaugcagcacccuccucccucagguugucagcccuugaaucucucacgcugucccuggucuucacagaaucccagauccccaguauuagaaaggaucucggguuccccacucacucuaucccagccucuuggcucaaguuuucaucuauagaaguggugccagccuuggccagaggaaaguggcauguguggucagugucuguuggcagcuucccagcaucaauguucccauucuccugccacuagcacccauauuugacuucuccauucuaggcugccauuugcugcagugcuuagcaagacauuauggaagguucugguauaacggaagggaucuacaacauagaguaccaccaaugguuaccucuggagguggcugugcucagagcaccugggccugggagggaaagggugucucagaaagaggcaugucuccuccuuuaaucaggguuccucagagauuggcauuugaaaucuccagacugaguaaggaauauucaccuucaccccacgggggcagacaccauccaaucagucgagggccuggauagaacaaaaggcaauggaaaagugaauuuccucauaacccuaacuaacggaggagacaugccucccucugagacaucccuuucccucccaggcccagguguucugagcacagccaccuucagagguaaccauugguggugucuauguuguagaucccuauuacuccggaaucuuccauaaagucuuguucaacauugcagcaaaccacagcauagaauggagaaacagaaccaagaauauagguagggggauggacagaugagcuuuauuaugggaauuggcucccgugauuauggaaguugaaaagccccaccauaugccuucugcaagcuagagaaccagggaagcuggugguguagcucaguccaaguuugaaggccugagaaccugugggugggggugcugcugguccaaguuauagaacccaaagccuggaucuaauguccaaggguaggagaagauggcugucccagcugcaggagagagagagagagagagagagagagagagagagaagggaagagagagagagagagagaagggaagaaagagagagccugcaugcaaauucucuuuuccucugccuuuuuucuaucaaggcccucaaccgauuggauggugucugcccccauugggugaaggugaauauuccuuacucuguccagugauucaaaugccagucucuuccagaaacacccucacagauauacccagaaauaaugccuugccagcucucuggguaucuggguaucccagucaagcugacaccuaaaauuaaacaucacaucuccuuuucucugccccgcuggugguccccagacagacuggcaagagccccucugcccauucuaaugccagcucaaguccuuuucuccaggugauauacaggagaaaggccugucagugccuucagggaacaccugcccccagccacagggagggccuuugucccucugggcgcaggcagucaguuaggugcaucaggauauucuggguaaugcauucuggcaugaguccaggauggggcucaccaaguccaguccagguugggcagggcccagcucaaaucaguuuauguuucucucagggucgggucagucacaaucaguguguauggcagcuggccuacaggucuugcugcacugcagcucugccucuccugcaaacugcuugagggagaaagagcacacugaguccucggucccagacccaaucugggucugagagggaugcuucuuuucaaauguccaaauugcagcaaacaaccaccaccaccauaacaaaauacguuucuuccaaagaagcagcacaucugacagcugaacucugagaugcugcgccucgucucuacagucaauccaugcaaccuucuagucuaaagucucugcuuuggggcuacuucucagcaugagaacuccuuaagagguggggacguguucacaacggcaaaacucggcugccuguacagaugguguucccagaacuaagaggcgucagccuucgguaaauucaagucugcacucuuaggaggcaacuuacaacuucgaagugaaagucuauauuuuucguuuuucagcgucagagucucaggaucucgauguggacaggcacccugauacaaaagaacgguaagaugggguacaaaauggauucugcagguaccgggaggacguugcaaaucccaaugaaggugaguggaugcacacacagccuggauagacacgaaauggcacaaagggagagaaaggcuacaucccggaggggcagggugugggagucacaucagggcuggugagucagagacgagggaggaugugaacacguucugugcugucuugggccccgccaggcucauguguggcuuugcuccggcacacgugugucacaugcucuggaacuguggaauccucuggcaugucaggcgggcucauuccaugggggcaggaacagagagcccagucauucgcacguucaucuguucuauacugcuugccucccacuggcuggucuccugcugggugcugggaacacaguuacaacaugaaugaacccauaaggucuuuguuuacgcggagcuuagggccgagacaggagucaggucuuaaucaaauaaccacacgaaugaacacaccggccacaggcccagcugaaaccuuagcaccgcgcggcugcuggaggucccugacgguggucuaggcuucacauuaacaaaggaaaugacacugggaggccugacuuguuuuucaugacugcaacugucucuugaugaucuucucuccuuucuaaucguccccagcucagaauuuugcuagagccgaaccccagcuuggaggagcguaagcccugggauaacuucuuuaaucagaaucuggccugagucccugcucgaagcucaagcacccggggccucgcggccgccugcaguacuccccucccaccgcgggccagggccgacuggaaaacggagcaggccauccccagagcacgggucccguggccacguugagugucgcagaguacgggacgcagggcggggcuucuggaccagcgcgcaucccaauuggcucucggggcugccuuuuagccggacgcgcggaggugggcaauccgcuccuucccuugagcaguccacgccuuguggcggcuuugcggagcugcugcuuuggcgggaguuggaagcuggugugaggugagaggcgcgguggucgcuccccggcgaggccaggucagaaggggaccgggaucauccaggggcuuuccugcuucaagagccuggucugagcggccuguuggggacugggcggaagucgaaagggagggagugccggccaugcgggucuuguggcgggaaugaguccuuguggggcgugguguuguggagagccccgcuuugccucuuccucggcaucccguuccccuacauccagagagggcauccaggaccugaugucgggcaggugcccuucgcacaucuugggguagcucggggagcgccugucacgggucugacgaggaagcugaggccugaggggcccugggcgggggcuguggggcgccgaggccauguuugagcagagccgggaaggugaaguucucuugcggcucucuguagggcacaagcauuccaaacgugggggcagguuuagaguuuuacccuugaucaagggcugaacgcucagaugugcacaggcucaggcgucagugauaaucaagguggaggcaaacgggagggcuccugcugucgggcuaaagggacaguggcggccagcugagcccuguggggugugugcucagagaugccagagcucagcuuuuuccauuacagccgcgacuggaaaccuugauuuucaaaaaauguauauguaacaagcccucugcuguucaacguugguuuuacaucauaagguuuuagcacguuguguagucaaagaaguguguguguguguauauauauguauauauguauuauauguauauauguguguguauauauguauauauguauuauauauguauauauguguguguauauauauguauauauguauuauauauguauauauguguguguauauauaugugucuaugaguugaauuugcccucggggugccaguuugcauccucugcuguaggaguccugagcuguguuguuaacuggcagaugggaauaaccccuugccauggcuuugacucugcuuccguagagcuagcacagaccuaaugggguuagauuuggggguuggggguggucugcagcuaggggacagacacccuccuugcaaagcgggcguggguuuguagccuuccuguaccaugugucugugaacagggcuaugcaacauuuucaagauaacagagugccuuugggaugagccucccguggcccccgagacccugggcacugcagggauccugaucccauuacugcuuggcuuccuggcuggaaaccgagcugacuggggaaaggaggaacgcgccuggagaauucuugggaggaaguuauugugggucagcuggcucuuccugguucccucuugcacaccgggcagacugcuggacauacagagaugagucccugcccucaggacacucugaccacguagggagaugaaaccauagcccuggaggagggcuucgaauggcucuuugccgggcaggcuugggcuggggaacccaaggaggagagggagggcuuagaggguguuccagaagcaucguggacuuagaacccugggcagaauuggguggguggcugggaagggagaggcuccuagaugggccugaucgaagugugguagggauggggaaacaugauuagaccagcccacucaucagggucgugcugacaaauagggaagaggggcuuuuaggcccaaauuuuugagccaggagucguucagugcuguuugaaggaacauagguauuuauuaguucagggaaauauuguggugggaaggaggggcugaggagauacaaguggcgucuucuguggagaacguuaaugugagaggggagugauuguggaaaagucugucuuuguccccaacuagaugcucauuccuggugaguaggccucuguguucugacccugaguugucccucuucuauuagccagcccacauucccguaauguuugggugguuacagggcugucuccuggugaggaggggagggcagcugaguaggaccugguggccucauggcgauagucuucuuccuccuuggcagucuugugccuccuuccuuccaauccagcccucauucuuucccucugcacagaaaggaucagcaucuccgguacagcccccaucugugcuaggagauggccggguggguguggaugcuaagacaaccgaucccccucauguuggcccgaggagggcccugaccuggauacugugagaccuuuugaggacagcuggcuccuuugugggaucaguuggguguggggcagggccuugaccugagccagccccuaguuuccagccuagguucuccucaccacuaauggccuaagugaugucugucuguccugugaugggggguugcaguuaccgcaggaggcccuggauuauggcucagauucuuauggcuccauccuugcaccuuuccccggcucagguuucuguggggagaaggagagugccagaggugacugguucaugguucuucuaggcucucauggccaccauguuggaaggcagaugccaaacucagccaaggagcagccccaguggccgagagguaauguggcuccucccauuccucaaauccucucugcccugccaccccuucugcugugccccucacuccuagagccuccauugcuccaucuuucccucucuccugccaaggacuuugaguccucucaucucuccucaucgcccuuuccaggcuagccuguggucgucaggcuuugggaugaagcuggaggcugucacuccauuccuggggaaguaucgccccuuugugggucgcuguugccagaccugcacccccaagagcugggugagugaugguagggccaggccccaagcaggaagcuugguucugggagccgaagcucugggaagcugcuuccuuuaugucccugcaagcuuggcucuucccugccccaugccucugcuucugucuuucaggggaauggaugcacugguauugguuguaugguugggcgguggcuuguucccaggccugggagaguugggugggagaaguacagaggggccuaaguggugguagggugugcccagagggcuggguucuuaucaugccugugucaguuuuguuguucaguuuuguggacaucacccacucagacuuccccagcacucagcacaugcuugaagaccucuuuuuugguuugugucaugugaugguggugagggagcccagauuucucauggagacccaggcugcguuuucucugcuguugagaagauaacuucuggagacuuucauauaccacucugaaagagggugauucuguacaggauacagcacuucaguuuugagcaugggccccuuuuuccugagccagccuagaaucuggggucaaacaccuuuugugaaauacugugcuguaaucuuuucuccuggaagacuuagcaggccaccaggcagagccagaggggcaguacaggggcguuucuuuaccaguuugcaaaggccccccaggacaugcugucucucccccugucuugcaggagucccucuuccacagaagcauaacggaccuaggcuucugcaaugugauccuggugaaggaggagaacacaagguagucagagcuauggacuggagcaggcuuggggacagggacccuugggugcagggcugcuggggcccugcuuuuuggugccauuuucuuccucugauagagaaagaagggccccguccucuguuccauacacaagccugcagggaggggcagacuuggagcucucuugcaguuccuucugugagcauguauggauugcccaccguguuucaggcugugaaccuguacccgacucaacagggugaggggugggaauggggcacagauggacaggcagcucuuccugcucagguguuccuaguacaugggucugggguguggucccuuucugauugaauagccuucugugaguccuaguggaggugggcccucucugaaggaucuucccuccugcucugggagcugugcccagguuucggggcuggcugguucggaggcucugcuauuuccuguggucccuggagcagcacaucccccccugccaggaugucccacagaagaucauggaaagcaccgggugaggaggcagggagugaggucuggcuggcauuucugggauccugaaugggaugacaaugacacuagguagggguguuugagagggguggcuggggcaaggcuucuagagcaugagcuuugccuggaacccuuccuuaaggaggagagugaagacuggaggcugugcccugcugcagccucauagcacuccuucuaacccccucacagggugcagaaccuccucucagggagggucccaggaggcacuggggaaggccaggugccugaccuugugaagaaggagguacagcgcauccugggucacauccaggccccaccccgucccuuccuggucagguaacugggcugaagggcacucacccuugggcuggggacucuguccuucuggagagcggguguuggccgggcuuggggaagugcuggacucuccuccuggguugcuggauaguguuuaccagagugggcugcagccugccuucaccaccgccucccauccccacauuuugccagcacagguuggagccuauguuagaugcagcacacuguuccagggaaacggaggguaaacgagauaugcgcggcugcaaggaggaaggaacagggcugagacagaauaccaggaaggggacaaagagccuguaagccagagccaagaggaagaaaaggcgaacaagaaugaggcgaacagucuugcuagagggaauagccugagcuuuggcccugggcaggaaaggacuagguuugcuccagaagcugacgugguuggaagccagcaagugaggggucgagagcugugggaggugaaaucgagaggcagaagggaucaaaucauguaaggccgugcaaguuuggacuggaucuccaagugcagugaaaaccaguugcaagguuuuaagugggaagugacaucaugaauuggggucaagaguggagaccagaagggcaucuggaaggcuguuuuguuaauccaggugagagaucaugguggacaguagagguugaaaaguggauugagaggucgaggugauauuaacaggacucacugagggauuggacagugggaacaggggcagugagggaaguaggagaaguuacaggacagccccguuucuagccuacuuucuggugguauggacagagaacaggcuuugggagaagugaguuggcccaaaaagguaguuuggagagagagaguuuugguaccugacaugcuuguggagacacugaggaggcagcugcauauaggagccuggagcucagaagagagguuggggccagagacacugcgaggcuuuagcauacagaugguguuuaaagccaaggagaugaaugagucccugaguacaggugggcuugggggcagcaugugucaagcucagcugucuugaaugugcugaguggccaacugagcaaggacagaaaguagagguuguuggugaccuugaccagcccucugcuguucuagucucuugaucugccuaccuugacaucagccaucagccucccuuucuguguuuccuucccuccaagccuagcucagauugcaggcucggggugcuaauaaugcucuuucgagggagucaugggcaugaccccccgcugucuaccuucucuuugcaccugagcagcccagcguugccagagaaacacauaccaguggacugguuuccuugcuaagugcaaaugucacagggacacauggcacucuccagggcucccacccagccugcuccuucuuagacuuauccacugucaacugauuccccaucucaugcuucacagaaagauaaaagccaucacauggggacuugcugcuuauccagcacauuucccugcuacuacagcuaugugucuguccuaaauuaaagcugguccuaugccggugcaguggcucacaccuguaauaucagcacuuugggaggcugagcgggguggaucacccaagagcugaagaccagccugggcgacauagaccagccagggcaaacuugucucuccaaaaauuagccgggugcacuguugcgugccugugguccuagaugcuugagaggcugaggugggaggaucgcuugagcccaggaggcagagguuguagugagccaaguuugugccacugcacuucagccugggcaacagagcaagacccuguccuaaaaaauaaauagagcugguccuccuguugggcugcagggacaaccccacccaccugcccaccagggauuuugccccugcaguuauccccuuuccuucuucuauuacuaauccuuccuuuuuauuucaccuuuucugguagauugugaagaccaggcuggguucugccuggagagaggcuugguccucuagucuccuuuaggguaaauugaggcagaugcucugauucugaugugaggcagcuccaccaugaggucgugggagaguagcagcgucuggugggcaugaacucuggugucagaacuuccagucccagcacugcuacuucuuagcguucacuaccaggaagcaguucuguagcuucccugagucucacuuuccuucuucuguaaaaugaggauaguggcggggccugcccuaaggagcacugggcagcccuccaagugccacgggccgagcgucacuccuugccgcaccucaggccuggugucccuccccaggcuguucagcugggcgcugcugagguuccugaacugccuguuccugaaugugcagcuccacaagggucagaugaagaugguccagaaggccgcccaggcaguaaggcccgcccuccauuggguuggggauggugggagcagaagagcagaggcugggccaagcccuuaagucaggagcaguccccaucugguccugcuuccuggccucucuguucccagccauacagcaguccaguccccaucagcuggugggaaaaauccccugcucuuugccgaccuucccuuaugucucacggcccugcucccauggggcuuccucuaacgucuuuccaucauggucuuaacaaccaugacgucagugcgucggugcaguuaccuuaagaguugucuaaaggcuccuuugcuuuugggaaaugugcucagaggaagaacucugcagcugaacugucccucccucuggggcugcccugggucuuuggcugccuguguccucaggguggggcagguuggcacuucccucuggcucuccccggagcagggcuugccgcuuguccuccucucuacucacaaaacccuccuggaugggauccugcugcccuuuaugcugcucucccagggccugggugugcuucguguggccugggacucccgcgccugcuccccugcccucagguaaaaaccuuuugccucuagacauacaugggagaagucgcaggcuggggcgggguguguaucgggguguguuggcagcagcucccuacuaaaggcccucuucguggccucucugcuccgagccauacagcagucuagccuguggggcuuagauggaggugucagccacagggccuagggccauggcuuugccucaggguauucaaguaggacacaggcuggccaugggggagcugagacucucacuagccccuuacucauucacaucuucagagccccuuuccuuaucaggcucugcccuaugucccacagagcucugcugaggaagcuuggggggcuuuuccugcccccagaggccagccucucccuggacagcucugaggggcuccuugccagggcugugguccaggcggugagugcccccagugguuacauaugggccaggcuaaggggacaggggucuguuucugcucuggccuuaacacccccucugaccccuccuauuccaggucauagagcagcugcugguuagugggcagccccugcucaucuuccuggaggaaccuccuggggcucuggggccacggcugucagcccugggccaggcuugggugggguuuguggugcaggcaguccaggugggcaucgucccagaugcucugcugguaccaguggccgucaccuaugaccugguuccggaugcaccgugugacauagaccaugugagaaugugagaccuuccagccccuugggccccuagguggacaccagcucccgauaggaggcacaauauuguguccuguggcugagccccacuuagggcuguggggggcacaaaggaaucguccuuacaaucaucuggcagcaccugucaaggccauuaccaucaucucauuucauccucugaagaccuugauagggagggauuuuuccugugucauggauaaggaaagaggagcuugggacaaggucacgcaccaguuugggccugagauaaaacugagcagggugggaccagaggauaccucuggagaccaggaugggugggcagcccugauguccgcccgagagcaguguccucggcgaguauaguuauccuuucccuccuugcaggccucggccccccuggggcuguggacaggagcucuggcuguccuacguagcuuguggagccgcuggggcugcagccaccggaucugcucccgggugcaccuagcucagcccuuuucccugcagguauggagccagcuggggaaggcugggaguaccuggggugucuguccuaggcauccuggcagccuggcccucaaagccacugcagggauagcuuugccuacuuccagugggcugugugcaaguuuccuggugggcccgagcaggccaccuaagagccuucucuugggcaggaauacaucgucagugccagaagcugcuggggcggcagacagacccuggagcagcuacugcagcccaucgugcugggccaaugguaggggcacaggagcguggggucucagggggcaaggcaagcagcccuucagcaccagcuuauguaucccccauauacacacacuagcagcccucccucaccaaguauccuggggucaucuagaauaguuccagguacucgccuugccaacagucugagugugggguauggcacagaggccuggaugggacuggggguuauagaagccauccucuguccuggggcugggagggggaaacacccucaccuuuuagaaagcucuaggcauucccacagcuguuuuuguguuuggacccuucauccuguaaucugugucucuaucucaguacugcugucccagacacugagaaggagcaggaguggacccccauaacugggccucuccuggcccucaaggaagaggaccagcuccuggucaggagacugagcugucauguccugaguggugagggugaaccagaucugggccuuugcgggugggucacugaaccguccccucucggggucagccagucaccaggguucuccauuccaagugucugcaccugaggugcucugugauaccuuggggacaucugaagaagaauggaacccuucuccuacaggaggagcaggcagccagggccaucauaagggagcagcuaagugcaugcacaaagaugguggccugaggccaggaggcugcagcugcuuccccaaggccacacccagcccugccuucugagcggagucuccuuagcuuuggguggagaugguguuaacugaauggaaugauacguguaaggggcuuagcacagcgccuccacagagggcccuuauagggagauccaucuguaucuucuucagugccccucuaguagaggcuguggguugaugugugggcccuacgaugagauccaggggaaggcccccagcuccuggccugcucucagccugugugaugauaaacaccacugcuccggguguacguuccucaucccugggguggaguugggauguguggcuaggaagacuugcuagaucauggagggaccaggcugcugggccucaaccugaccagcaucuccaccccccgccccacuccagccaguguagggagcucugcggugaugagcacggccauuauggcaacgcugcugcucuucaagcaucagaagguagggggugcaaugugguggggaccugggcggugggggggguggcgauguguggcccugcugccuagcccugcucugcccacccaggguguguuccugucgcagcuccugggggaguucuccuggcugacggaggagauacuguugcguggcuuugauguaggcuucucugggcagcugcggagccugcugcagcacucacugagccugcugcgggcgcacguggcccugcugcgcauccgucagggugacuugcugguggugccgcagccuggcccaggccucacacaccuggcacaacugagugcugagcugcugcccgucuuccugagcgaggcugugggcggugagucuugaggugcacgggguaggugggaugugugugcaguggugaagggaacggcuccuucuucauaauggacccuccgcccccagccugugcagugcgggggcugcuggcaggcagagugccgccccaggggcccugggagcugcagggcauauugcugcugagccagaaugagcuguaccgccagauccugcugcugaugcaccugcugccgcaagaccugcugcugcuaaaggucaggccuccccuacggcccacuugguccuaggccuuccccucuuggugguaggaauggcccaucccugcccaugcucuaccucugaaaccuccuggguaguagguguggccuugcccggucuuuggcuaggccccugcccaugugccuggcucuccugaggccacaugggugccuuuuucucccagcccugccagucuuccuacugcuacugucaggaggugcuggaccggcucauccaaugcgggcuccugguugcugaggagguaggcagggcaguuggagacaagauccuugccuggagccuggccuccuccagccucccacccugagugccagcugccccaggcuccuccucugccccgugugugcugugggggugggcagccccuggccuugcagcggggaagccuagcucgcaccucugcucccugugccuugggauauagccaccuaugccccgguucugugugucucucuggauagcacuggacaugugugccucugagguucucugcacaccuccugcuccccacauuucuuggccacagggcuacugcccuugagggugggaauucacuuccucucacucugcaaguuggcccagcaggugcuggggcauggcucuggccauccucuugggucucuaggucugcuuuuacugguuucaccugcauguaccuggucuggggguguaggguugaucccuggccagcuugucagagaacaauggcuccacggccccuagaccccaggcucccggccagccugugacacagggcgacagcgauugagcagaaagcugcuguggaaaccgaguggggacuuuacugauagugacagugaugacuucggagaggcugacggccgguacuucaggguguguuucaaaaagcugccccuggagggaggugguagggaggcgguggggagcugcacucaccccggccuguccccuccagcucagccagcagucacacugcccagauuucuuucuuuuccucugccgccugcucagcccgcugcucaaggccuuugcacaggcugccgccuuccuccgccagggccagcugcccgauacuggugaggcccuuguucccuugcaguccucgaggcaggcugugucugugcugggugccaggucuaggucuucucucuucugcagaguugggcuacacagagcagcuguuccaguuccugcaggccaccgcccaggaagaagggaucuucggugagucccaaccagucagcccaggcuccugcaggcagugguguuugcugguggcugcugcccccugcaggacagugacaacccaacucuaggaaggcaggcugcagaguacagucuucuguccagucagagcucuaucccucccugggcuucuuuaaacaagaggagagaagccugugcccaguggcucucuguucucccuaccuagagccuucacuucucucuucuuuccagagugugcggacccaaagcucgccaucagugcugucuggaccuucagagaccuaggggugagaggagccacugucaccaucuucugucccccugcucccaccccaauagaguagcucagggaaacccagcuauguccccaucacuccacagggcuggccugauggugccucauuaagacccugggauuuacuuggugucuuccagcaacagauuuggugauggguuggagaaggugggaugguuuccugccucuuggucucccaaaucacuggcucaucuuucuaggugggguauugggacugcuuugcggcagcauuugcacgcaaacauugaggucuaaggggccagaggucucaaggcagguuucugggggacaggccuggccccugggccauguguacacagucccuguggugagcgcacucacggcuuaucuuccauggcccagguucugcagcagacgccgagcccugcaggccccaggcuccaccuguccccuacuuuugccagccuggacaaucaggaaaaacuagaacaguucauccggcaguucauuuguagcuagaacugugaggaggagccugugcugagacuucucagccccagaacacagcuguguccuagagccagaagauggagaggaggcugcaaacccuuagcugcucuauaaauauaaucauugaggcuugauugucccuugccaucucuugcuuuuucccuucuuugaugugauaaacaaggggacgagacgaguugucuuuuccccagcccagcagcaucuuuuuggug

SEQ ID NO: 13383 - RNA, 32990 nt, Homo sapiens
caccaaaaagaugcugcugggcuggggaaaagacaacucgucucguccccuuguuuaucacaucaaagaagggaaaaagcaagagauggcaagggacaaucaagccucaaugauuauauuuauagagcagcuaaggguuugcagccuccucuccaucuucuggcucuaggacacagcuguguucuggggcugagaagucucagcacaggcuccuccucacaguucuagcuacaaaugaacugccggaugaacuguucuaguuuuuccugauuguccaggcuggcaaaaguaggggacagguggagccuggggccugcagggcucggcgucugcugcagaaccugggccauggaagauaagccgugagugcgcucaccacagggacuguguacacauggcccaggggccaggccugucccccagaaaccugccuugagaccucuggccccuuagaccucaauguuugcgugcaaaugcugccgcaaagcagucccaauaccccaccuagaaagaugagccagugauuugggagaccaagaggcaggaaaccaucccaccuucuccaacccaucaccaaaucuguugcuggaagacaccaaguaaaucccagggucuuaaugaggcaccaucaggccagcccuguggagugauggggacauagcuggguuucccugagcuacucuauuggggugggagcagggggacagaagauggugacaguggcuccucucaccccuaggucucugaagguccagacagcacugauggcgagcuuuggguccgcacacucuggaaagaagagagaagugaaggcucuagguagggagaacagagagccacugggcacaggcuucucuccucuuguuuaaagaagcccagggagggauagagcucugacuggacagaagacuguacucugcagccugccuuccuagaguuggguugucacuguccugcagggggcagcagccaccagcaaacaccacugccugcaggagccugggcugacugguugggacucaccgaagaucccuucuuccugggcgguggccugcaggaacuggaacagcugcucuguguagcccaacucugcagaagagagaagaccuagaccuggcacccagcacagacacagccugccucgaggacugcaagggaacaagggccucaccaguaucgggcagcuggcccuggcggaggaaggcggcagccugugcaaaggccuugagcagcgggcugagcaggcggcagaggaaaagaaagaaaucugggcagugugacugcuggcugagcuggaggggacaggccggggugagugcagcuccccaccgccucccuaccaccucccuccaggggcagcuuuuugaaacacacccugaaguaccggccgucagccucuccgaagucaucacugucacuaucaguaaaguccccacucgguuuccacagcagcuuucugcucaaucgcugucgcccugugucacaggcuggccgggagccuggggucuaggggccguggagccauuguucucugacaagcuggccagggaucaacccuacacccccagaccagguacaugcaggugaaaccaguaaaagcagaccuagagacccaagaggauggccagagccaugccccagcaccugcugggccaacuugcagagugagaggaagugaauucccacccucaagggcaguagcccuguggccaagaaauguggggagcaggaggugugcagagaaccucagaggcacacauguccagugcuauccagagagacacacagaaccggggcauagguggcuauaucccaaggcacagggagcagaggugcgagcuaggcuuccccgcugcaaggccaggggcugcccacccccacagcacacacggggcagaggaggagccuggggcagcuggcacucagggugggaggcuggaggaggccaggcuccaggcaaggaucuugucuccaacugcccugccuaccuccucagcaaccaggagcccgcauuggaugagccgguccagcaccuccugacaguagcaguaggaagacuggcagggcugggagaaaaaggcacccauguggccucaggagagccaggcacaugggcaggggccuagccaaagaccgggcaaggccacaccuacuacccaggagguuucagagguagagcaugggcagggaugggccauuccuaccaccaagaggggaaggccuaggaccaagugggccguaggggaggccugaccuuuagcagcagcaggucuugcggcagcaggugcaucagcagcaggaucuggcgguacagcucauucuggcucagcagcaauaugcccugcagcucccagggccccuggggcggcacucugccugccagcagcccccgcacugcacaggcugggggcggaggguccauuaugaagaaggagccguucccuucaccacugcacacacaucccaccuaccccgugcaccucaagacucaccgcccacagccucgcucaggaagacgggcagcagcucagcacucaguugugccaggugugugaggccugggccaggcugcggcaccaccagcaagucacccugacggaugcgcagcagggccacgugcgcccgcagcaggcucagugagugcugcagcaggcuccgcagcugcccagagaagccuacaucaaagccacgcaacaguaucuccuccgucagccaggagaacucccccaggagcugcgacaggaacacacccugggugggcagagcagggcuaggcagcagggccacacaucgccaccccccccaccgcccagguccccaccacauugcacccccuaccuucugaugcuugaagagcagcagcguugccauaauggccgugcucaucaccgcagagcucccuacacuggcuggaguggggcgggggguggagaugcuggucagguugaggcccagcagccuggucccuccaugaucuagcaagucuuccuagccacacaucccaacuccaccccagggaugaggaacguacacccggagcagugguguuuaucaucacacaggcugagagcaggccaggagcugggggccuuccccuggaucucaucguagggcccacacaucaacccacagccucuacuagaggggcacugaagaagauacagauggaucucccuauaagggcccucuguggaggcgcugugcuaagccccuuacacguaucauuccauucaguuaacaccaucuccacccaaagcuaaggagacuccgcucagaaggcagggcuggguguggccuuggggaagcagcugcagccuccuggccucaggccaccaucuuugugcaugcacuuagcugcucccuuaugauggcccuggcugccugcuccuccuguaggagaaggguuccauucuucuucagauguccccaagguaucacagagcaccucaggugcagacacuuggaauggagaacccuggugacuggcugaccccgagaggggacgguucagugacccacccgcaaaggcccagaucugguucacccucaccacucaggacaugacagcucagucuccugaccaggagcugguccucuuccuugagggccaggagaggcccaguuauggggguccacuccugcuccuucucagugucugggacagcaguacugagauagagacacagauuacaggaugaaggguccaaacacaaaaacagcugugggaaugccuagagcuuucuaaaaggugaggguguuucccccucccagccccaggacagaggauggcuucuauaacccccagucccauccaggccucugugccauaccccacacucagacuguuggcaaggcgaguaccuggaacuauucuagaugaccccaggauacuuggugagggagggcugcuaguguguguauaugggggauacauaagcuggugcugaagggcugcuugccuugcccccugagaccccacgcuccugugccccuaccauuggcccagcacgaugggcugcaguagcugcuccagggucugucugccgccccagcagcuucuggcacugacgauguauuccugcccaagagaaggcucuuagguggccugcucgggcccaccaggaaacuugcacacagcccacuggaaguaggcaaagcuaucccugcaguggcuuugagggccaggcugccaggaugccuaggacagacaccccagguacucccagccuuccccagcuggcuccauaccugcagggaaaagggcugagcuaggugcacccgggagcagauccgguggcugcagccccagcggcuccacaagcuacguaggacagccagagcuccuguccacagccccaggggggccgaggccugcaaggagggaaaggauaacuauacucgccgaggacacugcucucgggcggacaucagggcugcccacccauccuggucuccagagguauccucuggucccacccugcucaguuuuaucucaggcccaaacuggugcgugaccuugucccaagcuccucuuuccuuauccaugacacaggaaaaaucccucccuaucaaggucuucagaggaugaaaugagaugaugguaauggccuugacaggugcugccagaugauuguaaggacgauuccuuugugccccccacagcccuaaguggggcucagccacaggacacaauauugugccuccuaucgggagcugguguccaccuaggggcccaaggggcuggaaggucucacauucucacauggucuaugucacacggugcauccggaaccaggucauaggugacggccacugguaccagcagagcaucugggacgaugcccaccuggacugccugcaccacaaaccccacccaagccuggcccagggcugacagccguggccccagagccccaggagguuccuccaggaagaugagcaggggcugcccacuaaccagcagcugcucuaugaccuggaauaggaggggucagaggggguguuaaggccagagcagaaacagaccccuguccccuuagccuggcccauauguaaccacugggggcacucaccgccuggaccacagcccuggcaaggagccccucagagcuguccagggagaggcuggccucugggggcaggaaaagccccccaagcuuccucagcagagcucugugggacauagggcagagccugauaaggaaaggggcucugaagaugugaaugaguaaggggcuagugagagucucagcucccccauggccagccuguguccuacuugaauacccugaggcaaagccauggcccuaggcccuguggcugacaccuccaucuaagccccacaggcuagacugcuguauggcucggagcagagaggccacgaagagggccuuuaguagggagcugcugccaacacaccccgauacacaccccgccccagccugcgacuucucccauguaugucuagaggcaaaagguuuuuaccugagggcaggggagcaggcgcgggagucccaggccacacgaagcacacccaggcccugggagagcagcauaaagggcagcaggaucccauccaggaggguuuugugaguagagaggaggacaagcggcaagcccugcuccggggagagccagagggaagugccaaccugccccacccugaggacacaggcagccaaagacccagggcagccccagagggagggacaguucagcugcagaguucuuccucugagcacauuucccaaaagcaaaggagccuuuagacaacucuuaagguaacugcaccgacgcacugacgucaugguuguuaagaccaugauggaaagacguuagaggaagccccaugggagcagggccgugagacauaagggaaggucggcaaagagcaggggauuuuucccaccagcugauggggacuggacugcuguauggcugggaacagagaggccaggaagcaggaccagauggggacugcuccugacuuaagggcuuggcccagccucugcucuucugcucccaccauccccaacccaauggagggcgggccuuacugccugggcggccuucuggaccaucuucaucugacccuuguggagcugcacauucaggaacaggcaguucaggaaccucagcagcgcccagcugaacagccuggggagggacaccaggccugaggugcggcaaggagugacgcucggcccguggcacuuggagggcugcccagugcuccuuagggcaggccccgccacuauccucauuuuacagaagaaggaaagugagacucagggaagcuacagaacugcuuccugguagugaacgcuaagaaguagcagugcugggacuggaaguucugacaccagaguucaugcccaccagacgcugcuacucucccacgaccucaugguggagcugccucacaucagaaucagagcaucugccucaauuuacccuaaaggagacuagaggaccaagccucucuccaggcagaacccagccuggucuucacaaucuaccagaaaaggugaaauaaaaaggaaggauuaguaauagaagaaggaaaggggauaacugcaggggcaaaaucccuggugggcaggugggugggguugucccugcagcccaacaggaggaccagcucuauuuauuuuuuaggacagggucuugcucuguugcccaggcugaagugcaguggcacaaacuuggcucacuacaaccucugccuccugggcucaagcgauccucccaccucagccucucaagcaucuaggaccacaggcacgcaacagugcacccggcuaauuuuuggagagacaaguuugcccuggcuggucuaugucgcccaggcuggucuucagcucuugggugauccaccccgcucagccucccaaagugcugauauuacaggugugagccacugcaccggcauaggaccagcuuuaauuuaggacagacacauagcuguaguagcagggaaaugugcuggauaagcagcaaguccccaugugauggcuuuuaucuuucugugaagcaugagauggggaaucaguugacaguggauaagucuaagaaggagcaggcugggugggagcccuggagagugccaugugucccugugacauuugcacuuagcaaggaaaccaguccacugguauguguuucucuggcaacgcugggcugcucaggugcaaagagaagguagacagcggggggucaugcccaugacucccucgaaagagcauuauuagcaccccgagccugcaaucugagcuaggcuuggagggaaggaaacacagaaagggaggcugauggcugaugucaagguaggcagaucaagagacuagaacagcagagggcuggucaaggucaccaacaaccucuacuuucuguccuugcucaguuggccacucagcacauucaagacagcugagcuugacacaugcugcccccaagcccaccuguacucagggacucauucaucuccuuggcuuuaaacaccaucuguaugcuaaagccucgcagugucucuggccccaaccucucuucugagcuccaggcuccuauaugcagcugccuccucagugucuccacaagcaugucagguaccaaaacucucucucuccaaacuaccuuuuugggccaacucacuucucccaaagccuguucucuguccauaccaccagaaaguaggcuagaaacggggcuguccuguaacuucuccuacuucccucacugccccuguucccacuguccaaucccucagugaguccuguuaauaucaccucgaccucucaauccacuuuucaaccucuacuguccaccaugaucucucaccuggauuaacaaaacagccuuccagaugcccuucuggucuccacucuugaccccaauucaugaugucacuucccacuuaaaaccuugcaacugguuuucacugcacuuggagauccaguccaaacuugcacggccuuacaugauuugaucccuucugccucucgauuucaccucccacagcucucgaccccucacuugcuggcuuccaaccacgucagcuucuggagcaaaccuaguccuuuccugcccagggccaaagcucaggcuauucccucuagcaagacuguucgccucauucuuguucgccuuuucuuccucuuggcucuggcuuacaggcucuuuguccccuuccugguauucugucucagcccuguuccuuccuccuugcagccgcgcauaucucguuuacccuccguuucccuggaacagugugcugcaucuaacauaggcuccaaccugugcuggcaaaauguggggaugggaggcgguggugaaggcaggcugcagcccacucugguaaacacuauccagcaacccaggaggagaguccagcacuuccccaagcccggccaacacccgcucuccagaaggacagaguccccagcccaagggugagugcccuucagcccaguuaccugaccaggaagggacgggguggggccuggaugugacccaggaugcgcuguaccuccuucuucacaaggucaggcaccuggccuuccccagugccuccugggacccucccugagaggagguucugcacccugugaggggguuagaaggagugcuaugaggcugcagcagggcacagccuccagucuucacucuccuccuuaaggaaggguuccaggcaaagcucaugcucuagaagccuugccccagccaccccucucaaacaccccuaccuagugucauugucaucccauucaggaucccagaaaugccagccagaccucacucccugccuccucacccggugcuuuccaugaucuucugugggacauccuggcagggggggaugugcugcuccagggaccacaggaaauagcagagccuccgaaccagccagccccgaaaccugggcacagcucccagagcaggagggaagauccuucagagagggcccaccuccacuaggacucacagaaggcuauucaaucagaaagggaccacaccccagacccauguacuaggaacaccugagcaggaagagcugccuguccaucugugccccauucccaccccucacccuguugagucggguacagguucacagccugaaacacggugggcaauccauacaugcucacagaaggaacugcaagagagcuccaagucugccccucccugcaggcuuguguauggaacagaggacggggcccuucuuucucuaucagaggaagaaaauggcaccaaaaagcagggccccagcagcccugcacccaagggucccuguccccaagccugcuccaguccauagcucugacuaccuuguguucuccuccuucaccaggaucacauugcagaagccuagguccguuaugcuucuguggaagagggacuccugcaagacagggggagagacagcauguccuggggggccuuugcaaacugguaaagaaacgccccuguacugccccucuggcucugccugguggccugcuaagucuuccaggagaaaagauuacagcacaguauuucacaaaagguguuugaccccagauucuaggcuggcucaggaaaaaggggcccaugcucaaaacugaagugcuguauccuguacagaaucacccucuuucagagugguauaugaaagucuccagaaguuaucuucucaacagcagagaaaacgcagccugggucuccaugagaaaucugggcucccucaccaccaucacaugacacaaaccaaaaaagaggucuucaagcaugugcugagugcuggggaagucugagugggugauguccacaaaacugaacaacaaaacugacacaggcaugauaagaacccagcccucugggcacacccuaccaccacuuaggccccucuguacuucucccacccaacucucccaggccugggaacaagccaccgcccaaccauacaaccaauaccagugcauccauuccccugaaagacagaagcagaggcauggggcagggaagagccaagcuugcagggacauaaaggaagcagcuucccagagcuucggcucccagaaccaagcuuccugcuuggggccuggcccuaccaucacucacccagcucuugggggugcaggucuggcaacagcgacccacaaaggggcgauacuuccccaggaauggagugacagccuccagcuucaucccaaagccugacgaccacaggcuagccuggaaagggcgaugaggagagaugagaggacucaaaguccuuggcaggagagagggaaagauggagcaauggaggcucuaggagugaggggcacagcagaagggguggcagggcagagaggauuugaggaaugggaggagccacauuaccucucggccacuggggcugcuccuuggcugaguuuggcaucugccuuccaacaugguggccaugagagccuagaagaaccaugaaccagucaccucuggcacucuccuucuccccacagaaaccugagccggggaaaggugcaaggauggagccauaagaaucugagccauaauccagggccuccugcgguaacugcaaccccccaucacaggacagacagacaucacuuaggccauuaguggugaggagaaccuaggcuggaaacuaggggcuggcucaggucaaggcccugccccacacccaacugaucccacaaaggagccagcuguccucaaaaggucucacaguauccaggucagggcccuccucgggccaacaugagggggaucgguugucuuagcauccacacccacccggccaucuccuagcacagaugggggcuguaccggagaugcugauccuuucugugcagagggaaagaaugagggcuggauuggaaggaaggaggcacaagacugccaaggaggaagaagacuaucgccaugaggccaccagguccuacucagcugcccuccccuccucaccaggagacagcccuguaaccacccaaacauuacgggaaugugggcuggcuaauagaagagggacaacucagggucagaacacagaggccuacucaccaggaaugagcaucuaguuggggacaaagacagacuuuuccacaaucacuccccucucacauuaacguucuccacagaagacgccacuuguaucuccucagccccuccuucccaccacaauauuucccugaacuaauaaauaccuauguuccuucaaacagcacugaacgacuccuggcucaaaaauuugggccuaaaagccccucuucccuauuugucagcacgacccugaugagugggcuggucuaaucauguuuccccaucccuaccacacuucgaucaggcccaucuaggagccucucccuucccagccacccacccaauucugcccaggguucuaaguccacgaugcuucuggaacacccucuaagcccucccucuccuccuuggguuccccagcccaagccugcccggcaaagagccauucgaagcccuccuccagggcuaugguuucaucucccuacguggucagaguguccugagggcagggacucaucucuguauguccagcagucugcccggugugcaagagggaaccaggaagagccagcugacccacaauaacuuccucccaagaauucuccaggcgcguuccuccuuuccccagucagcucgguuuccagccaggaagccaagcaguaaugggaucaggaucccugcagugcccagggucucgggggccacgggaggcucaucccaaaggcacucuguuaucuugaaaauguugcauagcccuguucacagacacaugguacaggaaggcuacaaacccacgcccgcuuugcaaggagggugucuguccccuagcugcagaccacccccaacccccaaaucuaaccccauuaggucugugcuagcucuacggaagcagagucaaagccauggcaagggguuauucccaucugccaguuaacaacacagcucaggacuccuacagcagaggaugcaaacuggcaccccgagggcaaauucaacucauagacacauauauauacacacacauauauacauauauaauacauauauacauauauauacacacacauauauacauauauaauacauauauacauauauacacacacauauauacauauaauacauauauacauauauauacacacacacacacuucuuugacuacacaacgugcuaaaaccuuaugauguaaaaccaacguugaacagcagagggcuuguuacauauacauuuuuugaaaaucaagguuuccagucgcggcuguaauggaaaaagcugagcucuggcaucucugagcacacaccccacagggcucagcuggccgccacugucccuuuagcccgacagcaggagcccucccguuugccuccaccuugauuaucacugacgccugagccugugcacaucugagcguucagcccuugaucaaggguaaaacucuaaaccugcccccacguuuggaaugcuugugcccuacagagagccgcaagagaacuucaccuucccggcucugcucaaacauggccucggcgccccacagcccccgcccagggccccucaggccucagcuuccucgucagacccgugacaggcgcuccccgagcuaccccaagaugugcgaagggcaccugcccgacaucagguccuggaugcccucucuggauguaggggaacgggaugccgaggaagaggcaaagcggggcucuccacaacaccacgccccacaaggacucauucccgccacaagacccgcauggccggcacucccucccuuucgacuuccgcccaguccccaacaggccgcucagaccaggcucuugaagcaggaaagccccuggaugaucccgguccccuucugaccuggccucgccggggagcgaccaccgcgccucucaccucacaccagcuuccaacucccgccaaagcagcagcuccgcaaagccgccacaaggcguggacugcucaagggaaggagcggauugcccaccuccgcgcguccggcuaaaaggcagccccgagagccaauugggaugcgcgcugguccagaagccccgcccugcgucccguacucugcgacacucaacguggccacgggacccgugcucuggggauggccugcuccguuuuccagucggcccuggcccgcggugggaggggaguacugcaggcggccgcgaggccccgggugcuugagcuucgagcagggacucaggccagauucugauuaaagaaguuaucccagggcuuacgcuccuccaagcugggguucggcucuagcaaaauucugagcuggggacgauuagaaaggagagaagaucaucaagagacaguugcagucaugaaaaacaagucaggccucccagugucauuuccuuuguuaaugugaagccuagaccaccgucagggaccuccagcagccgcgcggugcuaagguuucagcugggccuguggccgguguguucauucgugugguuauuugauuaagaccugacuccugucucggcccuaagcuccgcguaaacaaagaccuuauggguucauucauguuguaacuguguucccagcacccagcaggagaccagccagugggaggcaagcaguauagaacagaugaacgugcgaaugacugggcucucuguuccugcccccauggaaugagcccgccugacaugccagaggauuccacaguuccagagcaugugacacacgugugccggagcaaagccacacaugagccuggcggggcccaagacagcacagaacguguucacauccucccucgucucugacucaccagcccugaugugacucccacacccugccccuccgggauguagccuuucucucccuuugugccauuucgugucuauccaggcugugugugcauccacucaccuucauugggauuugcaacguccucccgguaccugcagaauccauuuuguaccccaucuuaccguucuuuuguaucagggugccuguccacaucgagauccugagacucugacgcugaaaaacgaaaaauauagacuuucacuucgaaguuguaaguugccuccuaagagugcagacuugaauuuaccgaaggcugacgccucuuaguucugggaacaccaucuguacaggcagccgaguuuugccguugugaacacguccccaccucuuaaggaguucucaugcugagaaguagccccaaagcagagacuuuagacuagaagguugcauggauugacuguagagacgaggcgcagcaucucagaguucagcugucagaugugcugcuucuuuggaagaaacguauuuuguuauggugguggugguuguuugcugcaauuuggacauuugaaaagaagcaucccucucagacccagauugggucugggaccgaggacucagugugcucuuucucccucaagcaguuugcaggagaggcagagcugcagugcagcaagaccuguaggccagcugccauacacacugauugugacugacccgacccugagagaaacauaaacugauuugagcugggcccugcccaaccuggacuggacuuggugagccccauccuggacucaugccagaaugcauuacccagaauauccugaugcaccuaacugacugccugcgcccagagggacaaaggcccucccuguggcugggggcagguguucccugaaggcacugacaggccuuucuccuguauaucaccuggagaaaaggacuugagcuggcauuagaaugggcagaggggcucuugccagucugucuggggaccaccagcggggcagagaaaaggagaugugauguuuaauuuuaggugucagcuugacugggauacccagauacccagagagcuggcaaggcauuauuucuggguauaucugugaggguguuucuggaagagacuggcauuugaaucacuggacagaguaaggaauauucaccuucacccaaugggggcagacaccauccaaucgguugagggccuugauagaaaaaaggcagaggaaaagagaauuugcaugcaggcucucucuuucuucccuucucucucucucucucucuucccuucucucucucucucucucucucucucucucucucuccugcagcugggacagccaucuucuccuacccuuggacauuagauccaggcuuuggguucuauaacuuggaccagcagcacccccacccacagguucucaggccuucaaacuuggacugagcuacaccaccagcuucccugguucucuagcuugcagaaggcauaugguggggcuuuucaacuuccauaaucacgggagccaauucccauaauaaagcucaucuguccaucccccuaccuauauucuugguucuguuucuccauucuaugcugugguuugcugcaauguugaacaagacuuuauggaagauuccggaguaauagggaucuacaacauagacaccaccaaugguuaccucugaagguggcugugcucagaacaccugggccugggagggaaagggaugucucagagggaggcaugucuccuccguuaguuaggguuaugaggaaauucacuuuuccauugccuuuuguucuauccaggcccucgacugauuggauggugucugcccccguggggugaaggugaauauuccuuacucagucuggagauuucaaaugccaaucucugaggaacccugauuaaaggaggagacaugccucuuucugagacacccuuucccucccaggcccaggugcucugagcacagccaccuccagagguaaccauuggugguacucuauguuguagaucccuuccguuauaccagaaccuuccauaaugucuugcuaagcacugcagcaaauggcagccuagaauggagaagucaaauaugggugcuaguggcaggagaaugggaacauugaugcugggaagcugccaacagacacugaccacacaugccacuuuccucuggccaaggcuggcaccacuucuauagaugaaaacuugagccaagaggcugggauagagugaguggggaacccgagauccuuucuaauacuggggaucugggauucugugaagaccagggacagcgugagagauucaagggcugacaaccugagggaggagggugcugcaugcuacaguguucuguccuccacaucgguaucuucaacaccaacuugggggaugacacagaaggcaggcuuggccuucuagcagaugucauaaaccaauaaggaauaaaggguacuuacugacagaaucuggauucaaagacaauuugagaacaggggaauuaugaucaaaauaagccccaaccugaaagagugugguggaaccugaggggaaaguuccguagagugggcagagaguuggauuuguugguaggggcucuguccagugguacucuuuguuuccacuuauuccaacucaaguaugcauaagccaaaagcucauggguuggcucacauaacgagaaaguaugaauguguuaacucuaggcauggcuggaccuaagugcuaaagcaacauugucaggccuccgguucucucucauguguccauacugcuugucucugcuugguuuuguucuuccugaaggcucuuuucuauaaaaaccugacugccaaccgcccaagacuuauauccacccuccucaucaaccuuaguaggaagaaacuucugucccucaacauacacaugaaaccccagggaagacuccgguacugcaaggaucguccucauacccucuugaccaaucccuguggcuaggggguguggcauguccugauguagugacuggacccacaccauugcccccuuuccugucuuuggugagggggcaccaugauugaccagccuaggagaaacggagugcacgggguugguuuucucagggaauggugcuggcugacaugaacaacauguccaccauggugucuaaugcugacuggauccauuugaccauuugucuggucucugccacaucccagggccaagaagcugcugcacugugaggucuggauaaauguuuuucagguaaugagugaacuuccuucucuguggaccuuagcaggagaugacuucuccucuucucuugaauggggaugauaaucugucuacuuacuugacaauguugagguguagcucagucaagucaugagguagacaggcugaaugaagcacaacaauccucccaauccccgggacaagggggaagcagccagugccgccucaugaugcuggccgggaggguuggcccaugcuagggaaagccagaaguucuguugcucuguguccccuugccccuugccccaacuucccaccauaccugcuuccuccaggacaccugguuucguccacccagaaaacauagguucugugacaggauguuuccucccucuugccaggcguggcugggaauggaagcagugaugcugaagaauauuccaggcccacucugucuuccucccuggagaucugcucccuagcauugauugagcaacuccaucaauugccgacuaauugguaggugggaguagaauggggguguagauacuccccagguaaagucaucuccugcuccugggagggguggccugauauauggagaugucaguucucccucaauucauccaucacuucacuguagucccaguaaagauuccaguuuuagaaacucacucugaaucaugcgaggagggauaaagguccacagaugccuaagccaaaggaggguaggcaggaagcucuuccagauacucagguacacucuaaaggugcuguuguugucuuaagcaguauggugacagugaaccaacagacaacucagcauggagaggggagaucccugguuagagggaaauuucaucuaugauaaaaggugcaucacaagucagugggaaagaguugcuguucuuguuggaaaaacucuuacuauauggagaaaaacaaugugaucccuuauaagauggaugcucagaugauggauuaaagaaucauacauugauucuuuuuucauucuuauacuuuaaguucuaggguacgugugcacaacgugcaggcuuguuacauacguauacaugugccauguugguuuggugcacccaucaacucaucauuuauauuagauauuucuccuaaugcuaucccucccccagcccuccacccaccgacaggcccuggugugugauguucccugcccuggguccauguguucucauuguucaauucccaccuaugggugagaacaugggguguuugguuuucuguguuugugauaguuugcugagaaucaugguuuccagcuucauccacgucccugaaaaggacaugaacucauucuuuauaauggcugcauaguauuccaugguguauaugugccacauuuucuuaaucuagucuaucacugauggacguucggguugguuccaagucuuugcuauugugaacagugccgcaguaaacauacgugugcacgugucuuuauaguagcaugauuuauuauaauccuuuaguuauauacccaguaacgggauggcugugucaaaugguauuucuaguucuagauccugagaaauuaccacacugucuuccacaaugggugaacuaauuuacacuccuaccaacaguguaaaaguguuccuauuucuccacauccucuccagcaucuguuguuuccugacuuuugaaugaucgccauucuaacuggcgugauaugguaucucauugaggauuugauuugcauuucucugaugaccagugaugaugagcauuuuuucaugugucuguuggcugcauaaaugucuucuuuugagaagugucuguucauauccuucacccacuuuuuggugggguuguucguuucuuucuuguaaauuuguuuaaguucuuuguagauucuggauaucagcccuuugucagauggguagauuguaaaaauuuuuucucauuuuguagguugccuguucacucugaugauaguuuauuuugcugugcagaagcucuuuaguuuaauuagaucccauuugucaauuuuggcuuuuguugccauugcuuuugguguuuuagucaugaaguccuugcccaugccuauguccugaaugauauugccuagguauucuucuaggguuuuaaugguuuuaggucuuacauuuaagucuucacuccaucuugaguuaauuuuuguauaagguguaaggaagggauccaguuucagcuuucuacauauggcuagccaguuuucccagcaccauuuauuaaauagggaauccuuuccucauuucuuguauuugucaaguuugucaaagaucagaugguuuuagaugugugguuauuucugaggccuccauucuguuccauuggucuaugugucuguuuugguaccacuaccaugcuguuuugguuacuguagccuuguaguauaguuugaagucagguagugugaugccuccagcuuuguucuuuuugcuuaggauugucuuggcugugugggcucuuuuuugguuccauaugaacuuuaaaguaguuuuuuccaauccugugaagaaagucauugguagcuugauggggagggcauugaaucuauaaauuaccuugggcauuauggccauuuucacgauauugauucuuccuauccaugagcauggaauguucuuccauguguuuguguccucuuuuauuucguugagcagagguuuguaguucuccuugaagagguccuucacaucccuuguaaguuggauucccagguauuuuauuccguuuguagcaauugugaaugggaguucacucaugauuuggcacucuguuugucuguuauugguguauaggaaugcuugugauuuuugcacauugauuuuguauccugagauuuugcugaaguugcuuaucagcuuaaggagauuuugggcugagacgaugggguuuucuagauaugcaaucaugucaucugcaaacagggacaauuugacuuccucuuuuccuuauugaauacucuuuauuucuuucuguugccugauugccuuggccagaacuuccaacacuauguugaauaggaguggugagagagggcauccuucucuugugccgguuuucaaagggaaugcuuccaguuuuugcccauuuaguaugguauuggcuguggguuugucauaaauagcucuuauuauuuugagauacauuccaucaauaccuaguuuauugagaguuuuuagcaugcagggcuguugaauuuugucaaaagcccucuucugcaucuauugagauaaucaugugguuuuuguuguugguucuguuuaugugauggauuacguuuauugauuuguguauguugaaccagccuggcaucccagggaugaagccaacuugaucgugcuggauaaacuuuuugauucaguuugccuggauuccguuugccaguauuuuauugaggauuuuugcaucgauguucaucagggauauuggucuaaaauucaauuuuuuuugucgugucucugccaggcuucgguaucaggaugaugcuggccucauaaaaugaguuagggaggauucucucuuuuucuauugcuuggaauaguuucagaaggaaugguaccagcuccucuuuguaccucugguagaauucagcugugaauucaucugcuccuggacuuuuuuugguuuguaggcuauuaauuauugccucaauuucacaaccuguuauuggucuauucagagauucaacuucuuccugguuuagucuugggaagguguauguguccaggaauuuauccauuucuucuagauuuucuaguuuauuugcauagagguguuuauaauauucucugaugguaguuuguauuucugugggauugguggugauauccccucuaucauuuuuuauugugucuauuugauucuucucucuuuucuucuuuauuagucuugcuaguggucuauuuugucgaucuucucaaaaaaccagcuccuaguuucauugauuucuggaagggguuuuugugucucuaucuccuucaguucugcucugaucuuaguuauuuguugucuucugcuagcuuuugaauguguuugcucuugcuucucuaguuauuuuaauugugaugcuagggugucaauuuuagaucuuuccugcuuucuuuugugggcauuuagugcuauaaauuucccucuacacaguccuuuaaaugugucccagagauucugguaaucgugucuuuguucuuauugguuucaaagaacaucuuuauuucugccuucauuuuauuauuugcccaguagucauucaggagcagguuguucaguuuccauguaguuguauggcuuugagugaguuucuuaauccugaguucuaauuugauugcacuguggucugagagacaguuuguugugcuuucuguucuuuuacauuugcugagguguguuuuacuuccaauuauguggucaauuuuagaauaagugugauguggugcugagaagaauguauauucuguugauuugggguggagaguucuguagauggcuauuaguuccacuuggugcagagcugaguucaaguccuggauauccuuguuaaccuucugucucauugaucugccuaauguugauagugggguguuaaagucuccaguuauuauugugugggagucuaagucucuuuguaagucucuaaggacuugcuuuaugaaucugggugcuccuguauugggugccuguguauuucggauaguuagcucuucuuguugaauugaucccuuuacacauuauguaauggccuucuuugucucuuuugauuuuuguugguuuaaagucuguuuuaucagagauuaggauugcaaccccugcuuuuuuucccuuuccauuugcuugguagaucuuccuccaucccuuuauuuugagccuaugugugucucugcacgugcgaugggucuccugaauacagcacaaugaugggucuugacucuuuauccaauuugccagucugugucuuuuaauuggagcauuuagcccauuuacauuuaagguuaauauuguuaugugugaauuugauccugacauuaugauguaagcuggcuauuuugcccauuaauugaugcaguuucuucauagcaucaauggucuuuauaauuuggcauguuuuugcaguggcugguacugguuguucccuuccauguuuaaugcuuccuucaggagcucuuguaaggcaggcuugguggugacaaaaucucucagcauuugcuugucuguaaaggauuuuauuucuccuucacuuaagaagcuuaguuuggcuggauaugaaauucuggcuugaaaauucuuuuaagaauguugaauauuggccccuauucucuucuggcuuguagaguuucugcugagagauccgcuguuagucugaugggcuucccuuuguggguaacccgaccuuucucucuggcugcccuuaauauuuuuuccuucauuucaaccuuggugaaucugacaauuaugagucuugggguuguucuucccaaggagugucuuugugguguucuuuguguuuccugaauuugaauguuggccugccuugcuagguuggggaaguucuccuggauaauauccugaagaguguuuuccaacuugguuccauucucccugucacuuucagguacaccaaucaaauguagauuuggucuuuucacauagucccauauuucuuggaggcuuuguucauuucuuuuuagucuuuuuucucuaaacucuucucacuucauuucauucaacucaucuucaaucacugauacccuuucuuccacuugaucgaaucggcuacugaagcuugugcaugcgucaugaaguucucgugcccugcuuuucagcuccaucaagucauuuaagaucuucucuacacuguuuauucuaguuagccauuugucuaaucuuuuuucaagguuuuuagcuuccuugcaauggguuagaauauucuuuagcucagagaaguuuguuacuacugacuuucugaagccuacuucugucaacucauuaaagucauucucuguccaguuuuguuccguugcuggugagcagcugcgauccuuuggagaagaggcgcucugauuuuuggaauuuucagcuuuccugcucugguuucucuccauguuuguuguuuuaucuaccuuuggucuuugauguuggugaccuacagaugggguuuugguguggauguccuuuuuguugauguugaugcuauuauuuucugcuuguuaguuuuccuucuaacagucaggacccucagcugcaggucuuuuggaguuugcuggagguccacuccagaccuguuugccuggguaucacaaggggaggcuguagaacagcaaauauugcugccugauccuuccucuggaagcaucaucccagagcggcaccugccugugugaggugucuguuggcuccuacugggaggugucucccagucaggcuacacagcggucagggacccacuugaggagguagucugucuguucucagagcucgaacgccaugcugggagaaccacugcucucuuccgagcugucagacagggacguuuuaagucugcagaaguugucugaugccuuuuguucagcuaugcccugcccacagagguugagucuauaaagguaguaggccuugcugagcugcagugggcuccacccaguucaagcuuccuggcagcuuuguuuaccuacucaagccucagcaauggcagacgccccuccaccaccucccacaaggcugccaccucgcaggucgaucucagacugccgcgcuagcagagagcaaaggaccaugggcaugggacucacugagccaggcacgggagggaauuuucuggucugcugguugcuaagaccaugggaaaagugcaguauuugggcagaaguguaccguuuuuccagguacagucugucacggcuucccuuggcuaggaaagggaaauccccugaccucuugcacuucccaggugaggcaaugccccgcccugcuucggcucacccuccaugggcugcauccacuguccaaccagucccagugagaugaaccaggaaccucaguuggaaaugcagaaaucacccaucuucugugucaaucucacuggaagcugcagaacggagcuguuccuacuuggccaucuuggaagugacuaauugauucuuuaauccguaaucugagcauccaccuuauaugggauugcuuuucacgaugaccaccaugaauagccagauuauaacauguuagaaaacaaaacacacaggggaacuuaccaaaaggaguagaagauuucuuagacaaaauuucaaagcagaaaccauaaggcagaaaaaguggaggggauuucaugauguuacaaucaaauagaucuguugcaagugacacauggcaaaaugagagaaguuaugugcagucuaaaacugacaagagauuaguggccucaauauacgaggaacuccugaaaauuaacaagaaaaauaaauagacaaaggacacgagcaggcaguuuuugggagaggaaaccccaaaagccaggaagcauaugaggaaguggcuaagaucauuaguacagaaauacacauucuaacaauaagauauaugaggaaauaguucuccaaaaaagauacacagauggucaaugagcacaagaaaaggugcugagaaucacccagaauaagggaaaugcagaugaaaacuacagugagauagcacuucauacccacuagaauagcuacugucaagaaaacccgaaaauaccgaguguuggugaggagugagacauuagacccuugugcacuaccgguggguauguaaaauggugccgccacuguggacaacaacauggccauuccuaaaaaaaaauucaaauagaauuaccguaugaccaagaauuuccacuucuggacguauucccaaaaggauugaaagcaggauguuaaagagauauuguauauccaaguucauagcagcagcauucauaggaaccaaaaaguggaagcaaguguccauugauagacgaaugcaugaacaaaauguggucuauacaugcaauaaaauaugauucagccuuagaaagggagagaauccugugauaggcuacaucguggaugaaccuugagggcauuaugcuaaguggaauagccagucacaaaaagacaguauuccacuuacaugugauaccuagaauaaucaaauucauagaaacagaaaauagaaugauugccaagggcuggggcaaaaacggaaugggaaguuaguaucuaauuggacacaguguuucaguuucacaaaaguagaguucuugagauggauggugguaaugguugcacaacaaugugaaaguauuugauaccacuaaaguguacaauuaacagugguuaagaugggaaauuuuauguucugugugcuuuacuacaauuugaaccagauacaaccuuauacauacaugguaggcaaaauucucagcugaacuccaauaggcaagcacuucuguaauccucuccugguaaaugugcuucuaauuaauagauucuaacaaaggugaugaugugccauauggaaaaggggaaaagaauuugccaauguaauuaaagucccugaucaguugacuuuauguuaaugaaaaaggacaucauccagggugcaucuaaucaggugagcccuuuaaaaaaggauguaaagguaugagacuaucucuccugcugacauugaagaagcaagucuccuugaguucuacaaccacucggagaugaauacugccagccaccugaggcagccuggaaucagaucuuucuccaguggagccucugaugagaaugcagccuggccaacaccggguuacagucugagcagagcacccagcuaagccgagcccagaauccuggcccacagaaaaugggagaugaaaaauaaaugguguuuuaagccacacaauuuguguuaacuuguucugcagcuguagaaaacuaaugcaaucuuuuaggcaaaacuaaucuaggaagagacaaguauuggagcugggcacaguggcagaugccugucaucccagcuacucaggaggcugaggugagaggaucccaugagcccaggaguuuggggcugcagugagcuaugaucgcaccuguaaguagccagggcaacaagugagacccugccucaaaaagaaaaaaaaaaagaagucuucauguuggguggggaaguggggaaguugaugagggcacugcuuguggaguauagaccagagccaccauuguggagggauuuugaucaauaguaugcaucccuuacaccccugcuauuccauuucuagguagagauguaaaagaaauugacacagauucgucaaacaugcacaccaagauguucacugcagaguucuuugugguaguguggggaugggggcugcgggaggcacccuaggguuucuauccuggggagaauggagagacaaaaugggaaugguccacaccauggagaauuaugcagccacaaggagagaugaaaggcacacauagccacauggaugggccugaacacagggcugaguuuaaaaaggaagaagcaacaugggaacccaaacauuaccauuugcagacauuaaaaaacacauaaagacuguaucucuuuugaaagagcauuuuuaaagcagcacaggaggugggggaaucuauggggagcauguugcccaugcaggggaagggaaugggagugaguguggagauaaaagaauaaauaaaacaaaagugguuuuauuggaccaacaauaauucacugaguaguucagcgcaacuugaggguaaaauuaacggcaccuggaucuggggcagcugcagaggcagcgacguccaggccuuugugcaggggggcuaaggucacccgugcagguggggaaacaguaaaugccaaugaagcaggugugugugguauagagcaagcaagaaaggagagauuacuuuggccuaagagggauaucugcauuuauauuacuaaugaguuuccacuguaagccacagaaagcccggcucaaagcgauuuuuuuuuucuuugcaaacagaauuuauugacucaagugacuaaaauguccaggcugacucccuugggugggaaagaugguugccagcagggccaggcguauucucuccagcuaggaaaccagaauuguggaccucccuuucucagagguuuccacaaaagccccaaggcugguccccuuuggucagaaagagugacacgccugaacaaauccccagggccaggcccgggucacaucgccaccugcagacagcaagggcuuccagcagaggcauggcaugagcacaagcucguggagggacgucuuugggaacgaagcuggaaaagcaggaggugagguuccauggcugccagcucaggcgugaccuucgcugccacuuacucaacuuggaggcuguugguggauggaggagagcccuggagcauuuccucccagaaaggaaaugccuccagaagugccucccuccagguccuucucacugccaaaaagucccuuucccagagaggaaggaggcucaagggcucagagcguucucaacacaaaugacuguggggagagcccucgugggggucugggucauugcaagagggagcucauguggaugcaaaucuauauaaucgguugccaaaaaaguacugagccggccuguuuucauccuguaccaggcggccugcagaggacagaauguccacgcugucucuacagaaauccuuuccggccaagccccagggccuggggguucuccagcacuuaaccaccagcuuuccugcccugcccgcacaggagcagccaguggguggcugccauuauugucuccaggggcacugggggcgaugcugggcuggguagggcuguguggggcugagggcaguguggguucugagggucaggaaaugaccuuccuuuaugcacuaccacaacaccucccacaaaccacuccuccugcugccugggguuuugaacacaguccuggccucuuuauggcaguggcaggcagugugguuuuggaauggccagccugccacaggaggcagagcucccacugugccaggaggcagagcucccacugugccggcaaacaauaagcacuguuguuuuuccccagaguggggcugcccgguacuggucugugccugucucucuggagcaggaaaucgagcagagggaaauguguggauugguuagagugcugucagcugcaaggaacagaaaacccaacucaaaggggcuuaaacaaucaagaugugucuccugugccaagcagugcagagguaggacagcucagggcugguuagaucagggccgcaggaagccaacagggacccagguuuauuccacauuccaugcugcccuccucuucagugggccagucuguuuucaggccagcuucccucauaaucacaagacagcugccacaguuccaggcaucaccuccagauaugacaacacccagcaaaagagacucucuucuccuggauccaucuuuuaaagaguaagggaacuuuucccagaauuucacccagcagcucuuccaucaugucucacuggccagaauugcaucacagaccuauccuuagccaguauuugacagaggaaacaggaaagccaugacuggcuugaagggcauggacuaccccaauagcacaggguuuggaugcuccugcagaugcuccaacagccuucaccacaccaggagacagaaguucuucccaguuggagaucagcuuuauucaccauugaggaugugauguuuggagcuguaggggccaucuugcagcaauggggggaaauucaagaacaucucagacuugcuaacgccaugcuuugccuuuacugggccgugagacaauccugggaccacauagguuuguuacgugaguaaaaugaacuccuguucaaugaggccuccauuaguugaguuuucuuuacuugcagcccaacugacacagaguucaguuguucugggcaguggagggacaggaaaggcuccaauggcggccauucuccuuuggguucccauccucugugaugagaaauccucguaaaaaucacccaccaggacacugagauggccaaguuucugcugaccuuccauguguccuugcaaacuucagaggaaacuggacccugggcaaaaugaugaaauuagagagucccugagcccuucuucucgccagaaaacuccacccaugacccaaauucccagaggacauaggaaauuaucaguuauaauugcaaauaauaaagacuuagaaaccugacaagagggucuuaagcaaacacgauuugggguuuuucuauuccuugaguaaugagaagcccaaaggucaggauccaugauggucccacugcuggggcuguggugaggcuauaggggaccaggguccuuccagcucccuguguugacauccucaccaggugccuucauccucagggucacaaauaccugcugcuacaccuucaggcagaacuuugugccccagggaggaauauagggaaggggaaagguacagugaagagccaccaggcccaacaggaaagcaguagcuguccuggaagccccacucugaagaugccugucaugggcuguacuguguuguguaaccaccuuuggcuuugagggagaggaaggggagaauggcuguggacuagguagcuagcugcgucggccaccagguguggaguccggaaaccugggacucaacccaacacugcuuccugcugccuucaguaaccccaggcagcccaggucauugcugcagccucagcagccucuccugccuggcagaaagugggggaagagaacugccuccaugaggguuccugaaggccgggugcucacuuggccuucuccccaucuggggcaauggguccuagggcaagcaugggaaugggaaguguggcuuauucaaggcucuucugaugucaagugauagaaauugauucaacucaucuauagggaaaaagggcgggugauaauuaauuuauuucagacccaaugggcaagaggagcagucagaccucaggaaggaccugaccucaagcuagcaagcccuuggagacagaggcagccacuccuucuggcuccccggccccaggguugccugccucugcuguucuccccucacccacuauaccuucuuucccucuggauggaaagggguuucucagccucacagcuucugcauucccgugaacaaugggcugccagccucucugaauucguauuucacauuccuaggagagacugucugaugauccagcucacccugaugucugucucuuggccagucaauccagccaucgaguuagagcaguucccagaaaagaggggcuggaugaggcugaccagcacacugcaaaauugacuucaggggaggaagagaagcagaggcaggaggguccucuuggagaucugggggaaagagagacagggcauuccuuuaggacuugugccucaaagaccagugggaagagacagcugggugaggacaggcuucagguacucucauguguccagaucaaauauggcuuuaaccccucucuaagucaucgcaaaucuuuauuuugcaaagagcagaaaaucccauucaaauggcuuggcugaaaaagggaauguguggacccaccuaacugaaaagucagagccaggagggacucaggcaugguucgauccagagguucaacauuuacuugcaauauuuucucugcaaguuucauuuuguuucuguuuccaguucucuacaagucauucaucucuauuucuuugugagacaguuucauuugaggcuggcuuucccccuguggcacaaguggcugcuuuaugucagcauuucagugaaguccuuagaugggcucugaguggcccagcuuuugucacaugcccccuccugaacaaaucaacuucuguugggagggaagguaguuugccgauuggcuuggucaagucacagucucccuucuucucacccccuucaagaaggaaaucggcuucuuugggcucacaccaucccccagcagaucucuggacuauaaucaagaacagggagaaaaugaagcaaguguucccacaccagucauuuccaagagcuggccaguuagcacagaacaagaaaacacacgcacggggcacuggcaugugggcagcugaagaagggcccugaagauguacaaguccuaauuucuggagcccaugaauauguuagguuacauggcaaggagaaguuaagggcccaaaugggauuacggucacuaaucagcugaccucgaugucaggagauuauccugaauuauucaggugggaugugcaagagggagguaggcgaguccgcgugagggugcgcagugugagaaagccucacaacaauugcuggcuuuggaaauggaagggggcugugagccagggcaugugggcagcucagagaagcacagaaagagauucuucuccacagucuccagaaaggaacgcagccccgaugacgccuuugcuguagcccagugacacccaggucagagucugaccuccagaacugcaaaauaauagauguguguuguucugagccacugagcuggugguaauuuguuacagcagcagugagaaacaaaaacacggcauuccaagagcaggacuccgcauggcaggagugacagaguggugcccagugcaacggugugugacagaaauacaacaugcacugcaauggggaucuuaaguuuucuaguggccacauuaagaaagaaaaagaggccgggugugguggcucaugccuguaauaccagcaguuugagaggcugagguggguggauggcuugagguugggaguucgagaccagccuggccaacauggugaaacccugucuccacuaaaaauacaaaaauuagccaggaguuauggugggugccuguaaucccagcugcucaggaggcgaggcaggagaacacuugaaucugggaggcagaguuugcagugagccaagaucgcaccacugcacgccagccuaggcaacagagcgagacuccauguaaaaaaaaaaaaaagaaagaaagaaaaaaaacagguaaaauuaauuucaauaacauauuuuaacccaauauauucaaaauacuaucauugcaaugugucaucaauauacaaaauauugagaagguguuucccauucuuuuuaauccccaguuuuagaauucaguguauauuuuacacacagcacaucucaacauuucugagcuccuuuucagugcucaucaggcacacaugguuaguggcugcugcccuggacagcacaggccuagugacuguacuuuugguuguaaggguggcaguggcuggcaugaaccagaacagggguuuguuugugacaaugacaaggagaccgcuaaccccugcugaucuguguguccaguuuuauuucucuuuuuucuaauuuuuuuauuuccauacauacccugcuuguauaucaagcucuuuucuaaucagggauccucaaaugacaggaguugaccucugauuguguuugugcauuucaaagcccagagcugugaccucagccacggugggcaggaugggugcuggagaagggcauuaaggcucccagcuuugugggggaaauggcaucuucuugagugaguggggaagugcaaauagaauaugcacaagcuaggaaggacauuuuuaaagccugugcuucgaacauucuuccucuaaaggaucaggugagcuggcucagagcagggagccaaccgccgagccagggugagagggcuuuguauuuggagagugaaaagaauacgguuguuuaggcuuuggacucagagcaucagaaacucaggagaaaugagaucagcugaaaaagaaauggguuugauguuguagaccaaacaugaacaguggggaacaggcugaaaaacgaggggggaacagucagcagcuuccacggcu

SEQ ID NO: 13384 - RNA, 20207 nt, Homo sapiens
uggagacccaggcugcguuuucucugcuguugagaagauaacuucuggagacuuucauauaccacucugaaagagggugauucuguacaggauacagcacuucaguuuugagcaugggccccuuuuuccugagccagccuagaaucuggggucaaacaccuuuugugaaauacugugcuguaaucuuuucuccuggaagacuuagcaggccaccaggcagagccagaggggcaguacaggggcguuucuuuaccaguuugcaaaggccccccaggacaugcugucucucccccugucuugcaggagucccucuuccacagaagcauaacggaccuaggcuucugcaaugugauccuggugaaggaggagaacacaagguagucagagcuauggacuggagcaggcuuggggacagggacccuugggugcagggcugcuggggcccugcuuuuuggugccauuuucuuccucugauagagaaagaagggccccguccucuguuccauacacaagccugcagggaggggcagacuuggagcucucuugcaguuccuucugugagcauguauggauugcccaccguguuucaggcugugaaccuguacccgacucaacagggugaggggugggaauggggcacagauggacaggcagcucuuccugcucagguguuccuaguacaugggucugggguguggucccuuucugauugaauagccuucugugaguccuaguggaggugggcccucucugaaggaucuucccuccugcucugggagcugugcccagguuucggggcuggcugguucggaggcucugcuauuuccuguggucccuggagcagcacaucccccccugccaggaugucccacagaagaucauggaaagcaccgggugaggaggcagggagugaggucuggcuggcauuucugggauccugaaugggaugacaaugacacuagguagggguguuugagagggguggcuggggcaaggcuucuagagcaugagcuuugccuggaacccuuccuuaaggaggagagugaagacuggaggcugugcccugcugcagccucauagcacuccuucuaacccccucacagggugcagaaccuccucucagggagggucccaggaggcacuggggaaggccaggugccugaccuugugaagaaggagguacagcgcauccugggucacauccaggccccaccccgucccuuccuggucagguaacugggcugaagggcacucacccuugggcuggggacucuguccuucuggagagcggguguuggccgggcuuggggaagugcuggacucuccuccuggguugcuggauaguguuuaccagagugggcugcagccugccuucaccaccgccucccauccccacauuuugccagcacagguuggagccuauguuagaugcagcacacuguuccagggaaacggaggguaaacgagauaugcgcggcugcaaggaggaaggaacagggcugagacagaauaccaggaaggggacaaagagccuguaagccagagccaagaggaagaaaaggcgaacaagaaugaggcgaacagucuugcuagagggaauagccugagcuuuggcccugggcaggaaaggacuagguuugcuccagaagcugacgugguuggaagccagcaagugaggggucgagagcugugggaggugaaaucgagaggcagaagggaucaaaucauguaaggccgugcaaguuuggacuggaucuccaagugcagugaaaaccaguugcaagguuuuaagugggaagugacaucaugaauuggggucaagaguggagaccagaagggcaucuggaaggcuguuuuguuaauccaggugagagaucaugguggacaguagagguugaaaaguggauugagaggucgaggugauauuaacaggacucacugagggauuggacagugggaacaggggcagugagggaaguaggagaaguuacaggacagccccguuucuagccuacuuucuggugguauggacagagaacaggcuuugggagaagugaguuggcccaaaaagguaguuuggagagagagaguuuugguaccugacaugcuuguggagacacugaggaggcagcugcauauaggagccuggagcucagaagagagguuggggccagagacacugcgaggcuuuagcauacagaugguguuuaaagccaaggagaugaaugagucccugaguacaggugggcuugggggcagcaugugucaagcucagcugucuugaaugugcugaguggccaacugagcaaggacagaaaguagagguuguuggugaccuugaccagcccucugcuguucuagucucuugaucugccuaccuugacaucagccaucagccucccuuucuguguuuccuucccuccaagccuagcucagauugcaggcucggggugcuaauaaugcucuuucgagggagucaugggcaugaccccccgcugucuaccuucucuuugcaccugagcagcccagcguugccagagaaacacauaccaguggacugguuuccuugcuaagugcaaaugucacagggacacauggcacucuccagggcucccacccagccugcuccuucuuagacuuauccacugucaacugauuccccaucucaugcuucacagaaagauaaaagccaucacauggggacuugcugcuuauccagcacauuucccugcuacuacagcuaugugucuguccuaaauuaaagcugguccuaugccggugcaguggcucacaccuguaauaucagcacuuugggaggcugagcgggguggaucacccaagagcugaagaccagccugggcgacauagaccagccagggcaaacuugucucuccaaaaauuagccgggugcacuguugcgugccugugguccuagaugcuugagaggcugaggugggaggaucgcuugagcccaggaggcagagguuguagugagccaaguuugugccacugcacuucagccugggcaacagagcaagacccuguccuaaaaaauaaauagagcugguccuccuguugggcugcagggacaaccccacccaccugcccaccagggauuuugccccugcaguuauccccuuuccuucuucuauuacuaauccuuccuuuuuauuucaccuuuucugguagauugugaagaccaggcuggguucugccuggagagaggcuugguccucuagucuccuuuaggguaaauugaggcagaugcucugauucugaugugaggcagcuccaccaugaggucgugggagaguagcagcgucuggugggcaugaacucuggugucagaacuuccagucccagcacugcuacuucuuagcguucacuaccaggaagcaguucuguagcuucccugagucucacuuuccuucuucuguaaaaugaggauaguggcggggccugcccuaaggagcacugggcagcccuccaagugccacgggccgagcgucacuccuugccgcaccucaggccuggugucccuccccaggcuguucagcugggcgcugcugagguuccugaacugccuguuccugaaugugcagcuccacaagggucagaugaagaugguccagaaggccgcccaggcaguaaggcccgcccuccauuggguuggggauggugggagcagaagagcagaggcugggccaagcccuuaagucaggagcaguccccaucugguccugcuuccuggccucucuguucccagccauacagcaguccaguccccaucagcuggugggaaaaauccccugcucuuugccgaccuucccuuaugucucacggcccugcucccauggggcuuccucuaacgucuuuccaucauggucuuaacaaccaugacgucagugcgucggugcaguuaccuuaagaguugucuaaaggcuccuuugcuuuugggaaaugugcucagaggaagaacucugcagcugaacugucccucccucuggggcugcccugggucuuuggcugccuguguccucaggguggggcagguuggcacuucccucuggcucuccccggagcagggcuugccgcuuguccuccucucuacucacaaaacccuccuggaugggauccugcugcccuuuaugcugcucucccagggccugggugugcuucguguggccugggacucccgcgccugcuccccugcccucagguaaaaaccuuuugccucuagacauacaugggagaagucgcaggcuggggcgggguguguaucgggguguguuggcagcagcucccuacuaaaggcccucuucguggccucucugcuccgagccauacagcagucuagccuguggggcuuagauggaggugucagccacagggccuagggccauggcuuugccucaggguauucaaguaggacacaggcuggccaugggggagcugagacucucacuagccccuuacucauucacaucuucagagccccuuuccuuaucaggcucugcccuaugucccacagagcucugcugaggaagcuuggggggcuuuuccugcccccagaggccagccucucccuggacagcucugaggggcuccuugccagggcugugguccaggcggugagugcccccagugguuacauaugggccaggcuaaggggacaggggucuguuucugcucuggccuuaacacccccucugaccccuccuauuccaggucauagagcagcugcugguuagugggcagccccugcucaucuuccuggaggaaccuccuggggcucuggggccacggcugucagcccugggccaggcuugggugggguuuguggugcaggcaguccaggugggcaucgucccagaugcucugcugguaccaguggccgucaccuaugaccugguuccggaugcaccgugugacauagaccaugugagaaugugagaccuuccagccccuugggccccuagguggacaccagcucccgauaggaggcacaauauuguguccuguggcugagccccacuuagggcuguggggggcacaaaggaaucguccuuacaaucaucuggcagcaccugucaaggccauuaccaucaucucauuucauccucugaagaccuugauagggagggauuuuuccugugucauggauaaggaaagaggagcuugggacaaggucacgcaccaguuugggccugagauaaaacugagcagggugggaccagaggauaccucuggagaccaggaugggugggcagcccugauguccgcccgagagcaguguccucggcgaguauaguuauccuuucccuccuugcaggccucggccccccuggggcuguggacaggagcucuggcuguccuacguagcuuguggagccgcuggggcugcagccaccggaucugcucccgggugcaccuagcucagcccuuuucccugcagguauggagccagcuggggaaggcugggaguaccuggggugucuguccuaggcauccuggcagccuggcccucaaagccacugcagggauagcuuugccuacuuccagugggcugugugcaaguuuccuggugggcccgagcaggccaccuaagagccuucucuugggcaggaauacaucgucagugccagaagcugcuggggcggcagacagacccuggagcagcuacugcagcccaucgugcugggccaaugguaggggcacaggagcguggggucucagggggcaaggcaagcagcccuucagcaccagcuuauguaucccccauauacacacacuagcagcccucccucaccaaguauccuggggucaucuagaauaguuccagguacucgccuugccaacagucugagugugggguauggcacagaggccuggaugggacuggggguuauagaagccauccucuguccuggggcugggagggggaaacacccucaccuuuuagaaagcucuaggcauucccacagcuguuuuuguguuuggacccuucauccuguaaucugugucucuaucucaguacugcugucccagacacugagaaggagcaggaguggacccccauaacugggccucuccuggcccucaaggaagaggaccagcuccuggucaggagacugagcugucauguccugaguggugagggugaaccagaucugggccuuugcgggugggucacugaaccguccccucucggggucagccagucaccaggguucuccauuccaagugucugcaccugaggugcucugugauaccuuggggacaucugaagaagaauggaacccuucuccuacaggaggagcaggcagccagggccaucauaagggagcagcuaagugcaugcacaaagaugguggccugaggccaggaggcugcagcugcuuccccaaggccacacccagcccugccuucugagcggagucuccuuagcuuuggguggagaugguguuaacugaauggaaugauacguguaaggggcuuagcacagcgccuccacagagggcccuuauagggagauccaucuguaucuucuucagugccccucuaguagaggcuguggguugaugugugggcccuacgaugagauccaggggaaggcccccagcuccuggccugcucucagccugugugaugauaaacaccacugcuccggguguacguuccucaucccugggguggaguugggauguguggcuaggaagacuugcuagaucauggagggaccaggcugcugggccucaaccugaccagcaucuccaccccccgccccacuccagccaguguagggagcucugcggugaugagcacggccauuauggcaacgcugcugcucuucaagcaucagaagguagggggugcaaugugguggggaccugggcggugggggggguggcgauguguggcccugcugccuagcccugcucugcccacccaggguguguuccugucgcagcuccugggggaguucuccuggcugacggaggagauacuguugcguggcuuugauguaggcuucucugggcagcugcggagccugcugcagcacucacugagccugcugcgggcgcacguggcccugcugcgcauccgucagggugacuugcugguggugccgcagccuggcccaggccucacacaccuggcacaacugagugcugagcugcugcccgucuuccugagcgaggcugugggcggugagucuugaggugcacgggguaggugggaugugugugcaguggugaagggaacggcuccuucuucauaauggacccuccgcccccagccugugcagugcgggggcugcuggcaggcagagugccgccccaggggcccugggagcugcagggcauauugcugcugagccagaaugagcuguaccgccagauccugcugcugaugcaccugcugccgcaagaccugcugcugcuaaaggucaggccuccccuacggcccacuugguccuaggccuuccccucuuggugguaggaauggcccaucccugcccaugcucuaccucugaaaccuccuggguaguagguguggccuugcccggucuuuggcuaggccccugcccaugugccuggcucuccugaggccacaugggugccuuuuucucccagcccugccagucuuccuacugcuacugucaggaggugcuggaccggcucauccaaugcgggcuccugguugcugaggagguaggcagggcaguuggagacaagauccuugccuggagccuggccuccuccagccucccacccugagugccagcugccccaggcuccuccucugccccgugugugcugugggggugggcagccccuggccuugcagcggggaagccuagcucgcaccucugcucccugugccuugggauauagccaccuaugccccgguucugugugucucucuggauagcacuggacaugugugccucugagguucucugcacaccuccugcuccccacauuucuuggccacagggcuacugcccuugagggugggaauucacuuccucucacucugcaaguuggcccagcaggugcuggggcauggcucuggccauccucuugggucucuaggucugcuuuuacugguuucaccugcauguaccuggucuggggguguaggguugaucccuggccagcuugucagagaacaauggcuccacggccccuagaccccaggcucccggccagccugugacacagggcgacagcgauugagcagaaagcugcuguggaaaccgaguggggacuuuacugauagugacagugaugacuucggagaggcugacggccgguacuucaggguguguuucaaaaagcugccccuggagggaggugguagggaggcgguggggagcugcacucaccccggccuguccccuccagcucagccagcagucacacugcccagauuucuuucuuuuccucugccgccugcucagcccgcugcucaaggccuuugcacaggcugccgccuuccuccgccagggccagcugcccgauacuggugaggcccuuguucccuugcaguccucgaggcaggcugugucugugcugggugccaggucuaggucuucucucuucugcagaguugggcuacacagagcagcuguuccaguuccugcaggccaccgcccaggaagaagggaucuucggugagucccaaccagucagcccaggcuccugcaggcagugguguuugcugguggcugcugcccccugcaggacagugacaacccaacucuaggaaggcaggcugcagaguacagucuucuguccagucagagcucuaucccucccugggcuucuuuaaacaagaggagagaagccugugcccaguggcucucuguucucccuaccuagagccuucacuucucucuucuuuccagagugugcggacccaaagcucgccaucagugcugucuggaccuucagagaccuaggggugagaggagccacugucaccaucuucugucccccugcucccaccccaauagaguagcucagggaaacccagcuauguccccaucacuccacagggcuggccugauggugccucauuaagacccugggauuuacuuggugucuuccagcaacagauuuggugauggguuggagaaggugggaugguuuccugccucuuggucucccaaaucacuggcucaucuuucuaggugggguauugggacugcuuugcggcagcauuugcacgcaaacauugaggucuaaggggccagaggucucaaggcagguuucugggggacaggccuggccccugggccauguguacacagucccuguggugagcgcacucacggcuuaucuuccauggcccagguucugcagcagacgccgagcccugcaggccccaggcuccaccuguccccuacuuuugccagccuggacaaucaggaaaaacuagaacaguucauccggcaguucauuuguagcuagaacugugaggaggagccugugcugagacuucucagccccagaacacagcuguguccuagagccagaagauggagaggaggcugcaaacccuuagcugcucuauaaauauaaucauugaggcuugauugucccuugccaucucuugcuuuuucccuucuuugaugugauaaacaaggggacgagacgaguugucuuuuccccagcccagcagcaucuuuuugguguauguguguguauuugcucucuucuuccccagucccacaaaaugcccuaacuugucccaugaaacaaagcccaaacgaagacaaacagcagaagccaagcugcugcuuugacccgacgaauuuauugaagagagcucuguccuucucccuucuaccgagaagaggcggcuugcagggcuggcaccuguccacaccugucacugggccuuucccugggcuaggcugagugggagcagaugcccucauccuaugugcagggccugugcaggagccaucacaccaccuuguugaugaugacaccuaguucuucaaucucacacuggacuucaucccccuucugcaacagagcaggccaugagagugucagcccuuccgucagacacacguacacaagccuguacuucucaagucugagccaagccugccagcccuuuggggcccuugcucucuuugcuuuucacuaaccuaccuugagaaagacaggagguuuccugaauacaccgacaccuggguggaggugggggggucccagucaggaugacauccccuggguaaaagguaacaaaccuggagcaaagcaaaaggacccggugagaccaggggcuggcugagguggccacagccaaagguggagggcucaggucagccuccacauguguggcagguggagcggggcuggcaggauagccccugucacucacugggacacccaggcuaucagguccucugucuugaauaccaucugguugguguugcugcucuggaccacuuccccauucacucgacagcagaucuuuaaguuguguggaucugaaaugcaaagaugguaccuuggaguuaucccuuuuccccuucaaaccccccaguauuuuacaaacacaacuauaggggugcuucgugacuuggcaggugaaagggcuuuaaagugcccacauugacucagugcacuauguuagaacuuucuguauagacauuggccuucucaggccucccugcauccccaagagcaccaggcaguagucacuuggaugaguugagaggauguugcagacucugaaggagaagagaaaaauggcuaggguuuuugccuugaaaaagggcaucugucuacagcauaggaagauaccuguagauacaaaaaugacuccugggcagggccaagcgugguggcucacaccuguaaucauagcacuuugggagggcaaagcaggugagaacugauuaagcucaggaguucaaaaccagccuggguaacguagugagugcuugucucuaugcaaaauaauaaaaacauuaggcaugguggugcgugacuguagucccagcuacucaggaggcugaggcgggagaacugcuugaacccaggagguugaggcuucagugagcugggauugggccacugcacuccagccugggugacacaguaagaccauacuuaaaaaaaaaaaaaaaaaaaaaaaaaaaagacagcaucuauaaagcagugaggcaaugguucuagccaggacagagaagccucguguaccggaugcuggcaggggauggauuacuguaagaacauccuggcuaaccagcacuuuuaacuguugguguuggucuuaguguucuaccacccuuaaguagagcaccugaaacacaauuuaacuuugccgaggacucugugugggugcugugaggcacuggggucuuugguauccuggcauggcuggcccauguggacaccccccaccuccaccacaguuguggguggcuguguguuaagaggcugcgcucugcccucuggcacacugccuccaaccuggcgcuguccccucacuguguguggucaaugcuguuguuuccacaguggcugggugagucacacuggcuuucaucuguaguguggaaaaugccugggccuugcgauagcuaugcuccaugaugcucaacuuagauuauuucagaugguggcagccgcaggaagcccgauccacccaucagcucaguguucuuuguaauuuacuucacgcaugcaguuucacauccucugcaguuguguucccucuagggggcuugggaaggaagcccaugggagaacucguggcugaggauaaaagacuuucccuguauggagucagcagugaaagggcagccagggagggcaggugccacauguaccugaacccgugcuccucccuggagggcuguucaucugugcaaugguagguacaagggggcagggaucaggaaccuaccugcuacacuguccuuggucaccaaggcagggcccagagggcagaaggugucgaagguuuuucccagcagccacuguuucccauugcaucuuguuagccagucacgagcacucacgucaugagccacagugaagccggccacgugggccauggcaucuguggccuaugggggcaggggauuuggccauacaggaggauagaucaugggugacaccaacaccuguggcaagggaucucaaagcuguuaucccauguuaguagccagagccagccaaaggugggugaagggaaaggcagugucagggagcaaggaggcugacugcuuccuagugucagggacagcuggcaccauguguuggugagcgaggucagaacuaggagaggcaggagcuggggacucugcugcacucuggccugggagcccaccuuuuccacuucaccuugaugugcuugccuuucuuuccaaugaccacggccagcuccacuucccaaucuaccuccuguagggugggagaggaauagugagccgcaguggcuuuggggcccauuaacuaugcucagaggcuguacgcuguggaucucugucaguauggcuuggcugccaucccauguuugccaucaccacgaaccagagcccagugaacgacaagggaggugugacuuguagacccauacauuuugggcaguggcagacagcaucaugggaugcaggcacagguccccacaccauugacugcagaagagcaacacguguccagggcacugaguuuaaaagucacucuggauacuuuuaacaaaggauaaauacgaaguaauauccccuagcaauauguaaccuuacugugugucaggcacuauuuuaaguguuuuaaucuauuaacucacuuuaguaagagaaagaucccacaaaggacuugaguaagcaauucacaaaaagguaacggacauggccacaaaacaugaaaaaaugcucagccucucccauaauccauaaaauacacuauaaaauagauauaauuuggccuuuaaaauugguggcucuuucuaauaauaaccagaguugguauaaguacaccugacauccagauguuggucucuaauaccacuccccaguaaggagcaccggguuccuugguccaagacagacaguacaugaugagccuggaacgucuuggccagaaagcaaauauaugcuaaaagcuuggggauggaacaaacuugaaggucccucauuggccaaauugaggucaccugaagaauguaaaugauggauuacaaccaauugaauaaaaacaaaaaggaauucacagugauauugaagacacaggaauaaagagcgaggcagcuuuuuuucuuuuuuuuugagauggagucucacucuguugcccaggcuggugugcaguggcgcgaucucggcucacugcaagcuccgccucccagguucacgccauucucucaccucagccuccggaguagcugggacuacaggcaccugccaccacgccuggcuaauuuuuuguauuuuuaguagagacgggguuucaccguguuagccaggauggucucgaucuccugaccucgugauccacccgccucggccucccaaagugcugggauuucaggcgugagccaacgugccuggccaggcuuuuuucauagaagaaugccaguuaauaaaaacugcaugauuuagaaaaaucauuguucuuggccgggugcgguggcuuaugcccauaaccccagcacuuugggaggcugaggcagguggaucaccugaggugaggaguucaagaccagccuggccaacauggugaaaccccgucucuacuagaaauacaaaaaauuagccgggugugguggugcaucccuguaauuccagcuacuagggaggcugaagcaggaaaauugcuugaaccugggaggcagugguugcagugagcuaagauggugccacuacauuccagccugggugacagagacuccaucacaaaagaaaagaaaagucauuguucuucaucccccaaugcaauaauggauucaguaaggaugacuacaggauccuuggaugagaaucuacggggcaauaagaugguuaugugaucucaaacuaccacauagauugcuuguuaauuacaaaaauggaaaugcaucuucacaauggagggacuuagugaacgucagcuaaaccaaguggucaaauucugggaugcaaugggaaauguauaacaucuuuguagaucucuugauaaaaaugcuuacccugacacuaaucaugaagaaacaaccagacaaacccaggaugugaaacaugcuaugagacaacuggauucuucaaggaaagggcaggggggauuguuugaggucaggaguuggcaaacuauggccagcucaccgucugcuauaaucaacuuugauuggaaacccaucauucauuucuguaucgucccuggugguuuucacacuauaacagcagaguugaauuguugcaaaacagaccauaugacacucaaaguguaauauuuacuaauuggcccuugauaugguuuagcucuguguccccacccaaaucucaacuuguagcucccauaauucuaacgugcuaugggagggacccagugggagaugacugaaucaugggggcaggucuuucaugugcuguucucaugauagugaaugggucucaugagauccgauaguuuuaaaaaugggaguuucucugcacaagcucuuuucugccugcugcuacccaccuaagaugugacuugcuccuccuugccuucugccaugauugugaggcuucccuagccacguggaacuguaaguccaauuaaaccucuuucuguuguaaauugcccaaucucggauaugucuuuauuagcagcaugaaaacagacuaauacagcccuuuaaaacagucuguggaacccuguucuagguuaaaacuacuaaagagauauaacugaauacagugugugcccuugguugaucacagagcaacaaaguaaccaaauuaaaagucaucuuuggggcaauuggauuucauauuaaauaucauucaaguuaauuuucuuggcugugauaaugguauggucaugcaagccguuguccuuauaaaaugucuauuucaguuuuuaugacaauauuugcaaugugucaccccaaccccugccaaaaaaaaaaauguguguuugccaugugaagggcagggagagggcaagggagagaaagcaaauacagcaaaugucuacagugaaaccaggugaaaaguauaugagcguucacuguauuauuucagcuuuucuauaauucccaagacauuucuaaaauaaaaauuugcgaggaaaaguaaccaguguuaguaaggguauauacacuaacgauggauguguaaguugcucuuacaauuugcuuaaaggacaauugggagauuuucucaaggguuuugaaauacugccuguaguuugauaauauucaaauccuaagaguuuauucaaaggaaauaauaaggccggguguggugacucacaccuguaaucccagcacuuugggaggcucaggcaggcagaucacaaggccaagagacugagaccauccuggccaacaugguaaaaccccaucucuacuaaaaauacaaaaauuaggugggcgugguggcaugcgccuguagucccagcuacucgggaggcugaggcaggagaaucacuugaacccaggaggcggagguugcagugaaccaagauuguaccacugcacuccagccuggcaacagagaaagacucugucucaaaaaaaaaaaaaaaaaaggaaauaauaauauauuaauggacacgcaaagucuuuucuacauaaggauguucauugcgacauuuauuuauagaaacaaaaaacuggaaacaaguauccagcaguaagguacucaggaauauaaacuacccuguacaucacaaaacuccaagguaaccuaaauaugucagggagaauauuuaauggcaugaaaaaaugcuccugauggagucuuaaguaaaagguaaguauauguacaguauaaacauauacaggaguggagaaacaauaggaagguagacagaaaaacauuaauauucugagccaugggcagugggauuaugggugacauaauuuuuaaauguuuaucucuguuuuaucuacagugaagguguauugcuuuuguaaccaggaaaacacguacauuaacuuuuuuuuuccaaggccaguguuacuacuguguguauaauccuguagaguuucuguugaaugcacuauugagcgagagguggcuccaguaggcucaauacugagcucagaaugcccuugugaugggcccagugacuagggagggcaguggggaggcacugaccuggcucuguggugggaggaccaccucaucauagggccccacgauggagcuggcaaacuugcugaagaugaugggcuccuugggcacgggcacguucuguucuuugcagugguccacauaauucaugcccacacacaccaccuuaucuggccaugugacuggagccaggaagguuaccuccgaccgugguaggacuggcaacugggcagccaaggcucuguagagaccagagcaggugagagggucuggcugggaacaggugggcaaucccgggcaggcugggcagauccugcagcagcuaaagguuuugcuuucugaaaucuauuuccuagcucuaucaaccaucagagucauugugaaaaucacugacuauuguccuuugcuaucagagcagggcuuuuauuuauccaguguugauuuccucucccccuuagguaacucauguccauguaaaagauacaaacuggaauacauggaaagguuucccuuuccccuuccgguuaccccguuccccuggcucuucgcagcuacucuauggauauucuucucccacccuuuuguaugcaaaugauagcauacuauucacaucuuuuaaaaaaacaacugacuuuggagaucucugcuuaacaauauguaacaauacauagagaguguccucuuuauuucuuguggcugcauauuacugcucuauagagauauacccaagucccuaaugagggacauggaguuuuccaaucuuugcagauuauggcaauaugggaacauacuguuaauacugugagcugugaaacauuuguauuuuuuuccauuuuaauagaugaaaaugacaucuuaaaguauuuuuaauuuauuguucaucagcuccuuagaccagauucuauaggaguccaggcuucagggacacucucaccuaaucuaguccaaacccaggaaccaagugucuuauagaaaaccuccuugcaguccucucuccuuguaggagcugggagucuauaucacucccccagcugcauaagaugccuuuuaggacccccgggcccagacccgucagucaguccaggacuucauucccagaggaggcagugugaugaaguauagaguccugguuccagcaccacauguauggccuucaaauuguuaaucaccuccccuagcucucaguuuucuccucugaaaacugaagauguuauuauauaagauuuauaaggaucuuuuaagagaaugggagaaaaggaaaggugggguuacucugcucccuugcaaaagagcuaccugcuggugcuguuucccagagcggggaggauguggggggaccagggcagcugugucagggcgaugcugcccacuuacuuaccuucuugccacugagaggguggccucucccugcucuaggaacugcgucauugucuuugggaguguggggucaaaggcauugagguugauaaucccucuaccauucccugucuccaggcccaagugaggccccaccagguggggugcccagaacugcacuagucucaugucucuggaggguugaaagggccacuucugagccugcagcagagcugugaguaaccuucuaccagacaccaccaucagagccugcagagaaaaaugcaggauccaggagacggaggaucccagagccaucaucaggaucucugaaauuccuagggcuauauagcccaaggcccuuugccccaucaaccguucccugcauaccacacgggaagugguccaggcuuguauuuuaccugcuauucuucauaaggugaaacuuuucuacaggagcaacuacuacaugcuacgcaguaagucccagggauuccaguguuccuucaaccagugcuuucugaaaguucccacugugcuuggcucugcuguagguauuggggaaacaauguaggugaaacucagcccugccauucucccugcacaggucacagauguuaacaagugacguaagauucagcuaucaggacuaaugcugugaagauggucaggggcucuacccuugucuaguuucuggaggaagugaugugagcugagcugggcuaaaugagcaggaccaggaauuagcuggguggcagcccagcaugggcaagugaugcuggugaaacuggcuucacaguggccauaagccauuuuuuaaaugcuauuuugguccuguuaaccuccaacuuaaaaugguuuccacugcucacaugaucaagcuagaaccucuaccaggcuguccuugucuucuaggagcagcgcccccaccugccucuccagauaauaauuauuucauuucuccugauagagaacaaguugccugagggaagaggcugcagacaaacagcaaggucugggccugacagccaucacuuggucaucuccucccuggauccagggacaugucugucucuuucacugcccagcacugugccugguguacagaaggcucucagugacuuucugcugaaugaacaaauaagugacagaagcagaggcuugacauuucacuacuugggaaagcuuagugcuuguuaacuuuaggagacauggcugugccuuuccuccucaaaucaccuagaaaguauccacaagggccaggcgcaguggcucacaccugaaaucccuagcacauugggaguucgagguggguggaucacuugaggucaggaguucaagaccagccuggccaacauggcgaaacccugucuccccuaaaaaugcaaaaaaauuagccaggacugguggcaggcgccuguaaucccagcuacuagggaagcugagauacgagaaucacuugaacacaggaggcagagguuguagugagccaagaacaugccacgacacuccagccugggcaacagagcaacuccaaaaaaaaaaaaaaaaaagaaauuauccacagagcucagguccuauuuugaguccaaggcuccacuuaaagacaaacacuauucucuuguuuuguucugaauccaauucuggccacuauuccuuaccacauggugccuucccugaaugguuccuugcucuuacaacaaaggcuguuuguauuguacagccuucuaugcccaaaaauguugaggcagcugagccccagacucuugguccucgccuggagauucaaucugccuuguucagugaaagacucauuagacuuaggucaccacuguuguggcccaccaguuugacuagaaaaccgaggguuuugacuucucugcccugcuaucuuacacaagcaccaacugugccacugucaaaaggcuguucgagccaaagugcacacacucagacacuccacaugcuaacauaacaguaacugcugccgcugaaugccaacuauuaagugcucuaccuacaauguccgauuuaauucuuuuuuuuuuuuuuugagauggagucucgcucugucgcccaggcuggaaugcaguggcacgaucuuggcucacugcaagcucugcuucccggguucacgccauucuccugccucagccuccccagcagcugagacuacaggugcacgccgccacgcccagcuaauuuuuguauuuuuaguagagacgguguuucacuguguuagccaggacggucucgaucuccugaccuugugauccgccugccucggccucccaaauuguugguauuacaggcgugagccaccgcgccaggccugauuuaauucuugacgcuuguggaagguagguacuguuagucccauuuuacagaugaaacaguuaaggcuuaaagcgguuaagggauuugcccaagguuacacagucuuaaagcuaggaagggaaggagcugggaugugaauccaaguccaggugacauugaaguccuugguucagaagcuuguaaugcaagcaagaaaaucuagcuucagccccaucuuccuaccaag

SEQ ID NO: 13385 - RNA, 20207 nt, Homo sapiens
cuugguaggaagauggggcugaagcuagauuuucuugcuugcauuacaagcuucugaaccaaggacuucaaugucaccuggacuuggauucacaucccagcuccuucccuuccuagcuuuaagacuguguaaccuugggcaaaucccuuaaccgcuuuaagccuuaacuguuucaucuguaaaaugggacuaacaguaccuaccuuccacaagcgucaagaauuaaaucaggccuggcgcgguggcucacgccuguaauaccaacaauuugggaggccgaggcaggcggaucacaaggucaggagaucgagaccguccuggcuaacacagugaaacaccgucucuacuaaaaauacaaaaauuagcugggcguggcggcgugcaccuguagucucagcugcuggggaggcugaggcaggagaauggcgugaacccgggaagcagagcuugcagugagccaagaucgugccacugcauuccagccugggcgacagagcgagacuccaucucaaaaaaaaaaaaaaagaauuaaaucggacauuguagguagagcacuuaauaguuggcauucagcggcagcaguuacuguuauguuagcauguggagugucugagugugugcacuuuggcucgaacagccuuuugacaguggcacaguuggugcuuguguaagauagcagggcagagaagucaaaacccucgguuuucuagucaaacuggugggccacaacaguggugaccuaagucuaaugagucuuucacugaacaaggcagauugaaucuccaggcgaggaccaagagucuggggcucagcugccucaacauuuuugggcauagaaggcuguacaauacaaacagccuuuguuguaagagcaaggaaccauucagggaaggcaccaugugguaaggaauaguggccagaauuggauucagaacaaaacaagagaauaguguuugucuuuaaguggagccuuggacucaaaauaggaccugagcucuguggauaauuucuuuuuuuuuuuuuuuuuuggaguugcucuguugcccaggcuggagugucguggcauguucuuggcucacuacaaccucugccuccuguguucaagugauucucguaucucagcuucccuaguagcugggauuacaggcgccugccaccaguccuggcuaauuuuuuugcauuuuuaggggagacaggguuucgccauguuggccaggcuggucuugaacuccugaccucaagugauccacccaccucgaacucccaaugugcuagggauuucaggugugagccacugcgccuggcccuuguggauacuuucuaggugauuugaggaggaaaggcacagccaugucuccuaaaguuaacaagcacuaagcuuucccaaguagugaaaugucaagccucugcuucugucacuuauuuguucauucagcagaaagucacugagagccuucuguacaccaggcacagugcugggcagugaaagagacagacaugucccuggauccagggaggagaugaccaagugauggcugucaggcccagaccuugcuguuugucugcagccucuucccucaggcaacuuguucucuaucaggagaaaugaaauaauuauuaucuggagaggcaggugggggcgcugcuccuagaagacaaggacagccugguagagguucuagcuugaucaugugagcaguggaaaccauuuuaaguuggagguuaacaggaccaaaauagcauuuaaaaaauggcuuauggccacugugaagccaguuucaccagcaucacuugcccaugcugggcugccacccagcuaauuccugguccugcucauuuagcccagcucagcucacaucacuuccuccagaaacuagacaaggguagagccccugaccaucuucacagcauuaguccugauagcugaaucuuacgucacuuguuaacaucugugaccugugcagggagaauggcagggcugaguuucaccuacauuguuuccccaauaccuacagcagagccaagcacagugggaacuuucagaaagcacugguugaaggaacacuggaaucccugggacuuacugcguagcauguaguaguugcuccuguagaaaaguuucaccuuaugaagaauagcagguaaaauacaagccuggaccacuucccgugugguaugcagggaacgguugauggggcaaagggccuugggcuauauagcccuaggaauuucagagauccugaugauggcucugggauccuccgucuccuggauccugcauuuuucucugcaggcucugaugguggugucugguagaagguuacucacagcucugcugcaggcucagaaguggcccuuucaacccuccagagacaugagacuagugcaguucugggcaccccaccugguggggccucacuugggccuggagacagggaaugguagagggauuaucaaccucaaugccuuugaccccacacucccaaagacaaugacgcaguuccuagagcagggagaggccacccucucaguggcaagaagguaaguaagugggcagcaucgcccugacacagcugcccugguccccccacauccuccccgcucugggaaacagcaccagcagguagcucuuuugcaagggagcagaguaaccccaccuuuccuuuucucccauucucuuaaaagauccuuauaaaucuuauauaauaacaucuucaguuuucagaggagaaaacugagagcuaggggaggugauuaacaauuugaaggccauacauguggugcuggaaccaggacucuauacuucaucacacugccuccucugggaaugaaguccuggacugacugacgggucugggcccggggguccuaaaaggcaucuuaugcagcugggggagugauauagacucccagcuccuacaaggagagaggacugcaaggagguuuucuauaagacacuugguuccuggguuuggacuagauuaggugagagugucccugaagccuggacuccuauagaaucuggucuaaggagcugaugaacaauaaauuaaaaauacuuuaagaugucauuuucaucuauuaaaauggaaaaaaauacaaauguuucacagcucacaguauuaacaguauguucccauauugccauaaucugcaaagauuggaaaacuccaugucccucauuagggacuuggguauaucucuauagagcaguaauaugcagccacaagaaauaaagaggacacucucuauguauuguuacauauuguuaagcagagaucuccaaagucaguuguuuuuuuaaaagaugugaauaguaugcuaucauuugcauacaaaagggugggagaagaauauccauagaguagcugcgaagagccaggggaacgggguaaccggaaggggaaagggaaaccuuuccauguauuccaguuuguaucuuuuacauggacaugaguuaccuaagggggagaggaaaucaacacuggauaaauaaaagcccugcucugauagcaaaggacaauagucagugauuuucacaaugacucugaugguugauagagcuaggaaauagauuucagaaagcaaaaccuuuagcugcugcaggaucugcccagccugcccgggauugcccaccuguucccagccagacccucucaccugcucuggucucuacagagccuuggcugcccaguugccaguccuaccacggucggagguaaccuuccuggcuccagucacauggccagauaagguggugugugugggcaugaauuauguggaccacugcaaagaacagaacgugcccgugcccaaggagcccaucaucuucagcaaguuugccagcuccaucguggggcccuaugaugaggugguccucccaccacagagccaggucagugccuccccacugcccucccuagucacugggcccaucacaagggcauucugagcucaguauugagccuacuggagccaccucucgcucaauagugcauucaacagaaacucuacaggauuauacacacaguaguaacacuggccuuggaaaaaaaaaguuaauguacguguuuuccugguuacaaaagcaauacaccuucacuguagauaaaacagagauaaacauuuaaaaauuaugucacccauaaucccacugcccauggcucagaauauuaauguuuuucugucuaccuuccuauuguuucuccacuccuguauauguuuauacuguacauauacuuaccuuuuacuuaagacuccaucaggagcauuuuuucaugccauuaaauauucucccugacauauuuagguuaccuuggaguuuugugauguacaggguaguuuauauuccugaguaccuuacugcuggauacuuguuuccaguuuuuuguuucuauaaauaaaugucgcaaugaacauccuuauguagaaaagacuuugcguguccauuaauauauuauuauuuccuuuuuuuuuuuuuuuuuugagacagagucuuucucuguugccaggcuggagugcagugguacaaucuugguucacugcaaccuccgccuccuggguucaagugauucuccugccucagccucccgaguagcugggacuacaggcgcaugccaccacgcccaccuaauuuuuguauuuuuaguagagaugggguuuuaccauguuggccaggauggucucagucucuuggccuugugaucugccugccugagccucccaaagugcugggauuacaggugugagucaccacacccggccuuauuauuuccuuugaauaaacucuuaggauuugaauauuaucaaacuacaggcaguauuucaaaacccuugagaaaaucucccaauuguccuuuaagcaaauuguaagagcaacuuacacauccaucguuaguguauauacccuuacuaacacugguuacuuuuccucgcaaauuuuuauuuuagaaaugucuugggaauuauagaaaagcugaaauaauacagugaacgcucauauacuuuucaccugguuucacuguagacauuugcuguauuugcuuucucucccuugcccucucccugcccuucacauggcaaacacacauuuuuuuuuuuggcagggguuggggugacacauugcaaauauugucauaaaaacugaaauagacauuuuauaaggacaacggcuugcaugaccauaccauuaucacagccaagaaaauuaacuugaaugauauuuaauaugaaauccaauugccccaaagaugacuuuuaauuugguuacuuuguugcucugugaucaaccaagggcacacacuguauucaguuauaucucuuuaguaguuuuaaccuagaacaggguuccacagacuguuuuaaagggcuguauuagucuguuuucaugcugcuaauaaagacauauccgagauugggcaauuuacaacagaaagagguuuaauuggacuuacaguuccacguggcuagggaagccucacaaucauggcagaaggcaaggaggagcaagucacaucuuagguggguagcagcaggcagaaaagagcuugugcagagaaacucccauuuuuaaaacuaucggaucucaugagacccauucacuaucaugagaacagcacaugaaagaccugcccccaugauucagucaucucccacugggucccucccauagcacguuagaauuaugggagcuacaaguugagauuuggguggggacacagagcuaaaccauaucaagggccaauuaguaaauauuacacuuugagugucauauggucuguuuugcaacaauucaacucugcuguuauagugugaaaaccaccagggacgauacagaaaugaaugauggguuuccaaucaaaguugauuauagcagacggugagcuggccauaguuugccaacuccugaccucaaacaauccccccugcccuuuccuugaagaauccaguugucucauagcauguuucacauccuggguuugucugguuguuucuucaugauuagugucaggguaagcauuuuuaucaagagaucuacaaagauguuauacauuucccauugcaucccagaauuugaccacuugguuuagcugacguucacuaagucccuccauugugaagaugcauuuccauuuuuguaauuaacaagcaaucuaugugguaguuugagaucacauaaccaucuuauugccccguagauucucauccaaggauccuguagucauccuuacugaauccauuauugcauugggggaugaagaacaaugacuuuucuuuucuuuugugauggagucucugucacccaggcuggaauguaguggcaccaucuuagcucacugcaaccacugccucccagguucaagcaauuuuccugcuucagccucccuaguagcuggaauuacagggaugcaccaccacacccggcuaauuuuuuguauuucuaguagagacgggguuucaccauguuggccaggcuggucuugaacuccucaccucaggugauccaccugccucagccucccaaagugcugggguuaugggcauaagccaccgcacccggccaagaacaaugauuuuucuaaaucaugcaguuuuuauuaacuggcauucuucuaugaaaaaagccuggccaggcacguuggcucacgccugaaaucccagcacuuugggaggccgaggcggguggaucacgaggucaggagaucgagaccauccuggcuaacacggugaaaccccgucucuacuaaaaauacaaaaaauuagccaggcgugguggcaggugccuguagucccagcuacuccggaggcugaggugagagaauggcgugaaccugggaggcggagcuugcagugagccgagaucgcgccacugcacaccagccugggcaacagagugagacuccaucucaaaaaaaaagaaaaaaagcugccucgcucuuuauuccugugucuucaauaucacugugaauuccuuuuuguuuuuauucaauugguuguaauccaucauuuacauucuucaggugaccucaauuuggccaaugagggaccuucaaguuuguuccauccccaagcuuuuagcauauauuugcuuucuggccaagacguuccaggcucaucauguacugucugucuuggaccaaggaacccggugcuccuuacuggggagugguauuagagaccaacaucuggaugucagguguacuuauaccaacucugguuauuauuagaaagagccaccaauuuuaaaggccaaauuauaucuauuuuauaguguauuuuauggauuaugggagaggcugagcauuuuuucauguuuuguggccauguccguuaccuuuuugugaauugcuuacucaaguccuuugugggaucuuucucuuacuaaagugaguuaauagauuaaaacacuuaaaauagugccugacacacaguaagguuacauauugcuaggggauauuacuucguauuuauccuuuguuaaaaguauccagagugacuuuuaaacucagugcccuggacacguguugcucuucugcagucaaugguguggggaccugugccugcaucccaugaugcugucugccacugcccaaaauguaugggucuacaagucacaccucccuugucguucacugggcucugguucguggugauggcaaacaugggauggcagccaagccauacugacagagauccacagcguacagccucugagcauaguuaaugggccccaaagccacugcggcucacuauuccucucccacccuacaggagguagauugggaaguggagcuggccguggucauuggaaagaaaggcaagcacaucaaggugaaguggaaaaggugggcucccaggccagagugcagcagaguccccagcuccugccucuccuaguucugaccucgcucaccaacacauggugccagcugucccugacacuaggaagcagucagccuccuugcucccugacacugccuuucccuucacccaccuuuggcuggcucuggcuacuaacaugggauaacagcuuugagaucccuugccacagguguuggugucacccaugaucuauccuccuguauggccaaauccccugcccccauaggccacagaugccauggcccacguggccggcuucacuguggcucaugacgugagugcucgugacuggcuaacaagaugcaaugggaaacaguggcugcugggaaaaaccuucgacaccuucugcccucugggcccugccuuggugaccaaggacaguguagcagguagguuccugaucccugcccccuuguaccuaccauugcacagaugaacagcccuccagggaggagcacggguucagguacauguggcaccugcccucccuggcugcccuuucacugcugacuccauacagggaaagucuuuuauccucagccacgaguucucccaugggcuuccuucccaagcccccuagagggaacacaacugcagaggaugugaaacugcaugcgugaaguaaauuacaaagaacacugagcugauggguggaucgggcuuccugcggcugccaccaucugaaauaaucuaaguugagcaucauggagcauagcuaucgcaaggcccaggcauuuuccacacuacagaugaaagccagugugacucacccagccacuguggaaacaacagcauugaccacacacagugaggggacagcgccagguuggaggcagugugccagagggcagagcgcagccucuuaacacacagccacccacaacugugguggaggugggggguguccacaugggccagccaugccaggauaccaaagaccccagugccucacagcacccacacagaguccucggcaaaguuaaauuguguuucaggugcucuacuuaagggugguagaacacuaagaccaacaccaacaguuaaaagugcugguuagccaggauguucuuacaguaauccauccccugccagcauccgguacacgaggcuucucuguccuggcuagaaccauugccucacugcuuuauagaugcugucuuuuuuuuuuuuuuuuuuuuuuuuuuuuaaguauggucuuacugugucacccaggcuggagugcaguggcccaaucccagcucacugaagccucaaccuccuggguucaagcaguucucccgccucagccuccugaguagcugggacuacagucacgcaccaccaugccuaauguuuuuauuauuuugcauagagacaagcacucacuacguuacccaggcugguuuugaacuccugagcuuaaucaguucucaccugcuuugcccucccaaagugcuaugauuacaggugugagccaccacgcuuggcccugcccaggagucauuuuuguaucuacagguaucuuccuaugcuguagacagaugcccuuuuucaaggcaaaaacccuagccauuuuucucuucuccuucagagucugcaacauccucucaacucauccaagugacuacugccuggugcucuuggggaugcagggaggccugagaaggccaaugucuauacagaaaguucuaacauagugcacugagucaaugugggcacuuuaaagcccuuucaccugccaagucacgaagcaccccuauaguuguguuuguaaaauacugggggguuugaaggggaaaagggauaacuccaagguaccaucuuugcauuucagauccacacaacuuaaagaucugcugucgagugaauggggaagugguccagagcagcaacaccaaccagaugguauucaagacagaggaccugauagccugggugucccagugagugacaggggcuauccugccagccccgcuccaccugccacacauguggaggcugaccugagcccuccaccuuuggcuguggccaccucagccagccccuggucucaccggguccuuuugcuuugcuccagguuuguuaccuuuuacccaggggaugucauccugacugggacccccccaccuccacccaggugucgguguauucaggaaaccuccugucuuucucaagguagguuagugaaaagcaaagagagcaagggccccaaagggcuggcaggcuuggcucagacuugagaaguacaggcuuguguacgugugucugacggaagggcugacacucucauggccugcucuguugcagaagggggaugaaguccagugugagauugaagaacuaggugucaucaucaacaagguggugugauggcuccugcacaggcccugcacauaggaugagggcaucugcucccacucagccuagcccagggaaaggcccagugacagguguggacaggugccagcccugcaagccgccucuucucgguagaagggagaaggacagagcucucuucaauaaauucgucgggucaaagcagcagcuuggcuucugcuguuugucuucguuugggcuuuguuucaugggacaaguuagggcauuuugugggacuggggaagaagagagcaaauacacacacauacaccaaaaagaugcugcugggcuggggaaaagacaacucgucucguccccuuguuuaucacaucaaagaagggaaaaagcaagagauggcaagggacaaucaagccucaaugauuauauuuauagagcagcuaaggguuugcagccuccucuccaucuucuggcucuaggacacagcuguguucuggggcugagaagucucagcacaggcuccuccucacaguucuagcuacaaaugaacugccggaugaacuguucuaguuuuuccugauuguccaggcuggcaaaaguaggggacagguggagccuggggccugcagggcucggcgucugcugcagaaccugggccauggaagauaagccgugagugcgcucaccacagggacuguguacacauggcccaggggccaggccugucccccagaaaccugccuugagaccucuggccccuuagaccucaauguuugcgugcaaaugcugccgcaaagcagucccaauaccccaccuagaaagaugagccagugauuugggagaccaagaggcaggaaaccaucccaccuucuccaacccaucaccaaaucuguugcuggaagacaccaaguaaaucccagggucuuaaugaggcaccaucaggccagcccuguggagugauggggacauagcuggguuucccugagcuacucuauuggggugggagcagggggacagaagauggugacaguggcuccucucaccccuaggucucugaagguccagacagcacugauggcgagcuuuggguccgcacacucuggaaagaagagagaagugaaggcucuagguagggagaacagagagccacugggcacaggcuucucuccucuuguuuaaagaagcccagggagggauagagcucugacuggacagaagacuguacucugcagccugccuuccuagaguuggguugucacuguccugcagggggcagcagccaccagcaaacaccacugccugcaggagccugggcugacugguugggacucaccgaagaucccuucuuccugggcgguggccugcaggaacuggaacagcugcucuguguagcccaacucugcagaagagagaagaccuagaccuggcacccagcacagacacagccugccucgaggacugcaagggaacaagggccucaccaguaucgggcagcuggcccuggcggaggaaggcggcagccugugcaaaggccuugagcagcgggcugagcaggcggcagaggaaaagaaagaaaucugggcagugugacugcuggcugagcuggaggggacaggccggggugagugcagcuccccaccgccucccuaccaccucccuccaggggcagcuuuuugaaacacacccugaaguaccggccgucagccucuccgaagucaucacugucacuaucaguaaaguccccacucgguuuccacagcagcuuucugcucaaucgcugucgcccugugucacaggcuggccgggagccuggggucuaggggccguggagccauuguucucugacaagcuggccagggaucaacccuacacccccagaccagguacaugcaggugaaaccaguaaaagcagaccuagagacccaagaggauggccagagccaugccccagcaccugcugggccaacuugcagagugagaggaagugaauucccacccucaagggcaguagcccuguggccaagaaauguggggagcaggaggugugcagagaaccucagaggcacacauguccagugcuauccagagagacacacagaaccggggcauagguggcuauaucccaaggcacagggagcagaggugcgagcuaggcuuccccgcugcaaggccaggggcugcccacccccacagcacacacggggcagaggaggagccuggggcagcuggcacucagggugggaggcuggaggaggccaggcuccaggcaaggaucuugucuccaacugcccugccuaccuccucagcaaccaggagcccgcauuggaugagccgguccagcaccuccugacaguagcaguaggaagacuggcagggcugggagaaaaaggcacccauguggccucaggagagccaggcacaugggcaggggccuagccaaagaccgggcaaggccacaccuacuacccaggagguuucagagguagagcaugggcagggaugggccauuccuaccaccaagaggggaaggccuaggaccaagugggccguaggggaggccugaccuuuagcagcagcaggucuugcggcagcaggugcaucagcagcaggaucuggcgguacagcucauucuggcucagcagcaauaugcccugcagcucccagggccccuggggcggcacucugccugccagcagcccccgcacugcacaggcugggggcggaggguccauuaugaagaaggagccguucccuucaccacugcacacacaucccaccuaccccgugcaccucaagacucaccgcccacagccucgcucaggaagacgggcagcagcucagcacucaguugugccaggugugugaggccugggccaggcugcggcaccaccagcaagucacccugacggaugcgcagcagggccacgugcgcccgcagcaggcucagugagugcugcagcaggcuccgcagcugcccagagaagccuacaucaaagccacgcaacaguaucuccuccgucagccaggagaacucccccaggagcugcgacaggaacacacccugggugggcagagcagggcuaggcagcagggccacacaucgccaccccccccaccgcccagguccccaccacauugcacccccuaccuucugaugcuugaagagcagcagcguugccauaauggccgugcucaucaccgcagagcucccuacacuggcuggaguggggcgggggguggagaugcuggucagguugaggcccagcagccuggucccuccaugaucuagcaagucuuccuagccacacaucccaacuccaccccagggaugaggaacguacacccggagcagugguguuuaucaucacacaggcugagagcaggccaggagcugggggccuuccccuggaucucaucguagggcccacacaucaacccacagccucuacuagaggggcacugaagaagauacagauggaucucccuauaagggcccucuguggaggcgcugugcuaagccccuuacacguaucauuccauucaguuaacaccaucuccacccaaagcuaaggagacuccgcucagaaggcagggcuggguguggccuuggggaagcagcugcagccuccuggccucaggccaccaucuuugugcaugcacuuagcugcucccuuaugauggcccuggcugccugcuccuccuguaggagaaggguuccauucuucuucagauguccccaagguaucacagagcaccucaggugcagacacuuggaauggagaacccuggugacuggcugaccccgagaggggacgguucagugacccacccgcaaaggcccagaucugguucacccucaccacucaggacaugacagcucagucuccugaccaggagcugguccucuuccuugagggccaggagaggcccaguuauggggguccacuccugcuccuucucagugucugggacagcaguacugagauagagacacagauuacaggaugaaggguccaaacacaaaaacagcugugggaaugccuagagcuuucuaaaaggugaggguguuucccccucccagccccaggacagaggauggcuucuauaacccccagucccauccaggccucugugccauaccccacacucagacuguuggcaaggcgaguaccuggaacuauucuagaugaccccaggauacuuggugagggagggcugcuaguguguguauaugggggauacauaagcuggugcugaagggcugcuugccuugcccccugagaccccacgcuccugugccccuaccauuggcccagcacgaugggcugcaguagcugcuccagggucugucugccgccccagcagcuucuggcacugacgauguauuccugcccaagagaaggcucuuagguggccugcucgggcccaccaggaaacuugcacacagcccacuggaaguaggcaaagcuaucccugcaguggcuuugagggccaggcugccaggaugccuaggacagacaccccagguacucccagccuuccccagcuggcuccauaccugcagggaaaagggcugagcuaggugcacccgggagcagauccgguggcugcagccccagcggcuccacaagcuacguaggacagccagagcuccuguccacagccccaggggggccgaggccugcaaggagggaaaggauaacuauacucgccgaggacacugcucucgggcggacaucagggcugcccacccauccuggucuccagagguauccucuggucccacccugcucaguuuuaucucaggcccaaacuggugcgugaccuugucccaagcuccucuuuccuuauccaugacacaggaaaaaucccucccuaucaaggucuucagaggaugaaaugagaugaugguaauggccuugacaggugcugccagaugauuguaaggacgauuccuuugugccccccacagcccuaaguggggcucagccacaggacacaauauugugccuccuaucgggagcugguguccaccuaggggcccaaggggcuggaaggucucacauucucacauggucuaugucacacggugcauccggaaccaggucauaggugacggccacugguaccagcagagcaucugggacgaugcccaccuggacugccugcaccacaaaccccacccaagccuggcccagggcugacagccguggccccagagccccaggagguuccuccaggaagaugagcaggggcugcccacuaaccagcagcugcucuaugaccuggaauaggaggggucagaggggguguuaaggccagagcagaaacagaccccuguccccuuagccuggcccauauguaaccacugggggcacucaccgccuggaccacagcccuggcaaggagccccucagagcuguccagggagaggcuggccucugggggcaggaaaagccccccaagcuuccucagcagagcucugugggacauagggcagagccugauaaggaaaggggcucugaagaugugaaugaguaaggggcuagugagagucucagcucccccauggccagccuguguccuacuugaauacccugaggcaaagccauggcccuaggcccuguggcugacaccuccaucuaagccccacaggcuagacugcuguauggcucggagcagagaggccacgaagagggccuuuaguagggagcugcugccaacacaccccgauacacaccccgccccagccugcgacuucucccauguaugucuagaggcaaaagguuuuuaccugagggcaggggagcaggcgcgggagucccaggccacacgaagcacacccaggcccugggagagcagcauaaagggcagcaggaucccauccaggaggguuuugugaguagagaggaggacaagcggcaagcccugcuccggggagagccagagggaagugccaaccugccccacccugaggacacaggcagccaaagacccagggcagccccagagggagggacaguucagcugcagaguucuuccucugagcacauuucccaaaagcaaaggagccuuuagacaacucuuaagguaacugcaccgacgcacugacgucaugguuguuaagaccaugauggaaagacguuagaggaagccccaugggagcagggccgugagacauaagggaaggucggcaaagagcaggggauuuuucccaccagcugauggggacuggacugcuguauggcugggaacagagaggccaggaagcaggaccagauggggacugcuccugacuuaagggcuuggcccagccucugcucuucugcucccaccauccccaacccaauggagggcgggccuuacugccugggcggccuucuggaccaucuucaucugacccuuguggagcugcacauucaggaacaggcaguucaggaaccucagcagcgcccagcugaacagccuggggagggacaccaggccugaggugcggcaaggagugacgcucggcccguggcacuuggagggcugcccagugcuccuuagggcaggccccgccacuauccucauuuuacagaagaaggaaagugagacucagggaagcuacagaacugcuuccugguagugaacgcuaagaaguagcagugcugggacuggaaguucugacaccagaguucaugcccaccagacgcugcuacucucccacgaccucaugguggagcugccucacaucagaaucagagcaucugccucaauuuacccuaaaggagacuagaggaccaagccucucuccaggcagaacccagccuggucuucacaaucuaccagaaaaggugaaauaaaaaggaaggauuaguaauagaagaaggaaaggggauaacugcaggggcaaaaucccuggugggcaggugggugggguugucccugcagcccaacaggaggaccagcucuauuuauuuuuuaggacagggucuugcucuguugcccaggcugaagugcaguggcacaaacuuggcucacuacaaccucugccuccugggcucaagcgauccucccaccucagccucucaagcaucuaggaccacaggcacgcaacagugcacccggcuaauuuuuggagagacaaguuugcccuggcuggucuaugucgcccaggcuggucuucagcucuugggugauccaccccgcucagccucccaaagugcugauauuacaggugugagccacugcaccggcauaggaccagcuuuaauuuaggacagacacauagcuguaguagcagggaaaugugcuggauaagcagcaaguccccaugugauggcuuuuaucuuucugugaagcaugagauggggaaucaguugacaguggauaagucuaagaaggagcaggcugggugggagcccuggagagugccaugugucccugugacauuugcacuuagcaaggaaaccaguccacugguauguguuucucuggcaacgcugggcugcucaggugcaaagagaagguagacagcggggggucaugcccaugacucccucgaaagagcauuauuagcaccccgagccugcaaucugagcuaggcuuggagggaaggaaacacagaaagggaggcugauggcugaugucaagguaggcagaucaagagacuagaacagcagagggcuggucaaggucaccaacaaccucuacuuucuguccuugcucaguuggccacucagcacauucaagacagcugagcuugacacaugcugcccccaagcccaccuguacucagggacucauucaucuccuuggcuuuaaacaccaucuguaugcuaaagccucgcagugucucuggccccaaccucucuucugagcuccaggcuccuauaugcagcugccuccucagugucuccacaagcaugucagguaccaaaacucucucucuccaaacuaccuuuuugggccaacucacuucucccaaagccuguucucuguccauaccaccagaaaguaggcuagaaacggggcuguccuguaacuucuccuacuucccucacugccccuguucccacuguccaaucccucagugaguccuguuaauaucaccucgaccucucaauccacuuuucaaccucuacuguccaccaugaucucucaccuggauuaacaaaacagccuuccagaugcccuucuggucuccacucuugaccccaauucaugaugucacuucccacuuaaaaccuugcaacugguuuucacugcacuuggagauccaguccaaacuugcacggccuuacaugauuugaucccuucugccucucgauuucaccucccacagcucucgaccccucacuugcuggcuuccaaccacgucagcuucuggagcaaaccuaguccuuuccugcccagggccaaagcucaggcuauucccucuagcaagacuguucgccucauucuuguucgccuuuucuuccucuuggcucuggcuuacaggcucuuuguccccuuccugguauucugucucagcccuguuccuuccuccuugcagccgcgcauaucucguuuacccuccguuucccuggaacagugugcugcaucuaacauaggcuccaaccugugcuggcaaaauguggggaugggaggcgguggugaaggcaggcugcagcccacucugguaaacacuauccagcaacccaggaggagaguccagcacuuccccaagcccggccaacacccgcucuccagaaggacagaguccccagcccaagggugagugcccuucagcccaguuaccugaccaggaagggacgggguggggccuggaugugacccaggaugcgcuguaccuccuucuucacaaggucaggcaccuggccuuccccagugccuccugggacccucccugagaggagguucugcacccugugaggggguuagaaggagugcuaugaggcugcagcagggcacagccuccagucuucacucuccuccuuaaggaaggguuccaggcaaagcucaugcucuagaagccuugccccagccaccccucucaaacaccccuaccuagugucauugucaucccauucaggaucccagaaaugccagccagaccucacucccugccuccucacccggugcuuuccaugaucuucugugggacauccuggcagggggggaugugcugcuccagggaccacaggaaauagcagagccuccgaaccagccagccccgaaaccugggcacagcucccagagcaggagggaagauccuucagagagggcccaccuccacuaggacucacagaaggcuauucaaucagaaagggaccacaccccagacccauguacuaggaacaccugagcaggaagagcugccuguccaucugugccccauucccaccccucacccuguugagucggguacagguucacagccugaaacacggugggcaauccauacaugcucacagaaggaacugcaagagagcuccaagucugccccucccugcaggcuuguguauggaacagaggacggggcccuucuuucucuaucagaggaagaaaauggcaccaaaaagcagggccccagcagcccugcacccaagggucccuguccccaagccugcuccaguccauagcucugacuaccuuguguucuccuccuucaccaggaucacauugcagaagccuagguccguuaugcuucuguggaagagggacuccugcaagacagggggagagacagcauguccuggggggccuuugcaaacugguaaagaaacgccccuguacugccccucuggcucugccugguggccugcuaagucuuccaggagaaaagauuacagcacaguauuucacaaaagguguuugaccccagauucuaggcuggcucaggaaaaaggggcccaugcucaaaacugaagugcuguauccuguacagaaucacccucuuucagagugguauaugaaagucuccagaaguuaucuucucaacagcagagaaaacgcagccugggucucca

SEQ ID NO: 13386 - RNA, 18669 nt, Homo sapiens
auccuguucagccacgggaagccggcguuugcacacauuuucggacgucauauuaaagcgcaccggacgccgagacuucugggagaugaaguccuugcgaaggccccgcauugauugggagcgcagucgccaggacccugugcgcaggcgcguugguuucccgaccugaagaggcgccgucuucccgggucccgagcacucugugccggaggugaggguugugggugugugucuucaaggagcggagugagcgcagcagccgagagaggggacaugagaacuuuggggaggugcugugggagcaaaacggggugacacgggcgaggccagccugcagagcgugugucgcgacgucucggugcggacggaaaguugugcauccacccccgugugugcgugugucccguggggucugggcacccauuguaugucggucccggacuuuaagguuggagguuuggagucuuccuccgccucucccguuucuucuucccauaaugggugcuuaaugaacguggguggaauugacaccaaaucuaggaugcugccgcuccgucuuugccagacagcgccucagauugccucauuuagcucccugcccugggccuccgcacgagugcuggagggcuucauggaggaggugggauuugacgugaaagaaaaacaacaacaacaaaacaaaaaccacgaaagaagcagcuaagcguuaggcagauuugagcuggagauaguuuuuacagaaaugcaggaacagugguagacaagguugaagaaaagguacgcugggagccagggcccgggacucagagaaucaggacaagacucaguaggcaagguggcuuauauaggugugauccagggacugacacgaaugaaacuauuuggagacaguuauucuagaggucacauucaggacuagagaggggaaaggaccaguagcagagagcuacuuaggaauguaugguaguuuuggaguaagauguuguggacuugaauuaugguggugguagugaaagggaaggauacagaugacacugcaaaagaagagucaaaagggccuggugacuagauuugggaggaaagagagugagguaagaguuugaauuugggacaccugggagaacaauaaaacaucugauacaaauguaaagccaggaagaggcguugauguguggaauugccuaaaggaagauaguuuugaggugaugguggaacgccugauuuaagguuugcagucauuuggaaaugcaggaugagucuggaagaaugcaauacaguuguauuguaaaauuacaauacaauuacaggacauggacaucuguagaguuugaaaauggagcccugaauguggauggacuuucugagggauggcaaaaacgaagaaaguacaaagacugagcuaugggcagcauccauguuuccagggcaaaaguggggaaaaagagucacagaaagacagcaauuuuagugguuggaagaaaagcuagugcaguaucauagcaguuacaguaaccacuugaauaagcagaagcuuguccgaacagugaaaagcuacagagaaauagauaauauggccgggcacaguggcucacgccuguaagucccagcacuuugggagucugaggcgggcggaucacgaggucaggagaucgagaccauccuggcuaacacggugaaaccccgucucuacuaaaaaaauacaaaaaauuagccgggcgugguggcgggcgccuguagucccggcuacucgggaggcugaggcaggagaauggcaugaacccggcaggcggagcuugcagugagccaagauugcgccacugcacuccagccugggugacagagcgagacucagucucaaaaaaaaaaaaaaaaaaaaagaaagaaauagagauaauaggaucagaaaugcauugguaggccaggugcgguagcucaugccuguaaucccagcacuuugggaagccgaggugggcagaucacuugacgucaggaguucaagaccagccuggccaacauggugaaaccccgucucuacaaaaauacaaaaauuagcagggcaugauggcgggugccuguaaucccagcuacuugggaggcugaggugggagaaucacuugagcccgagagguggagguugcagugagccgagaugaugccauugcucuucagccugggcgacaagagugaaauuccgucucaaaaaaaaaaaaaaaaaguaguuuucaagcaugccauuucaggugugugaggggcaaaagcugaaaaacagggacuggagaagaguaagugguaacaguguggagucaguagguuauuauucuccaaaaaguuugaucaugaaaggacaaccuaaaugagaacugcuuugcuagaaggaggucaugggauucagugaaaauaguuucagguagaggaggcuuguaugucuuugaagauguugaaagaaagugcuacugggguggaaaaugcuggaagaaaaaaaaaaaaagacuggggucugggcgcuguggcucaugccuguaaucccagcacugugggaggcugaggcaggcagaucaugaggucaagagauugaaaccauccuggccaaaauggugaaacucugucucuacuaaaaauacaaaaauuagcugggcaugguggcccgcgccuguagucccagcuacucaggaggcugaggcaggagaaucgcuugaaccugggaggcagagguugcagugagccaagaucgugccauugcacuccagccugggcgacagagccagacuccgucucaaaaaaaaaaaaaaaaaauacugggaagugcagggacaaauucugagaggaagcaaugugaaaaacaguggaacccaggguauaggacacaaagguaaaguccuggagacagacauuucugucuuguugaccucacacaucucgcugcccuagcacauaacagcuacuugguacauauucaucaaauagugggaugaguggauggauugcauugggcaguagaaaggaagagaacuuuauuuguugaaugaacuguaugauaaaugcuuuauauuaauggucucaccauuuauaacuaugcugugaguuaggugguaaacaacuguuggcuuaaguaacucauccaaggcuucaugguuaauaauuccaugcuuguggaaugcuuucuaccauauaacccugcuucccuugaaacucauuccugggaaucuuuggugugguagaagacaaaaguuaugcggaaauugaaugguacccauggagguuuggaauagccauguagcuaagaugggagcaguaaaagcuuucuggacgaugucaagggcucguuugaagauauagacugaauuuaggggacauuuucuccagugauacucugagaugcagggauaggaaaagagaacacagaaguggaggugguucuuggcuagcaguaacucccugugaguuugguggauuugagaagucuucagugucagugagcuuacugaagugacugcugguggagucuaaaccuaauggggagagaagucuacggaugaggagcacuuugggaguauccacugguuguuuaauaacuggggagcuuauauguucaccaccauuuguaauucguucagugcucaguuuaauuaaaguuguaaucuaauaaacaaaacuuugaaaauugucuuuaaacauuuaacacugagcaguuucgacugcaguuuuggauaugguuugauuuguucaaaaagcuccagugcuuuagacaaacauauacaaauacuuugacuccaaaguuauuacugcacuuacauuuaaaccuacucuaaaauagcagcaacucggccaggcgcaguggcucaugccuauaaucucagcacuuugggaugccaagguggggagaucaccugaggucaggaguucaagacccgcccggccaagauggugaaacccucuacaaaaauacaaaaauuagccaggcaugguggcaggcaccuauaaucccagcuacucaggaggcugaggcaggagaaucgcuugaaccggggaggcagagguugcagugagccgagauaaugucauugcacuccagcccgggagacagagcgagacccugucucaaaaaaaacaaacaaaaaaaugcaacaacucaguguaauuaauauuuucagugugucuaccuuccuagaauuauaacauuacuuauuacauuacauuagcuuauacuaacuuuacuuagcacauuauucuaaauguguuacauguguuacccuauuuaagcaucaagauaacugcaagagauauuacuuccguuauuccaguuuugcaaacaggcagacugagacagguuaagaaacuuuccugagguagcaccgguaggaagaggcagagguggauuuugauuucaggcagucugucuccagagccuguacucccaaugacuacacuuuccuguaucucuaaaugcuaauuuugacuuauuucuagggccuaaggguaauauuuggauacccucuugugauggacgaaucuuaacagaccaaaaaggaaaagaauacuuuuagacaauacacguugcaugcucugguuaucaauugacaugucuuuguuucuguuuguguuuauaucugccuccucccagcaagauucaaacccuaaucucuccccguuagguuggggguguuuuuuguuuauuaguuuuugcuuauacuuagcuaaacuuguuuuuccaauaaguuuuugcuuuucacguaguuuuugcaaacugguauucacccucaagguaauauucuuuuaaaauuuugcuuggccagugugaacccauuguuaaauaacccugagcugucuggcaacuuuuaacucuaagcuauaaugauuuauuuucaugaaaagauagcauagguaacagaccaauagacuagaacagaaaauccccgaauauccaagaauaugauagaccuguuauagaauagaguuaaaugcuaccaaacagaccaguaaauaucuauugaucuggucuuuugacauuuuugaaaacuuaguuguuccuuauuuuuguguuugauucauaagucuagcuguagggagacauauccuaagggagaaaggaugaagucugcacaguuacuaugcuucuuuggaagcagagguugguucauuguuaguagagcccauuucucuuucuacuugauacuuacguguggccccaguacugauuaguccucccuguuugggguauguaguucuguaucuagaauuaccugguuuauucccauuccaaauuucuuuuuacauacuuauaugaguagauacaaguaucuauccugaggguacaucuauagucauacaauuaauagaaaaaaguaccuuuuuauguaaguaaaguuuuaaacauugccuuccuuguauuacaacuuuuauggcauauuuuauauuaacuuuucuauuuugaauaugaaacucauaguccuucaaaguucaaauuauuuuauuuagcgcuagugauuuuuauuauuuaucuggccagugggagccagagucaucugaguuuucuuauucaaagauguggggucggcucaaauucugaauguccaaaacuguacucauugguuuucccuucaguccuucucuguaccuuaucuccaugaacggcaucguuauccaugccgcauugguaacccgggcgucaucuuugcccucaucaccuucagccucuucuuccagccaguguauugucuguuuuucuucuucuucuuuuuuuuuuuuuuccccgacucagagucuugcucugucacccaggcuagagugcaguggugugaucucggcucacugcaaccuuugccucccggguuugagcgauucuccugccucagccucccaaguagcugggauuacaggugccugccacggugccuggcuaauuuuuguauuuuuaguagaaacaggguuucaccaucuuggccaggcuggucuugaacuccugaccucgugauccacccgccucggccucccaaagugcugagauuacaggcgugagccaccgcacccagccugucuguucuuaauagcuugacagcaguuuccaacauuucugcuuucacagcuuucauucaguuugucaucuuucuuauuuaauuauaacacucuccucaauggucuacucaccuccauucuuuccuuccuguaaucccaucacaccacagccacucaguguggcguggccaccuguguugggguccccaggaucaccccagguucagggauucacuagaaggacucaagacucgacccauaguuguacuucuggcuaagaguaugaugaugacccugcaaggauaggcagccagaucauaaggggaaaagacaagccggguagaggaauccguauauaggcuugcuucuauucucuuucucccaugugggugucacauggagcacacuccuucccccagcaacgaaaaugcagcaacaagugugaugucucugcucaaggaagcucauuggagacucagagcccauguuuuuuauugagggcuaagucacauaggcaccgucugccuaacacauaccaaaauuccagacccuccaauaggagagcacauguucaccauaaacgacauuguuugcacaaauaguuuaggcauaguagaccaccguuaucucuuagggaacuggggaacccucucaaaaucgaaguuuccagcugccagcgaagggccagcaugcaagcagaacuuucuaggaauagcagucucaggucugcugugacuuuucugcacaccacccuucuuuccuuccuguuauuuuuuucuguacaccaaaauaaggacuuacucuuguugaaaaaaauauaugaagaaugguaagaaaauaaaaauaacuuauaacucaccacucaaauuucauuuacauuuuauuauguguuuuuccuuuuucuauacauaaugugcauguacaaauauguaauuuuaaaagugugcauucuucaaguguuuugaauuucuuugugguuuuuuuuuuuuuuuuuagauggagucucacucugucacccaggcuggagugcaguggcgugagcucagcucacugcaaccucugccuucuggguucaagcaauucuccugccucagccuccaggguagcuggcacuacagccacgugccaucaugccuggcuaauuuuuguauuuuuaguagagacgggauuucaccauguuggccaagcuggucuugaacuccuaaccucaagugauccacacgccucggucucccaaagugcugggauuacaggugugagccacugcaccuggccguucuuugugguuuuuuuucaguuguugauuuuuuuuuuuuuuguaagaaacaaagcauuacagauaaagcugaaguauccuggguauccuuccccagucuuauuucccuuucuucucagauauguacacauuugcugcuuauugucccauguguuaauagauuuuuguagguauuauuuaccuguuuuuaaauuuuauguaaauauuauacaguaagucauucuauaacuuauuuuuugcccaguaauuauguuuuuguaauuuaucucuguuaacaugagauaauguauaauauucauauauaauguauaauacacauauucauauauaauauucauauaugagauaauguauauauauucacaaauccuuuaucugauuaauggacauugaaguuguuugcaguuuaucacuagugaucuucuccccagugacuuguaaugccaccucagucauacaucaggcuucccuaauguuuggauauguuuugggauuuucuguucuagucuauuggucuguaauugauguggcuaucuuuucaugaaaauaaaucaugguagcaugaaaguuaaaaccucccaggcagacaugguuucaaguucuaccucagauucuuacaaagccuuaauuuccuaaucuguaaaauagugccuaccuuauugauuuaugaggauggaguuaaauuagccuuauaaaaagcacuuagcacaguaccuggcaaauagaaaauacucaauaaugcuaguuguuauuaagaugauggguuuuuuuguuuugguuugguuuguuugagauggagucuugcucugucgccaggcuggagugcaguggcacgaucuuggcucacugcaaccuccgccucccagggucaaccaauucuccugccucagccucccaaguagcugggacuaaaggcacacgccaccacgcccagcuaauuuuuuuguauuguuaguagagacuggguuucaccauuuuggccaggauggucuccaucucuugaccucaugauccgcaugucuuggccucccaaagugcugggauuacaggcgugagccaccgugccaggccaagaugauguuuaauaguguuccauuauauguauggacugggccauaaauuauuuaaccaagucuccagauguuuaagguauuucaaauuuuugcugccuuauugaaaagauuaaaugagauaauacauauaaagugcuuaggaagugcccuggaacauagcugucaauaaggguuaguguuaaugaugagucauaaaaagcuguguauauaucauauaucauuacuuauuuccuaguauaaauuccuaggagagaauugcugggucaaacaguauguuucaaggcccuugcuauaagucacagugauuuuuuaaagcacggaugugaugacauguccacacccaaauccuucaguaaucuccaugccuguggagaaagggccaugcaaagcucuccucgaugaaacuggccucugccuaccucuuuucccucaucuuccccacagcacugcucacagccuagacuucuaccauucuaagcuaauuuuuguuguuaauccuuuccauguaaagaccugccuccuucuuuuugaaaaacuugagguuuuuuucucaagauuuagaauguucuagcuccucccacaaaugaaaacuuagcuuagaucccacuccugucaagaaagcugcagaguuccuccuuccaucccucccugcuggguuaggugagccucugaggugcucucauggauugcugugcauaucgcuuugcugcucuuaaugcauccuggagugaaauauuaucucauuuacuuguuuguucucugugcuaagcuauagcuucuggaggacaaagacagugucugacaguuuuucugugcuugauguaaguaguuggugcugaauaaaugcugguugaauagaaggaugaaugaaugagucacaagaagcagugaccauauccccuugacuguuggagaauggucagugcaccgcaaauaugccuuuuccuccuccucaccaggaccacaccaucucccagccaccauaaaucccagaaaugugggauuuaaugcucuuguuuuauuuuuauauuuuuuuauuuuuauagagacagaggucuugcuauguugcccaggcuggucuugagaacuccuggccucaagugauccuuccaccucggcuucccaaagugcugggauuacagacaugugccaccgugccuggucuguuguuuuaauuagacucuugauugugaaaaacugagacuuagcuaaucccaguaaagggaauuagugauaagaucuugcacagagcccaagagaguuagaguauuauggcaaucuaugaauaaauaaggaugguuugcauggaaauuggagcccauggguggugcuaggcgaggugagggcuuccccaggaauucuuaggucuuugcgucaguguuucaccgcugaugggacugcgcugggcuucccccugccugccucuggucccguggucuauuaugaccuuuucucuaccuuguaccucccaugugcccauggguucugcugcugguaacuuugguuccccgauccuuguggcugcuucaggacguccuuucaugauauccuuucagcucgucacccacuuguccugacauuucuuaguucacauucccaaggaaggaugucaucuuuucaagccagaucacaucucaaucuacuagucaugugugcauuacccaccuguggccuaaucaguguggcuccgggaauaagacacagggucacaugguacaaaaccuggcugcccaagggaugcuccuuuagcaagggcuaugagugggguauuuuuccuuugaagagacuggauugucuuugauaugucuuguccauguagucauuuauaaaauugcuaauggcuuuugcccaguaaucauucagggcaauauugaaugugaauuuuuacguacugugugaaucuuacacaguucuugacucucaggaacagaacucugccucuagcaucgugguaaaaaccaccaccacauuguggucuaauucgcaguuccaugguuguuggcucuaauucugggguggucugggauuguuccuggcuuugcuuuacuuagacccccuuuuguaagguauugaggaugacauaucccccugguaugugcuucaugggucaaaagacuaugcgacaggacuggucuuucuccuaccuucuuucucaccccccacuucugccucauuaggacucugcccuuguccacaaggagagcacacaggagagaauggcugcugugucuccgaccaccagaugccaggugagguggacuuuuguguucccgaaauacuccauucaucuccagaauguaaccacuuuucuuucucuauccuggagccucuuugagcagacccagccaggcagaugaaggacuccacagggaguauuucuuuccuauuugacuugagguauccuuuagugaccuuuucuugcugugagcaugugcccauuagcuugucaccaggcuuaacaacuccuggagccuucacugugagugauuuugccuagaagccaaugguagggucugauuggaagguuuggggaauagugggcugguucugguccugacagucccuuugguacauucauguguggacugagaggaggcuccaguguuccagggaguguggggcuaggcuggggcgugugauacacacuguagagcaccucuguggggugcuaagagcccugaagagagucuccugugcuagagacuguguggcuugcuccauuccugcccgagggcagagucuuaaauucugcauccuggccuagaacuuuugcagacacacuggagacucaucugagguuuuagaacugaagguaaagagaugcaaucuuacagaaucacagagcauuagaaugaaaugagagggauccuacagaugaucuaaucaacaccauuauucuaaggauuuguaaaaaaaaaaagacaauuggugaaauuugaguaagauuguagauuagauaauaguauaagaucaaugcuauuuucuccauuuuuuauaguuauacugugauuauaacaacaguacauccuuguuuuuacaaaauacacacugaaauauuuaggauuaaagacacaugauguugacaaguuagucaagaggccuaacaaaaagauaggagaauguguaucuagagagagacagaaaaauaaaguaaauguggaaaauguugacaguugaggaagccaggugaaggguacacaggaauuuuuuugugcuguuuuuagaagucugaaaaaagagucugauauucagaagcucagcuguaaguauaguggugugagauucugaccaagaacuucaugucuugggugaugaggccacuuuucccaaaugcuuuaaaguucuacucagucagaacuguuuuucuuuccucccaccaugcguccuccagggcugucaucuuugacauuuuuggucugguccaaguaaagagaaggauuaagaguaagggagaaugugauuguauuuucaggaaucagugacauucgaagacguugccgugguuuucacagaugaagaguggagucgucugguccccauacagagggaccucuacaaggaggugaugcuggagaacuauaacagcauugugucauuggguaaggggagccuccaugaggagguacagucuguacuaugcuaauguggggcugagagggcugaggaauuaauaccguucuccuccccgcugaguucugagccaccugagagauaaaguaagagucgaaagauguggcaucagaguacagcaacggcgggcucaauacugaaccccagcauugggcagacaugccuccccagccaugggcagugcuggaugaccauaggcucucucgcucagcagccugcccggcaaaauucagggagggccagcgagggcugagggacagagcggaauguguguuagaggcagggagcuggcgcuccagaggggcaggcagaagacgcugaguuucauaugcccaguucucccaguucgccaguuagguaacucagcucacccagaggagugugcgcugggguagggggccaucuugucggaauucaggguugugccucugaggucaccagauauauguuugauuuugaauauuugucuuagguacagucuuagaugcucacagaagacacuuuguaauuauagagacuugugugacaaagagaaaguuaagagucacugcugauucugguguuagugaaaaguaaaguugggcuccuggagguuaugagaaccuuucaggagcuucacgagaggcugagagagugcccagauugagaaaccggcuuaaaauaagcagcagauggcaguaaaaggagucacauugcagauuuccuacgaggcaggucaaaaaguaagugcuaacaccccccagauuaacuuaaucaggccaauugucucccaaacagaauggaauauucaggaggcaucaaaggagcauuuguuacaggcuuuaguagauggcauauugaggaaaauagaaccccugaggucagggacagagagccacagggagaugcuggguguggccguuuugucaacagagaauccacagaaaacccgguagacaauccuugggcccaauaagaaagugccucuuucccaaguuggggccucagcaaaagggaaguuuagagcccaagccuauuuccaggaucuauuuuuuaauauaaccaaaaauggauagauuugcuucagggaauuuauccuaaggaaauaauaggacuaguaguccaugguguaugcagauguucaucacacuauuguuuguuaauagcaaaacguuaaaaauggucuaaauuucuaucauaagggaauucauuaaauaaauuauguuauccauacaaugucauaucccguagccauuacaauggugagguagaucaguacugauauaaauaaaaugguauuuuaaauuuauugugugaaaaaaaaucagcuuuacaaaucagcgucauuucauuauccagguuugguuuuuuuuguuuuuuuuuuuuuuuugagacagagucucacucuguugccuagguuggagugcagugaugcaaucucggcucacugcaaccucugucuccaggguucaagcaauucucgugccucagucucccaaguagcugggauuacagccaugggccaccaugcccugcuaauuuuuguauuuuuaguagagacaggguuucaccauguuggccaggcuggucuugaacuccugaccucaggugauccacccaucucggccucccaaagugcugggauuacuggcaggagccacugugcccagccucauuauccaguuuuuaacagaauguauuuaugggugucuuuggauaucugaauagaaagaaagaaaauacacuguaggcaaggugauuuuuucuuuuugcuuguauacacuucuaauuuuccuagaaugcaccggacagacuuguuucaaugaaagcacaauguucaaggcaaacaaauaaacaaaaaugggcaguuuggauacacuuuuuacucaaggugacuuaauuucauucucaucucuccuaagccaacgaccuucauccuaccagugcuaacacugggaacuucccauucacuucacagggaagaauaaacacgugaaucuacacggguucucucaaccuucugaccuugugccacuugcuccuuuuauagccucaguccuggccuccguccagagguuccucugcuuuggacucugcauucuuggcuugugcguucugccuuuugcauuuucucucuaaaagacuuagaugcuguggccaggcucaguggcucaugccuguaaucccagcucuuugggaggccgcggcagguggaucaccugaggucaggaguucgaaaccagcguggccaugauggcaaagccccaucucuacuaaaaauacaaaaauuagccaggugugguggcacccgccuauaauuccagcuacuugggaggcugaggcaggagaaucacuugaaccugggagauggagguugcagugagccgagaucaggccacagcauuccagccugggcgacagagugagaugcugucucaacaacaacaaaaaaaucuuagaggcugggauugagcuuugggagagugauauuauuuucaucacacacagccaccugcuuuguuucuuucucuuugagcaggccuuccaguuccucaaccugaugugauuuuccaauugaagagaggggacaagccguggaugguagaucuucaugggucugaggagagagaauggccagagagugucucucuagguaacugagugugaacaagacagaauggaauuuuguuuggcuuuuuguuauuugggugaugggggaaauaacagguaucaucuuucucucaaauucaagucuucugcuuuauuauuuauuguauaucacccaauagcuuuuauuuuuuucccucuacaccuuaacguguuauucaucuauauucaccaaguguuacuuucucacgucuguaacguugugcacucacacuuugcuauuucuuuuuuuuuuuuuuuugagacagagucucgcucuguugcccaggcuggagugcaauggcgcuaucucagcucacuguaaccuccaccucccagguucaagcgauucugccugccucagccucccaaguagcugggauuacaggcacccgcuaccacgccuggauaauuuuuguauuuuaguagagaugggguuucgccaugauggccaugcuggucucgaacuccugaccucaggugauccgcccaccuuggccucccaaagugcuaggauuacaggugugagccaccaugcccagccacacuuugcuauugcuauugagugccauccugucuauucggcaugcucuccugauuguccuggccaugcucccacuggacauucuccuguuuucugagguguccaccauccauucuguucccugccaccuucuucacucccaggucuuagucccucccugccguguaagacuaucuaugggagcaagcaaugcagugaccauacauuacuuucagacucaucggagcaucucuucuuucuguaauauuuccuagcccaggaaaaaaacugcaucuguuuucuguuuguuccagacugggaaacuaagccugagauucacgaugcuucagacaaaaaaucagaaggaucauugagggaaugccuuggaaggcaaaguccucuguguccuaaauuugaaguucauacacccaauggcaggaugggaacagaaaagcaaagcccuucaggggagacucguaagaaaucccucucccgggacaaaggcuugcggcggcgacggucagcccuguccagggaaauucucacuaaagagagacaccaggaaugcagugacugugggaagaccuuuuuugaccacucaucccucacccgccaucagaggacucacacuggggagaagcccuacgacugccgcgagugugggaaagccuucagccacaggagcagccucagcagacaucugaugucacacacuggggagagccccuacgagugcagugugugcucaaaagccuucuuugaccguucgucccuaacuguccaucagcgaauucacacuggagagaaacccuuucagugcaacgaguguggaaaagccuuuuuugaccguucaucccuuacucgacaccagagaauucacacuggagaaaguccuuaugaaugucaucagugugggaaagccuuuagccagaaaaguauucuuacucgccaucagcuaauccacacuggcaggaagccuuaugaguguaacgagugcgggaaagcuuucuauggugucucgucucugaauagacaucagaaagcucaugcuggggacccucgcuaucaguguaacgaguguggcaaagcuuucuuugaccgcucaucccuuacacagcaucagaagauccacacuggagacaagccauaugaaugcagcgaaugcgggaaagccuuuagccagcggugccggcucacgcggcaucagcguguccacacgggagagaagcccuuugaaugcacugugugugggaaaguuuucaguucaaaaucuucuguuauucaacaucaacggcguuacgccaaacagggaauagacugaguugggcaaaagcuuggguaggacaagaacuuccauacaaauuugagauagaucucgccugucuuaaagcugccauuugcucauucuacccacucuggcugccguuguccuguccugcuucugcgccagaguguuuaauaagcacucccuuccugcuguguuauagaacuguaggggaggccauggaaaugacucuaaagauacaaaauuuugaagagguuugucagacaauaggauagauguuaggaggagacacaccucuugucugagaaccuaggccccagguaucacugcacuuuaagaaacuggaggcugcaacaggagggaaaggcagaaugauaucacagcaguacuauuuuuuuuuuucagaacauuuguuuugauggcuguuagucccccucucuuggagcauuuuggggcacuaaucuuguucucuugugucccagcuuuuagaccucuuacuuccacugcuaguagcuagcacuuacugagcaccugcgaugagguaaagacucagcuaaggguuuuacaggaaguagauuaauugauccugucaccaaccauaugaaguaggcacuguuaccaucugcaucuccagaugagcacccugagguuuagagagauuaaaucacuugcccaaggugaaccagcugguaaaaggugaugccaggucuugaagacagguccaccuucaaaaucuauucucuuuaccauuaugcucgaugguuuguuuguuuuauaauuuauguauauguauuauccucucaacuagauuguaagcacuuggaggugugacuuacaggucuuuguaucucacacagugccuugcuaauaggugcucaauaaauauuuauaugagugaaugacuuuucuacuuaccaaauucucuccauucagaacaccucuuggauuugcauacuuucucugaauucacagcccagccuauacuuuuaucauccccagcucccacuccuggcagcaguagcuuucuaauuccaguucuuccugcuuuauugaagagggaugugcuaagcugugguacaguaacaagcccgcagagagcuaugucucccuuaaaaccugacgggaaccauucugucuuauucuauccucauuauuuggaacaucuggcuuccaaagucaccacaagggcggaagagaaagcuagaggaauuuguaggauauuuucuuagacccaggcuuacaucacuucuguccacaucuaauaagccagaacccagcaccuagaagcuaggaaaguaaacaagcaccucgaaaguugguuaauaccaagaaccucucucacaguuauauuuugcauacuacuguuaagccagucuuugcaaaugaccccuuccugcccaucacugccuuccucaagaccuaaaauagcucccuauuuagugaaaaauuaucugaauauuuaaggucugccuuaacgugauccccauugcugaauuuuaccuccugacuccaaaaacucuucucuucccugggcccaguccuauuuuuuuuuuuuuuuuuuuuuuugugagacagagucucacucugucacccagguuggaaugcaauggcacaaucuccgcucacugcaagcuccgccucccggguucacgccauucuccugccucagccucccgaauagcugggacuacaggugcccgccaacacgcccggcuaauuuuuuguauuuuuaguagagacgggguuucaccguguuagccaggauggucucaaucuccugaccucgugauccgcccgccucggccucccaaagugcugggauuacagacguaagucaccgugcccggccuauauuuuuauuuuauuaaagguuaggcacuagaugaccuugacucuaggcaucugcauucucuugaucuuugcuuagggugaagcucagaaaaggacuugguucugaaaggcugucuggaauuagauuguccuacgugauucccagugaauugagaugaauuuccucuggaaguucaagucggauucgagaagcugaauuaccaaacagacccuccccaaccuacuaacgacccuauuacucuguucacccuagagcagacgaacggcagggaagacuugaucuguggacuuuugaaagcaacuugaggaaaaacacauaacagaaucuauagguguggacaauaugugauauugcuaaauaaugucaaguaggaaauaaaagagacuauugaca

SEQ ID NO: 13387 - RNA, 40421 nt, Homo sapiens
cgacugcggcugcgcgggguauucgaaucggcggcggcuucuaguuugcgguucagguuuggccgcugccggccagcguccucuggccauggacaccccggaaaauguccuucaguaaguguccgucuggugggguggggaagcccagggggcuggggcgccugggguucgggcccggcccgccccagaccugccuucuuuugcccccuucgcccccuuccuggguuuggaaugugucccacccagcaaggccgugggcugcuugagagccggggagggcuccggcaccuuggguuccgcugaggcccggcgcuuguccgcccaucugcgccgcgguggccguuuggagcaaucuggauaauucguuaggcccucagagcucucguuuauucuuuguaaggaauccccuccugacaguucaaccuaacaaaaauccugaaccuuguguuuagauuuugugauacguuuucaaagucacguauuuaacaauucgacuacaguagggaacgaauuuaaaguugcucuccuauccauaaucucacugcuauuuuuuaaaagucuuugaauacaggguacuuuaagaaaaaaaaauugaaaaaaaauagcuuugcucauuauugagugaugugugccaaccugcuaacaucacucacuuuuuacuuaaaguucccacgccuuuguuuuaugacuuagaugauuuacccagacuguuacuuaaaggcauuuaaaacaauuaagucauagguucaggaaguaaaacugguccguuuuaucaguucuuugcgaucagaagaccgagauuguuaaaugcagucaaaacaaaaauccauuugcucuaagacuuuuucuguaaccuucaaccuagccagcaaauuauuuucuuucagaagucccccgccccuuuuuuaaagguaaagcagauauuccugguccuguuuugacuuacuaaagauuaaugugcuuuaaugaacuggauguuuuacuauuacagugcauuuaggucauuuuacuagagaaaugugguugguguuagaauaugaaauguuuaccuugggcgagccuacuagacauauuuuggaagaaagguucugaaauagggauuugucccucugcuauaagacaugagagacauucaaacuucagaauuauuauuuuuuuuaguuuuaaaaauaagcaaugcguuuauaugacuaaaagaagauuuagaacaguauuuaccgagaacuccuguaccugacuacugucccacucugucacauguaaccguuuuucuaguuucuuuuuggaaauauaaauauuuacauuauuauaauauauuaaaugucugcacguuuguauacauuuuuugccuuuaccacacauaaaauauaacaguauauauauacgcugcucuuuugccuaacaauaucccuggagaucucuaccaauacauaaaguucuuucuuauucuuuuuuuacagcuguguaauacuucauguacccuaauugaucuaagcagucaacacagguuguugacaaucuguuucaaauaguggcacggugaaaaaucuuguacauaacauuuugcggauacacauguguaugugucuucuagaucugcagaagcgguuuguuggaucaaaagcaaaucaguccaguuuugguagauaauucccuuggcaggaauugagcacaugcccaccuacaagcaagaugcgacagagagccuguuucuuauugcugcaccuacacaaucuuuucacauguuuuuuaguuuugccaaucugaugagugaagaauuguuucucagcgaagugaauuucuguuaugagagacugaacauuuuucauguuugugagccauguaucuuuuucugugaaauaauuuauuaugcccuuugcucauuaaaaaaaaauagguuaauaguuuuuuucucagcuucuaaaagcucauuguuuuuccaguuuaucauuucucuuuugacuauuuugugguuuuuuuguuuguuuugguuauuugccauggagaaguuuuuauuuauauauaguugucuuuauuuagcuuuucuuuuguggcuucuggauuuugagucauaagaaacauugauuucauucauauaccgaggugauagcuagaaguaaauauugcuuuuuaggcaggacaugguggcucaugccuguaauucuaacacuuugggagaccaaggugagagagucacuugaggccaggaguucaagaccagccugcgaaauauagugauaccucaucucggcaaaaaauaaaaaauuagccagacaugguggcaugugccuguagccucagcuacucaggaggcugaggcaggaggaucucuugaacacaagaguucgagguuacagcgagccaugauugcacuguugcacuccagcgugggcaacagagcaagauuccaucucuaaaaaaauaaaaauaaaaauacauauugcuuuuuacaucguuuuuucaaaaaaaaaaaaaaucuuauagugucucagauagaaaaccucggagucuuccugacugguuucccacuucgauucucaccucuaccuccuucacacagagggacauuaaaaugcaaauuaggucuugucacccccaccuuuuccugcucaucacacuugaaccacacuggcuugcuuucuguucuugaaguucucucagccuugaccauuucccccucagauagcuacguggcugucuggcacugaucacaugucaccgccucugagaggcagggcuuccuugaccagccuaucuaaaaauaguaacucaucacauucucacccuuucuccuauuauauguuauuuuguuuguucuucugaguacuuaauguaaccugacauuacuuugcauguuucuuuuuguuuagcccuucuagcucuccccaaggggaauuuugcuuugccuggcugcuuuuuuucagcuguaguugaguauauggaagugggggaugcagaguucucugggagcucuguggcugauuucugagcacuguuaucaucugcucuuccucagggacuuuguuacuuugaagcaaugaaaacaaacugugucugggaacucuacuuugugguacucugggcugccucacacccguuuacaaucccucuuugacucguuccagccgugucucagccaugcuccugggaagcaaaggcaggugucugagucagugccaugccuggaucccacuggaagggcaggugucucagucagugccaugccuagaucccacuggaagggcagaggucugagucagugccaugccuggaucccacuggaagggcagaggucugagucagugccaugccuggauccugcuggaagggcaggagucugagucagugccaugcuuggauccucuuguuaggaggaggagcaaacuucuggcaacugccccucauggugguagugacauugggguuccgugagaggagaaggagacucuuggggauagagcugggacuuauggaaaaacacuggcugcuucugaguuuucugacuaugucugagcgaaugcuucuuaaaauuuuaaauacuauuuggaucgauauuuaagauuuucauuuuaaugcauauaaaugguguauauauaaaaugauugauauuuaagauuuuuguuuuaaugcacauaaaugguauauauaaaaugaaguauaucuuuugcuuguagaaauuaucccuaauaucccaugugcauaccuuucucucuucuaggaugcuugaagcccacaugcagagcuacaagggcaaugacccucuuggugaaugggaaaggucagcauuuaguuauuuuauuucccuuaaacaaacuauacacugccccauggaaaauuaacauuauccauauuuuucuagauacauacaguggguagaagagaauuuuccugagaauaaagaauacuugauaacuuuacuagaacauuuaaugaaggaauuuuuagauaagaagaaauaccacaaugacccaagauucaucaguuauuguuuaaaauuuguaaguauacuuaagauguauaaucaaaucuauaaucauguuguacuuuugcuuuuuaaacuuagauuguaagaucauuuuaggcuuuuaauuccuuguuucuaguucugaagauacagagaggaaaaucuguucauucucugauucaacagacuucugugccacuagugauuaaaaaguauguaggggcugggcgcaguggcucacaccuguaaucccagcacuuugggaggccaaggcaggucgaucacuuuaguucaggaguucgagaccagccuggccaacgugguaaaauccugucucuacuaaaaauacaaaaauuaacugggcaugguggcaggcaccuguaaucccagcuacucggggggcuauggcaggagaauugcucgagccugggagguggagguugccaugagccgagaucagaucaugucacugcacuccagccugggugacagagugagacucuguccccaccccccgcucccccaccaaaaaaaaaguaugugcggacuucucucuaccagcaaccagucaaucaacucuguaguugugucuccaauucaauuccagcacuaccugaaaauaacuucagauuccacagcuuaaggguucuguuccacaagacugccucucacuuacaaugccaguugcaagccacagguuguuuuaccugugcuucugccugacuggcuacaaagcagaguucgcacaacccucucccugggucugaguucgaucaguuugcaugaguggcucacagaacucaaggaaacaccuacgguuaauguuuuauuauaaaggauauuauuaagaauacugaugaacaccagaugaagagauguuuagggcaagguauuggggaagguguguggagcuuccuugcccuuuccaggugugacacccuccaggaaccuccauguauuuagcucuccagaagcuugucuaagcucuaucguuuuggguuuuuauggaggugccuuacacagacaugauugauuaaaucauuggccauuggugauuggcuuaaacuucagucccucuucccucccuggagguucagcaguggggcugaaaaguccaacccucuaaaccugccuugguuuugcugaugaccagcucccauccgaagcuaccuaggggcucccagcuuagcuggcuaacuccucaccagacauagacuagcaguuccauuauucuuaugucuuuuuguuuuggguucguguaggcugaguacaacagugaccuccaucaauuuuuugaguuucuguacaaccaugggauuggaacccugucauccccucuguacauugccugggcggggcaucuggaagcccaaggagagcugcagcaugccagugcuguccuucagagaggaauucaaaaccaggcugaacccagagaguuccugcaacaacaauacagguaguuacaaagucaaacucucugugaugauucugacuuugaaaaguaauguuugcuguuaaaaauuguaucauuagcaauuuguacagggaaauccuucuaguuuuggacaauguggauaauacaggauaguguaaagaaaaaaacugcucagaaauauuacuguuaacaauaacuggcacauuuccuucuaguaucuuuuccuguaccuguguggguaucuuuguguuuauauauuuuaacagcaaaucauauuguaugucuaguuauacauacaaagaaauacuuaagaaauuaugagcuuuuaaacuacuucuauaguaguugugaaaucugucacaguguugugucauaauccacucuccaauuggacauugaaguuguuuacauuuugauuuuuauaaacagcaccaugauaaauacuuuuuuuuuuugagauggagucucacucugucgcccaggcuggagugcgaugguguaaucucagcucacugcaaccugccacuucugggcucaagagauucuccugccucagccucuugacuagcugggacuauagggacgugccaccaugcccagcuaauuuuuguauuuuuaguagagacgagguuucgccauguuggccagacuggucuugaaccccugaccucaagugaucuuccugccucacucggccucccaaagugcugggauuacaggugugagccacugcgccuggccugugaugaauauauuucuuaauaacauuguucacauuuuuaaaacuuuuucuaugauuaaacauaucucacuuagggaauugugaaaauacagaaaacgaaagaaaaccuuuuggcauuuuccuuggcgcuuuuuucucuucuuguuacaggauugcaugcaugcuuuauguacauauacagcuuugcgucaaggucuuuuuccuucaucauaaaauuauuuuuuaguauauuuccuauuuuuacuuaguuucuuuucauagauucucagaauugaaacuauugagucaaagaguauaugaagaguuuuuacacuuguggugcauguaaccaaacuaccuacuugaagguuauaccaauuguuuacucuuccccucucauuaguagaauuugagaccuauuaucuacugcaccccuugccagccuuuaauauacucaucuuuucaguuuuucuguaguacucaugcuuuuuuaaaacgucauugagauuuuucaaacacacauaaaaaagaaaaaauuaguauaauaaacuuccauuuaucuaucaccaacuuuuaauaauuaacauuuuguguuucucaaugcugacaaauuuuaaagccgauccauaacagcaaaauauuuuuccccaaacccuauuguaaacaucucuaaaaucuuauuucuuacagagccuuauucgauaaucauaccuaagaaaacuaacaauaauuauuuaauauguaauuuucagucuuuccucaucacguaaaauggcuucuuaaccauugguuuguuugacuuaagagccaacaaggguuaccacuugguugcuuuauagugugcacuuuggcucgcaucgcucagaaaugucaggcaugggaauugcacauuacccgacagguagaguugaaaaugaaauaugccaugaaaugacauauuugagaacuucucacagaguaugaacaaugaugucugccuuuugaagcaguaaucuaaguacuuuuguacuuucacuucuuucuuccaaauauauucauuauguuccaaauguauaaagaaccuaaaguaggaggucaaacauccuguguuagaacauuugcagacuugacacguggagaagagggugcauuuuuauaugaauuugagaaauacuaacauaaacuaagcaaaaggaggaauuuuuguaauacagauaauguauuggauauaaaaauauuuccagaauuuuauuuuuuaauuucgaagcaacucuaaaaugcaacuguacauucucucuugacgucagacuuuacuagcuuauaauaaguugucuaugguauuuaguuuucacucuaacagcuauguacuguaaguuuauaaucuacauugaugccuuuucugcugucauuuagguuauuucagacacgccucacugaaacccauuugccagcucaagguaaaaucaggcuuucuaaaaugccuguuguuguccauuuagucuuggauuuguacuaguauuuucuuuucuuuaaaaaacaaacccggcugggcaugguggcucacaccuguaaucccagcacuuugggaggccaagaugggugcaucaccuggggucaggaguucgagaccagccuggccaacauggugaaaccccaucucuacuaaaauacaaaaauuagccaggugugguggugggcaucuguaguccuggcuacucaggaggcugaggcaggagaauugcuugagcccgggaggcagagguugcagugagcugaaaucaugccacuucauuccagcccgggcgacagagugagacuccgucuccacaaaaaaaaaaaaaaaaaaaaaaaaaaacccauccaauuuuuaaugaaaaccaaauugcacucucagguaacagagaaagcauucugaucaucauaaugcccacuaaauagccccaaagagcagaggcuuugucuuagcauuuuaaaagcucaaaccugcaaaaaaaaaauugauaauuucacuguauuuguaggauuuuuuuuuaauucaaaauugaccaaaauacuuaaucuggacuccaucuauuuugaauggaaucaaauguguuuaaugcaacuuuuaaagaaauacagccauuucuuuuucuuagaacuaaguaucacauuucagcaauaagcauugccuauccuaucugguuguuuaaaauuauuaguuagguuuuacauuucuuuuggguacuuccuggcauguugaguugaucagaaaauuguauaauacuuauuuuaaaaacguuuuaguugaaauuucugagacagugugaaugaguugauuuacuucuuaugauuccuacuggaaggaucaggggaauuuauuaugugauaauuuuacuuacgguuuuacccuuaauuucuccguauuuuauccucuuuucccucauagcuagaaccucagaaccucugcauaauguucagguuuuaaaucaaaugauaacaucaaaaucaaauccaggaaauaacauggccugcauuucuaagaaucagguaauaaugacauuuguagcuuguguggaaacugggaaugguauugaauggccagccuggcugccuucuacauccacuuugacaucucauuucuuugaucuuucucuucauggcucugagcuccaugucagccaccugcuccuguggcaacuuccugggccuguuauucucccacacagcucaccucaaauacaauuuguugucuaacccagaggcccucaccacacggccuccugucuuuacucuccccaccagcuuuucccuuaccaauguccuuuccucuguucugcuggccucugcauaggcucuggaaaucccuacugggaauggauccaccugggggcuucugagccuggcuuucaaaacucagagccucaaagauugcugccuguuaccucaaguaacagggaggucucauacucccaggcaaugggucauacucccaggcaaugggacaugcuuccagugucugauucacucuuuauguuuuguguaucucuuauguuuccagguucacucuagcgccaaacuauagugauuuuagacuucuuuucagucucuucaaacuugggaccucgcuaccucuagccucucucucaggaacuucaaaaauacuauuucaacagauagcagaugccaucaagugacaucuaucaguuuucugccaccaaccaauaaauguaacugcauccuucccugugagaaaagguggccuucuaucugugcuuguccuuauccucaucaagguuuuugcccuguggagaucucuucugccuccaugguguaucaacaugggaaaaugcucaagucucucuucuucccucagccucauguuucccaacuauguuucccauguuacccuccacaguacaacuuucuuucaaaguucaucaaggaccuccuugaagcaaaagccaauggaaacgccugugugcuuaggguguauguacagguuucauuaauguaauacauucuuagaaguagaauaugcgcuccugacuuugacagguagugcagcuugucccaauuuacauuuuacguccuacacaugcuugccacccuccugaccaccuauuguccugucuaagcuccagacaguagagaugggucuugauugcagucacauuucccagaccuagcucagagugugacauggaggugucuggcaaauauuuguuuagugaaggaauuugagaacucuugagggcagaguaguaccugaggaaaauuuuaauuaaaaaaaaaauuagcagcaguugggaaugucaaucccauaauguucagacacuauacucuagcuacuagacuaugaauugaagggaaaucagcuaugguucuucucuacugcugaguaggacuuuauuaaaaacaaaacaacaaccaaaaaaaccucuuucuuugauuagauuaaguuacaauaguuauuguaagguuguugauacaaacaaucuuuugauauuaaucauaauuuaaaauuacauaaaucuacuugggauuaaggucccucuuccccucaagcauuuucauauuguuuugugaaguaauuugggugaagcuuucuucucagauaagugaaugcucauguuuguuuucuguuuuuuaggguucagagcuuucuggagugauaucuucagcuugugauaaagagucaaauaugcaaguauaaucagugcauuaaucuauuauuaguuuccuuuaagugcucuuagguacauuguuguaaauaauguauuuucccccauuguagggaacgaagagugaucacgauuucuaaaucagaauauucugugcacucaucuuuggcauccaaaguugauguugagcagguuguuauguauugcaaggagaagcuuauucguggggaaucagaauuuuccuuugaagaauugagagcccagaaauacaaucaacggagaaagcaugagcaaugggguacuugcaaucuuguauuuuuaguuauucuuaugucacauaaaaaaauccucaucucugaguaauuacuuuuuuaaagaauaauugacuauguugaaagacugcaagaaagucuucaucucauccuaucagaagcccagaaaucauuauuaacccauuuugcguuugccccgagaaaacugcgcuggcagcaagcugcacuuuuuuuuucugaauuggaaauugcuuaaccacuaguguagcagccaaguuaguccaaggacuaaauugaugucuuggcagcaaacucauaguugaaagaguacuaaauuagauauccauaccagugucaucuuagcuuuagugaaauaaauauuuaaaaauuuuucaguauuaucuguauauaguaauucuaaaccucuaggucaguuauuugaaccuuuauuccacucaggacuuuuauacuaucuaaguuauuugggcuauagccauucugggccuuucuuuucuguucauuacuuuucauacucgguugacaacagagaagacaagucaguuaacacagaggacucauuuugugcugggcauagauguguuuuucuuucacaugcugugaccagaaguuuuaagccagacucuuugacuugccuguggcaugacucuguuaaccaguuguuggaaaugggacugaccacagcaugcuugaagcccugaucauuuagugcaguucacuucuacuuagaaagucucuagaaauuuuuaucuuauaaaaacaaauaaaaauuuauuuuaaaaugauuugcacaaucaugauuguuuacaagaacagucauguauaugauggcuacaaaaaucuuuacuauuauacugugcuauuauuauuauuuuugaucagcauguaguuuuuuuuuuuuuuuaguaauuuacauguccuaaacauguaguagccaagcugugggcagguaaaaauuaaaagguaauacaaguuucacuucuaaaaccaaauaugagaaagacuaauaaaaaaaucggcccccuaaaauauaacccuuuccucauuuugcauguauuccuaugaugaccuggauuuaaauuuugcaugcaaaccauuucuaucuuuccuaaaguaaaugaagacagacauuauaugaaaaggaaagaagcaaaugcuuuugaagaacagcuauuaaaacagaaaauggaugaacuucauaagaaguugcaucaggugguggagacaucccaugaggaucugcccgcuucccaggaaagguccgagguauguugugcuccucaugacacauccugugcccagcagcaggaauggcaguuugauuuguuccuuucuaugugcuguuuuagaguuaauucugauguuaauuuagcuaguaacuuucugaaagucuaaaauaauuugacauagacguucacaauguagagugagaguggaaaguuacaaaacagaaugguaguauguuuuacauguuuguguauguguacaugucuauauauucauguauuuauauauagaccuuuuucugguuuuuguacagugacuauuguguaaugaaaauuggaguauaguacucucaauaauuuaucauuuagauauauuuuuuguuugccauuauuucaucuuggaaaagcagagaagugaugaguguguuagagccacauauauuuucuuaaaauuaguagugaaugaaggagauuggaaauaaacucauuuaaacuguauaaugguugcuuaaucuuucauauuauauguuugucuaugacauaggauacgaugaagauaaaauacuuuauuuucuuacauauuuggaaaguauaaaaauaugugacuagaugguuuuuuaaaauaucacaugaaagguguguauauauguauauaugaaggagagcauucauuuguauauauguauguauguaugcauacacacacacacacacacacacacacacacacaaacauucuuuuucuuuuuuuuuuaauuuuuagacggggucuugcucugucacccaugcuagagugcagugguaugauaacuguucauuguauccuccuuaguagcugcaaccacaggcaugugccaccacacccaccuaauuuuuuauuuuauuuuuauagagauggggucucgccauguugcccagccuggugucaaacuccugggcucaagcgauccucuugccucagccucccaaaguguugugauuacaggugugagccaccacgucuggucugaauguucuccuuuauugcuaacugcuauaguuuguauuuuuccagacuuauuguguaugaaaacacauaaauaugaauacaauagaacguucuacauaaauaagacuuauuuucugcuuuuucuaccuaacaccucugauagaucuuucacugcuauugcauagauaucuaacuaauucuacuugcagcauagucuucugucauaccuuauaaaagggaguguaucauguagaaacuguuagaaaucaugcuaccuuucaaguguauguaccuaaaaugcugucagucugcccucuauaaacuucggacugugcacucacauuaacaguguguaaaaggacuuguuucuuguacacauuuggcuaacauuaacuauacuaaaucuuuucaagcaccugauguaguuucuuuaauuauagguagauuuggacauuuuuuggauacauuucguggcuguuuaacuucuuuccuuuaaauugacugaauggcuuuguccauuuuucuauugagucauuucauuuuuuuucugauuuguuuggauuucuuuuuguauaauuuauauuuucccuggauaguugcaagaaauuguuaauaaauuguucucccuggcuccuuuccugugguauaucccugguucccaugucguuaucucuccuuacuguccucauuucgaaggcacacuuucuccaguagcuuauuuaaaaaaaaaaaaaaaaaaggcaacagcagcauguuugagggguuaguuuuugaggucucuugcaugucuaaaagcaucuuuauuuuaccgucacauuugguugauaauuugguugggcacaauguucuaggagggaacuuacauucccucagaguuuuuaaagacacuccuucauuguuuuuuggcuugcgcuauugguguggaaaaacccagaguccuucugauuguugguucuuugaugugauguuuguuuuucucuagagggguguagaaucauuuuucccugcuguauugugacauagugauguaucugguauuuaucuuuucauccauuauacuuagugcuuaaauguucuaguuuugcaauucuggggaauuuucuugauauauauuuucagagguggauauuuuuuccucauacucucuguuaggcuauccuggacuggucauuuaauuuucuuaaauuucaccauuuucuaucuuuguccuuuuuucccccuaauuuucuuugagauugccuuaauuuuuauggccaucuuauuaaauucuuuuuuuuuuuuuuuuuuugagauggagucucacugucucccaggcuggagggcaguggcauggucucaacucacugcaagcuccgccucccggguucacgccauucuccugccucagccuccugaguagcugggacuacaggcgccugccaccaugccuggcuaauuuuuuuuguauuuuuaguagagacaggguuucaccguguuaccaggauggucuugaucuccugaccucgugauccgcccaccuuggccccccaaaguguugggauuacaggcuugagccacagugcccggccagcaucugcuuuuaaacagaauuuuacaauguuccuaucuucaccuccaccuucacuuccauucugagguguagcuagcauuguagauuucugaacuugucuagcaauuagggacacaccgcuccuagccuccuucaacagcuaugugaaguguuagaauuccuucacugucauguuggugagauuuuuggaguauaucaagccacugucuuuaacuagaagccucccuuuuucaaacuucucuguaugaauagcaucaggauauauuuuccaaguagauugccuguugucuguaaaucauuuauugaucugcucagccuuuccccauugauuuaaaauaucuuuaccauguacuaaauuuucauauauacaagauccaauucuaaaauaucuauaccuuugcuuuagucaguagaucucuucuugaucauuucauagguguauuuacuacaacuuucuuuuuuuuugagacggaaucucccacuaucgcccaggcuggagugcaguggugcaaucuccgcucacugcaaccuccgcuuccuggguucaaguaauucuccugccucagccuccugagcagcugggauuacaggcgcccgccaccaugcccagcuaauuuuuucuauuuuuaauaaagaugagguuucacuauguuggccaggcugaucgugaacuccugaccuugugauccaccuaccucggccuccaacuuucuuauguguuuuggugucugguggagaaaaucucugguauuguucagaauauuucuucagaauugaauauuaugaugauuuuuaaucuuuacuaauuugguaggugagaaaaugguguagguuaucauuuuugcugacgaaugaggaugagguuuuuauauuuuuuuccauuagucuguaaaauaacuauucuugcccuagacauuugguaguguguguuuguuuguguuuugaggcaggggcucacucugucaucuaggcuggaaugcaguggugcaaucucagcucacugcagccuccuccucccaggcucaagugauccucccaccucagcuuccugaguagcugggacuacagacacaugcuuccauguccagcuaauuucuuguauuuuuuuguagagacaggguuuugccauguugccuagccuggucucaaacucuugagcucaagcaaaccaccagccucggucucccaaaguucugggauugauuacaggcuugagccacccaugccuggcugguguuuuucuuaacaauuuauaagcauacuuuuauauggugagaaauuaacucaucuaacuuuguaacacuaaagcauacaauuacagucuuacacugaugugaguagcaaagcaaagauuuuaaauuuagagcuuguuaugcuuccuguugugagacaggcuuuuguggcaguuauuauugcaauuuauauuuguguuuccuauucuucaaagugaaaacggcuaugaaaaguauuuuauuuauuuauuuuuuucccuuuuucaagcccuaucucauauaccaaucuaaggguauuuuaaugggaggaaaaccguaaugagcuuuugauaacacugauuugucgaccuuuucccaaaauuaaguaaagagaaauaagauaauacuuaaaugcugauacaacuauagagacuuguuauuucagugguuagaaauuauaagcugcugauggugucugugguucagaagcuacaaagcauccauuuuguagaguggucuuuuuguuguugacuguacauuucagaaugcuugaagaaggaguauggggaaacuucaaggaaaaaggaauccauugaagacagaugccaugcuuugagaagauguaaugccugauuaguaguauucuggacuucaugguuuuguuuuuguuguuuguuuguuuaauaugaaagguuaauccagcacguauggggccaaguguaggcucccagcaggaacugagagcgccaugucuuccaguaaccuaucagcagacaccagugaacauggaaaagaacccaagagaggcaccuccuguuguuccuccuuuggcaaaugcuauuucugcagcuuugguguccccagccaccagccagagcauugcuccuccuguuccuuugaaagcccagacaguaacagacuccauguuugcaguggccagcaaagaugcuggguaagcugaagguaguccuagagaucacagugaugugaguggcaccugucaccuucuuuacaugaccugcauuaucaggaacaguauguaaaagaugaaugaugucugccuuuuauuuuuagauagguauguuguugaaaaagcaaguggcaaaacauugcucccaauccuuuaggcuuacuuauuccaugcuucuuuuagaauauuuauuuuauacuuucgugaauuaaaaauuuucaguaccugaaagucaacagucacuuuguaacugaagaauauacagcuguuaggcuaaaauucccuuugcucacuggcuuugauugaauaccuacagggaucauaacugucuagacaauuacuugacauguguucucauauuccuucugucuucccauagagagcaguuugggauuaauacacaugauucugucucucaaaauguaccucugcacuggaaguuuuuaccccaauuuugagggauuuuuccagauuucagaaauuauaguuaaugucauaucacucguuuaaguuacauuuuuaccuccagucauuuuggcucucuuuuagcucguuuuuauagggauuuguaaaauuaaaaaugcuuugcauguuuuacuuuauaccuuaacaggguuuauuaagggaacuccagcaauguuaaauagacauguuagauccacuaccccaagugcacuuaaagugugauauaaauggcuugugugucauuuuuuucuuucuugauaaccauuacuuuuaaaugcuagaggacauugcacuguggcugcuggcuuaucacagcaaagguauccugcacagcugaggcgcaccagugcuucuccacguccugacucugguuagcugccuggagccgggcucaacucuuuaaccucuguaaugaaugggaucauuugaauagucauaggacucuaccacauauagagaugguucuuaucccuguaaucccugugucacacaaauguuuaguaccuggucuuuucuguaagaauucuuuuccugaaauggaacugaaaggaaaaaaaaaacaguuuauuuacuaacacuguagacccuaaguaguuccaucuguauuuuaacaggcuuguaauuauugacugauucuuuuuucuuucuacuauuauuucuugagagucaguuaaaaauucuaauagaucaagcauuuuuuuguuuuguuuuuuuuuuguuuugagauggagucucgcucuuguugcccaggcuggagugcaauggugcgaucuuggcucacugcaaccucugccuccuggguucaagugauucuccugccucagccucccaaguagcugggauuacaggugccugccagcacaccccgcuaauguuuuuuuguauuuuuaguagagaagggguuucaccauauuggccaggcuggucucgaacuucugaccucaggugauccucccgccucggccucccaaagugcugggauuacaggcgugagccaccaccgcacccagccuagaucaagcauuuuauucucuagugugucucaagaguuuucucuuccagaugugugaauaagaguacucaugaauucaagccacagaguggagcagagaucaaagaagguaauguuuaauuauaauaaauguguuucuguccagauuccucuguaucacucagagguguauuuuguggcugugguuuaugaaggcuucaggccuuaaugaaccugaguguuagauuuccuauucuuagaguauagguuauuuaucccugaaccauuucaaauaaauguagaaauccacuuguuagucucaucuucuuuaacauucuuuggaaauguaauuugugaauacauuucuaguaaauuucucaggaaauuaauccaaaacagagucaucuuuaguauguuagguaggaaagguuaucaaaaguuuaauuaggaguguuacacuguuauucgguacuacuuuguuagaggcauuugcauaggagauaagucuuauaaauaauaagaugcacagguugggcuuucacuucuccgcugugugacugggacauuuuuuuucuggacaguuuggugaggaggagggcuguuugaaauagcuggagguucauuaacugaaccaagacuuacugagccugcucuguaggugccaggcacuguuauacauaguuagggaugaagucaugaacaaaaaaucuccacccacacagagggggaaagaaauguacuauuggaguuaugggguugaaauuucagucaaggugauauuuggguaaagggcuaaaguuagggagcuaccaugccauuagcuugggcaacuuuucagacagagggaauauuaagugcuaagcccucaagcaggaaaaucucugauauauucuaagcacagcaaagggaccaauguggggagguaagcagggagaggaggaaggugaggccugaccaaacaggacccaggcugugcagggccuuguauucuaugccugacugcaguggaaugagaugggaagccaaucuuaagauuuacauugugacuaugaacuugggauacaguggcacuaaggguauaauuuaugacaaaguugcuaaucugguauaauccagaccaaccacucaaucucucucagccuucauuuccuuuucuguaaaaggauaauuuucaccucauuuacuucauaggacuauuauaaagauaaaaaugaaauauaugaaagcacuauaauacuggaaauucuuagugauaauuuuuaacaaugacaaacuguuuuaauuguaacuuacuuaaauugugugucuuuuaaguuauucugauuucccuacugauaccacauuuugucuccauuucuuugcuagggugugaaacacauaagguugccaacacaaguucuuuucacacaacuccaaacacaucacugggaaugguucaggcaacgccauccaaagugcagccaucacccaccgugcacacaaaagaagcauuagguaaaguauuuuaucugaguguguagcaccugaugacaaguuaaugaaagcucuuuugcaaccuguuuacaauuauucuuuuuguucuuuaagguuucaucaugaauauguuucaggcuccuacacuuccugauauuucugaugacaaagaugaauggcaaucucuagaucaaaaugaagaugcauuugaagcccaguuucaaaguaauaacuauuuaaaagcuacuaagugcauagcauuauaggugguuaucacagaaaauaucaagaauuauuuaagaggugacccugcccuugauuagcuugucacauaaaggcagggaaugcaugaaauaaaaauaagacaguucuugacaagguacucaaugugugugauagauuugcuugauuaaagggaaaaaaaaaaaaagaauagugcuaaagaaggacaaaacccccauggauaagaagggcugaguacucaaggugugacuugagccuucacugguagaggaauggcuggggcagaguauuagaggaggcuggcagcuagcccacauuugucuagagucaggggauucaugcuagaagccagagaucaugauaaagauaaguagaagccaauuagacucaggaggacuugaaauguaaagcuaagagcuuaauucuuucuugaaggaaauggaaaacgaaacccugagagcguuuauugagugagucaggugacaauaguacugauuuaggagaaugauuaacaccuugcugauauguggcagggacucgugaccugggacuugaguacaaaacccuguuaccauaguuaagucacuucaucucacuauagugacuuacugccuaguauuugaaaagcugauauuaguucuuuucugucagcuguuaguccuuuuucuuauuuguaguugaaguuuaauauaaaggauguuuuuuccuaguacaauaauuagaugcuauuuuuuauucuguugcagaaaauguaaggucaucuggggcuuggggagucaauaagaucaucucuucuuugucaucugcuuuucauguguuugaagauggaaacaaagaaaauuauggguaaaaaaauaccaucuaguuaaugggaugcugccgaguuuucucugggaccagagguggugggguggugaggagagaaugugaacugccaaucacauggucaaaugagccuuuugaccacacaaccagggggguguugccaaaguucuccagauuuacaguacugcaggaauucauuuuuggcuucuaaaaguuaugugacagaaauuucuguacuucccacccucaaguaaugauaggucuacuuuuauaagucauguuaauuugauuacacucaguuuugcuagaacugcuauaaaagcaaggaauaucuauauaaagauuaacucauuaaauaggauaaguagagaacuuuucuaauggucaagugauagcauuuauuuccuuagcauauuuuacuauuuauaauuuagcaaaucuuuccuuagauuaccacagccuaaaaauaaacccacaggagccaggaccuuuggagaacgcucugucagcagacuuccuucaaaaccaaagguaaacaaaccuguuuuaucuaugaaauggguccuacaacccauccgcuuuauucuaccaaaugauuaugccagucagaggauauuguguaugugaaacuaugcuaaaaacuaugaaacauaggaagaauauguuucuuuuaggacauuauuuaauaauuauucaagaagaaacaggguaugugcauauuuuccaaguguccuaccaaaauuauuuauuaauauucauuacuguggugguuucacauuuauccacaaauucuuugaauuuuuuuccuccaguuuaauucaucuccuuuugaguguggcuagauuuggugacuugcuucagacaaaaagcaaagggaaagggaaaauuagauuacaguagggaaacaugggagauucugccuaaucaagugauuggguuaaccaggaauaagucauguugacagcagauauccccuaauaugauguaaugagaagaacauuucaccucugauauccuucccaaaaaucuguaaccccagucuaaucaugagaaaacaucaaauaagcccaaacuguguagggacauucuacggaguuucugacuaguguucaaaagugucaguacaaaaaagacucggaaaggccaauagacaaugacagacucaaggaggcuaagaacacuugagaacuaaaggugacaugggauccuggauuggaucccugaacagaggaggcacauuagugggaaaaaaaaggugaaauccaaacuacaguuaauaguacuauuucauuuuuacaaaugugccacaguucuauaagaaguugacauuagaggaagcuuggugaggaggguauguggaaauucugugcuaucuuuguaacucuucuguaaaucacaacuuuuucaaauuaaaaaauauauauauaauuugaaaacaaaaauguggcucuugcuguaauguaacuccacugauuuuccaguucuggggaaaagaacugaaccaugauauugugggcuguauuagccagggguugacaucuguuucuucuuuaauccucauuucuuuggaucuuaaaguguuauugaauaagguuucauggacuaaagagggagauugcugcuuuuuuuucauuucaucuucuguuauaggaggaagugccucaugcugaagaguuuuuggaugacucaacuguaugggguauucgcugcaacaaaacccuggcacccaguccuaagagcccaggagacuucacaucugcugcacaacuugcgucuacaccauuccacaagcuuccaguggagucagugcacauuuuagaagauaaagguguguguuacacuguuuuagugucugucuucugccaacuuugauucuuucaguuuucuucaugaaguuugauucuuguaguuuucuucauggaaauuccacaugggaacuuugaaaaucauaaagaagaaacuuaaaaucuguucauuguauuuuuguucauagguuuuuuuuuccuuuggcauauugucuuccuaaagucuauguauuuuuaaaauauaauagcuuagauuauagguagaaugggagaaaaucuauagaagcauuuaaaggaaauaagguccaacccauuuguauagauagagcauguuuauuuuguuucauagcaaacaaaacagccacuacagacauuaaauuauuugaaugcuaaaaauaaugaacauuuauauuuucuaauuuaauaagaguaacagccaauuuuaguccuagaugugugucuacacacauauaugucaacuuuauuagacauagccaaguacgauagucagaaagucuuauuuuuccuacuuuuagugaucugacuuuaagaaaguaaugauaaaacucacaaguaguccuuauuucuaccguuucaaaucuaucacccuauauauuuaaaaauucaucauauaucugaauugaauccuaacauaugacauugucauugagcacagauaauuguuaacuauuaaguaccaaccuacaaacuagacaguccucuugguauccacagaggauugguuccaggaaccccugcagauaccaaaauccagguggaugcucaaguuccauaguugacccugcagaacuuguggauauggaaccugugaauacagagggcugacuguauacuaacuaucauugcucacgcuuuuaaaauauagcaauuguuuaccaaagcaauaauagaagagcugccaaagaauuucacuucauuggaugaaagcauauuuuaauguggguucugagccuauagaccuaaacauuuuugaccaaggauuucuuagagugcuaauccaauauaauaaauuucuuuucugaaucuuaaaggagaggucaguugaaacuuugacaauugccaagcaccaucacaagcuugcuuuuaauuaaaaaaaaaaaaaaaaaagauuaaagccuuuuccauccaggaaaaguaguuuaaugagucuaaagaauccuucaaaaagucaauauuggcuauucuuaagaguauuuggcacuuuggcucgauaaacaaaaacuaauguucuagugcuaaaaaguaguaacaccuguucagugaaggaguaucugauaaaauguaauccaauauacuuggcugugugcaguauuauaaucacuugguagaaauuuauucuguauuucuguucuuccuaguuuaccuaucuauagauagauuuuuuuuuuaauuauggagaguaauaaauauugccagguugcuuucugauuuaaacacaaaaucguuucaauaaauuaaaugcuaauuuagucaaucaacuaauugacuacaacauguuaaagugaaaaacccaaaaucucugcccuccagaagcauuguagccuuuuacucuccauguucuugucuucagguucuccugaagcuggguguagcccugccauccguaccaguaacuucccauggucuggucauccugcccacaauggacuugccacucucucgaccccuuuuuucuugaaggauuauaggaauuagauguagaguugaaaugcucacauauauuaguaguagauuuuauuuguuuguuuguuuuuaagagauacggucuugcuauguugcccaggcugagugcagugcagccucaaacuccugggcucaagugauccuccuaccucagccucuugaguagcuagggcuacaggcuccuaccaccacaucugguuaauuuuaaaaaguuauuuuagggauagggucucacuauguugcucagccuugccucaaacuacuggccucaagugauccucccaccucagccucccaaagcacugggauauaggcaugagccacugugccuggccaguaguggauuuuuuuaaagugauuuuuuccucccauuuuuuuaaucuuauuauacauuuuacaauggaacacuauuuugaaaucauaaugcaagucagugucaaaagaaauccuagacuuuguaaccauaucaaaugguguguguugugcacacaugugcaucuaacauaucuugucucuaauuuuugaaucuuucagaaaaugugguagcaaaacaguguacccaggcgacuuuggauucuugugaggaaaacaugguggugccuucaagggauggaaaauucagguauugugaggguuuauuugguucugccauucucuucauuuucauucuaacauuguuuaccauuuucauucuagcuuugccuuuuaggcuguaauagaauaccuaauuuuagccuuaaaggccaauaaagauuuuauggacuaguagcuuuaagucagaagguacucuccgugaauauacauacaacagugaaccuaagcacuugauacaucaggccggugcuugaugagaaaacaucagagaaacccaaauugaaggacauucuccagaauaccuggccaguacuccucaaaacugucaaggucuugggaaacuaagaaagacuaagaaacugucacagaugaaagaagaguaaagagacauagcaacuaaaugcaaccugguacccaggacuagauccugaagcagaaguuccuuagugaaaagaguggugaaauugaaugaugucuacaguuuaguuaauaguaauggaacaaauguugguuuauuaguuuugacaaagguaccauuguaauaggaaaggauaaucuuagcagaaauugagugaggaguauacaggaauucucuauuaucuuugcaacauuucuuuauaccuaaaauuauuacaaagaaaguauaguugaaaaaaguuuacaacggaaaaaugugacaagugaaaauagcaguguaugaaauugcauguauaaauuuauuuguauaaaaauacauacuucaguauguuuagguagauauugauuggggguguauguggagauauaugugcagucaguucucauuauucacuauaauucuauagagucaccacaaacacugaauuagugaauaccgaauauucuuaaggggaauacagacagcauccuucaagccucuaauaacaacauuuuguuaaaaaacaccuuauuuauuauauauugucaauucauuaacauugaauuuauguccagcaacacugacuuacaucuaaauaaagcuuaucuaauacacauauuuucacagguuucuagugcuuaggaacauuagagagcacuucagcacuauacuuugggaccauuuucaauaccaaaaucaccaagaaaaagcacaaagacacaaaaauugugacacuaaguacagcucgaaaaggauacuuguuugcaguaugagagcuggaaccggaaggcugagugucaccuuguucaaccuuagcucagaacauguauguuagguggcucaauuuuucaucacucugcguucuguaaaugacugaaaaaucacuaugaguauugauuugaagcuuacaaauaaauuuuagcaugcaggugaauucacaaauaugaaauccauuaauaauaaggaucaacuguauacuguguguguguguguguguguguguguguauggauguauauguauacauauacuuccauguacagucaugcaguugcuuaacaacugggauacuuucugagaaaugugucuuuaggcaguuucauuguuacaugaacaucagaguguauuuacaugaacuuagaugguuugauuaguuuacuacacaccuaggcuauaugguauaaccuguggcucauaggcuaaaaacauguacagcauguuauuguauugaauacuauaggcaauggcaacagagugguguaagaauuuguguauguaaacauagagaagauauaguaaaaauacaguguaaaagauaaaaaaugguguucuguauagggcacuucccaugaauggagcuugcaggacugaaguugcucugggugggucagugagugagugaguggugagugaacgugagggccuaggacauuacugugcacugcuguagacuucagaaacacuauaguuagguuacacuaaacuuauaagaaaaauuuuucuucaguaauaaauuagccuuagcuuacugugagcuuuuuacuuuauaaacuuaaaaaguuuuaucuuuuugacuuuuguaacaacacuuagcuuaaaaaacaaacacauuguacaacuauacaaaaauauuuuuucuuuauaucauucuauaagcauuaaaaaaauuuuuuuuuucacuuuuuaaacuuuuuuguuaaaaacgaccacacaaacauacacauuagcugaggccuacacacccagggucaggaucaucagacaucacuaggagacuggagguuuucggcuccauuaugauccuauggggccaccauugcauaugcuguccucugaauuguuguuaugcagcacaugacuauauauauggaaguguacuggaguguuguauugugauugacauuuucuguuuguuucaauguuauaaaagcagccauuuuuggaauaaaguuaaauauucagucuugaugauaguagugucgcauagaugcagcuuggagaaauaaacccacuccugacauuuccuacuaaagaauaucccauguauuaccucaccuauuuaucuaauauaaccauaucuugauuuuauuauuucuguucauauuguacuagcuguauauuuucauagauuuguuugucuaaaaaugcuuuaaucaacuuuuagucugugaggcuauugugaaaugucauuucuagaaugagaagggaauuucaugugacugaauccaacagauuucuaaucaugugguguuuugguuucuuuauuccuuucacacguccaguccaauucaagagaaaagcccaaaacaggccuugucgucucacauguauucagcauccuuacuucgucugagccagccugcugcaggugggguacuuaccugugaggcagaguugggcguugaggcuugcagacucacagacacugacgcugccauugcagaagauccaccagaugcuauugcugggcuccaagcagaauggaugcagaugaguucacuugggacuguugaugcuccaaguacgaacacucacucuuuguuaugcccuugaaucaggacaggagcauggggaaagcugucccaugaaagaaacccacagugggacuugaaugucacugaguagaacagaugucagugaguucagaugaaacuugcauaaugcaucacaauggaguaacaguagcauacuugaagggcaaaucaauuuuaauuuuagaagguaucaaaauaacuacuguuggaagagggaauuagaauuugacagccuacuacgugccaggcuuuuaaucuaauacuauuauauuuuacauuuuacagaaguaaacugaggcugaagguuaaagagacacccccccccgcccacccccuuguuacacauaaacagucuggcauagugguuaagagcacagagucuggagauggacugacuauguucuaauccuagcucccucaccuaaguagucacgugaucuugaccaagaucauuucaauuuuccauaucccucuuuucuguagaguugagcugaugcuaguaccuaccuuagaggcuuauuguaagaaccaaguaaauuaauaaagcacugagaacaguguucugcaugugcuuagcgcugagugaguguuaaccauguuggauuaguauuugauaacugccacuaauauaauuuuuuguaacauuccagguuggagagaaagcuuuuucuuacuuuuagaaauuauuucucuuuuguggacccaaaguauaucucauauaugcaaauugcacauagguaguauaaguuuuguggauauaaguggaaaagaaauuaaauaauaugugucuaucugcgcacauuagaaguaacuaauguccacaucugcccuuaagacauguaucccuaauuguguuaaagauagaaucuagccguuccaguugaguggagcaaaugcaccuagaguugauucccuuugucacaacuaaauauugauccaaauuuguagaucuaaaauggcaaauaauaaacugugcagagcuaccaauuuugacuuuuaaaaauaguucuuuuuuauuuugaauuaauacucuuauaaggcuuugaaagcuuacuuaguaaauaucucuacucacuuugucuauaauuuauuugguaaaguucuugaguacucaauucauguucccuuuuuuuuuuuuuuucucauuccuuuaagacuucauuguugggaacccaugggaugauaagcugauuuucaaacuuuuaucugggcuuucuaaaccagugaguuccuauccaaauacuuuugaauggcaauguaaacuuccagccaucaagcccaagacugaauuucaauuggguaagaauuauuuggauaauauaacuuuaaauucuuguuucucuaugagaaguugaugguaacgugugugugugugugugugugugauucuccuauuugccccccaaccuccaauagggaguuguaucuguaauacuaaacugaucauuuuguuaagccaugauuguaggauugugcuugcuguugggacuauaacuccuauaacucauagagggcaauuugccaauaucuauuaaaauuaaaaaugcauuuacuuuuaaagccagcuauccacuuuuaaggauuuccuauagauauuauuauauacuucuauaguaaaauacuauaguaacauuggcaacagaacaagaaagcucacucuguacugauagggaaugagcuccaaaacauaccauacuguuaaaagggcagagccguauguauuauaugccacaauuaaaacaguuagcuguaggugggagugggaaacaaugguagcaagacuucacaauauucccuuuuaaguuuuuuaaugaauagacuuuauuuuuaagagaaguuuuaagcuuacagaaaaauucagcauaaaguacauauuccuaccuccccauauauacacacacagauuuucguguuacuaacaucuugcaugagugugguacauuuguuaaaauuaagccaauguugaugcauuauuaauugaagugcuaguuuacauuaggguucacucuuuggguuguauauccugugggguuuuuuacgaauguaguacagugacauguauccaucauuacaguaucauacagaaucauuuccucacccuaaaaauccccugugccucaccuauucaucccuuccuccuugucccccaacgccuggcaaccacugauuguuuugcugucuguguaguuuugccuuuuccauaaugucauauaguuggaaucauauaguauauagccuuuucaacuggcaucuuuuacuuagcaauaugcauuuaagguucccuugugucauuucaugauuugauagcuuuuuuuuuuuuaucacugaauaauguuuagugcaugaauguaccacaccguuaaaccuuuccacucaucuaaugaaagagaucuugguuacuuccaaguuuuggcaauuaugaauaaaguugcuguaaacaucugugugcaaguuuuuguguggacauaaguuuucaacucauaauuuggguaaauaccaaggaguguaauugcaggguuauaugaugagaguauguuuacuuuuguaagaaacuuccaaagugacuguaccauuuagcauucccaccaacagugaauaagaauuccuguuccccagucuugcccucauuaggugguugucagcguuuuggguuuuagccauucugauacgugaacagugauaucucaaucuuguuugaaguuucaauuaccugaagacauacuguguugaauauuuuuucauaugcuuauuugccaucaguauaucuucagugagaugucuauccagaucuuuuguccauuuucuaauugguugguugguuucuuaucauugccuuguuccugaucuuagggggaaagcaucuacauaguuuauuaccuauaaguaugauuuuagcuguagguuuuuuguaaauguucuuugucaaguuaagaaaguaucucucuauuccuaguuugcugagaggguuuuuuuuuuaaucauaaguggguguuggauuuuauuuaucgugcuccuuucaauauuuucugcauuuauugauaugauuauaugauucuuuguugaugugauggauuucauuaauugaaauuaauuaauuaaguguugaacuagccuuguauaccugggauaaauugcacuugguuguuauaguguauaauucuuuuucuacauuguuggauuggauuuacuuauaauucuuuuuacacauuguuggauuggauuuacuaauauuuugcugaagauguuuguauccguguucaugagagguacuggucuauaguuuuccuuucuuguaauaucuuuaucuggucuuggugucagggaaaugcuggccccuuagagccccuuaggaugagauaggaaguauucccucugcuucuuucaucugcgagagauuguugagaauggauauaauuuguuccucaaauguuugacagaauucacuagugaacccaucugagccuagugcuucccguuuuggaagguuaucaauuacugauuccauuucuuuaacagauauaggacuguucagauuaucuauuucucuuuugugggcuuugguagauugcgucuuucaaggaauuuguucauuucaucucaauucucauuuguggauauggcauuccacuauugauuucuacuguaauguuuauuucuuuuauucugcuuacuuuaguuuuaauuugcucuuuuuucuaguuucuuaagguagaaucucauugauuuuuagaucuucuuuucuaauauauguauuuagugcuacaaauuuuccuuuacugcgucccacaaauuuugguaaauuguauuuccauuuucauuugguucaaaauauuuuuaaauuucucuugagacuucuuugaccaaugugguauucagaaguauguuuaaucuccaaguauuugggggacuuuaccuuucauacuguguaugauuucuguucuuuuaaauuugguaaaauguuuuauggcccagaauguugucuauuuuggugaauauuccaugugagcuugagaagaauguauauucugcuguuauucgaugaaguauuccauaaaugucaauuagauccaauugauugaugcuaccauucaguucaaccauguuuuuacugcugauuuccugccugcuuuaucugccccuucccgucccucccugucccgccccuccccuccccuccccuucuuuucuuucuguguugaaacaggguaucacucugucauccagacuagggugcaguggcacaaucuuggcucacugcaaccucaaaauccuggauucaagcaauccuuuggccccagcuuccugaguaguuaggacuacagucaugcaccacaacaugcagcuuuuuuuuuuuuuuuuuuuuuuggguagagauaggguucucgcuauguugcccaggucucgaacuucugaccucaauccaucuuucugucuuggccucccaaagugcugggauuacaggugugagccaccacacccaguugaucuguccauuucugauggaaggguguugaagucuccaacuauaauagugaauucaucuuuuucuccuuguaguuguauuaguuuucgguaacuuuugacucacauauuuugacacucucuuguuaggcuuauacacauuaugucuucuuggagaauuaaucccuuuaacauuauauaaugcaggccaggcacaguuacucacaccuguaauccagcacuuugggagccaaggcaauaggaucagcugaggccaggaguuugagacaagucuggacaaugcauugaggccuugucucuacaaauauuuuuuuaaaaaaauuaaccaggcauggcaacacgugccuguaagucccagcuacuugggaggcugaggcuggaggaucacuuaugcagaggaguucagauuagccagggaacauagcaagaccuugucuuacacacacacacacacacacacacacauacacguaacgccauuuucuaugcugauaauuguuuugcucugaagucugcucugucagaaaugaauauagcuauuauuacauuuucuuuuauuaguguuagcaugguaugucuuuuucuaucccuuuacuuuuuuuuuuuuuugagaaggagucucgcucuaucacccaggcuggaguguagugccguaguacuaugaucuuggcucauugccaccuccgccucccagguucaagugauuuuccugucucagccuccugaguagcugggacuacaggcgcacaccaccacgcccagcuaauuuuuguauuuuuuuuggagacaggguuucaccauauuggucaggcuggucucaaacuccugaccucaggugauccgccuuccuuggccucccaaagugcugagauuacaagugugagccaccgcaccugggcuuaucccuuuacuuuucaucugucuugguauuuaaaguaugucuuuguuuugauugguauauuuagaccacugauauuuaaagugauuauugauauaauuggauugucacuauauuuguuuucuacuccuugcccuuguucuuucuuugucugcuauucucuuucuuccuucucugauuuugaguucuuucauaauuccauuuugucuccucucaguguauuaauuauacuucuuuuaaaauuuuuuuaagugguuaaccuaguguuugcaauauacaucacaacuaaucuuuuuugcuuguguaagaaaauuuuuauucuucacauuugaaggauaauuuuacuggauacagaauucuagauugguggauuccaaauuucuaaguacuuuagauauuucacuccacucucuucuugcuugcaugguuucugagaaguccuguguaauucuuaucuuugcuccucuauagguaagaugguuuugucuugcuucuuugaauauuuucucugugucuuuuucugcaguuugaauaugauaugccuagauguugauuuuucaguauuuauccugcuuggugcucucuaagcuuccuggaucugugguuuggugucuaucauuaauuuuggaaaauucucugcuauuauuacuucaauuuuuuuuuuuuuuuuuuuugagacgggguuuugcucuuuuuugcccaggcuacagugcaguggcacaaucuuggugcacugcaaccuccgccuccaggguuuaagcaauucuacugccucagcuucccgaguagcugggacuacagaugcccaccaccauacccggcuaauuuuuuguauuuuuuguagagaugggguuucaucauguuggccuugaacuccugaccucaagugauccgcccaucauggccucccaaagugcugggauuacaggugugagccgcugcacccggccucagauauuuuugucuguuccuuucucccuucuuccuucugguauucccauucuacaucuguuauacauuuuguaguugucccacauuccuuaaauacucuauucuaucuauuucuuucuauuuuuuuuuuuuuuuuuuuuuuugcauuucaguuuuggaaguuuuuauuggccuaucuucaagcucacugauucuuuucccugccauguauagucuauuggugagucaaucaaaggcauucuuuauuucuguuacaguggguuuuuauuucuagcaccuuuuuuugcuucucaguuucucucugccuguauuacccauuucuucuugcacacugucuaccuuuuucauuagaacccuuagcaugucaauuagaauuaaaaaaaaaauuucuagugugggccuggcaugguagcucauuccuauaaucccaccacuuugggaggcugagguaggaugaucacuugagcccaggaguuugaggcuguagugagcuauguucaugcuacugcacucuagccugggugacagagugagaaccuaucucuaaaaacacaaacaacaaaauccuagucugauaauucuaaaaucucugccauaugugugucuguuucugaugcuuacucuggcucuucaggcugugauuuuugucuuuuacuaugccuugugaguuuuuguuaagagccagaccuaauauaugagcuaaaaggaaaugggauuaaauagaccuuuagugugagcuuucaugcuuaaucugccuauggguuaggcuguguuuacuguuugcugucacuacauaagaggcuauaauugcccuauguguccuuauuuuuuuguuuccccuguuaucuuuggguuucccuacggacuuuuuaaauaaggucucagaugugcaguucuuuacauuauaacucccccaguacugguuccagcagugguuucuguuccugggcuucuaguuuggcaagcugugauucucugcguccacuugucugucucuaauuuuggaggaagcagauuguccuuugaccucaguucucuaauggaucucagaagcgucguugauuuucagccauuuggcuuacugugaggguggagugaugacuccaagcuccucauaugcuggaccaggaaccagaaaucuacuacuuuacaucugauuuugaacaugugaauucuuguuuuuaauuuaauuuaaaaaucuacuaguacagucuagguguguuagcucacuccuguaaucccaacacuuugggaggccaaggcaggaggaucacuugaagccaggaauuugagacaagccugggcaacaugguaagaccccaucucuacaaaaaauuuaagaauuagcugggcaugguggugcacgccugugguccuggcuucucaggagccugaggugggaggaucacuugggcccaggaggucaaagcuggagugagcuauuaccuugccacagcaacccagacugggcaacagcaagacccugucucuaaagaacaaacaaaaaacuacuacaacuucaccucuguggucuuccccccaaaauccaauaacuccaaaguaaccacaagaaauguaucaaacaaacccaauuugagggccauucuacaacauaccugacuaguacucuuuggaacugucaaggucaucaaaaacaaggaacaucugagaaacugucacaguccagaaguggcuaaguggacaugaugacuaaacauaaaguauccuagaacacaggcaaaaacuagugaaagugaguaagauguagagcuuaguuaauaggagcauacuacuuugguugauugauuauuugugacaaauauaccaugguuauguaagaguuaacaacugcagacaguggaugcgaaguauacagaaaacucuaugucuuuguaacuucuuuguaaauugaaaacuauuuaaaauaaaaggcguacauaaauuaaaauuuucaauuaucuucuaagguucuaagcuggucuauguccaucaccuucuuggagaaggagccuuugcccagguguacgaagcuacccagggagaucugaaugaugcuaaaaauaaacagaaauuuguuuuaaagguaaaugaccugaguugucuuuuguaugauauagaaaugaauuuuagaacuugaguuugccaagaaauuuuuuuucuuuaagauagugguguuuuuauuuauaucuacaguuggcaauuaaaaaacaaaaacuacaaaagauuuagaauuuuuuucccacuaaaauugucuuggagcaagccccacauugcagcaacaguucauagcuugucaucacuaucaacaccacaucuuuuauugggauagagguugcuuuauugcuaucauuuuucagaauacgagauuggauaugaauuucacauaccugauuugcagguccaaaagccugccaaccccugggaauucuacauugggacccaguugauggaaagacuaaagccaucuaugcagcacauguuuaugaaguucuauucugcccacuuauuccagaauggcaguguauuaguaggagagcucuacagcuauggaacauuauuaguaaguauucauuuuuaugaugagcacaugaauuuaaaauggauuuuuggcuuguaccuugcacguacuuuugugguuggggcuuuuguggaguggugggcaggggcaaagcucucaauuugaaauuuuauuaaucuugugcaacuaacucaggauuccacuuuccauuguuccuagaaugccauuaaccucuauaaaaauaccccugaaaaagugaugccucaaggucuugucaucucuuuugcuaugagaaugcuuuacaugauugagcaagugcaugacugugaaaucauucauggagacauuaaaccagacaauuucauacuuggaaacgggcaaguguuaugcuuuuaacaggguucuucucuuccuauuuccauagcagccuuucaucauuugugcucaugcagccuggcuuuguuuguguuuaauauagauuuuuggaacaggaugaugaagaugauuuaucugcuggcuuggcacugauugaccugggucagaguauagauaugaaacuuuuuccaaaaggaacuauauucacagcaaagugugaaacaucugguuuucaguguguugagaugcucagcaacaaaccauggaacuaccagguauaaaacuaaagugagggacuuggaaauauuuuucuguguugcgcuuaucagauuuucaaaaugaauuuggggaucuagguaguuugagguggucuuuugaggagcaguugaaggagagaugagccuaaggccaacauggcagggauagaauucuauuccugaagaauacucugcuuucuuauuaguccauuauagauccuguuaucaggaaaggggggcagauauauucugugaguuugaucauagggaagaguauuuaaugauuagugaacccuucagaaaggaagucaugcagcaaagagacagcuugguuuauugagaucaagguaggccagcccaauuuccuaaaucagggauaacagggagaccugcaugcccacuccaggcagaguugagcacauguuggauauaccugggaugcucucaggcaggaugguggguuugacuguaauagaugguacagccagauuccuaacuggccagaucaagaaauggaucauuauuauucuaauggaagacugcugaauuuucaaccaacuagaauauuaggugaccagggaggagaaugcuaauugggauaaaugaaauauuuugaaccuggguuuaacaaaaccaacugccaaguucccuggugagagcuaugucuuuccaggagcccaugguaaaaggggcaaagauuugguggggguggggaggggucuuguuucugguauguugucacugcuagugaggccuuaggagauggucaucuucuauccuguggauguggauggggcuggaguguucuuuucaauuaugaacauaucacacaacaagaggccaugggggcgaguuagagaacuacgaccagagucccaggggagugagcugggaggacuuccaagcugucuauguggaagagggcuuagaguguuguguuuguccucugugugacagaaugaaggacuugagagggacaugguagcucaggagggcagagcuuuucaagagacuggaagccuguggcaaagccuagauauucaguaagacauguuaguggggcgauugaacaaaugccuuccaaaauguuuuaaaaguaaaauccugugaguauuuaacuugcugccuaaguuagacaggcaucuugauauagucauguguaaauuacuauuuaagucauauauaccucuaucuucuucauagaucgauuacuuugggguugcugcaacaguauauugcaugcucuuuggcacuuacaugaaagugaaaaaugaaggaggagaguguaagccugaaggucuuuuuagaaggugaguauuagcauuggugcuguagugaaaagagaauaacuaaaguagaauguuggguuccaucuggcaaaaaaaaaaaaaggaucucugccaccgcauggaaauccuaugccuugggcaauauggugacaggacaguccugggcacugggcacagggagcaagcugcauagcuuuaccacuucucucuccccacuggggcagcugauguccucacugaaagcuccuggccaaaugguugacauccuguacacacgcaaauguuuccaccccuaaucaccuaaugucacuggaccucagguucucacugguuuuuucuuuuuucuuuuuuuucuuuuuuuuuuuuuuggucuauggaaauacugauccuauuuuugucagauauuuguaagaagcgaaggaaauaguguaugugaaagugcuucauaaauuauaaaguaauaugaauagcucucucucacaggacaguccuagcccuguguuucuugggcuucucaaagauuuuuuuuuaucuauaaaucacagugaaaauucaugauuaggcaagagcucuuccugucaacauggauggcucuccuaacacaaugugugaacaaacuguuggaauguuuuguuuaagcugaguauuugguaccugcauauucauuauaucacuuauacuuucuuuuuugaggcauaaaaacaugcagaaaaguacacucaucuuaaguguacagccuaauggacuuuuacauauguuuauaucuucuugagaaaacguaagaguaggaaccucaucugugaaccucaucucccccagcccccacaaaaaaaaaagaaaaauggcaauaauuuuaugaaaugucauauacuguacauaaguaagguuagguucaggcccuggaggaaagcuuauaacaacuauucuuuauucugcauaaugagcccucauguuuaguaaauacuuuauuccaucuuuggcucaaaauugaaggaacagauaguuucaucucugaccaccagugugaagaagagcuggaaguuaacccucagcaggccugauggcauuuccuauguggagcacaauuccuuugcauucuacuuucucuccaacaccuuaucuccauguucuggaguuucugcaguuaauuuuaacaauuauaguaguuggaacucuuaacucuugagcucucuccugggcaguccaaccugucuacuugguccuggugcauaugcaguuaggcuugacagaagcauuuguccagauuauccaauucuagcaguauuguauguauggcuagccagaagcagauaguuuggguuuuuauuuaaagggagagagagaaaauuuuuugacuugcaguauugcuaaaagauuacuuaucuuauuuuuuggaacaagauguauaagacaguuaauugggucuuuaaucucucucauguauaauagauauaguguuuccauacuugcugcauuguauuguguuuaggugagaguuguuauacuaaacuguccaagccuguggaagucagaugcaggggugggguuauccugcauauugaaggcuacauuuuagccauuauuuaugcuuugucuuuuucaggcuuccucauuuggauauguggaaugaauuuuuucauguuauguugaauauuccagauugucaucaucuuccaucuuuggauuuguuaaggcaaaagcugaagaaaguauuucaacaacacuauacuaacaagauuagggcccuacguaauaggcuaauuguacugcucuuagaauguaagcguucacgaaaauaaaauuuggauauagacaguccuuaaaaaucacacuguaaauaugaaucugcucacuuuaaaccuguuuuuuuuucauuuauuguuuauguaaauguuuguuaaaaauaaaucccauggaauauuuccauguaacuuaguuguuauaaauauuucaacaaaauauacaaccccauaaggucccuauauagcaggcugauugggcugcuucugggaugcaagcauuugugagaauaauucagacaugagcauucucuagaaaucacuuuuuaaacacugaccuguuuaagccaaaaaagggcca

SEQ ID NO: 13388 - RNA, 4352 nt, Homo sapiens
guaguuuuagaaaaacaaucuuauuaguuugguagcuuuuuuuccugaaaauaaaaaaaaaaauacauuggcaccuaagccauggaaaaugaaauaaaaauacaccagugcagcuuccaaaacacugacuugcaucucccucuccuauccgccgggaaugucuuaucccugccuuccaguggcugccagaaccaagggcauccgcggcguuccuuggcauuggcguuaacagcagauggauuuuccgcagcggccaggcggaagaugccuagcauugguccgccgucucacuguacugaauuucaagaaucauggccuacugccagccaggucaggaccgaaggcgcuagucuggggagacuggagcaggucucuagugguucaccuguucggaggcucuuccuguucaguucccucugcgcgccagaggguggcaccccaggcacuccagagguggagaggaggggacgacaggggaggcaaagagagaggagcggagggaaggaccagggaggaaggaccaaggagggagcuuuaauaaauucucagaccuuggucucgaguucccggcuaauuugggggcaaagccgaccgaccccacguccacgcccacccccuuacgggaaaagccgggguuuccacugggcuaggugucagaguugggaaugucuaaaacaaaaaaggcuuccgaggguuauucauggccaacaguuuccacaggagaauccaaagggaaacuaguuuccggggccgcugugugugcgggugcuuggugggcugaaagcugcugucacuagauggcuguaagugugccaacaucugaccugucccauuguguuguguuuugcaguugcuggauuugugcgacucggugaaggaugaugcccggagggugaucucgaccuuuaacauuccacacaccuaccuccacgcaccaaucgccggaaucuccaacccgcgggccgcgugggcuuucuacccugcaccgcugcagccgcggccacgggaagaggcgcgcucccggcggcccaagcugggagccaagcucuaacggguguggcgggaagugugguggcccgccagcagcugccacgacgcucgcuccaccgacgcccagagcuguggccgaggccgggggcuggcacccgcugggccgccacucucggggauuuugguggcaaagcggaggucccgccgaggcuggcgaggugcgcggcuggcugcuaggaaagagauccagacggucgccuggugcgcuggaucccugugcccuuucccugaaacccagccuggccugacugcaaccucucccaacuucagugccggauccccuagacaaucagggugggcuccccgcugcgagcgcgccccacagccgggugccgccaaaggucuccugcuguuagcggugacucacauucccagugauuuagaaaaacuguggugccgagugaaagaaaaaaaaaaaagcaaacacccuuagacaaaagaaaaaagcuccacucuuuccgcgagcgggaaaaaagguuugguucagcaagugaugcuauuucagugaaucagacgcucuggggcucugcaaggaaacgcacggacugggagaaggaagugggagccuagaguuuugcucucggcaaaacaagaacucggcuuguccucccaggccggcgguuuccguacggcaagacaaggcgcggaaaacauuuuuaccaucugacgcuguagucuguccuuuagaagagaauaggugaaaaguuuaauaaagaaauuaagcgauguggaagucguucccgcugcuugcagaggguggggaggcgggccugggcaauuucggaacuaggagagaccacgucggcaaagccuguggucccgaacaagggccauggauuucccauuucucagaucccggcugcccgacuucauucuuguuucuuucagcacaagccauccucccuucucccucccuccacgucucuuggcagagacagaaagggacaccgcucugcccgcguccagcgcgaaggaggugaccuaaaacccaugggcccuucucacacugcguucucugcgcuccggcccaguuccgggaggaccucccgacggcgcgggagaaggcuguaagggcucuuggcccccgacgcggccugggucucgggggacgcaugaacccgccaccucuggccggcuuccuuuuagugccccaaauagcagcgcuuagcccguugcuucccccgacucuuguuuuucaaaguguucacagggucgcgagagcgagcgacgcgggggcggcgaggcugcaaggcugcacaggaacagacgacaagaaauagggcuuucuucugcgugguucuuuuccggucccugucugagucgcccgaccccgcggggagcgcggagcauugcggcgugcggcgggcuucgggcucucagcccgcgcagcaaguuguguugcuuuuccccgggugcgacgcgggacggccgcgaagagcaaaguucguccgcgguaggaacuucgaggcccgguuaggaccgaucuccggccuccgagucuacuuagccguguccacgcucgugccuuuucccucuugcagcgaaauaacugggcggggcccgacgcgcguccuccagcgacuccgggaacccaaggccuccuucaccucgcucaaaauucacccgaaaaugcgcugagacuuuggcauggggcugcgcugugucccacugacguuacagaagcgcuuaugaauuuaaaaacugcuccaggcggccggacggcgggacaacgccuccucacuugcuccucuacggcaaggccccuuccuucucccugccggcugcggugguguguaggguggucccuuuacagaguuuccuuaauccaucuagccugaccucaccugcgggauguuccauuucccgauccaccucccacacccccgcugcaguugucuagaagcuggggcuggggaacugaggcgcgggaggagcagacaggagggccgggguuggggcgccagccacgcguugggagagcagacccgggugcagacucagaggacuggagaggcggcauggaguuuggucuccugggagguagagugaggugcugcggacuccagggaggaaagggauggguggggaggcgggaggggaggagggacgggguauuuugcgcucccgcaccgcggcccgaacucagcuguucugccuucacuggccucagccagucgagggagcuccuacgagguuaucugcgagcccagcaaaucuuggggguccuagccaaaugcagugcgcaacguucucucucacuuggaggccgccauucaccucguuuuuuuuuuuccuaaaaggauuuuuuuuucugagugcuuuuuucauuucccuauuuuaccugcuuugcacaugccucccgcccucacccgggaggcggcgaagacgcccacugggaccgcgccuggccguuuucugggcgcguccugcccccacggccucugucucuuagggcgacugggcgcggaagaaaagcuggagagccccugcgggguggcaggaggagggugccugagucccgcgagaggcccgggcgaggaagaugcgcagccugcugauccgcgucccgcccggcgccagggacccucagagggaggagagcucaaagaccucgccccgcgccuucgcgaggaccaacccaguccccgcgccugccccagagcggcuuagaaacucagggcacagugagagcgcagggcgccucccgaggcuucacaccgccggccgggccagcggaggcugugaccggagcgcccccucugugccgcgcacgccgcggccgccgccggguugggguaggugagcgggaggcuaggguacacuucggggugggggaugggcgcgcacauggccgccagcaggcagaguuacuccgguaaacacgccagggacggcggcgcgcgcgggaggcaacccagcggggcaacccccgccuuuaccuguccgagccugcacgcgccggcggccgcggcgccgaggggggcggagcuugccagcccgcgcgccggggcgggaccuagcgggggcgggguccgcagugauugggcguaggagcggggccgccagccagagcugggcugcagggccgcgcagguuucacuucgcuccgcgcagccgccuggucugcaguuuguuggagcucugcguccagcgccgcugccgcugccgccgccgccgccgccgccgccgccgccgccgccgccgccacuaccaccacuugauucuugcagccacccugcgaacccugccacacugcgaucgcaucaucgcgguauucgguucgcugcguucccgccgccacc

SEQ ID NO: 13389 - RNA, 805 nt, Homo sapiens
ucagcuagauacaagggaaaauguauaaaauagcaagggcuccgaaaagagucaggcuuaauuucucuugcacagaaaaaggauucuauugcucuuucuguuccguccucaaacaggaagcagguuuucugggacaagggucaacaggcagccaguucauccaucugccuacuccgccauccuuagcacuggcuuccuuccuccaaguuaucuuaugcuucaagaaggcugcuggagcuccugccaucacuucugcauuccagacagaagagaggaaggaaguggggggcaaaaggcaaagccuccuagaugucagacuccucugcaggccuuuccuugaauucccagcuaacccuuucagccuagucuuucacuggccacccuaucuguaaaggagcuggaggaggaagauggaggagugaggcaaggcccugagaugaugcagagcaaggggcacacaagaggggacucagguccaaggugaaauagcagcaagcacucucccuccaaaacccaccgccuccuuaugaaucccuuuggccuugauuaugccaguagauaauggguaugugacaguuuuagcuucucuggccuuugaucagguugauuuaugugaauagacuccauguccuuggagaugaaccuguucuaaaaauucuaagcaaccagccauuuggcucuuugcuggaaaguagccuggcuuuugaagccaagucuggacaguuuccuugcugcaccucaggacucaaaggacaugguccugacucaggaagagcuggcuuugagggaaggggugagucaugaa

SEQ ID NO: 13390 - RNA, 3604 nt, Homo sapiens
augauucaauuuucucaauuuucuuugcuuuaaccaaaauucuaaaugcaguuuugccuaguucccuuuuuuuuucuuuuuuuacuuuuuuuuaaacguuuguaaaaaccucuuugaggaugaggagucaguaaaauuccacuccccaaguggcccugccccagacaaagguugcuuucccccuuuuuguucuuuuuaugcccccaagcacuuucugcaguagcuagagggacagguuuccuuccaggaaggauucgaguuccugugccuguggguauuaggagaguauauauccugccugaauggggaagucuucuaaaaugggaaagaagugguuucaucuccacacagugucuuguaaaucucaacaaauguguacuguuagaaguggcuuccgcuuacuggauuaacuaauacuuuauaggcuuuucaggaggccacaucacuagcaguagggagaacaagaugucauuuguguucaguguaagcugaguaaacaggcccuuccuagaguguccuggaaaucacagcaacccauugaaaacugcccuccccaccagaacgugcuacguucuuucuucaugccuaugugugcuccauuccucauuucuacuuggcucaagaaaacauuucugcagucaggugagacuuuuacaaaagaggagaaaaucaaugccuccuugaacaugaugagaugugagaacuuacaaugaaaaaggcaauaaugauagaaauuauuucuuagguacagcaauaguugauaggaugugaggguguuaccuuggggugaaguggagaaggucccaggugaauuggcucucauggaaauuuggaauuacaaaauaaacguccuggggguuacccagaauacagauuuaaaaguuugccuguagagcaaaauaaaacagucaguuguagucauuaauccuugaggcccaacgcagccgauggguugguguuugggaaauucugagaugggagugagaucugaucggauccugggaagauguauacccaguuagaacguguaggguucugggucccuggcaagucuaggugggcgggugacagggaaagcaugggcauuuuuguauugcugucacaugcuaacagagguuuguaauuaucuuuuggacccaaauuauagagacauucacgaguuuucuagcccucacaguaacagagcuaagaauucagaugucaggaagucugugaaucuugauggauuuucugagaaaccugacucaauggcauauauaagagggaaguaagacuuuuaagaaaagaaaaaguuaugccucauuccucauguggcuuccaauaaguaucuuaggaacuuauuuccuuuuuaaaaaauauuuuuuaaauuuuuaaaauuugauuuuaaauuucaaauaaauuuaaauaaauuuuaaauaaauuuuaaauaaaauuuuacagagacguggucucacuguguugcccaggcuggauugcaguggcuauucgcaguuguaaucauagcacacugcagccucgaauuucugggcuugagcaguccucccgucucagccuccugaguagcugagacuacaggugcacaccaccaagccuggcuuuauguauuuauuucuguucaugcggaaugauugguucagaacuguuccuuucccuuccaugauguccuugacacagaagguuaugccuggcucccagucaggcuucauacuuuugguccauguaagugcuacccguugcugggggaggagucaugguuuauuuggaaaugucaguugcaaucaugguucugucauuugacugcacaguaucagaggagccuguuaaccucucugugccuuaguuucuuagcccaugaaagagaucauugccugacccagggacuaccucaagggcuuuugaugaggacaagugacaguaggaagaugcaagagccuuuaguaccaagguucucaacacugacuacaugcuggaaugacugugaagcuuuuaaaaaauguuagugcccacucuuccccuguacccccggacaguuaaaucagaaccucagacagcaauaugccuugagaugccuugaaccaugcuugagaaggaaggacaaacacauuauuaucuuggaagaauugcauaaggcuuaugacuuaaaaaaaaaaauucuuuuuggaaacacaagcauuucuuuaaggaugaccggauguugccguauguauuuauggcacaagcagguguugucuaagcaguuucucuguuugcuugucauagcagcauuuggaaacucaaacaugcuuucauuuacauaaauaguuuaugaagcuuugacaacaaauguaaacagacacgaaauuauaaaucugcuaaauauguauuaaggguauuaauuauugaaagucccuuuccccaaaacucaacuccuauggcaauuaugaacuccauuuuaccaagaacauuuaagugccucagcaucuguaugauauaguggagcaggugcugacauagguaccagcugacaugaugugucacuagcucugugggaugauugccacauacauggaacaccugggagugcuggaaauguacugugaucgaagugacaaaguguguuuucauucacaguggaggcuacaucaagcaaggggagguccagcccucuugcaaguguggugagaggcucuacuagcaaagacaugggcaccggaguaggucccguguagcaugcgggugcuguagagaaaauucagugacguacauggcucugguucuggacacaaaaucuguacuggagaggaaaugacugcugaaauaaggcgauuguaugaauauuuaaaaugccuggaacacuaaaguaaaguaaugauauuucaaguguuuuugugcucuuugguucuuguuguagguauugacuguccugggauaucacuggucauuuaaauucaccauauaauuagccgggcaugguggcauguggugguggcugaggugggaggaucgcuugaggcugaggugugaggcugcagugaaccauguucacaccacuguacucuagcuugagcaacagagcaagacccugucucaaaaguaaauaaauaauaaaguaaauauaaauccaugaugccguuacucagggguagacagacuuucuguaaaaggccagauaauaaaucugcuaggcuuugcaaaccauguagggccuuuuuugcauacuuuuuguuuuuuucuccaacucuuagcucauaggccguauaaaagcaggccagaugugcaguaauuugcugaccccaggauguuacccaauacauaagccaacagauuguccuucaaaacugaugagcuucucagugaagcacugagacuauuucagcugccaaagucccagcccaucguuucuuacgugucuuguguaucgaguucuuguaaagcauuucaccaaggccagguuuuuaaauaccuauaaaccucacacaccugagaugcuuagucuuguggauagaaagaguuucauuaaugcaaauuguuauuaacuuguaacuucuugugcaauaaggcugaaugcuuuggacaucuuuccuuuguauggcuggccugccuucuguggcugcuuccacuucau

SEQ ID NO: 13391 - RNA, 33890 nt, Homo sapiens
gcggaaacgggacugcggccacuacuuccggcguguaccgagagacuggcguccggcguguaccgagagacuggcguccggugugcagguggccacauggauccuggcagccgguggcggaaccugcccagcgggccuagccuaaagcacuugacugaccccucuuauggaaucccgcgggaacagcaaaaggcagcguugcaggagcugacgcgggcgcacguggaguccuucaacuacgcugugcacgagggucucggccucgcggugcaggugagcgcggcguccgccggcgcccuugccgcggcgaggccaaucccagggagguggcugggaggucacaguaugaccccagaugcaugugcuccuugauccugacaggcuugguggguaagcgggagagcacaacauguuaaacaggacgcgguacuggccuucgugagacuuggagucgaggcgucuuaagagauguauucgugauucuggagugaaaagugauugugaaccguaguuuggacaguuucggggugcugugagagugaggaaguggcuuaucuggggaugugcuucacaaugcacacggcuuuauaucacuugaagacuuaccucuccaaaacguaccucgaaagaucccgaacguauuuguagguacaguguaauguucaagguuauccuucaguuuccuucucuuagagcuuuaaagagagaaacuacucgucauuuguuaugaauuaagcaggugccgaggaagguauaaaugagucaugaaagcaagauugaaucgaaaaguguaauugcauuauuagcguagaguaaugguagcagaauucaagugaguauggugggggaaagcuucguuuaguaagcauccccagugucuccaggcacuaggcucagaggauguggaggaggcagucccguguacgagacaguucaugcauuuaagugcucccugucguguuuggggguugaaggggugaagauaaugaaagcagugcaugccaauguucuugagaacugcucugccaagggauugugugggcuacugcgggagccuaugggcggcgcaacuaauccaggaguuugagaaagggcaggauuagaugaguucaagaagugagaaacgugcauuucguccaggggaagaguagagcagagucacaugcuucggggacccuaccugugguuuuguuggguaagauuuguguugugggagauagggauacagauaauguggagagcuuugauugccagucugauucuugaacucuauucggcaaauaauaugggagccauuaagauuuauuguuuagaaagacuagagggguggggguuauuuguauugugccuggauuguuacaguaucaugucugugagaaaaaauuccuaauuaaaaguuaaucgggcugggugcaguggcucacaccuguaauccaggacuuugggaggccaaggcagaaggaugacuugagcccaggauuucaagaccagcuuggauaacauagugaaaccccaucuccacaaaaauuuaaaaauuaguggggcaugguggugcgcacccaaguagcuggucccagcuacucgggaggcugaggugggaggauaaguugaacccaggaauuugaggcugcaaugagcuaugauugugccgcugcacuccauccucgguaacagagugagaccugucuuuaaaaaaaaaaaauccaauugagaaauuuuagaaaagcacuaauuuaaaaauaagccagucggcugggugugguggcucuugacuguaaucccugcacuuugggaggucaaggcggguggaucacuugaggucaggaguuccagaccagccuggccaaccuggugaaaccccaucucuacuaaaaaauacaaaaauuagccgggcaugguggcacaugucuguaaucccagcuacucaggaggcugaggcacgagaaucgcuugaaccugggaggcggagguugcagugagccaagauugcaccacugcauuccagccugggugacagagugagacucucccaaaaaaauaaauacauaaauaaauaaaccaauuauauguuaacauuuuuaagaaaaauauuuuccaaagcaaaaaagaaguuagaugaauugcauuauuaaaaaucuuuuuaaugucuggcuuaaugaaaagacagcuggauucucaugucugcuugugcauucagucccuugugauaauuguuuugguugaaguagaugaagaaaauuuggcccugcauagaaaaugaugccacaacuuagcuaggacuauaauaauauaguauuugaaaaaguucuguaaaacacaguaacauaaauaacuaauacuuauaaagccaagggaaaaaauaguuaucauauuuuuuacuuacaaaacauaauuuugccaaguuucuuuggagugaauuccuccuuucugugagucagaauuuaugugucugucuuuucaaaauacaauugauuuuuauuacuuggggauuccauauuugcaaauucaccuacucacuaaaauuuacuucuacuccaaaagcaccaugcccagaagcagcaaaaaaguugaguugcucaguguccauuuucccagcugagaucuaacaaggugaugcucggccuucuuguuuuaaguucuuaaacuauaaacagagguugucuucacuaucuauuuagugccguguuuugugcuuuuuguuggugauuuugcuguuuaaaaugucccccaagcaaaguauuaaaguauuaaaguucuguauaaaguuccuaagcacaagaaggcugugcugugccuuuaggggaaaauauuaauacaugcauuuaacauaggcuuuguucaggcaugcguuagggacucaauaauauauauuagauaagcuguccuuaaacagaaacccacauaaugcaagguuguguauugaucaguggaugaaaucauaggcuuuguucaggcaugaguuacggacucaauaauauguauuaaauaagcuguccuuaaacagaaacacacauaauacaagauuguguguugaucaguugaugaaaugugaccagaggcucgcaggaagcuaaccauguauuuacccuaggagcagugguucaguauuggcuaauucaguguuuauggcaacuguauagaacauaacuauuaugaauaaugacaguucacuguauuuccuucuaaauagugcagcugcgucuugagaaagcaaauugucuaaucucucuuuuuuuaacuucauucuguuuuuuuuuuugagacaggaucucacuuugucaccuaggcuggaaugcaguggcaugguuauagcucacugcagccucgaccuuccaggaucaagugauccucccacgucaaccucuugaguagcugggaccacaggcgugcaccacuaugcccggcuaauuuuuuuauuuuuauuuuuuguagagacggggucucccuauguggcccagccuggucucaaacuccugagcucaaguaguccuccucucucggucucccaaauauugggauuacagguauaagccacugcaucuggcuuuuauuuuuaaauaaaauaugaauuucuaaaauaauaccagcuuuagauaacauuuuaaaauuuagaaaagguaaguuaacucacgugaagguggagaaccuccuugguauucuuucuugguuccauuuuuucauuuucauuauucuaagacuaagucuaggagguugcuuguaauuaauauauaggagagcuuggugaugccccuuccucagaacagcaaagcuuccccuacagaaugguacaaagaaguaacuucuguggaaggggaaacccagccuggccaccaucuuuuccuuugcauggcucuggcuucaguuugacguugccauuguacauuaagcaucuagucuuaaauccuaaaggauguuuccguauccuugcucuauuagcaguagucccauuugucuugcuaugcacauagacaaguuaagaauacacaaggcucuugguucagagaacaggaauuuuguucuguucacagcuguaucccuagagccuacuacagucucugacacauguggucacucaaaacaaucuuguacuaauaaugcuuugugguuuuaaguauuuagugaaguuaugaguagacuggagguagcuuuuuuuuuuuuuuuuuuuuuuuuuuuuuuuuuuugagacggagucucgcucugucgcccaggcuggagugcaguggcgugaucucugcucacugcaggcucugccucccggguucacgccauucuccugccucagccucccgaguagcugggacuacaggcgcccaccaccacgccuggcuaauuuuuuuuguauuuuuaguagagaugggguuucaccguguuagccaggauggucucgaucuccugaccuugugauccucccaccucggccucccaaagugcugagauuacaggcgugaaccacugcgcccggccaacuggagguagccuuaacuguccuuuuuaggugugucaugguggcaucacaggcaucaauguuuguagaacacauaagauuuggaagagucuuagagaaaaaaugccuuggaaaugcaagcaauuuaauagugugaauugcauuucaggcuauaccucccuuugaauuugcuuucaaagaugagcguaucucuuuuacuauucuggaugcuguuaucaguccaccuacaguuccaaaagggaccaucugcaaagaggccaauguuuauccagcagaaugccggggccgaaggaguaccuaccgugggaaguugacagugaguacuagugauacugugugacucucaacacugcacauauuugggaguagggcgggugccuaauaaaguuuaugccagaaauugcuuucuuggugcuauugucuaagagaucccaccuucuaaaucuaaggcauaaaauaauuuaauugaucuucuuccucagucuuugaaaauacucauuuguucucguaaaugcagauauuucuguuaaguaacuuuuucucuuguuuucauuuaggcugauaucaacugggcagugaauggaaucucaaaaggaaucauuaagcaguuucuuggcuauguucccaucauggugaaauccaagcuuugcaacuuacguaaccuucccccacaagcccucauugagcaccaugaggaggcagagguaaugacgggcguccaggcaugagacaguagagaaggccuggguugggaguaagaagacaagaagugugucaguguuuucuuucugugcuccaauuucuggauaggugaaagagauaucaguaucuugccugcauacaguguauggcucugaauaacuaucaaauuagacaguaugaaaaaguggcuguaaaauuagagaauauuauuguucggggggaagaacugguagguuuuucccuaauuuucugaaugauagagacauacuuccacaaaauuuguuuuuuuuuucaagcugucuuaauccacaaagcuauugucaaaaaugucuauuuaucugggcauggugguggcauggaucuguagucccagcuaacugggaggcugaggcgggagcaucaguugagcccaggaggccucacuacagugagccaugauugugccacugcacuccagcccgggagacagagugagaccccgucacuaaaaaagugaaauaaaaaugucugcuuugcuaacaguaagauucugugcgcauauuaaaugacuuauaugcauucccuucaucauuucuuucagcuauauuagguggcuuugcagaguugaguugagguaaucaagaugaacaaacagugccuacuaaauagguagaugguguuauguggugggaagaggguuuuggugucagaucuggguuugacacacagcucuuccgcuuaucagucuugugguuuggggaaguuaaucucccugagccucaguuuccucugcugcaaguggguauaauagcuaccccacucauuguuaugagaauuaaauguuaugauaacauagagcaccuacuauaauaugccuguuucauaguaggcaauucguaaauaguagcuguuuauuacagaaaugugauauugagcagagcuauuaaaaauauuuuucuauuuagcuaauccaaauuucugguuuccagagcuuucauacaaucaaguuuuugaacguauuugggaaaccauacucguauggaagcaaaaugguuacaguuuuuaucuuucuuuuuuuuuuuuuuugagacggagucucccucucucacccagguuggagcgcaguggcgcaaucuuggcucacugcaagcuccgccuccuggguucaagccauucuccugccucagccucccgaguagcugggacuacaggcgcccacuaccacgccuggcuaauuuuuuguauuuuuaguagagacgggguuucaccguguuagccaggauggucuugaucuccugaccuugugaugcuccugucucggccucccaaagugcugugauuacaggcgugagccaccgcgcccggcccaguuuuuaucuuucaacaccucuuuggaguaaguuuuuuuuaguguuauuugaagacugaagucauuuuaggggacagaaaggcaagauagguugagccugucugauaaagagaaguacccuguuuuucuuccauacuuuuuucccaugucccuaggaccuuuguaauauacuugagaaaacuguuaauucacacaaagacagugucuguguacuguuuucaagggaucaguaguacauuucaccucuguguuccuauucuguguguuguacuaccuuuggcuaggagugagguucauguuuacaguuagucauguaucuuuguuuaacaaguugcaauucaucuuuuuggcaggaaauggggggcuauuuuauaaucaauggcauugaaaaagucauccgaauguugauuaugccucggagaaauuuucccauugcaaugauaagaccaaaauggaaaaccagagggccugguuauacucaguaugguaaguucuggagauuauuagaauauuuuuuaaggaaaauuuaaaacuuuuuuuuuuuuugaaguagaugcauccaaauggucuuugauauuuuuguuucuuuuuuuuuuuuuuuuugguagggaugggguuucaccacguugcccaggcugaucucgaacucuugggcucaagcaguccuucugccucagccucccaaagugcugagauuacaugcaugagccaccgugucuggucuuucuuuuguuuuuuguuguuuuucuauugagcauucuuguguuaaguuuucauaauugggauggaagaagaaauggagagauguuagucagaggauacagacuugcaguuacaagaugaauaaguucuggggaucugauguacagccuggugaugauaguaauacuguacugcuuaaaauugaugaguacauuuuaagugucucaaccacacacgcgugcacacguacuacaaaugauaacuauggugauugauguuuucaucaguuugauuguggaaaucauuauaauauauguauauguauauucaagguauuguacaccuugaauauauaugauuuuuaucaaucauaagcauuuuaaaauucacuuuugcuaacugaaagagcauguguauuuuuguuacuacuuaugaagaugaaagcuagucuggcuuggccauaagugggugugggucuuggcugucuucugguucaggcugcugcacuuuugcaaacugaaagagcauguguauuuuuguuacuacuuaugaagauggaagcuagucuggcuuggccauaggugaaugugggccuuggaugucuucugguucaggccacugugguacaccccucagggucucugucugacagccaccuggccucuguuggaacauucucuuugacaaugccuaagacagcauguuguauucuugagcaacccugacaguuaaacaauuuguccugauaguugagcuaaaaaucagaccuuaauuauagccauacauacuauaccuagaaaaacagcaugccugaaugucuagugauuuucuuuugcaucaguugaugguaguaugucuuagcagucuuugccugaaacugaaauaaaaucuaaaauucuacuuuucuccauuggaacuauuagaucaagcaccaugucuugaccagacuccacaguuuaaggcagauauaaagugcuaaaagauguggacucuguccuggagggaaacuuugaaguuugcuuaaauucauaguuucgguuauuuuacauuaguguuucucaaucuggguagauuuugcaugcaagaggacauuugcugagguuuagaaacauuuuugauugccagucuuggcuaaacuuagugauuuggcuuuaauugugucuaagagguuaagauuguucagaaagaaaaugguugaagcaauuaagauaucaaugaguuucugauuuuuuuguuguuugguucaauaggaguuucaaugcacugugugagggaagaacauuccgcugucaauaugaaccuccacuacuuggaaaauggcacuguuauguugaacuuuauuuaccgaaaagaacuguucuuucuuccuuugggauuugcacuuaagguaugacuuaaugaaugcauucuuuuguuaugaagaaauucacuggggguaguauccugugcacauuggauggauucuccuuguuaaaauaauacuguacuaguugucuacugcuccaaaacaaauuacgucaaaauucaauagcuuaaaacucaauaacauuucugucucacaguuucugcgggucgggaguuugggagugcuuuggcugggcacuuguggcccagggucucaggagguugcauggagaugucagacaggacugcagucauuuucaggacuuccaagguggcucacucacauggcuggcaaaucugcugguugguggcaggaggucuccucaugggguugcucucuacauggcccuuucuguaggcugcuugaggcaacugucuuccuccauauaguuagcugagagaacagagagcagaagaugcagaaggaaaaagcugcagugcccuuugugaucuagcccugggagucucccauuaucuuuuucaccacauucucuuggucaagcaggccagccuugauucggcaugggaggaaacuacacguuugugaacaccaggagaugaggacccuggaggcaauugugcugucuggcuaucauacaaagaaugcuuuauuuuagagaguuuacuuugauucagcaauagcagagugcuaauuuuccuuggguauuaaaaaaaugagagaagauaauuauuagugaauagauaaaguauuuuaguuauuagugagcaauuaaaccuuuuauuuucuauucuaggcacuugucagcuuuucugauuaucagaucuuucaggagcucaucaaaggaaaagaggaugauucuuuccuuaggaacucuguuucucagauguuaaggauuguaauggaagaggguuguucgacacaaaaacagguccuuaacuaccuaggugaaugcuucagaguaaaacucaauguuccugacugguacccaaaugagcaagcugcggaguuccuguuuaaguaugugugcuuugucuaaacuguuuuuggaggggcggagggcugucagugguucuuuguauugguugcaguuugggcgggcgagucauuugggaaugagaaugaaucuugggguagaauccugguccuugcuagccgggggcuaccuuuguuuuugcggcccuccucacuuguauuuuuuuaguagucguguuuuauuuuauaguacuuuuuaacuuuuauuuugaaauaauuucagacuuccagaauaauguccaaauaguacauuggauucuaauugugaacauuucauucauuuacauuuacuuuuuuacuuucuguguacacagauguacauuuuucuuucuguacaaucccugaaaguugcagggauuguaucacuuuauuucuccaaagcaaggacuuugucuuauauaaccacuguauaauuacuaaagaagccagcuccauacuggugcuguccagugcauagccaccagucacaugauaagcacuucaaauguggccaguguagcucaaaaacugaaugcuuaauuuuauuuaauuaaaguuaaguaagcaugaguuggggaucuugguuaauagaauauuaaguaguauuaccaacugaauuguuuuaagcuuuuuuuuuuuucuguuuucacagccagugcaucuguauccacuugaaauccaauacugaaaaguuuuauaugcuuugucucaugacgcgaaagcucuuugcuuuagccaaaggagagugcauggaggacaauccugauaguuuggugaaccaggaaguccucacaccgggucagcucuuccuuauguuccugaagguaaaugcaugcuauguccacccuuggccagugguaccacuuguggaauggcgugacuuuguccagcagcacuguuuucugcauguuuauaguuucuaguuuuggcauuuuguguggucucuuuuuuguuuguucauuuagcaguaaggggaucagaaauccuggcuuacaccagguuuggaaauuugcuuaauauuuuuauguaaagaucacaucaaaucuuggucacaguguuaaugauaaaaagcaaauggccuguauuuauacauaugguugauccucauuauuuguagauucuguauuugugaauucacucacuggcuaaaauuuauuuguaacccuaaugucagugcucagugcuuucaugauuauucacauacaugagcagagcagugaagaauuugggucuccugaggcaaauguuacagcugaggcggggcagggcgaugcucugcuuuccgguuucagcucauacuauaaagaggguccuuuuugaggugcauuuggugcuauguuuuucacauugucgugcuucuuauuggugacuuuuuuguuuuuuuuugagacagggucucagccucaaccucccaggcucaagcaauccucccaccucagccuccugagcagcugggacuauagacauucaccaccacacccggcuaauuuuuaauuuuuuuuguagaaacagggucccacuauguuguacaggcuggucucaaacuccugggcucaugugauccuccuguuucagccucccaaagugauaggauuggagacaugagccacugagccuggccaguuuuugcuguuuauaaugguccccaagcauagcacugaagcgcugucuaguguucaguguuaaugaauuaacaagguauguuaaauaaggugccuuucaacaaaagcugacauuaaacaagauuguauauugauccguugaccagaauguuaugaccagagacuugcaggaacccagcccuguauuuuuccccaggaguagugguuuuauauguguuaauucaguguucauuagaacauagcuacugugaguagugaaauuugacuguagauguauauagagagaaaguuggcauggcacaaaaaugauuucauaagaauauugauucaguggcauuuuauauuuugcaucuuauccucaaaaagauguaaucuaagaguuaauauauuuuuaguagaggugggguuucaccauuucagccaggcuggucucgaacuccugaccucaggugauccaccugccucagccucccaaagugcugggauuacaggugugagccacugugccuggcuucuaauuuauuuuauuuuauuuugagacagagucuugcucugucucccaggcuggagugcagugcuacgaucucagcucacugcaaccuccaccucccggguucaaacaauucuccugccucagccucccggguaucuaggauuacaggcgcgugccaccaugcccggcgaauuuuuuuauuuuuaguagagacgggauuucaccauguuggccaggcuggucucgaacuccugaccucaagugagccacccaccuuggccucccaaagugcuaggauuacaggcgugagcuaccacacccggccuucuaauuucuuaucuagguaguaauucuuauuuacauucuucccgaaagguaauaaucuuuguuucuguuugcucuguccauaaaauuagauugaaaaauuucagcagccuacaauuuuccugacaaaaauugaaagcaggcagcguaaguuuucucuuauuaauuuaauguuauuaaauuaaccuuucaaguaaagguuaauuuacauuucccaucuacuuaaagugaagcauggugggcucauuguauuccacacuuauaaaugugucuuuauuccacaucaauuccuaauuaggaaaaaaaagaaaagaaaaagaaaugagaccaggaguacaguggcucaugccuguaaucccagcacuuugggaggcugaggcagaaggguaacuugagcccaaggaguuugagaccagccuggacagcacagagagaucgcuacagaaauaauaaaaacuauuagcaguggcugggugugguggcucacgccuauaaucccagcacuuugagaugccaagguggguggaucuucugaucucaggaguucaagacuagccugggcaacauugcaaaacccugucucuacaaaaaauauaaaaauuagcugggcaugcuggcaugcugcagcaauuccagcuacucaggaggcugagguaggagaguugcaugagccugggagacggagguuacagugaguugagaucacgccacugcacuccagccugggcgacagagcaagacccugucuccaaaaaaaaccuguuagcugggcauggugguacaugacuguggucccagccacuugggaggcugaggugggaucccugagcccaggaggucaaggcugcaauaaggggugauuuugccacugcacucuagccugggcaaaagagcaagaccuuaucucaaaaagaaaaaagaaaaaaacaccuggugcgguggcucacaccuguaaucccagcacuuugggaggccggggugggaggaucacuugagcccaggaguuugagaucaaucugggcaaacagcccagagacaaaacuucgucucuacaaauaauuuuaaaaaaauuuagccaggccuggugggccacaccuguggucccagcuacucagcaggcugagguaagaggauugccugagcccaggcggcggaggaugcagugugcugugaucacgccagugcacuccagccuaagugacagagcaagacccugucucaacagaaaaaagaaaugagucuucuguagcaaggcguuacuaaggugaccugugucagcaacaagagaaaccaagggaaaauuggggcuuuuucagagaauucauugccgaguaucugauuuccuuaccagcuacguuaaagcuuuuaaaccuuugaguuuggagcauaaaaacaaucuucagaagauacauaaccaugacauaagaugaauuauagacuguuaaaaauucacauuguauuuacauugaaauaagcaauauaaaauugaaaaauagcaaccauauuuucuguauuauuguagauuaaccauaaaacacuucaguuagccuuucugguuuugauuuuaaacccaaauaaggaaguagacauaguuaugaaaaaaaagggagaagaacacaaacaaaucaguugucaagauccagggcuucuuauuccaucuugacugugaagaugaaguguucaguguacaccugauaaaaacauuuaugacacaggaagauguaggcucaagaaaggaaucuaaacagcaaccagcagagguggagcagugaugccaggcucuucuacucaaacuugauucucuaguuucacuugauaaaguccaaaccuacauuaauacccuuguugggugagcuaacagcuuccuucacucccugguaauucccuuaucuguacauuacagauuuuuagcaguguacuuacaaauccuacuaguguguagucaguugugagauucauuguaacauuuuauaaaauauauuccuucuucccacaccucuccaaaauuuauuccuuccaaguacuaaaaauuuaauauuacugcaccacagugauauuaaaugcagugucagugccagagaauaugcagaaaugaaaugugucacuuccagugcugucuucuggaagaauaguuaggucuuccaagugugaguguucaaacacugauaguuugaagagguggauuaucaauagucaauggcuaauguguugacucaggggccugcuggaaaagguauacaugagugaccuauguacaucuuccacguuuucuuccaaauaucaaauauaggagagaaccuaucucaaacauucucuuagguauuuucagugguuucugaaccacccauagaaagcgcugaugguguauagucuuuuuuucuuuuauuuuuaguugacauguaauaacuguacauauuuaucggguauacagugauuuuuccauauaugucaauaauguauaaugaucaaaucagaguaauuaacacauucaucaccucaaacauguaucauuuuuuuguguugugaacauucgaaauccccucuucuagcuuuuugaaaauauacaauaaggcugggugugguggcucacgccuguaaucccagcacuuuggaagcugaggcaagaggauugcuugagcccaggaguuugagaccagccuaggcaacaaagugagacccccaucucuacaaaaaaaauuuaaaaauuagccaggcaugguggcacauaccuauggucccaccuacuuaggagguuaaggcaggagaaucccuugaacccaggagguugaggcugcagugaaaaaauauacaacaaauauaguuaacuguauucaaccuacauugcugcagaauaccagaacucauuccuccagucuagcuguaauuuuggaauugcaggcugcuuuaggcuuuucacuuaguguuggcagcauagauuaagauggacuguguaguucgugugauugguuuuagauguauaacaaguauaaugggugaaggagggcaucacauugaagagcuauccuuucugcaccugaaaagcccucuuucagguuuuugguuuugauguauguuaguagacguuuguuaaagaucguacagauuacaugggaauaaauaugaaguuugugauaauugaaacacauacuauuuuauuuuauugagaauagggucuugcccuguuucccaggcuggagugcaguggcacagucauggcucacugaagccuuaggcuccuggacucaagcgauccuuccgccucagccucccaaguagcuggaacuacaggcacgccccacccccucaccccacccccucuggcuaauuuuuuuguagacaggguuuuguuucaccauuuugcccagucucauguugaacucuuggucucaagcgauccacccaauccugggauuauagaugugagccaccacaccuggcucacauacuauuuuauauuaauuuuuuuuccuuauuucaggaaaaacuggaagguugguuagugucuauuaaaauagcuuuugauaagaaggcucagaagaccaguguuuccaugaacacugacaauuugaugaggauuuuuacaaugggcauagaccuuacaaaaccauuugaauaccuuuuugcuacugggaaucugcguucuaaaacagguaaaauuaaaucgaucguuuuaguuauguuuuucaaauuaguugcuuaguguagauuugccugucccugagaguucuuuuuaaaagcaaaccccacgaaaaaaguaaauuucucauaacuaugacuucgacaacuauuggucuaaagggcuuuagacaaggugucuguauagcuaaaauuuaauucagauaacugaauacauuuucucugcuuccuucuagaaaaugaaaggccacuuagaccucugaggaaggcuuaccuaacaggaacucuagauggguugcuguacaugcccaucucuaaaccauuugccuugccucagagugaccugagaggccaggugugguggcucaugccuguaaucccaacacuuugggagaccaagguaggagggucacuugauccuaggaggucaaggcugcagugagcugugauugcaccacuguacuccagccuggugacagagugagacccugucucaacaaaaaagagaaugacccuagaaacuuaaaaagugguaauugggaauucagaauuuuuuuuuuuucuuuuuugagucagggucucacucugucacccagucuaaagugcaguggcaggaucauggcucacugcagccuugacuucccaggcucaggugauccuccgacgucagccccacgaguagcugugacuacaggcauaagccacaacaccuggcuaauuuuuguauuuuuuguagagaugggguuucgcuaugcugcugaggcuggucuggaacucuugagcucuggugaaccacccaccuuggccucccaaagugcugggauuauagcaugaaccacugugccccgccuuuuuuuuuuuuuuuuaaacccauguuacuguugccgauucuuucauuagccugcuuucuugcuugucuauuaucugacucucucagaugaauuuaacuacuugcuauuuuauuaacucauuuaauguucacccacaaaggaggucauagaggagacagggaacuaguuggggcuaauacaguuugugaaaucuggggauuauuuuacauauuuuuuugugaacucuuuacacucaucagagcuaggagaauaaauguuguaauaauucauucuaugaucuguagagugcucugagguuuugucgucauaaagccucaacaauuuccauuuuucaaaagauuggcccauuuuugaaugacuuuuguuuuauuaaggucuuggccuccuacaagauucuggacuuuguguuguggcugacaagcugaacuucauacgcuaccucucccauuuccgcugcgugcacagaggggcugauuuugccaagaugaggaccaccacaguacgcaggcugcugccagaguccuggggcuuccuuugucccgugcauaccccagacggggagcccuguggccugaugaaccaccuaacugccguaugugagguugucacacaguuuguguauacggcaucuauuccagcuuuacugugcaacuuggguauguaguguacagugauaaacaucuuguuugguuauguggguuuuuuuguguucuuuuuguuuguuuguuuugagauggaguguugcuaugucgcccaggcuggagugcaguggcgcgaucuuggcucacugcaagcucugccuccuagguucacgccauucuccugccucagccucccgaguagcuggaacuacaggcgcccgccaccacacccggcuaauuuuuuguauuuuuaguagagacaggguuucaccguguuagccaggauggucucgaucuccugaccucgugaugugccugccucggccucccaaagugcugggauuacaguugugagccaccgcgcccggccaagguuacgugguuuuuaaccuguuaaguugugcugcuuuuggagauucagcagagauuuucuguaagaauucuuuuuuacucuucugugcaggaguugggcugcuuucuuggcuccucuguagaaggccgaaugcauucuuugaaagugaaaacaggagaaacuaaguguuauagguacuuuguuuucuuugggaaaaaaaaaaagauaauggaagugaggaucgcuugagcccagggauuugaggcugcagugagcugugauugugccgcugcugcacuuuagacugggugagaaagugagauccuaucuccaaaaugaaaaauaaaugaauaagaaugaugccaaagcauucgaaauagacuagucauuaauauuggaaguauagaagcuauugaguaguuuuuugggucauuucuuuuugcaucucuuggcggaucuuugcauuucuaaauagaaaacaguguugguuugcaggaggacaguuuaaaaggagguuucccagucuacccugauaucaucagauauauaaccuuuuuuccugauaaccuuaaagcugcugucucugucucugcuuggcuugauacuugguuugaauuuacuuucauaccuaaagaugucagccuucucugcagucuucuagucccaggguucuccauuuaugauuuggagacagaaauguucugucuuugguggucuguggacaggguccucagugggauuaauaugugugcaguaaaacuuccaguucauggggaucagaugauaaguguucucaggcaacuagaagggcauugacucaagaaaguucugcuuaaaaguacuucucccaauuagaguggccuggccgggcgugguggcccaugccuguaaucccagcacuuugggaagccgaggugugcagaugacuugcggucaggaguuuaagaccaaccuggccaacauggugaaaccccaucucuacuaaauauacacacacaaaaaaauuagcugggugugguggcaugugccuguggucccagcuacucaggaagcugaggcaguagaaucacuugaauccaggagguggagguugcagggaaccaagauugcaccacugcacuccagccugggugacagagugagacuccaucuaaaaaaaaaaaagagagagagaguggccuguaagaagagggcccuacagaaaguaaucaagaaauacucaagauucagaagauguaaucagcguaauuugaagguuuauccucuacgaggaaaagaauuuuguuacucgugauucaaaaugucaaaguccaggagaggguagaaaggagaaaagagaaaguggagagguagaaaguauauccaacugcagaaaaagagauggggaaggguuuuuugcucuagcacuggagaagaagacggaaucgcuaccuaacuuucgauagagauguucauauuguggugacagaugaaacacgaggcagguaacuucugacacucuaacaaacacuugaugucuucagaauguauuuaugguucauggaagaguguucuuuuuuuuuuuuacuuaauuucaguugauucucauuauuuguaguacucaucuuuaaaguuaccagugaauauugaaccauugugccuaggggaaauacaggguaagguuccuucaagccucggguuacaacauuuuuguuagccgaucaauauguagccuuguuuuuuguguguuucuguugaaagacacccuuuaaaaauauauauuguucacgugguaacauugaauucucagccaacagcaguguaauuauaggcuuaucuaacacacauguuuuucuguuaggcacaucacaccuuuuugcauuuaugaacacuaggcagcacuucagugcugcacucggaggcaauuuguuuuuucuguuuguuuguuuguuuguuuguuuuguagagauggggucuugcuauguuauccaggcuggucucgaacuccuggccucaagcauuccuucugccuuggccucccaaagugcugggauugcaggugugagccaccaugcgaagccuggaagcuguuauuuaaacagcuuccaacaaaaaaucacaccaacaaaaagcacaaaaaugcugaaaacgugccagugaacagacugggcaaggggcacuuguuuauaguaugagcugacaagaaggcauggcaucgucuuguuugacuucagcugcggggagcaucugcaucgggggacucaaaguuuuuugcugcauguucugaaaugacuuugaaagcauccccaguauuaauuuugugguuacagagauaauguagcaaguaggcaaaugugcacauaaugaggauuaacuguaauuacauuuuggggguuaaugcauuuaaugcauuuagguggcuuagaaauaaaaauauuaagacauacagugaaaugcucccucccauaggccccuguccccuugcuacuucuuuccuguguguccuugcugaagcaauuuaaacuuccacaagcaauacaaaagccuucaggcuuaccccggagauauugcagguuugguuccagagcgcugcaauaaagugagccacaugaauuucucgguuucccacagugcauaugaaaguuauguuuacacuaugcuguaaauauuucaauuuuaagaauacuuuauugcuaaaaaauauuaaaucaucugacccuucaguaaguuguaaucuuuuugcugguggaaggucuugccucaguguugcuggcugcugacugaucugggcggugguugcugaagguuaggauggcuugugacaauuucuuuuuuuucuuuuuuuuuuuuuuuuugcgacggaguuucgcucuugcccaggcuggagugcaguggcgcgaucucggcucaccgcaaccuccaccucccagguucaagugauucuccugccucagccuugcgaguagccgggaccacaggcaugcaccaucaugcccggauaauuuuuuuuguauuuuuaguagcgacgggguuuuuccauguuggucagguuggugucgaacucucgaccucaggugaucugccugccucggccucccaaagugcugggauuacaggugugagugacugcacccggccagcuugugacaauuucuuucuuuuuuuuuuuucuuuuuuuuuuugaaauggagucuugcucugucacccaggcuggagugcaguggcgugaucucggcucacuguaagcucugccucccggguucacgccauucuccugccucagccucccgaguagcugggacuacaggcgcccgccaccacgcccggcuaauuuuuuuguauuuuuuauagagacgggguuucaccguguuagccaggauggucucgaucuccugaccucgugaucugcccgccucugccucccaaagugcugggauuacaggcgugagccaccacgccuggccugugacaauuucuuaaaauaaaacaaguuugcgacaccaauugcaucuuccuuucacaaaagauuucucuguagcaugugaugcuguuugauagcauuuuacccacagaggagauuauuuccaaguugcagucaguccccucaaacccugccgcuguuuuaucaacuaaguuuaugaaauaaucuaaauccuuuauugucauuucaacaauguuuacagcaucuucucauuucuugagaucccaucucaagaaaccauuucugcugggcacaguggcuuaggccuguaauuccagcacuuugggaggccaaggcgagaggauugcuugagcccaggaguucgagaccagccuaggcaacacagggagacccugucucuacaaaaaaaaaauuuaaaaauuagccaagcaugauggcacgcaccugucagcuacucgggaggcugaggugggaggacugcuugaaucugggagguugagguugcagugagccaugaucaugccacugcacugcagccugagcgacagagcaagacccugucucaaaaauaaaacaaacccauuuuuuuugcucauccucuaagaagcaauuccucauccauucagucugauuaugggauugcagcaauucacucauagcuucaggcucuacuucuaauucuaguggucuugcuauuucuaccacaucuacaaguccaguaguaacaucagagaucacuaaucacagaucaccauaacagauauaauaauaauaauauuugaaauauugcaagaauuaccaaaaugccagcacagagacacaaagggaacacuugucguuggaaaaauggcauugauaagccugcuugaaauaucugaagugcaguuaaaagaaauaaugccuguaccuguuuuagagacaaggauaauuugauaucugaacugauacagcagcuguugaccccaucuggagggaaucuggaauguuggaugaagcauucugaugugauugugcuguuuguuuccuuuaccaggggucacucccauugauggagcuccccaccgaucauacagugagugcuacccuguccugcuggacggugucaugguuggcuggguggauaaggaucuugcuccaggcaucgcagauucucuucgucauuuuaaggugggcuugaggcuuugugaauuguccuaucccuugaccuuagguuuuucaguuccuuucuaguuuugggguuaaccccugggcggucuagagugaucaaguggucagggggucacaauguccagaaugccugugcauucccucuggugacagaggcuugccuuauacuggccucauugguuggggucagugacagauauuugacccauauacauucuuuggcaguuucauugaggcaccucagucugcuuaucuaacuaauuuuaacuuuuuucccccuucuuaauacuaguggcauagaagggaucucaaaauacagauauuucaguaauauucaaaauaugcaagguagaaguuauaccccauugccuccuagguuuugaaaauauauuuuuaaaaaguagaaugacauucuuugaauaacuuaccuuugggauuuccuccuagugaagaguauuuguugcuuugauaauggccauugaaagaauuauccuuuggcaacaggcuguuugugguuuauauucuguucuguguuuuuauuuuuaaaaaauguuuaaacuaaauuuuaguuuucguuuaagugcuguuucggacacuuggguuguuucuaccuuuuggucauugcaaauaaugcugcuaugaacaugaguguacaaauaucuauuuaaguccuugugcuuuuaauucuuuaauucuuauauuccuauaaguggaauuguggcucauuugauauaauuuuacacuuagagcaaagauguuuaaucaguacaugggaccccccuguauacacauuacccaaauccaccaguugcuaugcuuugcccuacauccuuuaucuucuguauacucaauuuuuuucuuuugaaccauuugagagcaguauugagacauugucucauuuuccauaaagauuuuaguguacuuuuucuaagaacaaggacuuucucuucaauaaccacaguacauuuaugaaaaucagagaaggucaugugggugggauccauaguugauacucagauuccaccagcugucucaguaaugcucucuuuuuuuucuuuucuuuucuuuuuuuuuuuagagagacgggucucacucuguugcccaggcuggggugcaguggcacaaucacagcucacugcagccuuagugucccaggcuuaagugauccucccaccucagcuugccaagcagccugaccacaggacuguaccacugugcccggcuacccugacccaguccuuuggguuguuauggaggcuuuauuacauaggaugacugauggaaucauuggccacuggggauuagcuuaaccuccagccccuauccccuuccuggagguugagggugggggugaaagucccaauccucuaauccuggcuuggucuuucuggugaccagccccauccugaagccaccuagaugcugccaaccaccagucuuuuauuuuuauuuuuuugagucagagucuugugccucagccuccugaguagcugagacuacagguguguaccaccacgcccggcuaauuuuuuuuauuuuuaguagaggugggguuucaccauuugggucagucuggucuccugaccuuaacugauccacccgccuuggccucccgaagugcugggaaucacagcucuccuguaauuuagguuuauguuuugcuuccucaugaugagauucaagauauuucaggaagcacaugacguugguuuguccuguuacgacucauguuaacugaucccuucaaaguuguguucuuuagguuaauucacuguacaguuucuguuuuucucuguaauaaguaacuuguggagagauaguugaaagcuauguggagcccucuuucuucauauuuucacccacuaguugauggauuauuagcugaauuacuauuccauuggugguucuuugcugaguuaauauuacugugaugguuaccacaugguguuuucccccaccagcauuuuuucuauguuuauuaguugcuauucuguaagggagggcuuucuuuucuauuaguuguucauuuauuuauguuagcguagauuuauagaugcuuguuuaauuuugugaauauucuguuacuacuuauuuugaugcucagaaaguguaugagauuugaucuaguguacaguugaggguuuuaaguacauucauguuguggagucaucaccaucuucagaacuuucucaucaucacaaauugaaacucuguaaccauuaaacaaucauuccucuuuuuuuuuuuuuuugaggcagagucucgcucugucgcccaggcugcagugcaguggugugaucuuggcucacugcagccuccgccucccauguucaagcaauucuccugccucggucucccaaguagcugggauuacaggugcacaccaccaugccuggguaauuuuuauauuuuuaguagagaugggguuucuccauguugccccggcuggucucgaacuccugaccucaaaugagcuaccugccucauuagucucagauuuuaucuuuuuuauagagaauuuauuuucauucucuuuuuuuugguuagcauuguggagcaucggaggaugaggacacuuaagaucugcucucuuaguaaauuucaagcaugcaauauaguauucuuaacuauagucacaugcuguacaugagaucuccagaaacuuaauuuuguugcauaacugaagcuuuauacucuuugaccaacaucuccccgugucccccuccaccaaacauucucucauuuuuaaugauaaugcaucuagcugugaauccccaugaguucugacacauggguuuguuguuguuguuguuguuguuguuguuuucagguuucuguaauuuagguuuuuauuucuccuuucacccaggaguuuguuggaguuuuuuuguuuuguuuuugagacagggucacucugucacccaggcuggagugcaguggcaugaucauggcucacugcagccucaaccuccugggcucaagugauccucccaccucagccucccgauuagcugggacuacaggcacguaccaccacacucagguaauuuuuuaauuuuuguagagacgggguuucaucauguugcccaggcuggucuugaaccucugggcucaagugauccacccacuuuggccuccuaaagugcugggauuacagguauaagccacccccggcccacccaugaguuuuugguuuauuaaauuuacaaauaaaaccaguaaucuacuguauuuuagaucacagaggacagaauuuccuuuaguguaucgacacgugcauucauggugugcuuuauccuuagccucaguaguuagugauuugccuacuagcuggggugagcacccaaggaaguagggcuuuuaccauggcugaguguggaugagugguauuccauggggcauaagacuggcagcgacagccauggccuugggacagguuuguuaaacucuguuuuuguuaaaaacagguguugagagagaaaagaauuccucccuggauggaagugguccuuauacccaugacaggaaaaccaagucuguacccaggauuguuccuuuuuaccacuccuuguagacugguacggccugugcagaacuuagcauugggcaaagaagagcuaauuggaacuauggaacagguaaauacauaugugugauggaugaguguaugugcuuguuuguauaguauacaacuuucagagacuuaacucuuccuuuuuuaaaaggguuguuaauguuacaacaacaguuggacauuugaaagaaagucagacuuuccaccuccucuaugaucagcacagagcaauuuccaugucugaucucacuccacagaaccugagagagggcugguggucacauuaccugccucccaucuuaucuagcucccagaacuccuuuguaccuggcucugccucagccgugaagugaaaacauuccauuagauucacacucagucuuugccuacauauuuacaguugcaaaauuauaggcuuugugcuacuuaaaaauuuuucuuccuauuccccuucacaauuggucugggguaguuuuagagugagauacguaaagcaagugguauuucuaacuggucgcuucccugugcuucccaguugaucccuucagcacucaugaugcuggguggggaugguuuucucuugagucuuugaguacugaacucugagaaaugguaagaguaaauguguaaccaguugcaguuauuuugugccuuggacaucugcucuuccagaucuucaugaaugucgcuaucuuugaggaugaaguuuuugcuggaguuaccacacaccaggaacucuuuccacacagccugcugagugugauugccaacuucaucccuuucucugaucacaaccagaguccacggaacauguaccaaugccagauggguaaggaagagggaugauguuacagucacaaucaggaaaguaaacuugauacuagcacacucuuuuauuguccuuauuuacauaugcugaccauuuguuccaaaaauacaguuuauggcaaguuuuucuuuuuucugugccacaagcaaccagcccaggaucacucauuguauuuaguuggcaugucuauuuaguuuccuguaauuuaugacagaucuuuaaacauucuuugucuuugacauugacauuuuugaagaaaaagguauagaauguccauagauuugggugugccugaggucuuauuauuugauuuuuugaagaauacaagcaauuauagucacccgcauauuuaucacuuccaguccucuucauuccugcugcaagauucaaguuuucauuguauacaauuuuccuucagccugauaaucuuccuuuagcauuuuuuuauagugcagguugcuggccacaaauucucuuuguuuucauuuaucugaaaaugucuuuauuuugcuucacuugaaggaaucuuucacuggauauacaauucugaguugacaguuauuuuucuuccaacacuuaaaaguuguuguuacacugucucuucuuagucucugucauuucuaguuagaaggcagcagucuucugaauauaguguguuucuuuuuuuuuuuuuuugagacagagucucgcucugucgccuaggcuggagugcaguggugugaucucggcuuacugcaaccucugucuccuggguucaagugauucuccugcuucagccuuccaaguagcugggucuacagggacucaccaccacacccagcuaauuuuuguauuuuuaguagagacgggguuucaccauguuggcaaggcuggucucgaacuccugaccucaggugaccugcccacuuuggccucccaaagugcuguauuacaggcgugagccacugcgcccggccucaaauuuuguuuuuuuucaguuuaauuaaauugcuaaacucuucugucauuauuuuuaaaaacauugcuccuauccuuuucucucuuuccuccucuucuaucaguuauucauauauuuaaaccuuuugauauuguuccauaagacauugaguuucuguucucuuuuuucuuuauuuucuucagauuggaucuuuuuuuuuuuuucccgagauggagucucacuuuguugcccagacuggagugcagugguacaaucucggcucacugcaaccucugccucccauguucaauaaauucuccugccucagccuccugaggagcugggauuacaggcacacaccaccaugcccagcuaauuuuuguguuuuaguagagauacgguuucaccauguuggccuggcuggucucaaacuccugaccugaagugaucugccugccucagccucccaaaaugcugggguuacaggugugagccacugcaccuggcccagauuggauuauuuuuauugaccuauuaucacagucacuuuuuauucugucuucuacugaauuuuugcuuacagucaugugcccuuaacgacagggauaccuucgaagaagugagucauaugugauuuugucguagugugaacaucauagagugaacuuacacaaaccuagauggcagagacuacuacacaccuaguauaugguauagccuguugcuccuaggcuacaaaccuggguggcauguaacuguacuguguacugucuacaguuguaagacaauggcaaggauuuguguagcuaaacauagaaaagguacaguaaaaauaugggaucaccauaguauauaugccauccugcauugacuaaaacauuguuaugcagugcaugccuguauuuuucaaguccagcacuucuacuuguuucuuuuuuuuuucuuuuuuuuuuuuuugagacaggguaucgcucugucacccaggcuggagugcaguggcacgaucuuggcucacugcaaccucugccuccccaguucaagcaauuuuccugccucuaccuccugaguagcugagauuacaggcaugugccaccaugcccagcuaauuuuuuguauuuuuaguagaggcaggguuuuaucauguuggccaggcuggucucaaacuccugaccucaaaugaucugccugccucagccucccaaagugcugggauuacaggcaugagccauugcgccuggccugacuuguuucuuuuuuuauaguuucuuucuucucuaagauuucuuaucuucauucauugugggcauguuuuccuuuauauuuugaacauaguuuuauaugauggguguuguaaaaucauuaucugcagauuccaaugucugggucaucuuaguaucagucucuuugaguauaagucaaguuucaccauuucuuuguaugcccaguaauaucggauuguauuaugaacauugcgaggaguauguuuuaaacccuggauccuguuaggguccucugaagaggauugguuuuguuuguuuuuagugugguguuuggccuucaauuacauuuuaauuuuuuucauuuuaugucuuuccuucuuaauacacaguccaucaccugguucagugcaugucaccaaaaauucuccaggggaagaggauugguuuuuaguuuucacugguacuuaacuuggugaacguggcaguugaaguacauucuucagccuuaggugggcugcugugaucugucccaugcaugcauaguucaggaguccaccaaagauucggacccaauuuauaugcugaauuuaagggucucccuuugugguucucucauuucugaaauguucccccuucccaauuguugucaugcucagaacucuauuucuugguucuucaagccaguaagauuguggguuucuaucuaaguuguagcugccacacugggccauaaggcaaaaauaaauacauaaauacuuaaaaaccuggaaauucacccaguguguuccuuuuguccaaguaaaaauucuucucagcuucugacagcuuuugguuacucuccagugcuguauguguaguugggggucugcgucucauacuuauguguugaggguggucuaguaagaguagcccuuuauuacuggaagcucuaagucuauaauuuuuuuaaaaauuucacuuguauguauuuauauuuuaaaaucauuuugucgugaaaugauucucuguacugugagguaguacacagaggaaucucaccccaugcuccacuacuuagaauuaaauacauauuccgcuguaagaaaguaaucuaauuacguaauaauuccuauccccuuuucuuccccgaguagugauagccuguaauuugcguacuuccuuucuguccccuucuaaagcuuuuauuacaucauacauguauccauaaacuaaguauagaauuguuugggguguguugcaaauacacauaaaucguaucauauuaaaugucagucugcacuuucucccacucagcaugguuuuccuggucuggucacguugauacauuuagguuuacuucauuuucacagcuuauguauuagucuaaaguaagcauaacuaccaugacuauuuauuuguucauuuuccucugauggauauuuaguuguuuccaguguugcguaucacaccuauaaucaagaugaaagcagcagaaaaugcuaagauguuuuuucuccauguagguaagcaaacuaugggcuuuccacuucucacuuaucaagaccgaucggauaacaaacuguaucgucuucagacuccucagagucccuuggugagacccuccauguaugauuauuaugacauggauaacuauccaauugggaccaaugccaucguugcugugauuucuuacacuggcuaugauauggaagaugccaugguaaguuuuaccaggaaauguuguuccaaucuuuuuauuuuuuaacuuguuuguuuacugugaaaucacugaaggaauauuuuuguguacccaaguaccuaguauuuggcacgugauguucuauuaaaugauuaguucuuagucuaaguugaaagugggcaagccuugaggaauauccacuaaauauucagauacacguaugucuugcauauuugagugcauauuaugaguaaauuuugaaguuugguuuuggaucuaucuaccuuuuauauuuaaguaugauuagauuuuaagcuauuucugugugccuggguuuuuguuuuucuuguuuuuuguuuguuuguuuuuuguuuuuuauuuuugagacggagucucgcucuguugcccaggcuggagugcaguggcacgaucuuggcucacugcaaccuccaccuucuggguucaagcaguucuccugccucagccucucgaauagcugggacuacaggcacccaucaccaugccuggcuaauuuucguguuuuuaguagagaugggguuucaccauguuggccaggcuggucucgaacuccugaccucaagugauccaccugccuuggccucccaaagugcuggaauuacaggcgugagccaccgugcccagccaugucuggguuuuuguaguuaguaucagugauuuggaaaaugugaggaaaguuaaaaugugaugccaguuauccuaaaccaaguaugauagucccaccuaguuuuauuuugaaaauccucaauuggccucagucuuuuaacgauucuuuuacuucacagauugugaauaaggccucuugggaacgaggcuuugcccauggaagugucuacaagucugaguucauagaccucucugaaaaaauuaaacaaggagauaguagccugguguuuggcaucaaaccuggugacccacgcguucugcagaaguuagaugacgauggauugccguuuauaggagcaaaacugcaguacggagauccguauuacagcuaccucaaccucaacaccggggaaaguuuugugauguacuauaaguaaguuuggguauccaagcuguuuuguuuuuguuuuuguuuuuguuuugagacagggucucagugugucagccgggcuggagugcaguggagugaucucagcucacuacaaccaccaccucccgggcucaagcaauccucucgccucagccuuugaguagcugggacuccaggcauggaccaccaugcccagcuaauuuuuuguauuuuuaguauagacgguuucaccauguugcccagguaggucucgaacuccugggcucaagugauccaccugcuucagccucccaaagugcuaggauuacaggccugagccaccaucccuggccuauuugugcuuuuuuuaaaaacuguauuauccaaacuuugucaucuuucucacauacaauguuagcaauguuuccuagccaaaauguugagcucauaccucuuauuagaaaugucuuauuuuagcuuauuuuacaauauaauuuauuucaauaggcuuucauaauaauuuuucaguugcuuuuguugcuaguuuucuuucagaugaacauaauucuguagugaauaucaccaauagcucuauucauaccaucucuguuuguauuggagaauaaagguaagaaugaguuuugcaggccaggcacaguaguucacaccugcaaucccaacacuuugggagaccaaaacaggaggauuccuuaagcacaggaguucaugaucagucugggcaauguaguggggcccuaucucuacaaaaaaaauuuaaagacuagccaggccuaguggcauauaccuguagucccagcuacucaggaggcugaggugggaggauugcuugaacccggaaagucaaggcugcagugagcuguaauugcaccaccgcacuccagccugggcaacagagugagacccuguaucauaaaaaaaaaaaaaaaaaaaaaaguuuuacaaauauccuuuaugaagcacuaauuauaucaaugaaacuuaucuccauaaguuaaaacaaauagguugaccuuauaugguuuacuuuuuccuaggaguaaagaaaauuguguuguggauaacaucaaagugugcaguaaugacacugggaguggaaaauucaaguguguuugcaucacuaugagagugccucggaacccaacuaucggagauaaauuugccagucgccaugggcagaagggcauuuuaagcagauuguggccggcugaggacaugccuuuuacugagagugggauggucccagacauucuguucaauccccaugguuuuccaucccgcaugaccauugggauguuaauugagaguauggccgggaagucugcagcuuugcauggucucugccaugaugcuacacccuucaucuucucagaggagaacucggccuuagaauacuuuggugagauguuaaaggcugcuggcuacaauuucuauggcaccgagagguuauauaguggcaucagugggcuagaacuggaagcagacaucuucauaggagugguuuauuaucagcgcuuacgccauauggucucagacaaauuucaaguaaggacaacuggagcccgagacagagucaccaaccagccuauugggggaagaaauguccaggguggaauccguuuuggggagauggaacgggaugcgcuuuuagcucaugguacaucuuuucuccuucaugaccgccucuucaacugcucagaucggucgguagcccaugugugugugaaguguggcaguuuacucucuccacuguuggagaagccacccccuucuuggucugccaugcgcaacagaaaauacaacuguacucuguguagucgcagugacacuaucgauacuguuucugugccuuauguuuuucgguauuuuguagcugaacuggcagcuaugaacaucaaagugaaacuggauguuguuuaacuugauguugaccuuuuggauuaagaggacuaucagauuaaagcaaaauguaauuuuaauucaaugaagauaucauuaccagguuacucuugagauuuuucaacgguguuagaacucucaaccaagaccugaaaaccaaguaugcaagguuucugaaucucucugguagauuaacuauugacaaugauuuucuguuaucuuuguucaaaaaguucaugucuucucaaaauaugaaauauugauaaauggaagagcauacggugacaagucuccuuuccaaccccagguucccuacacccugcucucagcaggcagugagugucacacaccuguuaauccaucuugagcaggacaguacuauacaaauagaaugcaagcuguaauguaauuuuauauuuucuuauagccacguugaaguaaaaacaaacagguacaguguuuuuuaccagcuuuauagaaguacaguuguuacauauuuaaugaauacaauuugaugggucugacuauaugcacacaccuuugauaccaucaccacaaucaggguaauaaacauaccugu

SEQ ID NO: 13392 - RNA, 5441 nt, Homo sapiens
cgccgugacagauuaguccuaaagggaacgggguuguuaguucaauuggcuaccggaaaaaaccaggcugggcugggcgccgccaugacaaccgauaccggaaaaggcgggucguuccccccggacagcccuacgccggcaaaggucucgagaugugaguagugagagcgccuaccccauacgugcugccgcuccccuucuuuuacccagugaucuagaccuagucuaggaccucgggaacuaggaccagccucccuccuucuuggagaucugacccucaggauucagcgccuucgcucacgagcuccaacccuccgcaugcccaagccccgcccucuaagcguuuaggccucgcccccucucgcgcugcuuaggacuucgguccagucacucuucacccaaucucugcccccaguaccccagguccggccuucacacugaaauccuaagacuacagacuuauuuagggaccucuaugacuccuacacccauccucagagcuccagguuccucccccuugaucaccaaacuuuaccuuuugaaccuuccagaucugccugggaccccaguccucaccuauaggguccacagacuuguuccuagaccacucugaccuugcccaggauucccagagcaccaaccucauccagggcuuccagacuucacgccccugggaccuugagucccgcaccagggccuuagguuucaucuugaagacucuuuggcuaagacacucuuccccaggaccugagaccccaccucuuggagcucuaaaccucacuuuuagaacccccaaacccauuaagggcucucaagcucucccuggaauucuagaucuuucuucuaaggccccaagucuucugugcaugauccccaggccuacugggggaugccuggauuucaaggccugucuucuaggacccugaaggccuaccuuacauuaaucagacuuuguuuuagaaccuccacucucuccccagaagcuccccuccugcuuuacaagccccagggcugggccucaccucuccacuucuuuggcaccaucucaggauccuucagauucccacaucugcccugaacuccuaguccuacuucagacccagaccagaacucccuuucuuugcggagcaccauagcuuaugccuguaauccuagcacuuugggaggucuaagcagggggaucgcuugagcccagggguucaauaccagccucggcaacauagcaagacccugucucuacaaaacauaaaaaauuagcugggcaugguggcucaugccuguggucccagcuacuuaggagguuggggcaggaagaucacuugaauccaggaguugguggcuacagugagcuaugaucgugccacugcacuccagccugggccacagugagacccugucucuaaaaaauaaaaaaaaaaaaaagaauucccuugcuugccuacugccuggaaugauccucagcccauccugucccacaggcaggcggcccuagaggucaccgcucgcuacuguggccgggagcuggagcaguauggccaguguguggcggccaagccggaauccuggcagcgggacugucacuaccuuaagaugagcauugcccagugcacauccucccagugagugcgggcaaguaugagacaguguggggggugggcaguggggugggaaucucccaggggcugaacugcccuacccccacagcccaaucauccgccagauccgccaggccugugcucagccuuuugaggccuucgaggagugucuucgacagaacgaggcagcugugggcaacugugcagagcauaugcgccgcuuccugcagugcgcugagcaggugcagccgccacgcucaccugcaacuguggagguaagaggggcucaccucaguucaucucuuuucuccauaacauccccuucauccuucugguuguucaggguaaagacuuuggagucauccucagccccaccccaucaccacacaggccuuugccaugcauccagaauccagaacaucaucacuucuugccccauauagccccugcuuuaauccaccaccacccucacccuccaccuccaggauaccugccccagccuucucccuggucucccuuccucccucuuuucuugccuccauaaagcggccugggugagcauguaaggacugaaaucuggucucaucacaccuaugcuuaaagcucuccaguggcuuugugucacauugagaacaaaaguccagguccuugcuggguucucuguguucuucccuaggcugacuucaucugccuccugccucacccucucucuucuuucucacuacuccucaucugcaacugcagaggggcugggcugggguggccaaaaaaaggucacucuuuuaaauguaucuaauauguaaaccagauauacaguauaucugugauauguaaguuucaugguugggcaauuagaacaaaagucuaaaaugacuccuugaggagaggcaguaacggaaaaagguugaaaaaugcucuuuuagauguuuacuacccuccucacuggacugugagcuccaaaggugaaagucacaucuuuccccagccccugugaguacccucuccuggggcccucucucugccccugcagcccuggcuucucucuugggccaccuggccauccuucuccugggccccaugcuccaucuugacuuuccagucauucuuggugaucauccuagacugaucucagaggaaaucugaccauguucugcuucuacuuacaaaccuuuccaugguucucaauuccaccagcccaagucuuaaugccagcacagcccacagggcccugugggaugcagucccugcgacccguggucccaccucuccucucuuucccccuuaagcucuauguuccagccccagugaacaugcaguuacucaagugcacgucuccgcugcuuuuguccagcuguuucccucugcugggacugcccuuccuaauccaucuccuggcuaauuccuauuccagcuuagacggcacgucucucagaaaaccucccugaugucccacccacuucccgccccugucuucaaguucccaaggucccugagccccuccaucaaggcucacauccuaugccugugucaagggagcucuuggcugaagauuggggugaugcccuucuuaccaggcccuauaggcauuaauuguuucuguaaggcaaggauaagugaauaguucagaccccuagggcagaaacuacgaccccugagagccggaaggaacuuaauucuccucaggaaacguuaccuaacgaucacauacuguucucagucagcugcuggggacauuucugucuuucaaguuuuuugggcaucugaacaguaaagaccccauccuccuaucuuagagccauuugcugcuucccucccuggaccagcaaccagccucucucuggucuccuuguggccaccccugcccugacagucuucucuucccuggcagccaaagaagcuuuuaaaaaugggaauuagggccgggugcgguggcacaugccuguaaucccagcacuuggggaggccgagguggguggaucaccugaggucaggaguuugagaccagccuggccaacauggugaaaccccaucucuacuaaaaauacaaauauuagccaggugugguggcagguaccuguaaucccagcuacuugggaggcugaggcaggagaauugcuugaacccaggaggcagagguugcagugagccaagauugcaccauugcacucuagccugggcgauagagcgagacucugucuuccaaaaaaaaaaaaaaaagggaauuaggucacaucuccucaucauccccuccuuccuggggauggcaucccaguuacaguuuuuccuuccuagcuaggggcagugagauuuguugucuggucuacacaauagcgaacacaaacauucucaucuccugcagcauggcauacagacuuuacagaauguccuguguuuuuguggcugacaaucaaagugguacaugucccucccauuccgcacacaccucugcucuuuacccugauuaaauuuucuucaucgaauuucuuggauguugacauauuuauuguccgucucucccugcuugagucagagaguuuugccugcuggguacacggcaggugcucaguaaauauagcagaauggcgcguucccugccucccaugacacuucaccacagcugacuuuuucacauggcucagggccaaggucauugcccaacacccuucucccuccagacugugggcucugcagggucucccucuguggugucuacauaggcuccccaggcugggcacagaggaggugcuacuagauguugauguacuuucuccacaggcacagccacuuccugccuccugaggacuccucugacggcaggaaaacuggacaugaaugacugcccccacgccccuccccugcagaguggccagauggaguccugagcccuggacaugggcccggcuuuccuggauaucaggacuuccaauaaauaaagacucuguauacugggcuuugauuccugccauccguaccugagaggguccuaggagagcuggcugggcagagucaucuguuccccagcuucaccgggugugccaaggaagugccugggaagaacaggacucugcagcugugccccaggguugagacuacccugccucccuugugaacucugccacacagccauuuccugacuucugcugcaugugccugggguaaagacccucaaucccuuccacucuagcauuccccaaauuguuauuuuuuuuuaauauauauauuuuuuauuuuauuuuuauuuuuauuuuuuuuugagacagagucucgcugucgcccagguuggagugcaguggcacgaucucggcucacuguaggcuccgccccccgggguucgugccauucuccugccucagccucccuaguagcugggacuacaggcgcccgccaccucgccuggcuaauuuuuuuuuuuuuuuuuuuuaguagagacaggguuucaccguguuagccaggauggucucgaucuccugaccucgugaucugcccaccucggccucccaaauugcugggauuacaggcgugagccaccacgcgcagccuauauauauauuuuaaagacaacgucuugcucuguugcccaggcuggaguacaguggugcgauaauagcuuacugcagccucgaacuccugggcuccagugauccucugccucagccuccacaguagcuagcacuaccguaagcacuugacacagugccuggcugcauucuccaaaucuguuuucaguuuucuggaggcuuggggggugauaaauaauaugcgucuuucccugcugaauucagaaucaacugggcaacagaggcauuaggcaauggagaugaaaauacuggcuuuauuauugaaaac

SEQ ID NO: 13393 - RNA, 8840 nt, Homo sapiens
uuuuucuuuuaauaaggguuuuuacucaaaaguguagcuuugaaaaucucuagcuuguugugaaaaccaggaaagccaaggagcugccucacacugcacaccaccacgugaagcugugggccgcuguguguuugcaaacucuccauuaccaaggcuggaaucaaaugcaccacuuuaaaaucagagccaacauuuaaaauuaggaggaugaugcauguccuacuuugauucaaggagaaaggacaaguucuuaguacaguaaaacaaaacacaaaaguaaacaaaucuuuagaaaucacuauauauauguguguuuauauauauauuuuuauauaauuaggauuaucaucauuucaaacuauuaaaaauaagguugccaccuuaccuuuucuuuugguaaugggguguuauuuuuuuuaagagaaaaaaccaaacauuuugcccagacucuagaguuucccaacuucaauucuguuuucugcugugcaacuuccccaccuucacgcuguauccccaagucccgccaccaauucuggcuggcaggaggcagagcaagcuuucauucuggucaucaagaugacaggcccacaaaaguacagcugagacgggaacugaauucuuccccaggaagaaaauaccuauacccacaauaggucugcaaaaucucccacaggcaccucuucucccuuucuugugguuguuuguuaauugguuuguuuugccuaaaagcaagauggcaaucuuaaucaaaaagggaagcuagauuuuuaaaauaacuuaaaaaaaccauuuuuauauaaagcagcaaaaacauaucuuccucucugcagaaagaaaaauguuaacaaggaaacacagcgaugugaacggacuguccgucaacuccugcuccacuggaucccccauccagcuucaccucgagcuacuccuuaacuccagcagugcugucugaagaagauccuuuggcgucuucaacugcucuuuuacuuucuugauugagacuuucauuuucggaccuggucccauuagggauagaguuuucaccguuuacaagcccguuuucuguggccuuugcuuugcugauugccucucugauguucaaggcauccugcacuccagccuccuccucgagguuucucaagaccagggggagccucgagucccccacgcugcucuccaacagcccaagguuacucucuucauauuugggaagcggagccuuuuccuccaucuguuggcgauaguauucccgguugacagcugcacucuuuacugcuuuuuccaaaaucucuuucucaccuaagcgcaauuugauggccauuuuugcacgaacagaaagaucgugguuuuucaagacggauuuaucuuccuggaaaacaagagcaaaauuaauuacaagaagucuaaaccagcaaaacuauagagacagagggcacaacggcuggggauggggacaugagggaacuuuuuggggugacgggagguucuaacacuugacugggcagguggucgcaugaccagacacucacaucaaaacguacgcuucagaaguaugccuuucauuguauguaaauuauaccucaauggaaauguuacaaaacaagaaagaacagccuaaaucaaacagugcuaccccaucugccagggaacuucacugauuuaaaaaucauccugucuaucuugggcacugauguagccccagggcagcacgugggugaauggcaucagugaaggaacgaauaaaugagaaagauguauuugaaguuaguggcucaguagugaacuuaaaaagcacaaaugaaaacauguuugugaaaucacgugaauuauaaauuauaaaaaaguauugaauaaucuuaaaaauguaucuucuaauaaacaaugccuaaauaugauuuuuugggaaaugaauggaaaauuucaaaugcaaucauuuugcuaaacuauuacaguaguuuagaauuaacaagaaaucuuucauuaaauuuuuuuuuuuuuuuuuuuuuuuuuuugagacggagucuugcucugucacccaggcuggagugcagugucgagaucucagcucacugcaaccuccgccuccuggguucaagcgauucuccugccucagccuccugaguagcugggauuacagaccacacccagcuaauuucuguauuuuuaguagagacgggguuucaccauguuggccaggcuggucuugaauuucugaccucgugauccgccccgccucgaccucccaaagugcugggauuacaggcgugagccaccgcaccaagccucauuaaacaucuuaacaacacaacaaguucaaaaccucauuuauuuaguguaauuaccucaauaguuguuuuauauguuuuuaaaagaagugaggcucuaucuucaagaaauguccaaaguuugaccucguugucccagcuaacaggaaauuccgaguuccccaaggugaagauucuaucaauagcgcugucucccagcaaguguucuuucaguucuucuacaagaaauacaaauggcaaucuguuaggaggaaaacauagcacuccucauuugaacaagcaaucuaccuuagaaaauauuguuuccaacaacgccauuuucccacgguaaaagcugucccuacgcaaugggccaggccacuccuagacucuccaaaguagagcagagcuaaguuuuggggagcaacaccaggucaggccucuccauguggaauccugaucaagccuugguagcacuccaguuuucacuguuucuaugagggacacugagagccuuuagacaguuucacaagauacuuuuuaaagacaaucuacagccauguacccccuuauuuugacaauaccccuuuugcuagccaugagcuccaucacaccaagucaaaaaagacauuuaggugaacgauguaaacggugaaaggaacaagagccacaacaaucccgcaagcccauaacuguaaaucugauuggcacuuauucuaguagaugaccugaccaagcuauuuaagccacguucguaacaagccacaaacugaaagaaauaagagccuaaaucaaacagugcuaccauaaggagcacuaucaaaaucuuaguuaaugggccgggcgcaguggcucacgccuguaaucccagcacuuugggaagccaaggcagguggaucacuugagcccaggcguuugagaccaaccugggcaauguggcgaaaccccaucucuacaaaaaauacaaaauuagccagguaugguggcacaugccuguagucccagcuacucaagaggcugaggugcauggaugacuugaacccaggagguggagacugcagugagcugugaucgcaccacugcacuccagccugggcaaccaagugagacccugucucaaaaaaaaaaaaaaaaaauucucaguuaaugaaaaauaugcccaucucucucacuugucaggaauuuaaauaggaauuacaaauacacacaagugaacaucucaauuaucuccaaauauauuuaagaagaggaaagaauucagcaacugcucuuagcauuuuaucucccggcacauuaucuccaaaaccaaaacaagccgauccuauucaugcugaagaaacagacccaugcuucuuaugugauuaggagacagugucucuuucagagcaaaaugccccacagcugucacuauuuacgauucaaacugaagaacugcggcugccagcaaaccaaacuuuuauuaguauuaguuagaguaauucaaagauacagcaauugucuugacaugacaaauugucuaugacuagagaggaacuaaagagaaucaacagaccuaaaaggauucaagcaguuuuaagaaaacaagcuaucuaauguucaaaaaaguuuauuaacuuuuauuuguuaguaaagaucaugauaaaauucaggauuuuuaguuuugagucauuuuauauucuuugcauacaacauggacguucuguuuuuuuaagcuuucuuaguggcugaaaguucuuuucaaaggcccccaguaugaagguuacuguuuccuucccucaucuccuuccucaaucugcccaaguugcacucugcaaugauggaagcugcaggugugcggcagagcuuucucuccgcuacuuuuuaaaagugaaacuggacucauuucacauuucuggagaaauaaagccuacaaaaaggggaguaagacaauguagcauguggccugccugcaggccaggagcuccugcagcaggugcccuccugagcuuuccuccagcaaacagggccugcaaauuaucccugcaccucauucuggccaccacagugugugcucaccccggaggguacagagcccagugcccuccacccucucucccuagcuccugcucaagcuccucccuaugcuaaaggucuucagucauaccccuccccuccugcucuaccuuguccaaacagucgcugagcuccacaguuuaacuugaaugccauuuccuccagaccccuagagcacuaagacuuuuuuccauguacuauguuaucugugaaccagcaggagcaaugugggauguccugcacgugggcucuggaguuaacagagguggguucuaagucagggucaucacuugcuuacugagcaaccucggccaaguuacuuauccucuuuggguuuuuuguuaguuuguucguuuguuuguuuguuuuagacagggucuugcucuguuggccaggcuagggugcaguagcaagaucacggcucacugcagccucaaccucccaggcucaaucaauccuccaacuucccaaagugcugggauuacaggcaugagccacagcauccagccaacuuuauacucuucccccacuccccacccaccugggucucacucugucacccaggcugggguuggcuuacuguagccuucaccucccaggcucaaacaauccuccuaccucagccucccgaguagcugggacuagaggcacgugcuaccacgcccagcuaauacuuacccucuuugaaguggaaucuacaucaguaaaaugggagcacuucccaaucaaggcugaugggauuaaaacugagcauguaccaaauguagcaucaugccuggcgcacagugaaugcuucacaaauucaaggaauaucaucaccaucaccucucuuaauuauaaaugccuugaguacaugaacugcaacauucaauucuguauccauauauaugcaagaaaagcucacaguuaaccccuuaacucguguucauuacauugaauugaugaaccauuacccaaguacaaaaagcaccaaaagcucccacuugaauaaccguaaaucuagcgacaggguugcuuaugaggaacaaugacuguaucucaguuuggguucugcgguuggugugugaacugccucuccuguuucgggacuagguuuuuucugccuccagcaugacgucaaacccuggacuugugcugcacugcucccuggauccagacauuaaaaccaaagccagugaccgccgagcacagcagcuucccccacaugggccaugacugcuuccuccgaccaaggaagugcuugggcagcuuccuuccagaacacuuguucgucuguucacucacucaaacacucauuuacucauuccuacucagacuguucuguacaggauuuaagguaguuaacaacagcaaaacauacacacacacacacacacacacacacucucucucucucucucucucucucucucucucuuucucucucuuaaaaaugaaaccucagggccaggaaauuuguaagauacauuuuaggaugaaaaauaaaaacacaaccacgagaggucaaaucucagcauaagaaaccccaaaugacuuguuuuaagcuaauauaaaaguagaugcucaauacaaauacuuaacucuuucugggcaugaaauaagaggcuguagccaggaacauuuuguguucuacacagauucuguuugcaauguuauuuacucuaacaggaugcuuggcauuaaaaugcuugcuggcaauuucagauuuagaaugcagaguagguuaacaaauaaaguccuacgguccacguaugccacagcugacuacacaacaucacagcaucaacugauccugaacugcucuauguaagugaaaaagacuagugccccgugagugaaaugaggcucugucaggcuacaaauguagaauuuugauauauuuacccuauccaagauguuuuaaguuuucuucaaaugcaguugagaauuauuugcguauuacaaauuaauacugacaacacaucgaggauuuaauaaaacauuucuaggguaaaacaaaucuauuucuucuuucuccaguauuguaucuucucucuucccaaaaguacuguaguuuuaauccacuuuaccuuuaaucugaaucccuaugcuuuacacuuucaugauuuaaaaagaaaaaagucaacaucucuuuuuuccugaaaugacuuaccuucagucauacagaauacucggagaaaagccaaaagcugagcagagaugggcggcucgguaaaaugcaaugcaaaaacacuggaacugauaaaagcagaaagcaagaucagucacccugcugcgguuacccacuugcuccaaacugagauuccuuaagucuacagcacgugugguuguccucaaggagagcugagcuggaaugggucauuccagcuccucaucucaacugugagcacgauuuucagccccugcaaaaggccgcaggcuggggcggaggcaagcggacauccagaauuggagaccauccucacaagcuuuuccuagagccuaacagcuguaaucucagguugcacauaauacauucaaaaauuaaacauacacaugguuuuuaaaaaguguuaacaauaauuuauguugaguucacacuuuaaucauuaaucaaauauugacaaguucaauaaaaaaaaggucugcauaauccauuuucauuaagaaugguuccucuauucccuggagaacuaaugaauccuaauuccugucuucuuuaucauuuuaugccucaaaugcaagaaaaucuuaaagaacuuaacuagaaauucuugaaaucacugaggaucaugacuucauuacagaaacuaaugguagcaacgaauuaaaugaaacaaauugauccaggccauuaaccuuuucaaggugaaagacaugaaugauacgaaaguaguuauuuaacuuaaugaggauuucaggccauaucccccagaacugacugugaaugcgcccaacgacacaauuauguuuaccugaaaacgcugguaagccaccaagcgucgccauggcuuaaauuugcugugccacggggauaaacggauuaagacaaacuacuggagagaaguuuuauuaacacaccaauuaaacacuaugcaacuggaaauaguucaaguacugcaagaaagggccaaccgauguuuuucuacguacguggggaugccggcacgagccaagaccucggccuucauggcguagagucugucacuuuuacucacuccaagcuuuauuuucacucugucgugugaguuauugucaaagaaaaaaccacuguggaucacaaacucugcguuggaucgagugccauaaaaaauguaaaucugagaugcaguaaagaaaaaagaaaagggcauuagacaaacuuggcauguauucuuaacacagggcagggcagaggcuuagugcuacuuuacauuuagacacuaaauagcugaaaguauugauacaccuguuugguauagguugcaagggugaagcugugcaauuuucccaacuuuccaaacugucugagaccaagcacccacuuccaccaccguguggagaggagaggggaggccaggagaaaguaccaccaaaggccuuacuaguacucaaaggaccccaggugaccuggggucaccaggccucuauuauaaaccucuucuccuuccaaaggacagcaaggcuauuacuauaagacuguauuuuaaaauucaccaaguucuuccuguccuuuuaauacagcagggucucuucuggaacuguaaagcaguaucugucagaaacuuauuucuagauccucuggcaauuaauccugcaccuggcagguggguuuauaaacuuuucugaagaaggaacagaucaguacuuugcuaggcaaguauuuuucauuuugucucaacuggaaugucaauuauggaugugaguuccaugacuguacugucugcuuggguguagacugauagaauguaggaauuuauagacacguauuuucaaacucacccaaaggcuuaccccuccucccacccaaacuacuagauuaaaaaaucagagauuaaaaugaaaguauaagacaacagauucccuugcuuuugccccuuaaauacucuuauaaaguucuaaucaguagaaaaaauaaaggcaacaguuuaugaaauguuaaacauuguuuagugucauaacacacuuuauuuucaguuaagaguguuacaaauauuuacaaauauuaggccaauugugcaacuaacuguguuuaaaucuuuuucucuguggacccaaagcacaaugcaaagcacaagugaguaaagcacaagugaauauguguacuacggguucuggucucaagauguguuccagaaaaacaauccucaaugugaauuccacauuuuuuccccuaaguuaaguuccuuuuuaagauuaccaacacgguguuaacguuagugcccacuggcuggcucacauuuugugagaugccacgagacccaccugcucuccagcccgaaaauccugcagagccacacacucacagcggucaucuuccagguuguaaccaguagugaucuagcc

SEQ ID NO: 13394 - RNA, 1992 nt, Homo sapiens
aagggccguucccgcgcgcgccgcccggggaccgccaaaaaggcccgcgggcgggcagacgggcggaguggaggcggccagcggcgaagagagaagccagccgcgccgcccacggcguccgccuccagcgccacggcguccgcgcccggccccggggagaagaaagagccuuuacgaggcggcgccacuacucaccagggaaaagggagggcggagcgggagacgaggagaucgaggcgacagcggcuggagccacgggcacacggcccgggucggcggcaccggggacagcucagcgggacucacgaccuucccaggaagcagccgcggggguuucagcggccgagaagaagaaccacgcagagagcgccggcagccaucacuccagcggagcaccccgccggccccuacuuauagcccgcgcagcgacccgcgugaccccgccgcgccucgcgccggccccgaagccccgcccccggcaugacgcagcccuccucggcccggcgugcccagccgggugagcccgacgguggcgcucauuggcccggcccgcuucggcggccacgcccccagcggggagccgguccacguggggcgggacagcccccucccugcggccucgcccuggagucucggcaccgucuggccccgccggcugauuacagccagagaucgagggggaccucgcugucccccuagaggccgucaugcgggguuacagaggcugcgaccaaagucauuccuagcuccucucucggggcuccggaaagccguccgcgccuccagccgcacuuucagcgcacgcaggaccugccgcgcccgguggccacacccgucccucugccgggugacgcugcgggagaucuugcgcccuggggcuccggauccaguucuggcacguuguugcaccugugacuuguccuuggccuggcacugucccucgccugggggaagcgggggggugggggggggaugcucacguggucgcuuugcucccgcagucaugcacuugggugaaaacagacugaagagucacgggaaccagcuugucuccccaguuauggcgcagagcugcaaggauggcugugggucauuaauuucuccguggcugaccuguguuuguaacgccgcagcuguugcgagggggaaggacacugcuucggauucaaauucugacuccuugcugcagugugucaccuugagccagucccagaucucugcguucucacaauuguaaaauguuaacagaggcugccuaccuuguggcuggaauuaaaugaauuaacgugugugaaugugacuagaauucaguacauguucaggaaaagcugauuuccgcuuugcuguuaccgugaauauuacuguuuuaggguguagaaaaggguggaaggggauguuauugcauccuggaagcuuauccuuuugagguaaagauugauuucugguccccugcgugguauauaguguaguuuugacauuauuuagauguguuaugcacauuuggguguugauuauauggcuuacgaucaagacuaaccagucaugccgugggagauuaaggucguggucucuugucaggauuguagugagauuuaaaaauuccagccagaaauaccaggcuuagaaugcucugaagcccuccccacauuuuugccaucucuagcaggagggcacugcauagcagaaacaaagacguuguaaauuguugcugccugagucauuuauagaggcuuaaacaaccugaauguccucugaccuaccuguaacauuugauggaguuguaugaguaacuuacaaagcuguaggucccaaggucggucugaaaaagaaaguucauauccgggagcacugaccccguaguguaauccuggcaccuuaaaacguacugcucccuccaccuucacuucaagguuaugaaaacauugaguaaaagggaugaucuguucaaaguccuuaguguucugccaauuuaaaacaguaauuuucaaagca

SEQ ID NO: 13395 - RNA, 17930 nt, Homo sapiens
caaauuuucuaaaaacuguaggcuuuuuuauucaguuaagagguagacaaaugaacauggaaggcugucccacuuaacuugcccaaaguucacauuccacuucauucauccaucccacacugccagaaaucuuaaagaaauaaccaagauugccaacaggcuuuuucuuucuuacuucuucuuagcaauaacagucaauaaacugcuugcaaaaaaguuacuaauuuaaauuuucacuguguucaaagaaccucaucccucuaagaagcucccgaauaugccaauagauccugccacuacugacaggagggcagaguaccaaggacucuacuuauauaagagacuacaagggaaguuguaguuauauuuuuguuguuaaaucccugugcaugugagggcagaagcuggugaaaccaacaacgcagagcaugcucugucaaacggcucuucaugguuuaaaaaaaagaaaaaaaaaucacaagucaucuucagagacaacauuaaaacauaauggaauugaagccugauacaaaaaguagagaaauauguacaggaauucacagcccagaaggaaaggggaccucagcaggagccaguggaacccgggcuauuuuacacagcuaauuuugagacaauucauauuuagcacaaaagcaguuauagcacaaguaacacuucccuccucuggcucccaaauaaaaagacucuugucagucuucuguuaacacuguaaucauucuucaggggagcaggaauaccuaagauggucccaaacauugacacaaauuuuaaucucaaacagcuucacauucugaggaugacauaucugaagauugccaugauggcagcacugauaacuccagaaauggggacugugacaaaccaggccauaaaaauguuacgaaagagacgccagucaacagccuucuuggaccggagccagccaacagacacaacagagcccaccuagaagagaagcagaccaaggaaacagguuauugaagugccagugguauucuggcaaacagacaccugagacuguuuggacaaggagccccagaccccuggacaagacaaaguccaagaaagcugguuuacaacagguuaagcugggaaaaugaaggcaauuugaaaauccaaucauaaucuauacuaacgguaguaaaaggacacaagaacuauuucuuuuccccuucucagcuacugcuaaaauuuaaugaauauauacugcuuuuauuuauuuauuuuuugagacggagucucgcacugucgcccaggcuggaguacaguggcgcaaucuuggcucacugcaaccuccaccuccugguuucaugugauucuccugccucagccucccaagugcugggauuacaggcacccaccaccacgccuagcuaauuuuuuguauuuuuaguagagaugggguuucacuauguuggccaggcuggucucaaacuccugaccuugugauccaccugccuuggccucccaaagugcugggauuacaggcaugagccacugcaccuggccuauacacugcuuuuaauaacaaauugcauuguaagucuuccuaagauuauuuacagaguggcugauauuaaaccuaauaaacaauugucuggagacacauccggguagcaaacagaugacucagcaggauccaugauggaccagcuuaaaugcucuuaaggaaaccaguuucuuccuucuccuauaauuauuagauugucaucaaacaaccuuaagauuuguuuuguuucucaguauuucaauccugagaggcccugaaauaugccuucuguaaauaaacugcuuugccaacauuuuggcaagccucacagacuuguuagaaccaggccuucagccaccacaaauggcagcagaaacccaccuggccagaauuaaagcaccugccaguuucuaagcauacaccuacccugcucugaauggcuuccccaaaggcaaagaacauaaugcugucggccgggcgcgguggcucacgcauguaauccuagcacuuugggaggccgagccagguggaucaccugagguuaggaguucaugaccagcuuggccaacauggugaaauccugugucuacuaaaaauacaaaaauuagccaggcaugguggcgggugccuauaaucccagcuacuugagaggcugaagcacaagaaucacuugagcccaggaggcggagguugcaaugagccgagauugugccacugaacuccagcccaggugacacagcaagacuccaacucauacauaaauaaauaaaacauaauggugccaaguagaaaugacucuugagauuaaaaaaaaaauuauuauaaagagacuacaaugagggaggauaaaguaacaaaggaagagguuaguagccagaaacuacaguaagcuguauauaaaacaauguuucuauuauuuggggagaauaucuauuuaauugcuuaaauaagaauaaacacaagaaauaacuuaugaacucuucaagacuccaacugcacaaaacuuucuaaaucaaaguaucagagaaguaaaacuaaaaacccuacauauuagaagaaccauuugaaagacacacauuggcauuacacuuacuuuacaauguguuguacugaugggaaggccaauauuugaugcaaucaccacagugagggcagaugccaguucaauacugaagccacuacagacacaaaaggauucuugucaggaagugaguuugacuuuuuugagaagcuaacacuacaccucaaguuaacacaguccugcuuuguucuacucagucacaaaaccuccacugacaucuuuauuugcuauaaccccuaagaucuacuuuauuuaaaucaggccacagaugcccaguuuccuuauucaaaggcuuccaguuuuacguuuuucuggaaucccacuauuaaauaaaauuugcacuuuuauuuugaagaguuugguaaacauugagucuuagcucccaagacaaauaaaaggcaaguauacauaacuauccgcucuuagcauacacagcuuucucagaaaagucauuuucuucagagaccaccagagcuaaauggguaaaaugucugaccaaaauguuuaagggccagacaaguaaaaucuaaaaagaacaaugacaauaagaacaucaugaacuuauacaaacuugguuacuuuagagauuuguguuagcacucgacaguguuauaucucugaaaaaaaugaguacugacauuuguagaaccugcuccaccuacuuaccuagagggugugaucggugucagauccuuccccauggucuggauaacucuucuuccccaaacccacagaccaacacagauaccaacaccaccauagaguagaagccauauugguguugccacuuuugaagaaacaucuccugugucauaaaccaaauauaaagcaaccagaggcccaauggcauugcuggaagaaacaaagagggcagaagugacuuuucaggcagaacuagaucuuggcaagacccaaucugcugaaugaucuaccagguugucuaaaguacagcuuucaagcucaucuggcaaaagggccuuucuuucuaaagacauaaauggaaccccaacauacacaacagaaaaaugaacacagcucugauggagggaaugccaggcaaaugguggccucuuuccuccuauaggcagcuuaaagcaacucucagguuccaauaaacaguuuacaaaccaaacuacaaaaucauucuauaugaaaaacuuuuaaguuuuucaucuuacaucuuacaucccacaauucacuaccaaagaacugaaucucaucuugauggacaaaagccuucucugugaagaguaucuguuuauauuuaucaucuacaaaaauaaacauucuuuguaauuccucugaagaauaaaacuguacugucuuauuaugucaauaacugcuauuaccucauccuauuuguauuauuugggguccuguaaaugcuaggaguaccacuaccacaagcacaggccugugacaaggauaaaugguuuaaaaauaggguuagcaacacuaagaucaaugucaacugaccuuacgucauugccaccaugggcgaaugacccaaagcaggcuguaaggaucugcaggaacuggaagaggagagagacuucaggcuuauccuggucauaccauucuucuagagagccauuacuuccuuuucugucaccuagacccaucucugccuugacacucaugucuaucucagaugcugagugaaggucagacacagcauugcaguaacugguguaacuguccauucgaauucgcuucuuggagucugcauuaggccaugucagcuucuccauuucuucgcccuucuguucaccuucuuuggcacggaaugaauccagaggcaugccacauauugccaugguauaggaaguauagcuauuauugcgccuuaaggguuugucaccggagucucccaugcaaucucccaccuuggcaagauguaauuuauggaguagcucuuuguacaggccggaauccuuaugcacggugugauacugguaguggccacuggaguuuauuugguugcugacggcuugacugaacuggacaagguucccauuaggcaacugcacugcaccuagucaagaucaccaaggugacauucaauacaaaaagcaucaaauccaaaacaauaagccuccucaccacugcagguaacaaaagugaaaccaggaauuccaacucaccauucacggugcuaucuaugcugguuuccucuuucaaguccacgcugggaagccucucucucucuggagcuuccuccaaaucuccaaguuugaaugagacuguucucuccuccaccacagccuggaggggcacaguggcaggcccuaccucagaaacaggaugcuuguuuucaauaucaccaacagacaacuuuguuucuucauggucuucuuucaagcuauucuuuuuuuccauuaaggggcuuucagaaggacuacacuuuauuucuccuaggaaaaaaaaggggggucuuuuuugguuugguuguggccauacuacuuuguuccacgucuccuuuccuccacccccaaaaaacucaucucaaaacaagaauguaugugaacuucaauuaacauucaggaacauuuuuccugccugcuuuaucauuugccagcaacucucacuugggaacaaccagcaaugcagaacacccuaugucaggggucccaaaauuuuucuguaaauauuuuagguuuuacgggcuucuguagcacauuguuguuuuguuuuuauuuuuacaacccuuuacagauauaagaacccuucuuagcucccugcugacucauucuguaggggaaaguagcucaaccauggggcugauaagcugaaacuaaaaaucugaacuguacccaauucuauucuuuucaaaagaggauucucucaaauuucaguccaccaauucaagcaaaguggcacagcucaaugcagggaacuaaagacgacaacuuuaauuuccaccucuauaaaacaaagagaugugcaucauggcuguaaaucccacaggcagaccagaguaucuucugccucucucaugccagugcucaguaugcugaccuauccauccaggcaccucagucaaacuacagacugacuaacauaaagcaagacuugucucaacuccucccagagagggaaaaugaggccagagaguccugaaagccugguucccaccgugcacucggcacagccagacuagcacagaaccucucggaggcucuucgguucagcugcggugacgcagcguucuuccuaacaccacugcagucuaugcaucccucagcuucgaaacgauaaacuucaacuugcuaacccagccuucacaucgaugaaaagggcagaaaaugauuauuuuaaggaaaaaaaaguccgauacuaaccaaaauuuacucaguauuuaauuacaugagugugugguaauggccuaaaugauuccuugacacuugaaaauguuuacuucuagaaucugugcuacaauucuagcagacacacaauguguguuuguauauguauuugcauuguauacugcaauacaaugucuacauguauucuagccuauauacaacauguacacauuagacuuagcuuugcuugucugaaucugaaguuauacacagaagcaguugggguaaauauuuccucuacgaaaauaucuuguaucuaccccuuauuuuucauuaagguauccuucuacuucucaguaaauguaggcuaugauuucucuauuuaucuaucaugucacuggcaacugaucaaggaacauaaaaaaauucaaugccccagauugucucuacagcauagguugaauacucuuuaucacuaggucuuaggucauguaaguccauuuuuaagaacaggucuuaggucauguaaguccauuucuaaaaacaguuuggacaacaaacccauauccucaaauuucccuuuaaaaucucuuauuuugccaaucucuucuaauagauuuuuacagguggccaaauaaaaaauaaacacaacauuaguaguuaaacuuuucugcuguuuaguuauuacuuacguucaauuuuucucuucauccugggacauacaaagaaccagacgauaagggcacagaaaacugcacaucccaccgagaugaggaugguaccccacagaggaaguuugucaaagcccagcacuaggagauaaaauggugcaucuugaaaaccccagggcaacagcccccugcaauauuguguaaacccuccucuggggacugagggguuccccauaccagcccaucaccccugacagcugcugccagauuuaagugcacaggauuacugugcuagugccuauacaaauuugggagaaaaacucaaugaucaucugaaaacccacaccagccuagcccacuugaacaccugcgggacucaaguuccuaugcuucucaacauacgagccuuuuccuuucuucaccuuggaagauaauaaagaucacuacacgcuaaggaccuaugacuagcuaugaaaaagacagcaaguguuccacucuccuagcucaugaucguaacugccacauauuccauuaccaccuacaaacuuauuuuaauguuaacagaaugaugucucaguagucacauuugucaugcugacacaauucuguguaaaagugauuacauucacuauacuggccuuuaguaaaaugcuuuaaugagauuaucuccuugaaagcaguaucaaagcaagauacagaaaacaaggauauuaucuaucaaaaguugauaauuuaagaauaguuguaaaagcuuugucuuucagccaggcacgguggcucaugccuguaaucccagcacuuugggaggccguggcaggcagaucacuugaggucaggaguucgagaccagccugcccaacauggcaaaaccccaucucuacuaaaaauacaaaaaaaaauuagccgggcaugguggugggcgccuguagucccagcuacucgggaggcugaggugggagaaucacuugaaccuggcagggcggagguugcagugagcugagauugcgccacugcacuccagccugggugacaaagucagacuuugucucaaaaaaaaaaaaaaaaaaaaaaaaaguuuugucuuucucacacacaaaguuuagugguaauuucacuuacaagucuuaccuuaaaaaaagacuugccuagcaacacuguucacaugguuuaagaaugaguaauauuagucauuaucugacugucauaugcacgccaguaggcuccaaaccauuagccuguacuaaagacagaaguaaagcacuggccaggcacaguggcucacaccuguaaucccagcacuuugggaggcugagacagguggagcaccugaggucacgaguucaagaccagccuggccaacauggugaaaccccgucuccacugaaaauuaaaaaaaucagcuggaugugguggugggcuucuauaaucccagcuacuugggaggcugaggcaggagaaucacuugaacccaggaggucgagguugcagugagccaagaucgugccacugcacuccagccagccugggugacaagagcgaaacuccgucacaaaaacaaacgaaaagaaguaaagcacuauacaauccuauuuaaaucuaacagauguuauaaugaucucuagcuacucaggagacugaagugugagaacacccugagcccaggaauacaaggccagccugggcaacacagcaagaccccaucccugaaaaacaaaaaagguaaaaaaaaaaaaaaaaaacccauaaaagauauuauaaugaucuguaguugauaucuaggaauagcuuaguuacuucugcuuguuuugcuuuauuuugcuuguuauguacgaaaucacagaugcuccucaacuuacaaugagguuauguaccuauaaacccaucaaaaagucaaauaacugaagguugaaccaugaagucagggacuguuuguacuuauaaacuggaaauucuaucauaccccaaaaugauuaaucuuuaaaaaucagacacaaggccagacgcggcagcucacgccuguaaucccagcacuuugggaggcugagguccguggaucaccugagguugggaguucaagaccagacugaccaacacggugaaaccacguaucuacuaaaaauacaaaaauuagcugggcguggugaugcacauguguaaucccagcuacucgggaggcugaagcaggagaaucgcucaaacccgggagguagugguugcagucacccaaguucgcaccacugcacuccaaccugagugacagggcgagacucugucucaaaaaaaaaaaaaaaaaaaaaauuagaaacaaauugaggucccuucaaaacuaaaacuuuuuuuguuuuugaacuuuuuuuuuuuuuuuuugagacagcaucgcacucugucgcccaggcuggaguacaguggcacgaucuuggcucacugcaaccuccgccuaccaggcucaagugauucuccugccucagccuccgaaguagcugggauuacaggcgccugccacugcaccugguuaguuuuucuaguuuuuaguagagaugagguuucaccaacuuggccaggcuggucuugaacuccugaccucaugauccacccaccucggccucccaaagugcugggauuacaagcaugagccaccgcgcccggccccaaacuacaauucuauggugacuauguaucuuuucauuuuaaauucugcuuucaauuuugaucauguggucacacaaacuaaaauauacaugaaauuacugucuaucacaauuuaaguuggucuacauuccaagucaaaaaggaaagagacugguuuuucuuacaaaugauccauaaaggacacaacgaaaauaucuaaguuucuguuuuuaaaaugauucuaauuucacucaucucugagcuuugcuucuaccacauaaagaaugaguguuaagagcaucaugggagacuuuuuaguuuaucacaaagaacuguuuacaauggaaaucuggcauacaaacuucucuucaccggcacauagcaguucaguauagucuaaguaagaacaauauuuucuuaaaguugucuguuucguuccugauuauuccaagaauuaauuagcaagauuaaaaauacuuagcuccaucuaacaaaauacacauauaaucccucaaucuaaaauaagguaaaaaauuaaaauauuggcgaggugcggugaucaugucuguaaucccagcacuuugggaggcugaggcaggcggaccaccugaggucaggaguuggagaccagccugaccaacauggagaaaccccgucucuacuaaaaauacaaaaucagccgggcuugguggugcacgccuguaaucccaguuacuugggaggcugaagcaggagaauugcuugaacccgggagguagagguuguggugagccaagaucaugccauugcacuccagccugggcaacaagagcaaaacugucucaaaaaaauaaauaaauaauaaaaauauuuagcuaacucuacuuugggucagcaacuuacuacuucagugagguuuaagagcaagucacaacccauuacucaaaacugaaaucauuucagugggccacaacaaauguuaagaaaaaaaaaaagagagaauuugaaaauaugggugcauagcacauaguaagcauuaaguggcuucaugacacuauuccaguuaucuuucucucuacauacauacauguguguccuguauuucauccagugggucacaguauaaagaauaaaagucacugccuauguagucacagaccaucaggccaaaugagucuagauaccaaaacuguacuguccugccaguuacaaguuaccaaucuuuuguuguugcuaaauuaaacuuguagcgccauaauuuaauccaugccuugccuuagucccaaacaugaaagucaucaacauuucaaccuuuauauucucacaaauuauuuuuccucuuagcugcaugaauuucuucuuccaagugcacuuagagcaggugguaaacaucccaacucuucucauucaagcagauucauggaaguuuaguacuuagaaacaauaguaucuccauuugggagagaaaaaugagaauauccagcaaaccaguccuaaaugacugauuacugaagaucagauauaacuaaugacuucaguaguugaggucaguauuaauuccagcauuuuuagcauagacaggagaaagggaaggagaugaucauauuaucaguggauccugugaagacuaaagaggaaaggucuguagugauuuagaaucugagcaggucucuuugguugaaaaacuaucuagguuaacucagcguacacuagccugcagccuucugaaaugggcgcaggccagccaccuucuaggagauuucagcccuguaaagcaaaaagggguaaauugggcauuuaaugcaaguuuuguaaacaacuuuaaauucacauuuaaauauuuugauagguacuuacacggugcuccaguauacaugauggaaaagagguuuauuccaacugugcaggcauagaaaacuggcaaagcucgcaaaccauuaggaacuggaucugccuguaaaacaucauuaagaucaauaucuuaaaagguauaaagguuaacccauuuccacagaaucuuuuaacaggguagguuugggaauuauagugccaauaacucucuccagaguaguuuccaaggacaacagaguuuuuccugcauuugcaucuggaauucuuccuacgaaggcuaauuccaacuucuaccuguuuuuuuuucuuuuuucuuuuaauaacaagacuaacuguaccagugacugauaacauccugaauaaagauugcaauacccacauucuaagguacccaaaagcccuaauauaaacuucagcacacaccugaggauaggcuauacucuacguuuguaagagaugucaagaaauagacuauguuaggauguugcuuaccugacuucauaucuucaaagacuaaaaauacaacaugcagacuaugcguacgccaaccaucuuaucuaaacaucugacaaagaugccacaauuaaugcuuuaccgaaguucaaugauaauaacugauugugcacaaggucauccacucacucaaaagacugugugccaagugcuauucugggcaccgaaauauaggagggaauaagaccaaguuccuguucuaauagaacugacacucaccuucuaguauggaauaauguaaaguacugacaaaugcugugaagagaaauaaagaaggguaagaggagagugauggaagggggggcaccauuuggguggggagggucaaggaauaagcaugacauaaauguaguaagcuagcaagcuguguacauuaacuauggguacagaaggggcaaaccaccugauuauuugggcgcugaauguuccagacagagauaucagcaaaugcaaaggcccuaaggcaaaaacuugaaauguuuaaggaacaguaaggccagugacuaaaaauaagaauucuaccauaccuaguauguauuaauucuauaggagaacacccaagucaaacaccgaaagaaugggaggaggcugggcgcgguggcucacaccuguaaucccagcacuuugggaggccgaggcaggacaaucaugaggucaggagaucgagaccauccuggguaauacggugaaacccugucucuacuaaaaauaccaaaaaaauuagcccggaugugguggcaagcaucuguagucccagcuacucuggaggcugacucaggagaaucacuugaaccugggagacagagguugcagucaguggagacugggccaccucacuccagccugggcaacagaguaagacuccaucucagaaaaaaaaaaaaauugggagcaaagaucugaauacauauaugggaaggcuaaaaacuuuauaaagaccuuagccuaaaagguuuaauguuaucuugaucacaauuccaguggaaaaucuuggggaggaaaaacagaaaguaaaacccuacagcuuccaacaauaaucaauacacuggaaaguuaguagcuuaagaccagugaaacaagggaaagcucagacccauguguaaaguaaagguaccauuucaaauuagcagagaugagcacucauugaaaaccacucuaaaauuuaacucuuaucuauaguuuaauagagaauguuaacagauagugaaauagccaaaacaaaaacaauagcauacagaaaucaagaacuguuaagcauccuugaauaacuaacucaacgguggucaaacucugagggcagucaacaagauuaggaaacuaagguguguauuuuuauucuaaagacuagucuuaagaaaaugcaggucagguguggugguggcucaugucugucuguaauccuagcacuuugggaggaugaggcaggggauggcuugagcccagaaguucaagaccaacuuaagcaacagagcaagacuccaccucuauaaaauauaaaaaguuagccagaugugguggcacacacccauagucccagcuacucuggaggcugaggcaggaggaucacuugagccugggaggucaaggcugcagugagcuacaauuaagucaccguacuccagccugggugacaggcgagacuucgcuuaagaaaaaaaaaaagccaggugcaguggcucaagccuguaaucccagcacuuugggaggccaagacggacagagcaccugaggucaggaguucaagaccagcuugaccaacguggugaaaccccgucucuaccaaaaauacaaaaauacuagccgggugugguggcgccuguaaucccagcuacucaggaggcugaggcaggagaauugcuugagcccgagaggcggagguugcaguaagcccagaucgugccacugcauuccagccugggcaacagagugagacuccgucucaaaaaaaaaaaaaaaaggcuccaaaaaacccaacccaagacucccacccccaaaaauuuccuggguuuuaaagacauuauguggggacuucucaauagauuuucaaagauauuucguaauaugauuauccauaaaucaaauuguaauugacuagucugaaguagcagccuguguauuuauuauccuguauagcauagcccaauuaaguauucccugagguaaacaaaucugagguauucucuacgcaaaguuguuggggaugggguaggguaugaaugacacuacuauaccaauaguuuauugugaaauacagguucaugguuaaaaaaaaaucaaaaguuccagagagucuaggaagaagguaaaacaagaaaggucucaucauuguagagauccaccuaacacacaaguaaaacuucaccuggaaauaaugugaaugccucaucgucuagucaugugggacaggaaaggucuucacaaaaccccccaucuucaccagaauaguucacuuuuacauauuggauauucugguuuugucuaaagaaaagggaagacauccuaaauauauuucuaacuaaugagaaugccaaaagcccuauuuucuuugacuagaauuuaaaaauacucaacaggagcacugaagcauauuccuucugugcgaugccaguccuaaauagaaguaccucaccuccauucugucuguucccaccuauccccaacaugcuuggaacaaacauucagagaauagaaaauguuuaaaagcaauuuuuugaaauuaaaaaaaaaggucauguuaaucuuaauuuucaagauagacauuuaagaguuggaauauaucuuaauggucaaauauucagauuuuagcaguuaagauaccaaaagcuuaccagucuaaggauauuuucuugaaauuuaacuccuaaaaggaagcagaaauauucauacucaacugaaaacuccuguuacugagggauuggccugcaagagugugugugugcacgugcacagagugggggaagauccucaaagucaauauuguuuuaaacacuaugccaaucauucuucaucauuugaucaugcccauucccauacccauauaggaaauauacaauuaagaaaucaguuaccguaucuaacuucagcccucaauaacaccguggggguaugcauuccucaaaugagagguucugggcaccugagaaucccucuuugcaccucagagcaccaccauuccccuuccggggaauaaguguuuuguggaggugaaacacacaaacccucuccaaaaacaaaaugaucugcuacucaauaaucaacacagggccagcauaaaccuuuaccaagcaggaauucacaacaggagauccuacuaaugcuucugacucucugcuaaguagcaagauauacaguucuaaugaaaacucuaaaaaaaacaaaaaaaucugguccaugacuacuggugagccucuaauuuaagcaucccaguaucauacacuacaguuguagggagugggaagguagaugcuuaucguaccugucugcugaauaaaacaguaccaaacuuaggaguccauaaauaucaaugaacuguuuacucucauauuauaccaggcuaaagauauuucaaguuuucaaaguguuaaacugcuauauucugccagauucuggcuauggaaaacagugauuagugaaucacuuuacuagucauagaauuucuacagagaagagacaaaucuuucccuagagaagcuuacaacuagaccagacaagugggucugaauacauucuuaccugcugggauuuaugcuaucucccucagauuucuacaguuuaggaacacuuuuaagaacuuacaauggauuguuaagagccauucaccuuagaaaaaggacaacuuuguuuccugagaaaaaugcauuuauccucacuguaacucaguccuaugccaacauaaucccuugucaacauuuauuuugcagccagcaagacuucuugauaaaagaaaugcaaacugggucacuuaaaagggauuuucaaauggacaggaaauuaaauggcugccugaaguuuuuuuggggggcgggccaaaaacuaccuuuaacugguucuuuucaacuauucugagaaauuggagucaagucacuaugggaggcagaguccucaucuagaagcuuauaaacugguuaugauaaucagcacggcagagacccauuuaacuggcagcuuaguuaaaaaagccacaggggacacugucuugaacuccaaguuuacguauuauauuagccugaauauaacagugguuuaaacaaauaauguguauacagcuacacaaaaccacgcaaaauaaauuuccuuauuuuuuugcucccaguuucuccuacuucuuggcacaucauaguauucaauuuuuccuuccugacugcccucuugaguauuaaaaacucgcuuucagagaacuccacaacauacaagaaaugcacagaacaaagagcuuuuuaaaauuuuccaaggccgcauaccuauacaccaaucacaucugcaaaaguaccacuggguuugaaaucgauugggugugcuccaugaaaggucuucauacgggggagaaagguuaccuuauggaggaugaaugcacgaaccaggaagaauaaaauuccagacauaauuccagaaagcaguggggacacgaaccaagacaucacuggaauagaacacauuaagaaaaaauaucaaauaaugaaaaucagaaaccaaaaaccacuuuaaauguuuaagaguucaaaauucuugggucugucccucgacguuagaacacauccucccauaccuaaugccaugguaacauaugacgaaaacgaaaauuaagaagccguuuggaauuaaacauaccaauuuuuaucaguucagaccacuugacacccuccugccccuuugccacgagggagaaaccaauaguugcaccaacaauacaauggguuccagaaauagggagcuucaaaaacgaagccacgaguugccacacagcagaaccugaaacauaguaaaguuuuauuaaguaaauaucaaaauuccauuauguaaguggcacauucagaaagguuaaucggaaagguuaugcacaaaaauggaaccacccaugauacaaauuugcucacccaccacgaagaggacaaaacauaaaaagaacuuaccaaacauagcacugacugagccggccaucagcagcccuugagucgaguuguacaucuccacgucaaucaagcccuuccggaugguuucgcucacuuuggcccccaguaagacagagcccacuguuucaaagaugcuagcuaggaugcaggcuugcuucagggucacuacaccugagcccacagcuguaccaaaagaauuugcuacaucauuggcucccacggagaaugccaagacaaaugcaauaaugaagcccaggaugagcauccauagguaguccaccaaaggaccagaagcggcgguagcagcuguaguacugguaaucagcguugccauucucuggaguagugguuguuuaguaagagaacuacugagcgccuuucaagauguguaaacagaauaugagguaucaaaaaugcuauaauaaauaauauauauuauauaaaauuaaauacuguaaacuacggcacagaaaccgagcuggggaguuacugcuauacgcugcguaugggcaucuguugucugggguuucuuuggcucaggagggcuaaaagcacggagcagaauuccauggcggagaagagaaaggacgcaaguucauccugcgggggaggggggaaauaacaauagcugcgugccccuggggggccaguggggcaccccgcucuacccacgcgcccggggucccgcaauagccucugccggcuacuccagacccccauccccaguaggacgcgcgagaaggagaggcacguggcuccggguccuccgcggcccgcgcgcgcccagcccagccccugcgcugccagcccgcgcgcgcccuccgcgcgaaaaucggaaaagggccguucccgcgcgcgccgcccggggaccgccaaaaaggcccgcgggcgggcagacgggcggaguggaggcggccagcggcgaagagagaagccagccgcgccgcccacggcguccgccuccagcgccacggcguccgcgcccggccccggggagaagaaagagccuuuacgaggcggcgccacuacucaccagggaaaagggagggcggagcgggagacgaggagaucgaggcgacagcggcuggagccacgggcacacggcccgggucggcggcaccggggacagcucagcgggacucacgaccuucccaggaagcagccgcggggguuucagcggccgagaagaagaaccacgcagagagcgccggcagccaucacuccagcggagcaccccgccggccccuacuuauagcccgcgca

SEQ ID NO: 13396 - RNA, 4505 nt, Homo sapiens
caguccagaaggcagauucuaggccuggcaggugggcacccugggugcucccuguuggaucuugaggccuaaccucuagcccagcagagucagcuaaaaucugagcucucccucucccuccaagccacacuuugcaaagggauuccuuguauugugggcuuggagucuuuucuccccauuugccucugcaggaagcccuugcaacaacacaucuggauagccuccaggucccaaggcuggagggacuuguaaugggaaaguagucuuuaaaucagauuuacuuggcacccuguuugccacugaaagaggcaauuuaggggaaaaaucuggucuccaagcacagauaacacucuacucuugaaagaggagaccugcucauguuacuggucucagcgucuccacugaccuguaauaagccaucauuucacuggcgagcucagguacuucugccauggcugcuucagacaccuguguaaaaaggagaaaaugagugacuuccccaugacggcuacguucaugugugauuucucucagcauccagugcauggcagucaugcaaagaaaugaucucugaguaaaugaaugaaugugugaaagagaaguccuuugggucuagagaaaagcauuugcuaaaccaaaccccaacuagcaauguauuggcuaggagagcuggagcagaggcuuugacacuaaccuuuagggugucagcuguuagauaagcaguauccauucccagaauauuucccgagucauaagcauuauauuacaccuggcauuuuugcaaaaagcugagagagggaggcagagagggaaggagagggagagacagagaaagaaagagagagagagagagaauaugcauacacacaaagaggcagagagacagagagacucccuuagcaccuaguuguaaggaagauuaaagucauacuugagcaaugaagauuggcugaagagaaucccagagcagccuguugugccuugugccucgaagagguuugguaucugccaguuucucccucgcuguuuuuauggcuuucaaaagcagaaguaggaggcugagaaauuucucuguugaauaccugauuucacaaucaaguuaaaggaaaggggaaaagaguauugguggaagcuucuuaggggaggggacuaauaaacugagauaauucucugguucauggaagggcaaggaguagcaaacuaugacacauuuugcaaauguaucaccaugcaaauaugcauuguuuuccugacaaucguugugcaguugauguccacauuaaaauacuggauuuucccacguuagaagaauguuuaaauuuaguauaugugggacaaaguggaagacacacagauuuauacaugcacauacuuuucuucauucacuucuuuguacuuaaguuuaggaaucuucccacuuacagauggauaaauggguacaaugaagggccaauagcccucccugucuguauugagggugugggucucuaccuugggugcuguucucugccucaggagcucucugucaauugcaggagccucugaggagaaaauugaccuuucuuggcuggggcagagaacauacgguaugcaggguucaggcuccugacggaguuggggcaacccuggagauaagcucacacaacccugcaagaccaggugcuguuacccuagccaaucucauggaugaaccagaucaaugccagaugagcucugccuaaaaugauuuuuuggugaacucugaaaaguggaauauuguuucuguaagaauauccaucugagacucuaucucuugguaauaccaaccaagaguuaucaguuucucuuuaaccgagacaccagcaaagugccugcuccaggguacugcccaggggagcccuccauuuguagaaugaaugagaguccagguuaugaacagugccuggaguguaggaacacccuccuuugccucuuugacaggucugcaucauaacacuuuuuuuuuuuuuuugagacagagucucacucugucgcccaggcuggagugcaguggcacgaucucggcccccugcaaguuccgccucccggguucacaccauucuccugccucagccuccccagcagcugggacuacaggcaccugccgccacgcccggcuaauuuuuuguauuuuuaguagagacaggguuucaccauguuagccaggauggucucgaucuccugaccuugugaucugcccgccucggccucccaaaguguugggauuacaggcgugagccaccguguccagccuguaacacuucuuauagcacugaguugaaaccuugcuccuccugguuccuccaggaaacugaaaucuuuuugagccaagucuagcacagugccuggcauguacauucaggugguagaguuugcugcuugaaugggugaaugggaauuugacagcauuuuuauucaaauuaguaugugccagguaucgugcucgcucugcauuauccaagggagugagccucugugcaaguauuugagacacgagggaaauagguucuacugugggaaaaagagcauuucauggacuugcucuccaagcagccuucugauuuuuaauuuggcucccaguaucuugauaucaggagucagucacaagaacuccaucuuuaguaaguuauauuuuccacaggaaaucuaaaagcuguucaacauguuaguuuccugugaauuugauaagccauaauccauuccuaacacugagcccuccugaaauuuggugucugguccugcagauagcuaaaagcccugucuggguggccuaggggacuccucuguuuugccuccacaggauccacuuugcaaauuaaccacugguucucccguuguaggaacugccaccuuccucagagccugucuuucuuccuuccuuccuuccuuccucuuucuuuuucuuucucucucucuuucuuucuuuucuuuucuuucuuucuuucuuucuuucuuucuuucuuucuuucuuucuuccuuucuuucucuuucucucuuucucucuuucucuuucuuucuuucuuucucucucccucccucccucucucucuuucuuucuuuuucuuucuuuucucuuuucuuucucucuuucuuucucccucccucucucucuuuuucuuugucucucccucccuucucucucucuuucucuuucucucucucucucuccuagacaggaucuaccuuuaucccccaggcuggagugcagugguacaaucaugcauucauugcaugaucacagcagccucaaacccuuccucagagucuuuaugcggcaaccagcagggucuggaggguugguggcucugugaacucuccugacagaacacagagaugucuuuggucuguugaugugauuacaagcugaacgaaggaggaucaaagccagugacaggaagggagauaugcaagggacccgagcaucagcucugaguuaguccauucugcuucugggacuugggauacaggucagaaaccuugagcuucuacuucuccaucuuccaauuguagcauccaggaccucagaaucugccagcuaagaggagcccuaaugauugucuggugggauauggugggaccacagagaugaagacaugaauagcuauuugaaugugaacagcagacgaagaaaucaaggcuaggaggguggaagugacucauccaauagcacagugugguugaagcagcacuaguauccagguugcaugagccccugaugcuuucgcucgagggaaauuuuggagccauggggcaaugcccccugacguaacagucuccacaguucugccaugucucauccuggcccuguaaccuggacccaaaucugcuaccaucccauccaucucaggaagugaaaccucuuaugucaaauagguugugcaacguauguaucagauccugucuucccaaggagaccgcucaggccacagcacuuccuuccgauccccaaugagcagaaaauaucucgcuauaaacauaguuggcacuaagggagggaguggaagagugaugaugauguagauggugauguagccccaaggaaguggaacaagcagagauggggagcuggaaaugccaggaugcuccagcuuuuggggaauuauucagcucuugagucacuaaagccuuucucagcugcaaguuccucuuuacccugucaggucauucuuccaagacaggagacugacauuuauucaaagcagcaagugcccugauaccaucuugugucuaaucaugggcuucgcagccaguuaucaagguugaucucaucucauuggucuucaaucauuuugaacaagaagacaagcaaaauaaucauggguuaguucuuauauuauuguguguacaugcagugaugucuguucuuuguagugagcuguuccuuccuuguucacccucuugcuuagaacagaacuaagcaaucugcccccaacauuuuccccaauuucccaucucauucuuggcacuggcuuccuaauauuuguucu

SEQ ID NO: 13397 - RNA, 2371 nt, Homo sapiens
ggaccauuagcaaaauuuaaauauggauggaguguauuaaauaaaacaauuguaucauuguuaaaauuccugauuuuugaccacuguacugagauuaugccagauaaugucuuuuuuuuaaggaaacacacacauauauuuaggauaaaggaguuugauguuggaaacucuaaaaugauguaguaaaaaagaauauauacauuauauaugugugugugugaauaucuauauaccguauacugauuuccuuucuuuugggguauauaccauauagauauccacacacaauauguauuuguguguauauauacacauacacgagaggauauggauaugcagcaaaauauaacaauuuguuauucuaguggaaaaguauaugaucuuuacgauucuugaaauuuauguguaaauuugaaauuuaaucacaaaaaaguuaagagguuuucagcgaccaaauacauuauaagaaauggccuguauccagugagcacucuuuagcucauucuuuuucuccaucacacuuaccacuggcaaaaauuauccugugcauuuauuuaauaauacuuaacauugugugcaaggcuguccuaagugcuuuaccuguauaaccucuguggaucuucuuacagguaaggaacaaauacacaagaagguugacuaacuugcccaaggccacccaugugguuugucuccugcaguggcacagaaccucaaccaaggcagaaacugccuugucuauugcucuuuccccagcgacuuggaauggugccuagcacauuacggguguucaauaaacaucuguagauucaguuaacaaacacugggcacccacuaggccuacacuggaauacaaaauacagaacaaaauauucaaaaaucugugccuaaaugggagcuuuggguacuaacagccccacacccaauuagccuccaucuagguauuucauuugggucuaucauuccugggaauuaaagcccauucuauccauuuugcagaggaucauuagauaaacggaugcucagggugggucaaugauuugcacaagaucacugggcugguagaagggaaggucgggauuccaacccagucccugagguucccaggacagagcuaugaaucaaacgaccaagacaaucacccagucaguauuuauuaggcgccuacugcggacgguuggucuucacgcagaucaggcgagaagggauagugaugcgcgggccgcugcggagacccggagcccgccgcggaucacgggaauuucgcgccuauuuuuuguuggcuggguguucucgccagugauugggucccggcaaggcgugccggugcgcucggcugcggcugcuccgucgaccuuugcaggaccgggcggugcagggcucacucggcuggcgucccgggggaugggccaccaggagucuccgcuggcccgggcgccggcgggaggugcagcuuauguaaagagguuauguaaagggcucagcuggcgcgaacacguggaaagccacgggagccuaggagcccaggcuuccccagcgagcgccgcggcagcagaaggauccgcuacacgccgggcucgggccgccaccucccgcgcugcucggucccggaggcagcccgggcccggagcggaccauccccaggcaggggcuccaggggggaaacgggccgcccggaaguggaggugcgcgggccagguaagggcgccguuggaggacugaaggccagcgccgaggcuggaguuacugccacugccuccgcgcuugggaagggaaaucggguccucggccagucgcacuccgagaagccgaacuuuucagccaaucccuucuacccgucgcccucggggacuugggucgguccgcugggcuccgcuagggcuuaauucaauggacuguuuacacccgggcgaacacaaggcggggcgcggggaggagcgucacagagggggccaagcaaagaaaaauauuuccgccggccaaaucgcgucucuaagcgguuuucagaaggcgugaagcuugcuggcucuucuuuuuccuaucgcuacaugacaagcuaacagagagagcggagaguuugugcuuuucuuuccgguucccccucugagcugcugcccagugguucggucuuucccgcuuuccccuccccucccccguucaaucagcggcgguggcuuccgucuuaaaggggccgcggcggccgggggaggaggaggugggacgccccgcggccuacgcuccuggccuccccgccuuggccuggccguuuaaccgauucuuucgcccgcaggucacaauccaagguccggcuccuccgcgucccagggccggacggagggaugaggcagggggggcccgggcagcgccguugcug

SEQ ID NO: 13398 - RNA, 2371 nt, Homo sapiens
cagcaacggcgcugcccgggcccccccugccucaucccuccguccggcccugggacgcggaggagccggaccuuggauugugaccugcgggcgaaagaaucgguuaaacggccaggccaaggcggggaggccaggagcguaggccgcggggcgucccaccuccuccucccccggccgccgcggccccuuuaagacggaagccaccgccgcugauugaacgggggaggggaggggaaagcgggaaagaccgaaccacugggcagcagcucagagggggaaccggaaagaaaagcacaaacucuccgcucucucuguuagcuugucauguagcgauaggaaaaagaagagccagcaagcuucacgccuucugaaaaccgcuuagagacgcgauuuggccggcggaaauauuuuucuuugcuuggcccccucugugacgcuccuccccgcgccccgccuuguguucgcccggguguaaacaguccauugaauuaagcccuagcggagcccagcggaccgacccaaguccccgagggcgacggguagaagggauuggcugaaaaguucggcuucucggagugcgacuggccgaggacccgauuucccuucccaagcgcggaggcaguggcaguaacuccagccucggcgcuggccuucaguccuccaacggcgcccuuaccuggcccgcgcaccuccacuuccgggcggcccguuuccccccuggagccccugccuggggaugguccgcuccgggcccgggcugccuccgggaccgagcagcgcgggagguggcggcccgagcccggcguguagcggauccuucugcugccgcggcgcucgcuggggaagccugggcuccuaggcucccguggcuuuccacguguucgcgccagcugagcccuuuacauaaccucuuuacauaagcugcaccucccgccggcgcccgggccagcggagacuccugguggcccaucccccgggacgccagccgagugagcccugcaccgcccgguccugcaaaggucgacggagcagccgcagccgagcgcaccggcacgccuugccgggacccaaucacuggcgagaacacccagccaacaaaaaauaggcgcgaaauucccgugauccgcggcgggcuccgggucuccgcagcggcccgcgcaucacuaucccuucucgccugaucugcgugaagaccaaccguccgcaguaggcgccuaauaaauacugacugggugauugucuuggucguuugauucauagcucuguccugggaaccucagggacuggguuggaaucccgaccuucccuucuaccagcccagugaucuugugcaaaucauugacccacccugagcauccguuuaucuaaugauccucugcaaaauggauagaaugggcuuuaauucccaggaaugauagacccaaaugaaauaccuagauggaggcuaauuggguguggggcuguuaguacccaaagcucccauuuaggcacagauuuuugaauauuuuguucuguauuuuguauuccaguguaggccuagugggugcccaguguuuguuaacugaaucuacagauguuuauugaacacccguaaugugcuaggcaccauuccaagucgcuggggaaagagcaauagacaaggcaguuucugccuugguugagguucugugccacugcaggagacaaaccacauggguggccuugggcaaguuagucaaccuucuuguguauuuguuccuuaccuguaagaagauccacagagguuauacagguaaagcacuuaggacagccuugcacacaauguuaaguauuauuaaauaaaugcacaggauaauuuuugccagugguaagugugauggagaaaaagaaugagcuaaagagugcucacuggauacaggccauuucuuauaauguauuuggucgcugaaaaccucuuaacuuuuuugugauuaaauuucaaauuuacacauaaauuucaagaaucguaaagaucauauacuuuuccacuagaauaacaaauuguuauauuuugcugcauauccauauccucucguguauguguauauauacacacaaauacauauuguguguggauaucuauaugguauauaccccaaaagaaaggaaaucaguauacgguauauagauauucacacacacacauauauaauguauauauucuuuuuuacuacaucauuuuagaguuuccaacaucaaacuccuuuauccuaaauauauguguguguuuccuuaaaaaaaagacauuaucuggcauaaucucaguacaguggucaaaaaucaggaauuuuaacaaugauacaauuguuuuauuuaauacacuccauccauauuuaaauuuugcuaauggucc

SEQ ID NO: 13399 - RNA, 47188 nt, Homo sapiens
uuuuucaaaucacauauggcuucuuugaccccaucaaauaacuuuauucacacaaacgucccuuaauuuacaaagccucagucauucauacacauuaggggauccacaguguucaaggaacuuaaauauaauguaucauaccaacccaaguaaaccaaguacaaaaaauauucauauaaaguuguucacacguagguccuagauuaccagcuucugugcaaaaaaaggaaaugaagaaaaauagauuuauuaacuaguauuggaaacuaacuuugugccuggcuuaaaaccucccucacgcucgucugucccacacaaauguuuaagaagucacugcaauguacuccccggcucugaugaaaagaagccccuggcacaaaagauuccagugccccugaagaggcucccuuccuccugugggcucuccuagaaaaccagcgggacggccucccugcugauaccgucuauaaccuuagggggcccucgggcaggcaacggcaguggacucaucucggugauggcuguagaugcuaacacuggccaauucaaugccacaccuacugguuacccuuugagggcauuucuccagacagaagccccuugaagccuagguagggcaggaucagagauacacccguguugucucgaaggcugugccacagcccaguacgacagcuuggcagagccaguaucucuggacuucugccuccaaaacccaguggccugaagagcuaaacaaugucagcuuggcucuuccaagguugccagggccgagacucccaggagcuacgucugucugggggcugccagacaggccuaggagggaaaaccagccaaggggagggauagucugagaccaaccuagaguaagugccaccagcgcccccagaugucgggggaagaggggcguaugggcaggauggaaagugggagcugcacuuggugggcagggcuggaaggagccauauggaaccaggcaagggcagaacguuagggucccuccuuaggggguggcagccugacuccugcuuuucuaaguuuccaaaagauaccccaaggcuaaaacccagacauccauccuauuaggaugucuucuaagaagguaaacagcuaacagcauaaaaagaaaauucccacaaugccagcucuuuuccuucucuuagaaaaagauucaagcaaaaauaaucaucuuauugcuccaaacacugguuuucuaggcuaggagacaacugauauguuaaggagcugagaucuuggaggaggggaauguggagguggggaaugugcagggcgaggaggccguagggaaggcggggagugguccuagcaccacaggguugggagcagagggagcggagggcguuugccccugccccgggcaucucugcccucauucgcucuggggccccccggcagugccacuaaggaggccaggcccuguccagagucaaaucuccacucaguguuggguguuucuccucuggcuguaaacaggguguuucuuaaguaaacauuuaguauacucccucagaaaggcagccacaggggcaaacuauguccaggugggaggaaaaaaauucccauucuccugauccaaugccucugggacgagacgaggcuaaggccugcaaccuuaguccccagugcccagagaagguucagacggggccagucucgaaugaacagacugaggcauccuccuggcuagagguaagaggcagagagugugcaccuguccaaagcacaguuuuucuguccugggcuauagcugcgagugagugcccugguggugguggggagaugcggaccuggcuacagcccucaggaagaggguguugggggugagggugaucccucccccguggcucucugggaaugagagagagagugaaagagcaagugacagaggacacagauagggagaaagaagccaugcacuuccagcugagccaggaggccuggccaggggaggacaauggaauaaggcacuacgaucuguccugcugauucuucugacgggaaaaccaaguucagaucccuaacagccgaggucaagagucccccuccaaagggcuauccuugccacagagccgaggagaacaaaugacugccguuugaaguuuugaauacuacuagaacuugggcagguccuacaaacuuggugguguugagacgaugcaccagagagcugcuggcagccugagacccagugaagacgcaggaggggggacgugacagugaguggaagcugguccacaaggggacaguggagaguggcacugaaacuacaggugcuacccggggcugagccacggccaguucucucaccacggcggagcccgcugagugccugaggugggcaaguguuugagaaagcaggggagggguaagaagcaagggcaggcacuuggggcuaaaacgcuggccugcauuuaugcuauggaaagaggucgugccacuaagcaagaacuggaagaugagggggcauggaggcuggcgaccccuaccaggcugcccaccugucaccuacaggggugcuguuucuugcuacucugauagcaagaaaaauaacaaagggggagcacgauggcuccaagaacuuuuuaguuagagcuacuagaccuggggagggaaaaaaaagaaaauaaggggcucauuaggcuggagccucacuagggauguuacagugugggcugcagccagggagaggggggugcuggguuuggggacuguuuuugcccauuugcucauguacagagagacagcugcccccaaggaaaggcaggguggcgggcggaaaaggaaccguguacugcaauuaggggaugcugcuguucccacccucucggauacaacucagugcacucaggaggcugccugagaagucagagacaggagagacaggcagucacaauggguuuuggcuuaggaagggaagggccugguuaucacugugggauccugcuaacagcagccaaccuucugcucacaaggaagaaaguuugguguugaggggggugacagaaggcugaaagaaugugagcaaacauauugcugagccuggccugaugcacuguucucucccaaauucucagggccaaaggauugccgcuuagcagguaaaagccccugcugccuuggucacauagaaacggaaaugcccgccaaccgucuccccuaucaauccuaugcugguuuaggugaaacagaaaacaaaaaugaacacaaaaugauucccuucccccuccccaguggcccuauacuauuuggccauaauggggugaaaagccuucggaguggccaggcgcguccagacagagggacaacacaagagcauugccccuucuugcagggggagaacagaugggcucagagcagcagcccagggggagggaagcuuccccuagggaggugcgagagugucgcuggagagugcaaggauggcugcagcagacaggcauggguggcggggcugaagugucauggcuggggaagccugaagguggcgagcccacaaaugggccccuaacgcugcagggggucuacccaguuccacgacaccucccugcucugggcagguccgcuguuuucccauuggauacgucuauacugagggcaggcaccuaacaguaagucuccaggggugagggaaauggcgcuugacagugugugucacugcauaugacaccauggaccccggcacacagggcacgcccuucacugugagaacacgacaacggcagccaguucaggacacccuguuaucauggcaaagucacaaccagaucuuagggccucaggccgucucugugacaccuggacacuaugggacacaucugggaagaugacaauccaggaggcaguuaggugagaagcgcugaccucacggcagugacagaugccugcugaagacccagcuguguuccacacaagaguuuggcacaacaguuuuucccaacagaaaggcagggauggcugcuccaccgccagcaagagcgagauggucgcccuccacccuuaccuccuaguucccugcaacacagggcagaagaggaauggauucccaccacugcaaguccugguguggccuggggcucucaauagcuuaaacacaacaaagccuggaguugagaccuucuuaguucuccuggccaaacccuggccuuccucuuccaggcgguucuucaccucugaucaucuccgaggcccaagggcuagccagggccagcccaccaaggaguccaggaguuccugcaucugguagggaggcguggcccagaggccuccuuguguccucacgccccguuccagaagaaacccccagauucccuauggggaggcaggccuucucuagggaagugaggugucauaaguagaacugagaaaaguauaaagaaggaagacagagggaaagugaaggacaaaaccaaaaauagcucccuaaccccuuauaaaaaguaaaagugaaauuuacacauaugccuugcccacauugaauuucuuuaaagaaauuggugccuguccacagcauuguguccugcucuucugaagucucaaugguuuaaauuuaaaaaaaggaaagaggaaaaaaaaaaaagaaaagaaaaggaaaaaaauaaagcaaaacuaaaaagaagcggggaaacccaaacaaaagcuucacauugccggauccagcugucgggagaucgccaaccggccaggccaccaccuguacccucugccguccucuggaggagacguggugagacugugggucccgaggaaucgaccuggaagacagaaggcggguaaggaggggacauuggucagcaggccugggcaccagcccucaacccagaggaacacugaagcugugugugcugggggcuguggggcagagcucuaaagagaugggguaaaucuagcuucacaaccucccuggucuuauucacacaugcuuauuuuucagauagggaaacugaggcucagguuaaguaacuuacccaagggcacacugacuaaggggcagacacuagcugggaacccaagcuugcuggcucuagcugucaaaccaaucuugaacccuggcuuccccguacuauuaggagcaagacaccgcagggcccacccuggauagucuguccccacagaccuugccagcacugcuuccacucaugcuuucuuccccacucucugugauuaauugugcuguuuguuagaaacgccacagcaacccucucuagguucaguaauccuguuuuacagaagagaagagugaagcucaggccucugagaauccgaaccaggcuaccugcucaggucuuaacaugggccagaaucccacacccaggggcagggcuggacugggccugcacugucugcugcagugcacuguggggguuaagaacgagggcucuggagccagaacgggcaacugaguaaacaggagcugccccucgacugugggggaauuuaaguccucuguucccuggucucaucaccuguaccugcgucacaggcuauuaugaagauuaaaugaacguaaaaccaagaagagugccugauccuauuaguguuggcuauuauuuggaaacugccuuagugccaggccucaggaauaagacaagaagccugcccuucaguggcuuauucuacuggaggccuagaauacaagggcccacagagauuagucuugggcagcgcccacucugagcuaucggaucagugcuaaguauagcgcuguccugggcagggcgggccaucuagggcaacagugcuccagccucguugcacauggaaucaucuaggagguuuuuugagacagggucuugcucugucacccaggcuggaguacagugccuugaucacagcucacugcaaccuugaacuccugugcucuagugauccucccaccucagccuccugaguagcugugacuacagggcacaugccaccacgccaggcuaauuuuuauauuuuuaguagagacgacguuuugucauguuguccaggcuggucuugaacuccugggcucaagugauccaccuaccuuggcccaucuaggaguuuuuaaagugcccgaaugaccaaagcagacaagucuuucacugugcgugccuuucuuugucaggcagagccagcaccguggcugccaugacuugccaccugugcgggcugacaacaccagcucguuguccucagcuccugggaagggaccuggccaguccucccaagaggcagcaggauaggacaauauuggauaauuuacugucuguuggccucaguuucucccucugagcacuggggacucuugguugaggucuggguggaaugacucagguuccuggcccacagcagggacaaacauacucaaugacucuaccccuuccuggccaacuguccccaaccagagacuauaaacguguuaaaucugaacaggccaugguucucagccacgcaaccacugaaaguguuucuggcuggugagggugccccgcacacugcuggaggaggggauaaggcuucuggaagguagucuggcacuguuuuuagggcuucaaagguguuuagauugguagcucccugaaauucuacuccugaaagccaagcuuaacagauaaaccuaaauaugaaaagaacuuuauggauaaagaaguucacugaaauauaacaacucacaaguccaaaaauaaggauuaaguaagcaaaugauccuucaacgcacugauauacuacagaggaaaugagaucauugcaugacauuuugaagauuaugacaaaagcacuucccugggguagguggaaaaggguagguuacaaaguuguguagcgcacagcaugaccauaacuauguaaaaacacaaaccccucaguguaggaaaaucugacaauaaauacaccaacauguugugcuuguugugacuggauuuuccucuucccucacuucugauuuuuaauaaugaacacacaccaauguuauauuuuaguuuuuaauaggaaaaauaggguacuuuaaugaacaagaaaagcuggcagcuccaauagaaagguccagauguggggucuugucuggacucuuccaugcccaguggacaaaggagagcuuccacacugccaaacgggagguuagacuaugugacucccugcucuacugcccagggagcgggugaccaagaaaguggguguggcugaucuggaaagaaaauacaggauuucucgggcccagucuuucacucugcugcuucuguuccuuggucuguuaauuccccucaaaaaaauccacuugugggucuuguaucccaguuuuugacuuggaaaaagaaaaucaucauaaacauauucccugaugauucagcagccaucucaaacucuagcucuauuuagcaugccuauugcuuucucuccgugcuuuccguagacacagcagaucaaccugaagaugggggaagaggguauuuaggguaggcccucaccaucugagacauuaagaccuugugaaauacgaugagaaauuauacagccacaugugaugugcuaaaauaaucuuugggaccaguuaugacuuuccagcauuccuuuccucccucccugcggacaaucuccugaaaaggaugcccaucagcaggaagguagcauguggcagcugaaaagcaguguuggcaaggaggcagguucagaaaccagagguuccuuuuuacauaauaaacuagcagaacacagugugacuacagaaggucagaccaacagcacagcacucugcaagaacuccugagacaccagcuuguaaugaccgcuguaaucacugggucccaugccaggaagugaagcugacauuucccaaaggcuccucccugcucccucuagcucuggcacuggcucuggcccuccuguuggaagccucagaacagccuacaggucugagucugguucucucuugugggcacaaagaaggaaaauaagagggcucucuacuggggagaggaucuuggcuugggguucuuuucccaucugccaucacagaaagagcauuuuucccagggagcuaacagcacaguaagcucaccgaagguaguggaggcgcuuucuguagcuaugaacaggaauggcucagaccacaugguucugaguuuaagcacagacccucccagguacuugugggcacaauaaaggguguaggucucagccccagugggcccuuggggaggccuuaggcuuguggugcuucauccuagcagaugccacaucucagcucccugacugcucaggcugugccugacugccuggcuaccagcuucuaccggggcucuucucauuccucucuguggaaccccuaccucugaccagagcccgcuccuugagggcaaaaaucacaccugcuaagcauaaugaaaaguggugaugugauaaaccugcaacugacaucuguagugcccuuccaugauuacugugaggagggauuuggccaguuuucacaagaaaacaggcccagagaaauggagcaacuugccccacaccagaguugcugagcaguagaaccagcacuuaauccaaaguuuuccagcuuuacuacccaaagucucugcacuaugauagucuucaaucagugcuuccaaagccggcucagcaaugguuccaguagcuugcaccugagaugaccuuggggguggaaggugucagugaucugggaaaaugugcuaugaauccuuaccuuucucauuucagcucuuggaccaaguucucucagugcaccccaccuucuuauuucucuguaacuggcguaacagcaaucacuuauugagcagucugucugugcaaguucuaacuguguuauaggcaacaaccucguaaagcaacacugcuuuccaaucacuguuaaaggaucgaguguuuuacauccauugccucauuucaccccagcaacccuaagagguagggguuaucgucccccucgucuuagagaugagaaaacugaagcucagagagaacagccucauagacaguaagugguagagaaaaggguuuaacucagggcagucucacuccaaauccccugcuuuugacauguaacgaugcaaaaucccuuccuagagaagacaagaagagucuuaaguggaguuuaaaacccaucuaaucccuucauuuauaaauagacucacucagaaaaaaggcucauggaaggcuuacgugccugugcacaggucuagugcucgggggacaaaaggggacauggugccaaccaggcagugaacggucuuccagcaagcuucucugccagucaggcaggugucuggucuguuuaagaagacugagaaacugaacuacuuucaugaaggccauuagcagcuuggagaacagaagccugggagauaugaggggaacaugcacagcaggauggggcuggagacaaggauggcucacguguucaccuccuuccccuacuccucagccugcaggcacagaauaccuuggugauuaucccuuacucuaaaaggauggccuuccuacuuuauuagugucaaaaugucauuaccuuuugcuuucuuuucuaagacacagggucucacucugucacccaagcuggaguacaguggcacaaccauagcucacugcagcauuaaauuccugggcucaacaacccuccugccucagccuccugagcagcugggauuauagguacaugccacuacaccuggcuagauuuaauuuuuauuuuuguagggacggggucucauuauguggcccaggcuggucucaaacuccuggcuucgcucaugcaauccuccugccuuggucucccaaagugcugggauuauuacaggcaugagcuaccaugccuggccuaaaacaucauuucuuugaugaaaugaugaugaaaguaaguaggaaugguuuuaaaaauugcuucccuccuggaccugccuccccaguuuuuaaaauugcaccaucuuaggaaauguggaagucugguaaccacgagguuuaucgucacuccagugcucccucagggaagaacacaggcucuauggcagacaguccugguucaaaugcaagcucugccauuuacuagcuacuuccaugaucuccuucuccuaaacuagaaaaugggcauggaacucuuuccucuucaggggccugcugugaagagugaagaauucuucaaguaaauugccugucauggcaccugacccaggguggggcauucaguaagaucgaucuugcugucauucauguuaauggucauuuugguucuuaggguaucacagacugggacuucaaacccaaagcccaauuuucucuuucuauccugacucucagauuuaguuaauagaaaagaaagucaucccauuggcauacucauagacuaagguacaguauaaacucaaagugggguauuauuggguggcuagccaagaauucacuccuaccuaaauucacccgcaguccuguguaguggcauuaucacuguagcuaaugauaccuaugacaugcuagcugccgugcaaacugaauaugcaacaccucauuuguccaaaggaccauguaagaauuauccucauuuuacagaugagcaaacugaggcucagguuauuaauuuucagcauaucgugcuguggagcaagcaggccucacaagugcacagaggcaaagucaucugucagggucacagacggcaguccucuccuuccucuaagugggguuagucauucuucacuuguuuaauacaccaaagcaucuggcuuuucacauucagacaucaacaugccagcccuggggguucgguggccccagcacgaaugucuccuccaaucacucagaggcaccaaggccagggagucacgcuuccugaugcaucauuccucuaaggcugcacucccaacuguggugcuuaaaguagggcaaaaacagggaugacugugcugugaacgugccuguugucagggucgaaggaaugggaguacugacaaaugggauaacacuguuuucagucuucggguauacagaacgggcaaaauguuaggaaaaagaggagcaagagggcagagauuauacaacauauacaacaggagcuucgcagugcuccaugacaacccagaagaccacagguccacgccuuacgacaucugagcccugaccaggagaccaaaccaaggcagcucacccacaggcagauauccaggggcaggccccaaaugcagaggagcguggcuuggaggugguguucucucaaggcaugggcuuuggaguaggaagauccaaaauuuacaucccagcugaccuucaccaagucagggucccccgagccucaguuugcucagccuaaaaugaggaaaugucuacuuugccggguacaaagaccagugauaguacacauagcagguggagugaggugcacaggagguacuuuaauaagcuacaacaguggcugcaaaucacauccaaaaaaacacaaaaccaaacccauaaaaccucacugcagucacuugccagggcaaaaauuccagaaaagaugccuuggccucaaguugaucuucucuugaggugacagccucccuccugcuuugggucuucagcuccugcugaucuggcuaccccaacucccacccccuaucugucacucagaucgcauucacccuuuggguucccauccacacgccuuccccaggaaacacucccagagggcccagucucuaugggaacucuucugucccccugcccagugaaaaggcauggacgaccucagaucccacuagccuugucgugugcuccaaccuuaccaucuuagacccugagcuuccugcaggacagagagagucugcugcuuuucuuaagccucucaggugaccaagcagcagugcuggguuuuuaggaagagcucaaauaccaggugauagcuagaaacugggaauuaguacauagcaauaaaacuucacagaaucauucauuccacaugauaggguuuuaacauaaacacaugauuauaaaaaaaucucugccuuugguugaguuccugcaucacugccaagugcucugcacacguucccacugaaaaucccggcaagccagguguggacagugaugcucagagagcugggccacuucuccaaacuccagcagcugguaagggacagagcugggaccguguccaagucggaagcccaugcuauuuuucuaccaugcuacagggugcugcuccccucucucacaccuucagagcugggugagagaaaugaggcaugcagggauuacagauuuuccugacauuacauagccuaucaguuacacaaccagggggcuccugucucgauuucagcucucucugcuacuauuccccuuacugacuucucaacaggaggccuucuuucaaggggaagaagacggccaacuuuggcaaauacaucuguuucacguggagggguuccuugaaauccaaguguggcuauuuggagcaggcccggccucagaauguguccccugagucuaaguuagguaugguaagagguuaaugaaaagaguagacuuaugacuggagcacuaugguuuagucugaaaguauggacuucccaagauggcuuuuuuuucugagauagggccuugcucugucaggcuggagugcaaaggcaugauccuggcucacugcagccuugacuucccuggcuuaagugauccuuccgccucaguuuccugaguagggaccacaggugcaugccacugugcccagcuaauuagucuuauuagucuugcugucgcccaagcuggagcgcagcagugcaaucucggcucacugcaaccuccaccuccuggguucaagugauucuccugaguagcugggaagacaggcgcgcaccaccacgcccggcuaauuuuuguauuuuuaguagagacaggguuucgccauguuggccaagcuggucuugaacuccuggggucaagugauccuccugccuuggccucccaaagugcugggauuacaggugugagccacaacgcccugcccaagaucuuaaaaugcacaaagccucuuucuagacccaaccauuuguaaaauggcaaauauauccuauaagucucuuuagcuaacaagugguccaggaaguggaauccuggcugaaguccugccagauauguuggacugcuggaggacucccauaugccacauucaaaacacauggauuguugaaagaggcggcuggggcagcccuacaaggaacugagcaccaccagccccugcucagcagggguccacccuuuaccuagccacccccugccaccaucuuccacauucuguucacccacuuaaguguauccagaggaagccagucccacggauucucugaaaggcagacagacugucgcccaggcuauaaaagcacagaugcaaucauaggaaugugcucccaggaggcaaccuacuaagaggaacugaagugaaacacgggaagaugaaggaucuugccuguugcuaagaguaaaugugggaaaccugguuccaggccccucuagcucucucccuacucccccucuggagacuucauuucuuccccugccaaaugaaggaccuggggccagcacagggguucuuaaccuggacuccuucuaaccccaaggaugcacagguucugcaaagccccuuagggcugggaaguuuaaugcauaucccaggcauuuuuuuuucuuuucuuuuuugacacagagucucacucuguugcccaggcuggagugcaaugacacaaucucggcucacugcaaccuccaccucccggguucaagcgauucuccugccucagccucccgaguagcugggauuacaggcgugugccaugacgcccggcuaauuuuuguauuuuuaguagagaugggguuucaccauguuggcaaggcuggucuugaacuccuuaccucaggugauuugccagccucggccucccaaagugcugggauuacaggccugagccaccgcgccaggccccaggcauuuuuuaaaugguagaauaacacaccauucagguucugagaaaggaacauggcacaaagaauacugagaagaggcccucuauaggccccuuauuuauuaaggcaaaaacuaacuggacaguggcacaugagugcucuaaacagggcacccccagcacaggugagacguacaacuuguguggcuggggcugagggaaaucaggccaaagaguguuuggagggaggcagacuucagcucaaugcaccagagcccuuucuaacagggcaacagugagguccuccuccuccuugaaaguuucuagcagaacccgagacccgccccaucuuuuuuuuuuuuuuuuuggagacggagucucgcucuguugcccaggcuggagugcaguggcaccaucucagcucacuacaaccucugccucccggguucaagcgauucuccugcuucagccuccccaauagcuaggauuacaggugugcaccaccacgcccagccugagacuccccuuucaaguggacgaauguuaucaggaggagacaggcucuaugcugcgucccugaagcucaauccacgccccacuuauacaaggaagaggcacaaacacucuugcagcaacaaguggcaggcccauguaaggcccaguaagucagcaggguaugacuuacugagggaaagggucugaacaaagcuuaaagccgagacagcaugcugcugcaaagagaugucagcuguaucucaagugugccagaaagucagggcaguggagcaagcaguuacugugaaagcuccuagacaugaagacuugcuuaauauuguuuuaaacaauuugauugcuuggaguauacugccaaaagugcuaguauuaaaaaguuugccaaaugcacacagagaaacaguaggcaagacugcagauucugagauuuggaggucuccguggugaccagcaggcagggcugcacacugagucaucuugucugcgucugagaacccagacucacuuaaaccucgucuuucuggccuugggaggucaagaggcaauagggcacugggaugguaguuccucuaagcacuuuaauuaguacacagacacugggugaaacccaacaccaacuaaggggaacuauuugucucuagaaacagcccagguaauuggcaguuagcuguguggauacccuaauuccccuccucaacuuauuaaguguggggcagaaaauaaaagcugccaacugccucaauugguccccagagacagguucaguuguggcugcugugauuagcaaagaaagagcccaagggaaaggcugagguccucaggggcccuugccaggaggaagaugcuaaggugccauuacuagcuaaaggggaacggucacucuuccauauggggacagaacaauuugugguuauaagaaagaugccaagaaggucacacccacagagagguccacauggacuuuugguuacaacaaccaguuaaagcccacuaagccaaggggaacucacuggaggcaauugcuaagggguuuggagaucucuuugggagaaagaaugcuaucacaaauuguuagugagaagcaaagugaaaacgugugauuagccuauaaggauuuggcaaaaacaaacaaaauagcaggaugggggcaauacacagagccaccacugacucaacugucaucaggagcuaggaacugcgccggacacagccuacagugagcaacacuuacugcacugaccagacaaggaaaugggggcccagagaagguagaucacuugcccaaagccgcccagcuaguaaguaggagagcugccguuuaaaccuagauugaccaguccaacagguucaacagcaagucuguugaugucuugacaccaauauagaagcaaagguuucucaucuuccuauucagauguuacccuuaccgccuucccaugcucuggaaggugccugugcagucucacacuuuuuggagacagguacugccaguguggcaauucaucuuccccuccugggggacugacaguucuccccucauuguuacugacucaccugccuaaaauacagccuugcucaccaccacccacucacccuugucuuuuuuggcaggaugaaguucauucuccucaggcuggcauucaaggcucuuggcaacuuagcccuauuuagcuuucuacucuagccucugugugaacccacccagggauaggcacucuucacaaauuccaguguucugucuuuggacgugcuauggccccugcuucaaauauccuaaucuguucuucuuucuucaagguccaucuuaagucauguguccucuacuuugccaucacuuacuucuuuggcaaaagccagcucccuuuucugagcuccugguggcccugagacagugcggugcauauggauuugcucagaugaacucucuuugguagcucgauggagaucaugagcacuggagcucuggccuuugagcuggcaugagcuagccauguggccagugguaaaucacuuccuuucucuggagugggaguuggggggacaacaauacuuaggaugcaggugaggauuucacaacauuuaaaaaagaguggggaguacugacgcugagccugcauaggccuaggcuaauguguggguuuuuguuuuuaagcaaaaaaaauuuaaaaaguaaaaaaauuacuuuuuuaaaauagaaaaaaguauacagaauaaggauaugaagaaagaagggccaggcacgguggcucaggcuuguaagcccagcgcuuugggaggcugaggcaggaggacagcuugagcccagaaggucgaggcugccaaguaauccaagaucgugccacugcacuccagccugggugacagagcgcgacccugucuuauguuuguguuuuacgcuaaauguuaaugaaucaagaaauuuuuuaaaaauuuuaaguuuagaaagcaaaaaaguuacaguaagcuaagguuaauuuauuuuuaaagaaagaaauucuacaauaguguacaguaauguccuaggccuucacacugacucauuacucacucacugacucacccagagcaacuucuaguccugcaagcucuauucauaguaagugcccuauauagguauaccauuuuuaaucuuaaaaaaaaaaacaaaacuuuaauauaauuuuguagagaugggggucucccucuguggcccaggcuggucucaaacuccugggcucaagugaucuuccugucuuggccucccaaaguguugggaauauaggcauaagccagcaagcccagccauuuuuuuuaccuuuuaugccguauuuucacuguaccuuuucuauguuuacauguuuagacacacaaacaccauuguguuacaacugccuauaguaguauucaguaccacaacaugcuguacagguuugcagucuaggagcaauaggcucuaucuaccauauaaccuagguguauaggaggcuauaccauccaggacuguguaagaacacuccaugaugugugcacaaagacaaaaucgcuucacaguggauuucucagaauauauccccgucauuaagugacgcaugaguauauagugaaugcaagaugaucggcaagcugcuaauucucaguaaccacuugcugaauuuguauaaagaccuagguccccaggggguuccagggaagggggucuggugagcaggcagaugacacaaccucuacccacgcccucuauugucauucaaaccacggugugacgggauggccaaaggagugacuccaaagccccuuccccacuggcugaccguccagauaagguuggagggccgccccucagcuccgggugcuugcacuuagaaaccugaagauuacugaaaccagggacuacagaccuucuucccccaucucccuccccuguaugccuuucccuaacccaaaauagaaaguauuucccaauuuacaaauuaaaguaguucucaaaaucaauuuuacagccagcaaucaugacucugauguuauauaacuaguaaaaauaaauaaauaaagagagagcgagaugcccacacuggagagcugccccgugacaggaucaccaggcugcccaugugacaagaccccgcacagguuuucagcucuaaaaagcaaaacaguacaaaaacaacaaaacgccauguucuugaaacacaauuauagcagagagcagaugcaaauaaggacagaagagcaacacaucauaaccuaaugagaagcugauuaccaagaaaagaacaaaacgcagcaagacucagccaugaacgcagccccgaguccaagggaccauucugugccugugaaggugcucuuuguucgcagcaaaacugagauccaacaguccucucagaagacccagauaaacgggcgccacuuaccacaaacacccacgcaggagagagaguacggucucauguccgcacguccaagacucauuuguguaucucccuacuccccuaaaccgucuccugcugcaacauucacucuuacauggcucuguucccaccacccagucacucaagccacacaugauggagucagcucugagccacuccuuccuaccuuccgauuucaggccaucugagagcccuuuugaaccuccaaaaugcaccuugaauucacucccacuucaccaucuccccuaaccugggcagcuacagccuccuaccugggcucccugcuuccacaacugccucucuccaguuuuacuggccacagagcagccagugaccuccuccuggccucccacaccuugaccaccgcacuccagccggcucccuccuccucugcuuggcagaggccucauccuucaggucucggcuucaaugccaccuccucagagagccuuucucugaccgccuugggcagguccucauuuucugcuauuuucuucauuuacacacaacugaaacuguaccuaugguacucucguaugacacgucucucaaacucagugccucaagggugaggaccacgucugcuuuuuucacccauguguuauuaauagaggcacccacuacagugcccaacacacaguugaucaaaaaauuaacggguccccuugggcaugcauguuuuccuuuuuauuggugggggagggggaaacacaugagccugcacacauuccgagaugcuaauucucgcucugccaucagcgugcccgagaacuggcaugaaagggcagcaggaaccaacgccugugugguaccugcugcgugccuggcaggccucugccagcuuuucauucccguucuauguaauccccacggcaaucccuccagguguuagcaaccccccuuuacgaaggcagacucggaggcucagagagaugcccaggguuuacauggacugaggaugggaauucucaucuccacggcccaaaccuggcucacagcgggugcucaauacaugucuguggaacagaaaaacgaaguuugcuagucacaauucaaagucauguuuaagauuccacuuagaggccuggugcaguggcucaagccuguaaucccagcacuuugggaggccgaggcggguggaucacgaggucaggagauugagaccauccuggccaacauggugaaacccugucucuaauaaaaauaugaaaauuagcugggcgugguggcaugcacuuauaaucccagcuacucgggaggcugaggcaggagaaucgcgugaagccagugagccgagauugugucacugcacuccagccuggcaacagagcgagacuccaccucaaaaaaaaccccccacagauuccacuuaagagaccuaaguuccaccuguaccucggggggcuucccuguuuccuaugcccuguugcuucucaauuucuccuuccucuaggggugaccucccuaccauucagacuucacaggaauccugugguugcccugacagcacuccccugagaucaccuugagacauucaucauuauuauggcucagaaguccacuuccccagggaagcccacggagagguuaaauuguuuccuccuacucccacaggaguaagaggccacagggcuucacccuauccugaagacaaaugcacugagagccugagcgggagucaguugucccagggucccagaaccacauccaccauggaacuaggaacacgccaggacagaaggaacgggggaaagggaaaacagugguccuucagguaccuugguucucuggaggagugacuuguccaagucacagugcuagguaauuauacaauuacuuauggaauuauagaagccaggaccuuacaggcccucccgauucucacaccuagguccaagcuuuuugaagguaaaaggguaaaaggugagggcaauggucugcaugucuaaaagauggcaggguggcugacugcacauuuacccucuuuugccagagcaguucugaagcuuuuguguucaucagccaucaccuggagagcugauacaauaccacuccccaguuuccaacucaguagguuugaggugcagccagaaauacguguuucuaacaaguucccaggugaugcugcuggucugggaaccacauccugagaaccacuggugcuaggguuucucacugacacuguguguuggggggugggaucaagugaggaggagcagagaggacacaagggguugaagauaucuucaccaacacuucuuacucaugacauccucuguuccugcugcagauaaaauaaaagcaaucuuuuaaccaugguuaaaacuucacccagguucauauaauuaggcucaagacucacaucuggaucucucuauggcaaugaucccaacucaguucuaagagcaggagcgagucuggcauuaucacgacggcuguuguccugcuuacaggacuccagagcagcaggaaggagcuaugugcucucugaaggcuuuuccugcuauaccuguugguacccuggccccuaagaugcucaggucagaaaagggaggaggaccucuggaccaugucaguggugucaucuggauuucaguuuaggcacuuggccuaaacuccaaaauauuuuuaaaaguuaaaguuagccuguuugucuggggugugguauaaucacuuauuucugcuguucuaugcaaaccaaggguuccuuccaaacaucaucagauccaagaugcaaucugguuacuaacaacagagucuuuacuugugacuucuaguucucuuucugucugguacaaggccgggcugugcugguaaugcccauacaaccugccaagaucugacaacacuauacucccaacuccaugccuuagauuugcccuaggcaugccuagcuuucugagagggcuugucuuaagcacauccaaaaaaaguagaaaaaaaaaaacaaaggggugcuguacauggugaaggguuuucuuuccccacaaagauggaaguaaaugcagaaugagucaacugguucacaucaucuuugugauuuucccauuaaaauagauaaucaauacuaaaacccaacacgauauaacaaagccaaccugccuccuguuacagcuacacuaccaggccuccgaguucaggggaaaaaaaaauaaaggugaccauucauaaggcgacuuccccaagccccacaucaagaugcuuuuugcagccuggaaaaauggaagcauuuucaucuuccucacuauggccuauggagugccuggguggcccuaauccauuccucccaugucccuagacaucacuuucuuuaauaaagaaacaaaauauagaguucugaccuguguacgaugcaaacugaguuauagcuuuccccuggcaccucuaacugaaagugaaauuucuuuaaaaguugggaaauucauugcaguguuuuaugguauugauuuauuuuaaacuugguuggcaguuuuaaggccugccaugccucugaauccuagaaacgcuggaggagaucuccauuuccucugauuuuguaauaucacagcggacucacuaguggaaaugaaaagaggggcugggagcacgaaugcggcugcccuaaucaagacagagccuugggcacucucccuagguccuggguccacaguguaucuccaguugggaauuucacuaccugaacaguaguacccuuuccuccuguagcugagaauacuguaaugaaaccaaaccugaguauguacccugagauguggcuccugcgcaucccaccuggcuuacaagguaccccuaaaaccuaccuucaagaaccagccuggaauaccaccuccuccacucuuuccuguccuccuguaucucuacugagccaucuauaacccauuaccaccaaguguccauaucucaucugcauuauuaaacuaaguuccuaggagaccauauuggggucuaaacaaucaaugccuccacugggcaagugccuaccauaugccagaaucugacuuggcuccagaaucuuucgacacagggcuaugggcagccacaucaauuggaguaagcaugagugacggaaucccuugcuuaagucaggauucagugagugagcuggaagauuugucagaaagaaacagagcaaccgcugccauucugcuggguccucaucaacuuuaaaaucccuggguucacucagaaugggcuucugccagggcaccaggaccacagacacguaugaugccuuuggcucuuauuggagcccuuuccuugcagcuggugccagacgcuggccuaaugacagcauucccucagugcugggugcuuucccagcugccgguggguggaggugugcuuuagaucuccuacuuuccaaacuuuuggcaauuuugaccuggcugcauauguggcuccugccuucucugcugccagaccucgguuauaugggcaccucacacuaucccagccuugccuccucugccaauguuuggggcagucauuguaacacaggaggaauccacaugcaggcugaccucgccugaagggauggcugguggcccugccacagugugccugugcugaaaccagugucagacugugaaggacacccauggcagcccuggcugcuuuacuguaugguacuacuggaggggaacccaccaucugccucagaauagaaauucauuaaaaguggcuuuaagaggcuguagaaugcagaacggagcaguagaguuuccagacagauacaucucgucucaaauccuggcucucaaaaccuuaggaaagugauuuucugcuuccuuaucugcagaaaagagggcacauaacagaauagcuaagcagaugauguaugauaaugauacauguaaagugcuuaauucagggcucggaauaaaaaggcagggucucugcccugcacaagucaaggggucccucagagcagguuuugauaaccaguagcuguuggugggagugucugcgucccugggguaagaggaaaugggaguuggaagcaccccugaaccaucaggcagcuuugcucacagcuggacgauuacaagagccacucugauuugcccaaagggaugcuaucuagguuagguggcaccaaggaggccauggaggaggaacaugugagcagcaacugggccuugacgucaacagccccgggccaggccuguccccucauggaugcuuucaaguccugcagagcugcaagggacagaugaucccuggggggccaucggccccauuacauaacugacagcucagcuuccugcuguugaugcggcagaaacaaucaagagauggcaacagcaggucacuggggagcuuguggggacuuacaaaaaaaauaaaauaccagccuuccccaccuggggaggaaaacuccucagaaaacaccagcagagagaugaggccccaagggacaugucucuuuguauacagguaucuagcgccacuagggucuucacaguugaagacugagcuucaauuuccugcgagaaaagagaaccaaacacucugacucuucacucauaacccccaccucuugugaagcuguuuagugcuagugagauggguuguggcaaagcugugaccccuacuauaugggcagggacucaaagaaccucagggguucuggaucugccuggauuaaagaauugaucaucaucaagagauaccaccucgaccccaugaucucucugcucuuaauaacaccuccauucuuacccacuucgggguacagcuuagcguuucccuuuucccauccucccuuugggaaauucaaggcuccaccaaagacuaaguagggaucagcuucuggggugcaaaaccaaaccacugacuucgaccccuuggcaguuacaccuucccaugaaggaagaaccuuccuugcuucuacuuuccuuugggcuaccuggcugcuuaucaccauauucuggaccuuugcagaguaggagaggaacuagcuccucuugaagcccuacuaaguguuccauacugcgcaucucauaaugcucugggcuuugugggcaggaaauucuaucuacuuugaugcucaguuauuuguugaauucaauuaggaaaacauuuuaaauuuaaagaugauucaaugaggcaauaaaccaaacugguuaaagccauggacugacuccuggguucaaggcuaggcuuuaccucuucuuagcucugugaccuucaggaauuuacuugaaaguaaguaaaugaauuaucagucauaaagcacucagcccagggacgaccaugaaucacugccguuuuggucaucuuuggcgcugcugcccuucuucacagccuaaccccucaggcugccacacuccucagccaggcaccagguacaggcaagggagggcaguccuguaaggcaggagcuaguuccuggccauccugagagcugggccaggaagucauagaguggaccuauuuaguacuggcggucccaacuucucaccuaaaacgauuuuaaaauuuacccuacagagacugcuuugaauacuuugcuguuucaaacaaaccauguuaauuacgcauuucuuuuccauuuuuuaguaucacugcugauuaacuugguagcuauagcgugcguaacaacacaguugcguguaauuccagcccaaagcaaaaaauuggucauugaauugggcuucuauggcuucaacaggcaauauacucuugccugucagauaagcugaaagggcuugugaauuccugucuuugauuaggguuguacuaggguuagaucuugcaaaauagaaguaaaaucugaagcgcaggucaaggggccaacgcaggucacccaguacguuagcugagagccacaucuuuggaccccaggccagggauaaaugcaucaacuauuacuucaacagaaauugggccugauuuccuucucugauguuaggcagcuaccaagaucucauauagaacuagaaauacuuucugugaccccucaggucacaccaacaucugauuuccuucagcaggccuuagcugcccacuccaaaaagacgucauucgagggcuuuggcuucaaaaggcccuaguaacggagguuuguauaucagacagcagacuuggccaugaaugcagauucccucaucccacaacacucucccugguaacacgugggcggaggcaccuggaacaucaguuuggcuggcuuccugcaugggauaaaaggcuguggcuagcugguaggagccauuaggaauuauuaaacaucuuucaaaagcgacaaauaagaaagagaucagacccaucacugaauggucuuuaaaaauagauauacuuuucuggaacaagugauuggacagcgugggccuugacuacagcuuuguuucaaaagaaaagcuauuuggcaauccacaaaagugaggcuaccaaagaccacugucuucagagggaaauggaagccaauacuucuaccuaggccaaaguauggaucuaaacaaugcuacuguauuacaauuaauucagacuguuuacauagggcacuuucacaaccucuugugauucccccaacaaccucaauaagauauauaggaucaacuccauuuuauagauaauaaaacugcggcccugauaaguggaauaauuugccuaaggccacacagucaggaaaacgcagauaugagacuccaucccugcauuguuacuagacaccacuucuuucaggggaaucccagguuuccaacccaaaaugcauuuccuuuuauuuuugcaaaaaaacugaaacuaguuaguccugacuuaaaugcgacucugaaaucuacaauccuaaaacauugagguguuuuuucaucuuggugguauaggggucaaguguguuuacuuaugcaacuagaguuuuuuuguuuuuuugagacagagucccucucuggcgcccaggcuggagugcaguggugugauccuggcucacugcaaccucugccucccugguucaagcaauucuccugccucagucucccaaguacugggccuauggcaugugccaccacaccuggcuaauuuuuguauuuuuaguagagaccagguuucaccauguugcccaggcuggucucaaacucgugagcucaaacaaucugccccuacuuggcuucccaaagugcugggauuacaaggcaugagcuaccacgcccagccuauuuuaauuuuuaauaguacaaacauccacagauauaacccaaaacaaaagcucuuuggaguccguaaauucaaaaauguaaagaggcuuucagacaaaauacuuugacaacuacuggucuauucuuccacugucuccaauuccucuccucuuccccucucaaauccacucuaguuacagguuuccccauuacuccaccaaaauuguucaugaguacugaugcuuucccauuuacuaaauccaaugaucaaguccucucaaucaacuagcagaugaugccacggcuggcucccuccuccucuugaugucuuuuccccucucucuggcuccuuucuuucuucccauccucaauguugcaccaccuggagcucaguccucugaccuccucuugucuauacccacuccaguacuguggcaaaucucuaaauuuguaucucuaggcuggaccccucccuugaacuccagacucauccaacugccuacucuacaucuguaguuggauucuaaauaggcaugccaaacuuucagauaacuaaaaccuaacuuuguccugccaacccuauucccccaaugucuuccccaucuuauuuaauggcagcucuauucuucccaucacuuaggcugacaccuugaagugaugauuaauuccuuucucucacaccucccauaugauccggccggaaauccugcuggcucugacuucaaaaaaauacccaaaauccaauaaucacuucucuguuacauuguuucaagccaucgucaucucucaccuggauuauugcaacagccucccaucuuaucccguuauuucaagaugcaaagugauccuuucaaaagagcagauaucacacagcugaaaacauccccauggcuuuccaucucauccaaaaacacaagccaaaaucucuagaggcuuacgaggccuacuuggcuccuaguuaucuaucucuuccuauacacuccuugcucacucuggccaacuuucaggaccuucacaguggccauuacuucugucugagaugcucuuuccccagaaauccuugggacucacucccucgacuccuucuaacauucgcucaaaggucaccgucucugggagacccacucugauaucuuccauuuaaaaguacauccccaccccuccccaccacccaagcuucagaucuccccuacccugcucuacucuucccauccuacccucucaccgcacccagcaccgagcacuuucuuguacauuaccuauggguacugucuucccaacagaacgaauguuaagcuccauacugcaaaaacuugucuguuuuguucaccgauguauuaucugugucuaaaaugguacuuggaaagaguuuccaaagaacauguugaaugaauaaaugaaauuagcuuguccaucuacaaaacuuggcaggggaaagggaggucagacucaauguucuucccaagucaagccucagauucucugaccagccagauacagcucuucuacagaagcugauuugaaguuucuggcaacacaggguuuggcucuggucacagaccugggcccaggcccacaauucuaagugcccaccuaagacaggggaggauaggcuauggucaaauuggcaccaccaguacuguaaagauuagcuguaagagccacaaaaugaauuaacaaaacagccugggacacucaccaguaaccauauuccuaaucuuuuccccucuucucaaggucgccuauuucuccuacaugaaagaaucacuccaauuuagccaaaacugcccugcaaaacagcacaaaucucaaguguggauauccacauggaagcccugaucucaauuaguuaugacaaccccauaaucguaaccuaaauucaggucccucuuccaaugacaaccuuccuaugccagagcaaaucugaauuuuaagaggucuuucaaaagcagaaagcaugagauggaaaugggaagugacagcacaaaauacauuuaaaacacugucuagccaacccuuuugguuucuaauauagcacuacccuaaaccuagcuuuggggacugcuguucuccuacccacgggugguaggcccaauugguccagcaccuggaacacacguuuguagaaugaaagaauuaaaccuaagugacucacucgagaaauacauucacugagaacacuacacaugaaaccaagcucaacuuggaaugagccaaccccaccuagaaaccagaggauaaugaagggaaagggagggaacccacccaagugauggaaagcuccgugccuuauggcuccugaggcuucuugugaccaccaggaggaucagcacuagcuccaucaccucaucaagacuucagcacaacguaagagcagcuuacuucuagcucaccauauuaagggaaaagggggugggggaugcuugaauaagauauacccauccuuaacuuaguaggaucugggguaaauuacuuaaucccuugcaggguuguaaaggugaaacaaaaugguucaugugaaacuaccuagcauauaugcuggucaauuuuucaucuuauuucucuuacacacacaucaaacuucaguccaacuaaacuauucugcuguuccuauaaauaccuuuggguuuuccaguucaauuucugucuacacuguucccuguccucucuaauuuccacaugccuacuuccucauuaacccaaauuggucuagucucucaaaugugccaggcucucccugguuucagguccuucgcagagguuggucuaucugggaugcucccucacccccaauucccuccucuugacucugugcaucaacacccgaaaggucaauuucccugaauaccucuucuccuuaaacagcuauaaaacaauuaugauuugaagaauuagaccuagugacucauuacaaaaauaccuucauugaaaauacuacacaugaaaccaaguucaacuuggaguuucucucccuaauuaagaugcagaauucaugaagauggagaaagucucugauuuggcuuaucaugucaccccagagccuagcacauacaguuaugggucgcuuaacaaugggcugcuuaacgauuucugagaaaugagucauuaggcgauuguuguguaaugucaagaguguacuuacauaaaccuagaugguguagccuacuacacaccuagaugacauguauggccuaucauuccuggacuacaauucuguacagcauguuacuguacugaauacuauaggcaguuguaacacaaugguaaguuuuuguguaucuaaacacagaaaagguaacacauacaccauaauaugcacuauaacauuacaacagcuacaucacuagguaauaggaauuuuucaguuccauuauaaucuaaugggaccaccgucauauaggccauuccuuuuugaccaaaacguuguucaugcggagcaugacuguacuucacaaaggaaaacucacaauaaauuuuuuuuuuuuuugagacggagucucgcucuguugcccaggcuggagugcaguggcacgaucucagcucacugcaagcuccgccucccggguucacaccauucuccugccucagccucccgaguagcugggacuacaagugcccgccaccacgccuggcugauuuuuuuguuauuuuuaguaaagaugggguuucacuguguuagccaggauggucuugaucuccugaccucgugauccgcccaccuuggaauaaauuuuuuaaauaagcaaagacuucuacauaaauauucacuaauacauucuuuauaguaucuaaaauggaaaaaaucuguuuucuaaaguaggagaaugguuaaauuaugguacauauaaugggaaugucauacagucccugaaaagccauacuucuaaaguaugacauggaggaaugcucagauuaguaaugaguaaaaagaaaaagaccuugaccaacuagggcaagaucuaaacuauguggaaccggaugugugaguaggugggauacaaucagagauaguguuuauucucugaaaaccugucuaccucuuaugcacauuuucuacagugagcauuuauaaugaugagaaagagcguuucuaaaaaaagggagacucggcuuaaacgcaaccuccucugagaagacuucucuagacuuuccaacguguacucagauaauugcacguuucucccaucaagauaugggggggaucuuugaaaagaagcacuucauuuucuucaacuuuguauuccccugcaaguucacagggcccaugccaggguccagaaugaagaacccgguccaagaagugggcauacagaaaaaaaagagaggcugggcaugguggcucacaacuguaaucccagcacuuugggaggcugagaccagcagaucgcuugaggucagaaguuugagaccagccuagccaacauggugaaacuccgucucuacuaaaaauacaaaaauuagccgggcaugauggcaggugccuguaaucccagcuacccagguggcugaggcacgagaaucacuugaacucgggagguggagguugcagugagcugagauccugccacugcacccgcugcaccccagccugaccaacagagugagacccugucucaaaacaaaaaacaaaaaacaacaacagagagcacucaccuaguuuaaaaucacccaaaaugcuuagcccugaauuuuaagcagcacaugugaccugguccauucugguuucaaguucaaaggcaucaggccgguccuguggguuagcagcuaacauaucuuucaagagcugcuugauccccucagacauggaaguccugcguuuuugggggaugugcaacuccaucuuuggguuuucuagcagcgccucaccaacagggacgaucucaguccccuguuuaauguagguccccaggagcuccuucuuggucucagagucaauaaaagugauucuuucuaucauugcccagaugauaaugcccagggcaaagauguccgccuuggcuguguagugucccucccagacuucaggagccauguagaaguccgaaccgcaggcugaggacagccaguacuuauucacauucacauuuuuguugucuugauugcccucuuugccucggggugccagcccagcacagaccuugcuuaguccaaagucggccacuuugaggaugggggugccagaccgcucugugaugaggauguugucuggcuucaggucccugugcacaauaugguuuuugugcaggaaggcaauggcgcucgucagcuguagcaugaaacuuuuguugguggcugggucuggccuccgggacaggacauacugauucaggucuccaccuucacagaacuccaugacaaaccagagauagcagggcuccucagcauaacccaggauccuuucuccuaaaucaaagaagacaggaaggagcuugagugagauggacacagucacacuucuuuuuaacuaaaggaugcaguguauucaagagugacauuggugacaaacaacugcuccaaggggaccugcacaacuggcacugagugccuuucuaagguaugacacaggcaccagggacuggugucagguaccuggguuuggaaugaggcccagguggaaacucggguuuacugccgucugguugacugcgaagccuuuuuguuucauuauacugucuccaaacagggagugccauaccacccacaccucccaaagcugcugggcagaugggacaagggaaagcaugcaagaaggcugucacgggucuguugcuucuaauaucauuguuacuccaugcugagcaaaugaccuucccucucuuuuuuccugacuuguagaaggauucuuguuaaugcaccuagaauggcacuagaauuuccuuuauuucagaggcacacuccuacaauuuccuugguuuauuucagaggcacaguccgauccaucaauauuuucugcaagcccaccacaugccuagcacaaguuagguacauaacaugccuccaccucuaugaggcuuaguuucaaggagaugacagguauccacagcagcaaccaucaaaagcuguacaucgccaucaggcucaacuacuacaaacagugaagcggaggcaggagucgccagaucugaauguacaucuccaucagggucaacucauauaaacagugaaggggggggcaggaguggccagaucugaaggugucagagggggcaggacugaacuuacccuguaaaaggcaggcaguagaucagugggggagcaggaagguaauucuaggcugaaagauggaauggaugauggaacacagggacaaaaagaccagaaagguguaaauuggaagucuggugggaacaguggagucuaaagucgauguacaagacagauuuaaauugugugggcuugaaacucuaggaaagcuggugaccaaccucuccaagcaaaucucaauguucuuuauaaagcaacugacaguccagugaaucuuuauguggauguuaugugaugacuacaacugcucccaaagcuaaguguaagaaggcagauguuuuaucucacugaugaggagaggcugggccugcaaaugugcuggcuuguucuggguggucacaaggucauuuguaacugagccaggaccugaagagaaguccucucucuggccccaguauggaguaugcauccuaccaaaaaugacugcacuuccucagacagcuucuggcagaggguuccuuuuacuagucauuuacucuauuacaaagaaaacgagugaucuaggugaggcucugcuaaccccaacagccugaaauuaccaaggcucacagucuacuaaagccaauggucugagaguucuggguucagccaagaugaugugacacacaaaacaaaagcuuuagguuuuugaucacaaucggauagcccucacuucccuuguaauuauauaauuuauuugcuuauauuacucacaaucaaaguaauacagguagaaccaguuuagggcagauguuuuuuguucuuuucaaaucaguuauuuccccucucauaauccucuaucuaggucaugggcagaggcccucuauguaaaaauacugcacaaugaagcaucaaucugaagcccaagucaauccagaugcuaaagacccacaaaaaggagagcaagaaauguguacuacagguagaaccagaaaggaaaagaucaaaaagccauccaauuccuuuugcaaaggccacaucagaaaacacugaaacuucuggugggggaauaaaggaagaggaaugaugguuauuuuauauacaaaguuaguaacuauggcaaccuaaggaaaaagaaaacaagucugcaaaacagacuauaaucuaaguccagguuaugagaauccagggaaagaaaaaaugguaaaaaaagaacccaaaguuugugagugguugggggagacuggaccuucggacugaggagcugcucugaggaaggagcuagacucaggagaugcuacaggaggggcuguuuguugagaggaaaauucuggacaggaagaaguauucucagaaucacacccaguaacaguggguaugacagaauggaaaacugggagugcagcuauuugucccagauacaaaaguguuauuauuuuuacgagucaaggucucacucugucacccaggcuggagugcagaggugugaccauagcucacaguagccuccaacuccugugcucaagugguccucccgccuuggcuucccaacguacuuccaaaagaaguacuuuugaggccgggugcaguggccucaauagucccagcuucucaauagcaccuggccucaaaaguacuucuuugcgcaggaaaggccccuggacuucuuucaugagaagcugcagcguaugcuuucacacacgaacucccgggagaaaacaaacaugucagaauucuaguccuuuacuccaagcagacugucuaacggggucucagcuaccucacgaccagauggaaggaggcgacguggaugaugccaggcacucggaggcacuuggugaaguaacaggaaaaacacagaccaggaaacaaagaguuuggguucagaccccaacucugaccacugccucacuggguggauucuuuguuucaaggaaaacacagggagacugaggugugaugaaaagauggcuggaacccugggcaagucccugaagcucucugagccucagucuuuuugguaccucagucuucacaucuaucaaaugagagaaugaaacuauaccacaugaguacugugacuuaagucagauaggaacuacauuuggcagaauguaagaucuuuuuggggaaaugaaccacugaccaucacuaacaucaucauucccacucaaccccaaccaaauccuuggaagucaccgauuucaauaaucccagugcuguaggccguaagaguaaguuuuuacauguuaggcaaaagaugaaauuuagaucuuagaaugaaaguguauuauuccaucuaagacaucacacuucuuaggcuguaacagcugaaacccauguucuaggcagaccaggcuauuccuauuugaagugaucccucucccuaggccugcugcccccacaaucucugcagguacaauugaaaugugcaccuuaaggcuagcugcaacaccagucuaucuuauacucacuugauuucccaguaacuucccucuucugaccagccaaggcccuaguuucauauuuuuauuuuaguuuuuauuaaauuauaccagauauucugguuagcaaucuauggcuuaacucuucuacuuaacccugagaaaugcuggcacauucugcagauguuuugaggucgggggacuagauuucuuacucagucuuccggccuccccagggagaccugcagucauuuccaaggugccugugcauugaggaagggaaaguaaucaaacuuuaggggauuacugaacacaaguuccaaaaagacacuaauucccaaagaaccaaacugucacugugguccaccagucagaacaggacugauggagggcaggugauccauggaguuucagcucaggcccaucucacagugggcucccgacccacccacaacugcggguauuuccccaguuucaggauauauaauuggaauagauauaugcagcaaccacuaaaauccccacaugaaauucaguuuuuugagcugagaggaacaaauaaaauuuacuuaaguuuuauaauucccuugucugguauaaucugacaguuguauaagauuaauaagaguuacaaauuuagcuuccuucccagagagggagaaaacaggcagguuauuuggagauaguaaggauuugagguaaauuagccugugaaagccuacuggguuccagguacuauuuuaaaaguuuauuaugugagcuaucucaucuuaccaggcaccguuuuacagguggggcaacuaaggcugagaaaggcuucagagucugcccgagggcccuuaccaugaguaacugggggggauaggagagaacccccacagcaaguccuccccccagaccaugcugucucccagcucacagagggcuaaaaaguguucuuccaagagaggcaggccugccuuuggggacaguuuuacuaccuuucccucaagucugacagucaggugaccauaauauaaauuauguauuucaaaacauauccuaugccacaguccacagggagagaagaugcuuaaaguaaacccaagaacaaaaccaagcaggugucuugcaucucauuagucauggaaauucaucaguagugcuuaaguucccaauaaaaacauggcuugcuucgcugaaaaacgugaggccagcaggcucagcauaaagacaagccaguaggagcuuuggaaagacaggcacuuccuguaaagaaauacaaaaugcucuagauuuuuacaagccuauccuuaagccuucuccagaaguuagauuuccagguuuuagucaacgccacuucaacaauuucugagcacacauugcucuugagacagaggugcggugagcugaggggcaucccugcccuuacauaggcuucuggucauuagaagcagaaugacuacagcugugagaacuaggaagcgggcccggaucugccagaagaguugggagagaagcugggaugagaggaaggcaggcugagaauaacugcgagaggcccugcagcugcgucucccaggaugaggggagugggcacaggagcaggugggugugcgccagggacacgaguagucuggauaaucacagaagaguuucuguagaugugccggaaugaggcuggauaucuucuaagguggauuuagacuccaagaaaugggaagugacugaaaguucuuaauacauuuuauuuauuuacuuauuuugaaacggucuagcucuguugcccaggccagagugcagccaaucacagcucacugcugccucuaccuucugggcucaagggagccuccugccucagccucucgaauagaguaguggggauuacaaccaugcaccaccacgcccggcuauucuuuucuauuuuuaguagagacagggucuccuuauguugcccgggcuggucuugaacuucugggcucaggcaauccuuccaccucagccuccuuaaguacuggguaauuauaggcaugagccaccacgccuggccacugacguauuuuagagaugugucgcuuacagaaucuacaagucaccaauuuuaaggcauaccauuuaaguaagccauauaggcugcugacaacgcuaugggcacaccauugacuaagucaaccgcugauuucagagacguuaaacugugaaagagcauaucuuggacaaugaaacaaguuccuuauggaggcaugagggguuggcgaugggagacagccuaguggccgacugacuuaucaagaggcucugaaaccuggugaagugagggcuggcaagggaggaggugagaagaggaugugaaaggucuuagaaguuuaggauaaauaagauuuaauaacuugucacauaagauggaaaggaagaauucagagagugcucugccauuccucucugguuacucgaaacugcuaucuauucagauaauaauuacauuuccucucacaggugaggagacucaggagcaaaagauuaaguaacuugccuaguugagggcaggaccuugaguuuccauaggcuagauucucagcagaagcacugugacugccuuagugccugcagcaaaaucgcacaccuggaugugcuaguucccacagcagacucugaugcgugccccccagaguuuaauguucauccagucccucgugaugguccaaccacacaacaugcagaucugucuuucagcagaggacuaauuaggacuuugacuuacgcacacuucagcaauucagcaauacauauaggaagucuuagaaaugcucgauccauuugaaagaaaaaucccacuugaggaauucauuccaaaagugucaaaaagacacaaaacaaacaagccuccccacccaacaaaaaaacacacaccaaacaccagagacacucagaacugguauuccauacagaguaagucaaaguggaggauuggaaaacuacuguccaagaaugagaaugaguaacaguuaacuaugguaauaccaauuggcugaaaguuuuaaaggaccauauuauacuucaacaaaaguuuacuuaaaaagccaaaagagaaagucacauagcauguaauaagcaaguuuuaaugugaaggggggaaaagggcagaauauuaaaauuauaaaguuaugucuuaagaaaaaggaugagggaaccccgaaaaaugaaguuugaauaaauuaugacuauagccaucccuguuuaauuaggaguuguacauuaaaauauuuuaguuaaagagcuggcucagccaaagaucuguccuaagaagcuaaagacacggacccauccuggcacaucuucccaaagaaauaugaaaaugcagaccaagaauuggucccauucucaaugauuuugugcuguuaugucauuauaaagaggcuggguaccauagcaacaccacaggguguguccaaaguacuuccuaagauuaacagacuuguucuguuggcugccagggcaaaacacaguguccaaaagaggacaagaguaaacccaccggccggacaggggcuguaaagccagccaggccuggggucaacauucccucuacuaccugcccccaaucccccaauuacauagcuauaugauccugggcaaauuucuuagaacacuaagaaucuguuuaguuuuuuauaaauugagaagaaacaccuacagcacuggacugcucuaaggcuuaacugugacauacaaagcaccuugaauggugccuggacacuagagcagacugcuacugggugugaauuaugcuaaugucucuggacaccacuggcagcuguccaacacggucacaaggcagccugucaagaacauggacacuggaaagagcaucuggauguaaaccuaggcccugaccuuucucuaguguugugcuggacaagcaacuugaccuugauggacacugacguucuugucuguaagaacaaguuauauaaacaccaacuuuacaguggugaugauuaaaugagaaaaggaguaugaaaauacuacgaaaugcuagcuauuacuacuuggaacauuacagggguuuguuaaaauguagaauccaccagccaggcagagaguugggguaccccuaauccauggcaguccgggcucaaguaucucucuccauaugcaugggccuugccacacaccuaagccucagcucuugccaggcuuguuucugauuuacccuuuuacaacucauccuuccuuuccccagauuuaguccacauuccuggcagcugauucacccagagcaccucuuacaggcugcagugaaguaacaucuauuguacuguaaccaucucuuccauuagacugggcacucacgguggaaugaaaucaagucucuggguuccccacaguauaccacaugcacaccuagguggucgauaagagggugaaauaaaucaagauaaaagucaugcgcuggagagguguaaaaagagaaagaacacagaaaguaguaguaggguaugcagaauaugcaaguuaaagacaacuaggucaggauccagaauuuagaagucacuaaggaggguuccuagcccuacagauaccagcaaaggccacauuugaggugaauaugagcagacuacaaguucuacuuaggaagcaccccucgagaguuuauacuauaaaaagccuuacccaacgcaaccccaauuaaccaaagcucucaauuaaggaagggcugcuucugucuccuggggcugguaccuaaaauccccaaugcacauaaaaaguagucggucaggagcaagaagucugugugguugccccaagucauucaagaguagagcagagagcagguggggucccuggcagcugagacacacagaaggaaccaacagaaaucagcagugccacaagcacugaucaauauacaacuaaaaacaaagaggagccauuaguuucuuucuuuuuuuuuggagacagucuugcucugucgcccaggcuggagugcacugaugcgaucucagcucacugcagccucugccucccggguucaagugauucuccugcuucagccucuugaguagcugggauuacaggcgcccgccaccacgcccagcugauuuuuuguauuuuuaguagagacaggguuucaccacuuuggccaggcuggucuccaccuccugaccugaggugauccguccaccucggccucccaaaguguugggauuacaggugugagccaccgcacacggccugagccauuaguuucugaguaaaauaugauuaugcccauuuuacaaccaagaaaaacagaagaaccuagaacuuaagcuaccugucccagcaguaccccacagcaguuaagaaagcauacucaaguuugaaugucuggccuugaauccugacuugguuacuugcuuagcuguuuuacauugggcaauuucacuaaccuugguaccucaguugccucaccuauaaaaugaagauaaucacgguacugacuucaccugauacauagcaaccugcaaguuucagcucuuauuuacagggugaaacugggauuaaaaccuucugacucugagucuagcauuuuauuguauuguguuaacuuauauuuccccaaugccagccagcucucugccucuugaccuggcggcucucuaaacucugagacccaagccacagaagaggauucagaguugcuuuucuaagggcuggggagggaacggccuugcucugcucugaagguucccuaggcacucgacaaguuggggaaguuugcaggcugacaacccaucuauugcuaagacccuggucuauccuauacuauuauaguuccucccucagcuucuuccuuccccugcuuccccaaugccccuaacuaaacucccagacaacuguacuauuuucuaagaugcuaccacuugugacccugcauuauguucaugugggcaugcguccucugcaugccucguggagaaaaacucugcauggccucuuauaguagccuggcucaaagccacuuggugugcaggcaagauuacuuuccaaggccucgguucccagccaccuaaaggcaucgacaucaaacaauugguaaagaacaauuagugucuuaucaaguugaguguaagcuaggcucccggcucucccaaacuucuaacuauucuguuauaugagucuugagaguuuguccuggauuagugucugugaguguguccucacuugcuauuugucagaagaaucagugugugccuuagacaaagcaacagaauuucugacugacagugacucaggcuugccugcugucuaaguggcaguaaucuugaacuuuguuuuaggcacauucaggacaggcauucucgcaauggaaaacaaggggauaaaagcaaacuguugaugccuucacccccccaaccuuuaugugagaaguauuucaaaguuaaaaacauaggcaccaacccuucaaccaaauaauuuacaggauuguaaaugugguuuuaaaaagccugggaggcugguuugagugcuaucacuaacucauuguggauaaaaguuuugucccuuuucugggcuucaguuuccuuccuugugaaacaggcagccaggucacacaucuaagaccucuuucuauuccuccgaagcuucugcugucuuaaugccucuggguaggacguguuuggucugugcacagaauggaaggagacaaugcauuuaaggcuaucaaacaaaaugggguaagaccaagaacagcauuucaagacauuucucuuuucgauacuggauuauuuuacuggccaaauagugaaacggacucccuuugucucuucgccuauccacaguccuaggcacccuacuuucaagcccaccuucucccuaacuccugauucucuuuccucuuaauucuugugcaaagcccuugcuuaugaguugacuggucauuuccuccagugaucuugaauagcauuuaaaucuucuuccaguucucaaacuuuucaaauguaaguuccauuggggcaaggggugguguguuuugcuuugcuuuuuuucuuucccuucaaauaccacaguagggacucagcauuagguuuaguugagacuucaaggcagauucacacuuuuuggccuguucaaaaucauucugaguuuuaggaggcagggccaagggugacuguaaaggacuuuucuauuuaaugagagagcugaaccagguuaucucuacgauuccuuccagcuuuaacauuacugggugguauuugcaugcuguaaacccaaggccccaggacagaucaagaccccuaaauuuuggaauccagaauaagcaaaguuuaaccuggaguaauuuugguaucuguucucuauuuuaagaagcaaaaaugauuaccuauuuacuacuugaaaaauccacacauugcaagucagcuugaaugucauuuucauaagcagaaacaacacauauuuucuucacugcucugucucugagcccugaacaccguagagguucaaauauuuuaaagacuccaaacaacugaaagggaccaauccaauccaguguacggccuaaagcaaaagauuucauuuuucuaggucccaguuuuaguucacaaagggaggaugaaaacaccaguguuucugucaacuuggugugccugacaacacagaaaacaagguguguucuaugaugaaacaaguuugggaaacuugagcaagaacaaugugaaucuugaagggggugaggguagaagaguacagaacauggugugaacuuauauaaggcagugaauuccucccuauguggagcacuugcugacauuaacaguuugcacagugacccuauguaccuaaugucauagguacauacccacuaucuuacaauaaaggaaugcuccucacaggguucaaacaauuugcuccauguuuugugcagucaguccugggaugagccagagggucuaaccccaaaguccaugguacuaaccacuaugcuaugcugccauggggucacuuuggaauuuugacaaauucuucaggugaggaaaguccacauaguauuuauauguugagagaguaagcaagagcuucaagcugagguugaagguucgagacuggcgucaaugaacugaggacacaaggaauaaacauucggcaaggcaaauuccuacaucccaaggcaauccuguaguaggaaguccagaccauucauuggcaguaaaggagaagacuaagagaagucugagaauagaaagacuucaaaguaagugaugcgcuccuagaauauagguaagauaaacgaauccccuagggagucuuuuuuuuuuuuuuuugagacagggucuugcucagucgcccagguuauagugccauugcaugauaauggcucacuguagccucaaccucccaggcucaacugauccuccugccucugccucucaaguagcugggacuauaagccugugccaucagguccggcuauuuuuuuuucuauuuuuuguggagaccagggucucacuuuguugcccaggcuguucccaaacuccugggcucaagccauccucccaccucagccucccaaagugcugggauuacagucgugagccauugugcccugcuggaagucuuuucaaaacaaaaacacucacccuggggagaggguaggcuucucagaauggauggggcacggauggacuuuauaaaguuagacaucuaauuaaaggacucuaggugauacugauucauguuuccaacuccacugucaaacaacugacuugcaaugggacaaagcguucucuugggaaagacuugggggaucuuuaaguugugcaaaaguaacaagauuuugggaaaccacccccuccaaacucaccccaaauccuacccacucuuaaaaaaguucauccucagggugcagagaacagcauuacgccuucgaaaggauccaggccucgaaucaagacagaucugggauccccgucacuuaagcucugagaaauguaaggaaaccaggaguacagucuaacuucccuuucaagcggauuaacccugaucaaguuauuuguucacuucuaagccuuaguuuauuuauagaaaaaggauagaauuuacuuuugaaguuauuaccuaaaaauuacuucagcacugagaccacagcugggacucggauuaguaaacuuucuuccccuggauccuccugccucggaaagucuccucaaacuuucuaccgccucucuccucuccaagcagacacuuagcuacugguaguaugaaaaaggcuugugaguacugaguaguuaggaugaauacauucccuaacugcaguuaaaacccggaaacuaagauaauuaguuccuccaggacugcaagaccucuugccucaauguaccccauuuuccuuuuaaguaaaaccacuucccagccagccucugagguuaagaaaaagauuaagaauguaaaacggagggaaaagaugccggaugcuuuguuaugugacagcucucaggccaccugugaggguugucagccugcaccccucagaggaccaagccagaagacagucaguuugcucggcugccugggaugaagggccgggggccucagaggaaaaggcagacgaggaagccacaggaguuuggggguuggagcuggagggugucaggaaacuuggaaccagacagggagaggguguggguggguccagucaaguuuuuucuuuuuguuuguuuugggagggaaagagagaggcccucgggggugaggaggcuccgcaguucugcuacuaacugaacccgaccccuccuccacucccccaaccgaucuuaaaaauagaagacguuuaauaaccauagcucgcaauucuugagcacuuauuaaguuaaugguuagcacuuaaacgagcucuuguuauggaaacaccagccaacuuuaggcccagggacugaucuuaggaccugagaagagagggccgaaugccugggcccaggaaaggagggugugucagggcacagggugacagggaccaggucugaggccuaggaaggccaggaacagugugggccaagccguccggagagcaggggguccaggcccugcguggguggaaaggcccgcggugcuccuaccuuucagcgaggucuccaccaggcgcagguaaagcugcgagcucuuguugccgugacucaugcgcugggcuaacccauugcgcugcaggacgcacuccucaaacugcacgacguucugguggcgccgcuugaggcuggugagggcccagaauucagccagcgccagcuccacguucucgggggcgucgcagcggaucuucuugaccgccacccgggccccgcugcgcccggccacugccucauaaaccacgccguagcugccgcgcccgaucuccgccaacaggcuguaacgcggccgcgcggacccgccaccgcccucaggccgucgccgcgccaggaaggccucgcccggggccucggccgccaccggauccauggcccgggccgccgccgccggccucagcuucgugcugggcgcccgcggcacugggcuucgccuuuuccgcuccgggcuuuguguaccucugcgggcgccguccuuccccguuuccauggcugcgggcggcggggggagcagcaacggcgcugcccgggcccccccugccucaucccuccguccggcccugggacgcggaggagccggaccuuggauugugaccugcgggcgaaagaaucgguuaaacggccaggccaaggcggggaggccaggagcguaggccgcggggcgucccaccuccuccucccccggccgccgcggccccuuuaagacggaagccaccgccgcugauugaacgggggaggggaggggaaagcgggaaagaccgaaccacugggcagcagcucagagggggaaccggaaagaaaagcacaaacucuccgcucucucuguuagcuugucauguagcgauaggaaaaagaagagccagcaagcuucacgccuucugaaaaccgcuuagagacgcgauuuggccggcggaaauauuuuucuuugcuuggcccccucugugacgcuccuccccgcgccccgccuuguguucgcccggguguaaacaguccauugaauuaagcccuagcggagcccagcggaccgacccaaguccccgagggcgacggguagaagggauuggcugaaaaguucggcuucucggagugcgacuggccgaggacccgauuucccuucccaagcgcggaggcaguggcaguaacuccagccucggcgcuggccuucaguccuccaacggcgcccuuaccuggcccgcgcaccuccacuuccgggcggcccguuuccccccuggagccccugccuggggaugguccgcuccgggcccgggcugccuccgggaccgagcagcgcgggagguggcggcccgagcccggcguguagcggauccuucugcugccgcggcgcucgcuggggaagccugggcuccuaggcucccguggcuuuccacguguucgcgccagcugagcccuuuacauaaccucuuuacauaagcugcaccucccgccggcgcccgggccagcggagacuccugguggcccaucccccgggacgccagccgagugagcccugcaccgcccgguccugcaaaggucgacggagcagccgcagccgagcgcaccggcacgccuugccgggacccaaucacuggcgagaacacccagccaacaaaaaauaggcgcgaaauucccgugauccgcggcgggcuccgggucuccgcagcggcccgcgcaucacuaucccuucucgccugaucugcgugaagaccaaccguccgcaguaggcgccuaauaaauacugacugggugauugucuuggucguuugauucauagcucuguccugggaaccucagggacuggguuggaaucccgaccuucccuucuaccagcccagugaucuugugcaaaucauugacccacccugagcauccguuuaucuaaugauccucugcaaaauggauagaaugggcuuuaauucccaggaaugauagacccaaaugaaauaccuagauggaggcuaauuggguguggggcuguuaguacccaaagcucccauu

SEQ ID NO: 13400 - RNA, 12845 nt, Homo sapiens
cuaucugcuaaagucuucucucugaccugagauacuuguuuucucuguaggaacuuuccgcuguacuuuuugccauacagagguagaagaggaugaaucagcaaugcccaaaaaagaugcacgcacacuuuuggcaagguuuaaugaacaaauugagcccauuuaugcauugcuucgggagacagaggaugugaacuuggccuaugaaauacuugagccagaacccacagaaaucccagcccugaaacagaggugaguguaggcccugugcucuuacuaagaacacauuucaaccuguucuuguuuuaacuaccuguaccuuggagaacaagaguggguaauuuacuaggagacucaagacuguaauguuacguagguucucaguugugccacauuugucugauuaacgugugccugugaugaaauucguuuguucuaaaugcagaacacuguggacuucaggcaaaaaucuuuaaauauuuagguuugacuucaaguacucauucugcuugggacugcagcaacucagccaauuguuagcuaauccuaaauuaguugugccgcuuggggauauuugaauuuuccuagccagcuucugaaggcugaaggccuuuaaggaauucagcauuuucuuuuuuguuuuugaagcauuuuaaucaccuuuauuucuuaguuguaauugcaacuuccuugaaaguaaaguauagcugguguuaccuauggguuaauacuccuaacaguggcucccuauuuuuaucaguguucccuaauguuugaauuucagagguaaccuuaguuuugccaugccagaaaaggugguuuauauucuuucuugaaaagcauaaaugaaaauuggggucagggagugcucuccuacucuacccuuuuuuuucucucccucuucccagcaucaaguaagggauaucuuuauuuaaccuucacuucacccacucccuuccaaagagcucaacaaucaggcuguauuuguauaguuuuuaggagcauucuuaguauuuuauuuccugugguacugauguuacagaauagccaguccugaguaaauugggcuccuuuuagaugguucaaagcaauccaauucuacagaaaauuuuguaucuguaagaguuaugaauuuucuaauccaguaccgugugucaguuaggaugccuuugccugugauaacagaauauccagcucuaguuggaauuagaauccagucuagcaguagauugaacaauaagaaaauuugucuugcaugacuagaagucuugaaguaguacaguucaaaacugguuaauuucacagcucaauuauaucuucagggaucuagauuuguuccaucuuuauacucugcugaacucagccuguugauuauccucuugggaccaugaggggagcuagucuaauauggccauguauuucuagguaucacgugcagaugacaauguccaaaugcagaaaaagggaccgucccuuccuuguguccuauuuuaaaacugaagaaagguuucccagagggcucccuaggauacucuauuuauccccugaugucucacuggcugcaauuguuuuauaugcauauuucuaaaccagcagcuggcaaaggaaaugagaucacaugacugguacuuagacuaguuaagguuuaccuucuaggacuggggaaggucccagaguucuuuggagcaaauugccauugguauuuuaauaaaaccaauaagcaaagaaagaaaggagccacaguugauaggaaacuaauaacaucuguaucacagauagccuuaacuuuugguacugguuauuuauuucuuuuuguguaagaaaaggaauuccucuuuugaaaaaggaauuuuucuuuuuguaucuuuuucaguccuuuuaaguuauauuguagcucuaacauacaagcuuaugagggaaauugauuuuacaaaaauacaaaauuuucuaagcuuauggauuauuucauguugaaguaugcgucaguguaguaucugauugcuuccuacacaauauacuaucugaauuauucugauguuuccucuccuaccuguaguuauuuguccuguuuaucaagaugcuuccccacuacaauagcauucagucaccaccaccacuggcuuccugucucuaauguucuccaccuaccacaauccagcuccccuuccaggaucuuuauuuccauaucccccacucacugcaggccuuggaugagucuuagugguacagugacaccagaggcccaacagcagcucucuguaucaagucaucuucuucuuaucaggaaugauggugacuccagggaugaagaagaaccaggaaauagaggaaauaaacugaucaggaaaaaaggauacccaaaaaucuggucauuaagaaaaaagggaggaaauggaggcagacaagaaagacagaaugggguuccuagagcugccagccagaccaaaguaaaaucauuuccacguggucaggaaaaaaaccauuagguuagaagauguuacccagguuauaauguccccaccaaagcauuugacaaauuccacugcuuggauauaacauccuggaggugguauugauuuggccuuucuguacuauaggaguaugaaguuuugaaauggcccauccugccccaaggauguaauaguccauccugccucaguacaagagaagaggcaucaauagaaugguaugggaacucagagaugauagcuuuucuuuuuuuaaauaaguggcaauauuauuaguuugauuacugaucuguaaucaguuaaauucuagcuugucccuagaucagaaacuaggggcuaccucugcagaacugucaguaggccuaacccaagaauugauggacaauucuauccuuucagcaagucaaccuauugaugagauauaaaaaucuuccuaucuuucuagaguggaauuccuugcuaguaaccuucccuuuuucaucaucucuuaacacuuaccuuaaagauuuuuaaaaauuuaguuuugaaauaauauuccccucucaucucugaguaagaguuguaucuuuuaaaaguucuaaaauuuauuaaauaauauaaaaagauucaaacaugaauugucauuuuugucaucuucaauuaaaauuguuccaaauuuuaaaauuuguuugacuuauggucaaaugucugcugccucaaacuagaauaaaacccaucuugaauuucuaugacagaauacuaaaaacaaaagacuuuuuaaaaguacucuuguguuaacauuuauuuuaauucuguucuuuucucucuagcuuucuuguuuuucucaaaguacuccucauaccuucauaagacagucuuuguagucaaugcuaaagauagagaauagagaaaaacucuguguucaggauuauauauaaagagaagcaguaaccucagagugagugagucauuuaagucugaaucaaggaaagauaaggaugugguuggccagaucagagaaauaugccuauucugucucucccagguggguuuagcuaacucagggagaaacauuuugggguggcagauauauagagcaggcucagcacaucaagauggggauguuggcugaggauagaagaggcauugaaaggagucagagagacaaaugggugugagaggagaggccagaauguagaauaagcacagaaacauaaaaaaccagaucagaccaagagaaaagagaaaguaaagugaaugcugaagaagagaaaaguucgaaaagccaaccuauacaaaguaagcagcaucauauuacagugaaggcagccacauagccuuuaaaagaccacacagaacagauagaagauagagaaugacuagggacaguuaaugguuaaauugagaugaacaagaaaugauacacaaaguaacaucaaugaaugcagaaagaaauagcagagagaaaccaguuaugugcaauuguagcauaagacuucagaauauagcaaaaaaaaaaaaaaaauagauggauuggauauauuuacagagagaugccucauaggucuagacuuagaguggagagcaaauaacugguagaaaguaggagcagugaggaggcaaaagaagugauugagacauggaacagguagaacaggcaccgggaagaaaaaggcugugggagaaagugguuuacaaaguagcccugggcacagagguggaauaaugaaaaguaugcaaacgcaguaccuggaaggcauggauuaaaugacuggaucaguguggacugggcaacuggagauaacauuauuuuuuuguugcacaaguagcauggcccuauagauauccagaggcaggacaggauaggugggaugagcuaagcccaaguuuaccuccagaggauggucagaaacacaguguaauuuagggaaagaugugaugggcuaaucagauacacggacacagaccucagcuaaguaugaguuagaaaaccccaguagauaagaaguggacccagaacaagugaagaguaagggaguaagcagagaugaaguaagacaaaagugaaggcaaaauagugaauggcuuaggaggaaagacuaaugaaguauuuauuagauucagaaugagucggggcuccacacaggagauaauucaggauccauggaaaagagugagaaaaacggacgaaaaauaaaggagaaacgugagaccaggucagucauggacacugaaagaaacacccaaaagguuuggagugagcaggcaguucaagaaacaugaagaugguuacaggauaaaaaauagcuggacagagcgggagguggagaagcauacguagaaguugaaguggaaagcaucaguagcaggcagagaaaggcaugagcucagacagagaaucaggcauauucgaaagaauuuggaacagauugagagugaaacaggcagauaaaauggggaaccaucagaaauacugaaaacuuggccuaacacagagguuggggggaacuuaagugacuagaagauaaggaaaugaucagacauggaacaggcuaacagacaaagaagaucgugggugguaaaaguaaaaagcaaaauaaaauagacugagaaaaacagaccauuguuacugcagaguagaaucagugguuggagauggauacagaguaucagcauagauguggagauagaaacauacaacuacauagaaaagcagcuaguuugugcagaggguuauaccuuacugcaugaguggugggagaagaacguugguugaggucaggcuuuguagaauaguuuucuagcuuuuuccaugaucagcacacaaaagaaaggaaaaagcacacagaaccacuuugaauuguucuggguugagcugagauaacauuuuuaaaaauacaauguguuuuguuuuuguuuuuuaaacaaaauacugggagagauuuuugucagacuaguggcuuuaaguagaugaugucaccauaucacuuucuccuucuccaaguauuaauagauuuauugaaacaucuuaaaucuauaaaaccucagucauuuauauacaucagaggaucccauguuugaggaacuuaaauauaaauaugauguguuuuucuaacgcauacaacuuuuacccugagguauagaagcacuuucuuggaauuguuaaagcaugugugcaugauugcuagguagcauuuacauguaguauuucaguaauugccucccuagcugcccuucuuuuccaacaccaagacauuaauuuuucuucuuccuguacuccucuauucuuuuuauauagcaaggaccaugcagcaacuacugcuggagcugcuagccuagcaggugggcaccaccgggaagcaugggccaccaaagguccuuccuaugaagacuuauacacucagaauguugucauuaacauggaugaccaagaagaucuucaucgagccucacuggaagggaaaucugccaaagagaggccuauuugguugagagaaagcacuguccaaggggcauaugguucugaagauaugaaagaagguaagaguagaagucaguaaaauggaugugucuuagguucuguagaacaugaacuuggcuuagugggaaacugccugggcaauucuggaucuguucuacagaacaauuaauugcauuauauuaggaaguaagaaauugaacaauaagauaaaaaccaacuaguauacuuccauugcccuucaacuuagugaaaauaacaaauagccuuuuaaauuuucauuuuuagauuugaaaaauugucaucuuuuuaucuuaauuucuuggaaaaaugcuaucuguuguuuucaagguagccauacucaccuuuccuuuaaucuuauauuacccugacuuauaugcauuuaauuuuucugaauugggagccaaaacuauacgcuaccccaaacuuuauguuuucucuucauaaauaccaaggaguguaugcuaccugaaauagauacaaagagaccacaugaauaaaggauugagcauucucacaguccaagacgguuagcagaacuuuguucuagaggauuuuggaaauuucugaggcauaaaggguuaagaauugcauacuaaucuucggaaguuagagaacugcaagauuuuacuuucuaaguuuuagucuaaguuacugcauucaagacuuugagugaugaugguuuaggaguauguagaaaaugggaggcaaaaauggaugacgaugacucaagcuggaaaguagagaggaagggugucucuauuucuugcugaauuuuaucaguguaacaaucaaugugccgcuacucccaaguuaauauaucauuacuaacauaucacgugaguuuggugauauguuagugccaaagaauaaucaguagcugaaaaccacuuguuuuuuggcguuucuccuagccucuuuucccuucauaauuagcauuuaguauauguauauacuagaaauugugaagguaacguggaguuugguagugaugguaaagcagcuaauaccucuacugugauucucuuugauauauuaauuuuaauaagaaaagguuuuccaaggcaaccauacuuuacccuccuucuuccucacugauuagccugccauguuaguuuuuuugacggagucucgcucuguugccuagguuggaguacaguggugcgaucuuggcucacugaaaccucugcuuuccguguucaagugauucucuugccucagccuccugaguagcuggaauugggcgcaagccaccauggccagcuaauuuuuguauuuuuaguagagacgggguuuugccauguuguccaggcuggucucaaacuccugaccucaagugaucugccugccucggccucccaaagugcugggauuacaggcaugagccacugugcccagccuguuguguuauuuagauugaaguuguuuuagauuauacaguaguuaggcuauacuacuacuuaauaaauuuguuuuccccaacuuggcuucuugccuguucuuaaagcagccuucuuuucuuugaacuuaggaagaaaacugaauaaaauaaaauuauuauuaaccaacauuauauauuaagcucauaaguuuaacauucuaguuuacaguuccuaaaaugauagaauaugaaucauaugggccuuaaauaaguuaucuggucuacuuaaguuuuguaaauauuuauuucugcauaaaauaggauaguauguugucaugucugaauuuauccuaaguuucuugauaguagagcagacucuauccagugaauguaugaagugggucuuaacacuugauuuuccucaaacuucaagucauguugauaucuuucacaauuguaucgacuucaaucauguucucauuacuauacugaagaaaguucuaauuccuuuugauucuguuuuccuuaaacaguucucuuuuccacugcugccaccuccuacaguuuuuguuuauuuuugucuuuuucuggaccaucucuaauuguaauauacuuuacuugagacauagugaccagaaugauacauguuguucaugcauggauucaccauugauuugaguuuuauuuccaguaucuuucugguuuuuacuugagauuuuguuuguugcuuugguucuggaagcauguuaagaccaaaaacuucuagaaacacguagagguacuuuuuagguucuucugugccuugaauccaauagcuuggaucauaucuuucaguauauuuuagauuauuuuucugcaggcugauuuucuugcacuugcugaaauagaaauagaucugcuacuuuucugcccacguauacaaccuucagcucuuccuauauuuuuuugcugcaacuuggccuuucaguacccacaauugcuuagcaucaauuccgugaauauaguuucccaguauacaucuucuuuguaauuuauaacucuguugaaaaaggcuguuccuagaaccacuguuucuacuuuaccauccagaaauuugcucauuuauccuuguuuuuuguuuucugucuucaucuguaacagaauaauucuuuuuucuccaaaccucucaagacccuugucagaaaucuguuacgugugacuuaauuuaguuuacaaaacuaauuuucuuuuucccuaauuuaauacuuaaacauuaaucaaaauacuguguugauauuauuaaacuauuuggaacauucuuuuagaagcaauuauugucuuaaaggcuugcaugcauuccuuaccuucuuuucuuucuguuguagugcugcauuggcaguaagcucuaaggaggagguucagccuuugacaauauuuugaaguaguuaaguuugauuuuaacucucauuuugacagucauguuaucaaaagccucuuuucucugaccuaaacuuuuaacuugucugcuucuguuucccuuucucucucuuaucugcucaguaucucauuuuaggaguucugugccuucuaaaauguccagggauuuagcuaauucauuuuaauguguuaaugagaagaugcuuucacuuuauccauagucagaauugaccauuucugagucuucucuugaugacgaugaugauagauaacacuauucuaagugccaggcccauucuagacacuucacagacauucacuuaauccccacaguaaucuagugaaguaaauacuauuuucccccuuucuguacuugagaaaauugaagcggagagaugaaauaacuuggccagaaucauacagcuaaauaguguuaggauuugaaucagggagucagguuccaaacaauacuuuuaaucuuuuuauguauuuuaaauggcaguauguuugguaguaguaucagaaugcagaaugcagaugguuuucuuaaauauuucaucugcaguauaucagguaagauauguacacaaaaugauaggagguguguggugagagaagcuucauuccuaaaauuagauucuuuuuuuauaaagaguuuuaaguaugcuuaguuugcuucaugaaaauaaaacucacauuuauucacucauuugucagauguuuauucagugccuaacagaguggcagguacuauuuagguaaaugggauauauccaugaauaaacaagauaaauaucuguugugguagaaccuacauccuuggaaagggggugacaaagacaauagauguaaguuauucauuauguuaggaaauaagugcuaugggggaaaaauagagcauugggaauguagggauaggauacauuuaaaagguaacauuugaauaaagacaugaaagauggaagggaguuagcugugugaguaccuaaaggaaaaauauuccaggcagagggaacagguaaugcaaaggcccugagguaggagugugucugauauguacaaggaauaccauggaggcuacuguggcuagacaagaaugagcaggggaaagaaguaagagguagaugaucaggaaggauuccagaugaugugggacccuauaggccauugcaaagcuuuuggcuuuuaccuugagugagauaaagagccauguuuugauuuucuguuaugccagcuacucuagucgauucuucauagacauuaucuuauauguuuuuauucagaaccuuagaaaguagaugcuuuuaucaccucauuuuacagaaaaagguauugaaguuuagagauuaaauaacuugcccaagaugcuuguguguagaagaaccaggauucaaaucuaugcuauaauacucuuaaagccaauguacuugaccauuaugcuacuuaagcuccaguuuguaagaaauauuuugaauauuuuauggauagcagcucaaaaauggaaccagugaagucuguuauuuuaucguauuauuuaaauauauguuaaaauauugucuauaugcuauaaagaaaugccauuuauauuuaaggauauugacuuucugaguuuuacuccccagggggcauagauauggacgcauuucaggagcgugaggaaggccaugcugggccugaugacaacgaagaggucaugcgagcacugcucauucacgagaaaaagacuuccucugccauggcugguucagugggggcagcugcuccagugaccgcugccaauggcagugacucagaaagcgagaccagugagucagaugaugauucuccaccccguccggcagcuguggcugugcauaaacgagaagaggaugaagaggaagaugacgaguuugaagaaguagcagaugaccccauugucaugguggcuggccguccguucuccuacagugaagugagccaacggccagagcuaguggcccagaugacaccagaagaaaaggaagcauauauagcaaugggacaacgcauguuugaggaccucuuugagugagcuuucccuaauucuuucuccuuucucuaaugcucaguucaaaaaggaaugucucaucuuugaagaaaaguauuuaaguggcuuucugccccucuugauguaagcaacuguccauccuugugcaaagauugaugguagagaguuugacuuuuaugccagaaacuuucccagcaagguagggugcugagaauccuacccuuccuugcugucacuacaguauuaauauuuuacuguauuuucuuuucuuuuuuuuuuuuuuuuggagaugaagucucacucuuguaccccaggcuggagugcaauggcgugaucucggcucacugcaaccucugccuccuggguucaagcgauucuccugccucagccucccgaguagcugggauuacaggugccugccaccaugccuggcuaauuuuuguauuuuuaguagaggcaggguuucaccauguuagccaggaugaucucgaucuccugaccucaugauccacccgccucggccucccaaagugcuguauuuucuuaucugauuuuuuucuugccuuauuaagacauaauuuucucccuucugaaaugagugagggaaguucauaagguaaauccuucccauccaucuguuuacuacaauagguuacaauaauucacugaucacauccauuuuaucuguucuagccaggcauuccaaacaauuucuuauacugcugcccaccaaagcagcuugccaacagucaaaucacugauugggggaaaaaauccugaaauuuugcuuagaauuugagcauuuccucaaaauugagauggaucaauauguaaggggaggugggagcguguguggaagggggagagauauacuugagucuuaugauuaaugucuaaaccagaauuugugucuuuagaacugaccagacugguagauuuuauuguauugcuuaaugucuuuugguuuggauuuaggaugauagaaaacagaaguauaauugguaaacccuuaggaagaaauuagaaaaacauggacguaagacaagaagucucugugaaggguugaagagugacaagcauugguaacagugccuuagaacugugucaguuagucugauuuggaaauccuuuauguaaagcugagacugguccugguuuuguucccuuuggguacagaccucuugucagugcuauaaauuguuuaaugaggccauuccagcagaaaucaacagaauaauugauuacucuucucucucucugucacucucccucuuucuaaacaucauugaaggcugucucucuuuuaauuuuugucagacacaguauuuuagggugcauccaguauaccauugagcauuguaaccucaggaaacaguuuauuuuggguucugauauguagcaugguauuuucccuaaggcagaacuuuaaaaauaaagaacuuucacacaagggucuguaacaauuguauaucuuacaauauuuuuccuugcauuguaauuuuuaaguauuuaucauuuuauaguacacauguaaagaauauaugagccuuguauggagugauguuucauuuaccuggguuguguuaaugacugaauguugacaauaaaucuguuuuauacugacugaaguuuguucauuuuaaguucuguaacaucuuggggcauauuaaaaugaauauucuucccauuaaaaaaauguuaaagacuuuuuuauuagucauauuucaaaugauagaugcauaugggaucuaaacuuuuugugcaauaagaugccuuuguaccuuguauacguaaaguauucaacuuuuacacuugaucuuagccaaaagaccaagaagcaaugcucuucagcuuuuaaacauuguuuuuuaaacuuuuauaguucuagaaguuaauuuaaauaaaaugguaaucagauguuaauuuuuaaaauguaguuaauuuuuuaaacuauuuuuuguaaguguguucauguauauguagaauucguguuaugggaaaaugucacaagugaauauggagguaagaauaaagguauucauugcagcaguauuugaaauagaauagaaagauaga

SEQ ID NO: 13401 - RNA, 800 nt, Homo sapiens
uuuugggaauucauauuguuuuugauuuuucguaacuguaaaucaggcaaugcuggauaauuugcguaaaaguauuuuuuauuuggcguuucuaaguuuuuaggagcaacaaucaugauucaaaggcaggggcuggaaagaaggaaacugucauuuauugaacgaggcgugugcaugaccuaucucuggaagucuguauauaacgaauuggccaguuugguugccuguggggaaaggaaccugguuugagaggaguagaaaaggaagggagaauuuucacugaauaccauuuagaaccuuuuaaauauuaagccuggcgcagguggcucacgccuguaaucccagcacuuugggaggccgaggcgggcggaucaccugaggucgggaguucgagaccagccuaaccaacauggagaaaccccgucucuacuaaaaauacaaaauuagccggucgugguggcgcaugcguguaaucccagcuacuugggaggcugaggcaggagaauagcuugaacccgggaggcggagguugcagugagccgagaccacgaaauuccaucucaaaauaaauaaauaaauaaauauugaaccauuaagcgccuuaccuaguuaaaauuaauugcauuuaaaaaaagugugaaauaauguguguuuuuaaaaaaaaccccaucaaauccacacgggggcagcauugcuuuacagggaggaagggagccgcaaaggcgugggcucagccuuagcaugggugcugggaucgugacuuacauuuuuuucucauuuucuguauuguccccauuuuc

SEQ ID NO: 13402 - RNA, 9236 nt, Homo sapiens
agauccauaggugcaauuauaauguucucuuaagaguuuauuauaaaccaguuucauaggccacaaggagauaaaaggacuauguacagccuuacgggaaacaggcagggagcugaggagggccaagaugagucuagggccuuggugggcgcauucccgggggagggggcccuguaagggaaaccagacaaucccaugagacuccacgaacaacagcauaagaaacaaacaggucugugguaacguggcccugaggaaucgagcccacgccucugcggagcuacuuccauacucuguggccaagggucaaagaaggccugaaguaagaguaagaaguuuagucagugccugaucugcaacuugaauccccaacccugccccagccucccacgcccugcaguaaucgagugaggagagggguauacauggcauaugugcuaacuagggacuacucugaggcugacuggguuccuaugucuauaaaaacccauagaggaauaauccagacuagagaaacaggggucaccaaguuugcccauggguuaucuuauagggaaagaacacugggcuuggaguccaaacucccugggggccuauuuucucauccauguggggacugaucucagaauuucuccaacugaaguuaaagagaaauccauaauaguacagcaaagcccagagcccccucuuaauuacuaggcacugucaaaccaaagagcauaagacaaucucauaacuucuguuagggauccucagaaugcauuauuucauuguguccugaggccgcugccuuagauauugagaaacacccugggugcauggcugcucuaacuuuucuaagaggggagguaagcccaauuuaagaaauguucccucuucucuuuccuuucuggauuucccuagauuuaaggcuugaaagcccaugggauaugaucuaaaugcaaucuucccuccauuuccuaucccacuaggcucuagggaaagaagccaaagucaccacugcaggcacuuaccucgcaucccagggggaggaggccgcauucccggagggggcaugcccauuggagucccucuuccaggggggauccccauugggggacccauaggaggucucauaccaggaggugggcccaucaugccugcaagagaaaagccccaagaauauagcucaagugucuaucuugaaaagguagcaaaaaaacuacaaagcuuuccaccaaguucugagauagauggaccauuccacccucucagcagcucccagaaaacugacauuugagccuaacacccagggcucccaauggcucuuguccaccuagucucaucagucagccacgcuggaucucagaguaauccugcuuaauuauacaaacucaucaucagcuucagucaagguuauaucucaucauuaauccagcuaaggcaucuucuaucaauuagcacuggucuccuuaugggcuccucaccuggagggggugcuccucggcccauaggugggggaggacccccacggccagguggguacuggguuggagccccggcaauacuggcuguggcagcagcugcagcggcugcaacaguaccucuuccuuguggggucaucaccuaagaggacauaagaagaaagaguuagaagaguacaguacaaugcagcuucccacucuccuccccaacuuggggaaggacagugggaaauaacagacaccaaaucccuuaaugcuacaacucucagcaccagacuucccauccaaaaccacaugucgggaaagaucaagcuugaaugcccaacucccaucuucuagaccugaauguaagcauguccaauccaagugagagaaggcaacugcauuuucaaauaugacucaugauuucaaaugcugucauggaaauauuuuccuuaaauacaguuggcuaauucguacaucucuuuaauagcaucaacauaauuuacaauggcaacuuauccuuuucacuugcuucuagggccauguauaaaccacagugaaacacugauagucugacaaucacagguuggucacucuggacccuuuuaaaacuauggacccuccccuuuauccuuuauuuuagccaccaggaggugguacccuuuccccaacuccucaccuguugggauggcccgccaaccccacggacuggcccagcaaguccugcaggagccuggggcaugggaaccccagcugggauuccucugccagcagcccugccgaucccugggcccccggcagcuccagcaaguggaacucgagcaauaccagucugaaaaauaaacaaauaugcucugaugcccagugaucugaagaucagaaguauacuuuggaauaucauugccaagagagccccucgaaauagcuuauaaauacuaucgaaauagcuuauaaauacuaccucuccaugugugccaacaccauucuuccuccauccaagacuaugaguuaucccugaagcaggguagaacuuaagaguaagucuagagaaacaugccacaacucaaccaccuauaugcacuccugugaaaguuaaaccaagagcaaagggccaggguuccacucaggguucagcaggcaaggcauuaaagggacaugagauccauucccagcugauucuaauccgcuaggugacaauggacaaauaaucccacaaucccgggcugaguugccuuaucugcaaaugacaugguuaugguacaacugguugugaucacaaagguuuaugauggguuauguuagaccagccaauucuacuggaaguagguacuaagagauuugaauauguacauggacuuugaaccaagauaugcuaacaucccuugcagacauuuuuaacuggaaaaggcaaaaacguaaaaaucuccaaaaaagaaaaugauuaggauaaacuacucuguacucauuugagaaaaucucagucauuaacuugacuuuaaaaguguugagcaacuagaaaaauguuaacauuaagugaaaacacagaacaacauaauauaugcccacuauguguuaaguacaaaaaaauccagauaauauauguggauuuuuaaaaaguuaaaaggauuauucucuuuugauuaaaauaacgucuuggcagggcgugguggcucacaucuguaauccccgcuacucgggaggcugaggcaggagaaucacuugaacccgggaggcagagguugcaauaagccaagaucgugccacugcacuccagccuggcgacagagcgagacuccaucuaaaaaucuaaaaaaaaaaaaaaaaaaaacccuucaaaugaaaaagggaaagggaaaacaaauuugacuaggucucuaaagccugcucuauuucuauguguagcuugguguuuacagaaucaagacugucugagaucaaaugucaguuucaccacuuaguggcuguggcaccuugggcaaguuacuaagcccugguuuauucuauuuauaagaugagaauuuaucucuaaagagaccuaaaggaucaaauaaaauacugaagugguuggcgcaagguagauucucaguaacuaugaacuguaacuguacaaaacaaaauacacacauuuccuauuguuucggaguuacaacuuuuuaaggucuaccuaggcuuugucgucacauuaagaacugacccagauggcuucaggugcuuccuccacugacucacuauguacaucaacugagaaacagguagagcuuuaaagucugagauacccaaauucuaguuccccuuuuccacuucuuucuugcaggguaaccucuuuuuuuuuuuuuugucuuuuuuuuuuucuuccuuuuucuggagaauggggucucgcuauauugcccaggcaggucucgaacuccugggcucaagcuauccucccgccucuugccucccugagagcugggauuacagaugugagccaccgcgcccggccucuugcaggguaaccucuuuaagauuucauuuauuaucugaaaaagggggcaaaauccagaggaugccugugagaacugcaaugaaacagaaucuaacacagagccuggcucacaguagggccuccccuccuccacaaggcuuccugcucugacuuacaucuuugggaggaggucccucuacugucauugagaccagauucuccccucgcagcagcaccagaccgaggacucgcuucucuucccuuucugcuuguuuggaguucuuuggccuaaagagagguuuagaaggaacaaaaaaaguguuagagguggguaaaguucaccugccuaguggccuccaagauuugcuuauacugcaucuccuaacaaacaguacacaaacuuucccaagauagcccuccuggauagucucuacaggcugaacacauaaccucuuagguggcuaucuaccuguuuccuaccaugccaagaggacacacugaccaagagauaggacaaggucaacaaagcccagcccgggcccaaaugcuauuccacagcaaccgugaaggcccuucccucagccaagucuucuuucuuaggacccuauucccucccuucagcuuaaggucuugccaacaucaggaggcugccuaaacaauuccaaucaaaugacucccacccaccucacuuacgugcaguguccuucuaauaucaauucaaccucacaggccuauaauucugccccucaucuuacaucagaaauaggagaagccauagaaggaaaagguuaagagaaauuucacauacacagaaauugaaauuucauaucuguuccucaaaagcauaaaaacagaaacccccaaaaagcaacaaccagaaaaagaugaacaaaauauaaaugugaaguaggaaaaauaacugcaacaggauaggaaaguggggaaaaaagcuaaagcuagauccuaaaaauaaaggggaaaaaauagccugauuuaaaaaaagaacucaaaagauuuuguuuugauauuuuacaguauauuaacugguugucuguggauggacaguuuuucccuuuuuuggcucacauuuucuuauuuuuuaaaauaauaaccauguauuguccuuucauaauuagaaaaaaacccuucgggguauuuuaguuucuauucauagacuucuuuguauuuucaaaaauauuuuccaauaaacauuuuuuauaaucaggagggaacuuuggaguagcuccacgcucaucuguuggccccucucuaauacguaccuggcaccaaggcaucccuaccacauuuuuaaacuauacuucuugaccuugggucacagaagaaaucagccccaaggagaaucaaagggaauucaaagugagugacagaauaauauggacacugcauaugacaaaagagcugcuggccacggaagucacaucaucuuuuugugccucaaguagccuugaauguaaaacaugaugggaagcuaaaucauaucuuuuaaugggccaaaagcuuaagaucugugagacucaaggcaagggaguuagccaauaacuuacggaauuguagcaaaguagacaauaucuccaauuguuuguauaaaugccaacaaaaaucacuggccccaaacccacauggggagcugagcacuuacccugaagagggucagaggcuucuuaaagcaguuucagaccaggcugcauugggagagcccuuuaggcuacagcuuuacaaauaggcaaugaggccagaaacucaagcucuccccccucacacaccuguggggagaacaugagagcccuuuaccccaguacccaggggcacgcaaagugagagaaacaaaaagccuagcagcccuucacaacuuguacuuugcuagacuagagagcaagguuugcuggacucaaaaagauuucuuagcguucaauguccccauuuaagucugcccucuaaaacuggagaauaaacagagaagaaccaacuagcuacaucaccaccucuauugcuuggcccacccacucaauccauucccauccuccagucuccgccccccacaguccacuccucacuugaucuuucugaacucaucacagucacagaggaucaaauucaugugcuugucaaaagccuugaaggugccaaugaagauccggccguccugcaggaugcaccucauccuguaaucaauaugcugcagcaucuugcugcucuugcccaccgucugcaaggagaaauggacagggaugagacucugcucuuuuggacccaagcaccucuggcccuccccaaaacuucccauggcguucuuguccauguguccaacuuucucaacagauucuuagcucagucucccacccacagccuuuuccuaggaauucucccaugccacccuguuuuagcccugaccucuacccaguaaucugcuauucucucuucccuugaaaucggucuuucucauauuauaauugccuuucuccuugucgugucaguugcagggaugagaguauaggguguccccaaaauaauccaaugcauacauacuagagccaucuaccagugugcagauuauagauaugugacucaagugcuauggaacauucaaaucucauuaaaaacacugaguaaaggaagagcuagaauagggcugaaacuaaaaaucuaaucaacaagaagcuuguuaucaggaaggagaucagcuucaaggugaaaaaugaaauccacauaucaagaauuuguuagugugccuccaagacuauauuuggcagagggaaacuucugaugguuagggugcuaaccaguuuggacauauaauggucuuuaacccaacaaacauuucugcuuucauaaccuggguuccaaugugcuaaaauaaagaagugacuauauagguaucacuuugugaacugucagguacccuaagcaguuguauuucucucuauaaacaaaucaccuggcauuugaucuguauaucauccucccaucagucugacugcuauacccaaguccuaacccaccaagugccuucuauggacaucuguucaucucugugagcucagacaacaaaguucugaaccugcaaauaugcagaucaaaaccuugacuccauggccgggcucaguggcucacuccugcaaucccggcauuuugggaggccgaggugggcagaacaccuuaggucaggaguucaagaccagccuggcuaacauggcgaagccccgucucuacuaaaauuacaaaaauuagccacacgugguggcaggugccuguaaucccagcuacucgggagacugagaugggagaaucgcuugaaccugggagguggaggcugcagugaacugagaucaugccacugcacuccagccugggugacagggaaagacuccaucucaaaaaaacaaaaacaaaacuugacuccacacaaagauacugcgagccucccucagguuaggugguucaguuuccauucaaugaccauuuuaaccagcuucuaaccacaagggaucugaaccuuuagggcaacauucacugguccagcucaacuaauguuuacugggugcucacuguguaucuggcacugugauaagcacaguacaucucauuuaauccccaaaauugggcccauuauuaucccuauuuuacagaugaggucacugaggcuaggagagguuaaguaacuugcccaguuucacagcugggaagcuguguuggaaccuagacaaaaugaauccagcgccuauucuaaccaguuauccaaacaauauccuaccagguuucccugcuuccagucccaucgaauauacaugccagagcuagagcaaucuuucuaaacaccacuaagcuuaugucauuuugcugguuaaaauccuucagugggcagggugugguggcucacggcuguaaucccagcacuuugggaggccaagguggguggauuaacugaggucaggaguucgagaccagucuggccaacauggugaaaccccgucucuacuaaaaauacaaaaaauuagccaagugugguggcggguaccuacaaucccagcuacuugggaggcugaggcaggagaaucgcuugaacccgggagguggaguuugcagugaacccugaucgauccaccgcacuccagccugggcaacaaaagcaaaacuccgucucaaaaaaauaaaaauaaauuaaauuaaauccuucaaugacaugccucaccaccacugagguaaaauuaacaugcaaggccuuuaguaacuagccuccugccaauucuucccgucuucccuucuuucuuccuuucuccuccagcaacuuuuucucagucaacaaacgcagaaaaauccaguaacuuuuuaaaucuuguuacccuucagccuuuguuccuucaguucuccgggucuguaauauuccccccauuuucgccgggaacauucuugcuaaucuuuuaggaaucugcucaggaaccaucuauuugagaaaacauucuuaccccgccccgcugccguuacuuuuaccgaaugaccacacugaauuauauuauguguccccagcuaccucugugaaggaagcaaacauauuucagagaguagccccagcgccugagaagucaggcacaggcaaacacggaaacgugaugagcaacugaguggagcucuuccuccauucgccaucacccuccuccgcccuccucuccauccagcagaccuagcgagacucuagcgugguccacgagccccuuccacccacuuccgccaacucuuucucagacucacaaacuuccgcaagucugagccuuuuaccgggucccccugcggcuccagugccugcuccgaagcccgggacauauauuuauucggcaaaaguuaacuuagugccuacugggucccaggaauuauggcuacagcggugucgagagccgcgguucuacccucgccccugccgagcgaccucggccuccgacaccgguuccaaccuuuuccucgaccccaugccuagccgaaccgccaagguccuggucuuucccgcccagaccgagcggccucggcccaggccuucaccgcccuaaguggcuccaacccacggcuuccuccccgaucagucgcgguucccacuccacaacagacucggaagcucccgcgccgccagccugugcccuccuuaccaugguggcgguucugauggcucugauacccgccggauucgccuccucagaggccuagccucucucccacagccgauuucccgccgccgcuaccggaaaugcagcaccacguaaaaugcggucggguagaaaccuacuuccgguccagcucacuagcccuggaguuccggc

SEQ ID NO: 13403 - RNA, 7058 nt, Homo sapiens
ggagcagguggggaaauuagcgggaggugucuugggggagucacaguuucuuccuguccauauccacagucuugaguaucacuccagcaugaucgcagaugcggugaagaaggugaucaaaguuggcaaggugaguugagaagaguagugcuggcuucaggauuuagaguaguucuggugucagcaccucggcacuacccucuggggaaccugaaugggggucuccuuuccccccagguccccagaacaucugcucccugacaucccugcaucccucucagggcuguucuucaucucccuucucuuggcuguuucauccucuugaucucuuuugccucuuagaucccaucugcuguucccucuuuccugcuccauccacugcccuuuucaugggccaucugaaugcagaacuugcagcucuccuuggggguggaacagcaagggauacaggcaggcugaagcaucagcuucaccuucacgccccaucuccuuuucgcugugauucuuuccuuccaccuggucuugucucuauuucuuccaaggaagguagccacauccugccucugaucugcguuucccaucaucuuugccugcucagccuccuguccugcccuggcugcagcacagcuaauaguggcuuaagaggaguggcagguccaugugcuucccauccuggcuccuccuuccauuccugugcauugccuuuuuucuggcugucacgcauucuuggcuuccauuuccucaaucacauugcccuaccucccuucaugggcucucuuuucucccuccccacggcuguugccggugguggcuguaggugcggacucgagacaugggcggcuacagcaccacaaccgacuucaucaagucugucaucggucaccugcagacuaaagggagcuagagcccuuuauuucuuccaaccuugcaaggaccacacuccccauacccuucagugcaguguaccagggaagagaccuugugccucuaagcaguggaccauggucaccuugcuggguagagccuagguuguccuugggccggcuuccuuaggggacagacuguuggguggugauggggauuguuaggauggagcccaggccacauggaugaugaugauucucccccacagguucgaaccucugacauggguggcuaugcuacuugccaugacuucacugaggcugucauugcugccuugccccacccauaggcccuguccauacccauguaagguguucaauaaagaacaugaaccaacucuugugaauuuguuuuuauuggggaacacggcacagggugggaaaugucaccuugggcuaugguaugccccaccucccagagaauguccauuugcauucuaaucuuccugggaugcuuuauggaacuuuuucuucuucuuggagcugcucuugccaaccgccucuucaggcccacugcugaccggcuccucuuuggagaauuuccucuuuuucuuggagccacuucuguggccugccuccucagggucauuaacuguuuccuccuuggguguagacuucuuccucuugggaauacuggugcugccagcggucucuucaagaucgcuacucaucaacuccuccuuggaaaaagauuucuuuuucuuggguuuggagaaagagauagaugggucuuccauuccauucuccugaggaaccuccuggggcuuuugcuuuuucuucuuuuuggguuuuucacucaucuccuaaagggaaggacaggggaacaggcugugagaacagugcucauuacaucuucagcaauuaaguagccaaggcaggggaacgcgugucguuaacauugcccaguguuucugggauaguuuaauuguguggguauaacuuuagaaauccaccccaaaggcugucccaaauuagaaggaaaacaugucaugagaaauuaccucagcccauuaaaaaaaaaaaccuaaaaaacacccaccaugcuggucgcaacagaaccaucaugccaaguuccagacagggcccugaaacacuguuuaagaaacugggugcuaaaugaaaaucucagggagaaugauuguagcuuagcacauuggggaccucccugcccccauccccacugugaaacacgaccaccuccggacacacgucugauaauaagcagagcaggaauuuacacuaccccagguugaggacuccugggaggcagccgaggacagaacacacaugcccagggaacgggugugagcuacaaccagcucucugggcucuugagcaaguucagcaccuaucuccuuccuauagaaucaagagguaguuuuagauguuucagguccuuguuucaguccaaaagccuggacucaagaccacagcuugaugcagcauauccuuuguucugcuguugaaaauccuacaaccuaggaucucugccagggccgugcugccuacugaccucacacuccucuggaguacuacugcuguuuucugaagacgcgagggcaagugcagccagccguuucuuuuccuucuuuaagcguuucuucuccuguuucuccagcuuccuaguaaucucagcagccgcuuccucugccuggucaaagaaaagugcuaaaagggccugaagacuucuggugcucugaggacuccuuucuggcuuuauuggaucaggcucauuaaaucaguuuuuuugccuccauucuacaaggucaggcucagacaguucaucaccuccaacagcuagcuaugccacuccacacccagcaaagcccaacugaccugaaccauugcuuccuucaugacauccagauucuuucgugguaucucuccagucucauagaaggacagucgcucuucaacuuguucucgaagcuucuccccgaauacacucgugggcaccucuggaugugugugggugacaaagccugucagcccaaagagagaaacuaccccaacccuguguucccucuacccucagcuucacucagacccagagucucaacacucacuaggugaacugcuguugacgaaaaauauugccaucauuguggaagcuaugguugcaagccuccccacccagccacccagccccuucucacaccugccaacgcccccccacccauaccagagaagcaaucgauucgugaggcaauacugcauuuguuugccagguaucgggagaugcggccuuuguucuuggcagcugcucggccaaugaagguggaguggaaaaugaguccauauuuuggaguguuaccccuugucuucagggcucugagagaauauucaguggagaguuuaagaucagaaauuucaaccccauuagccaaggcagcucagcuccuccccuccucucaccccgaaguccugagugagccucaggccagauuggaucucuaccccaaugcaugccaacccauagcucccagaggcagagggaaggcauccaaugucgcugaccuggaaacuuggucccuuugcugggcccugggaaucacucagacaccaggacuggccaucacccccauagcagaggccuguauaggucagggagcccuggucagccaucaccgugaucccccaacaagcagugggcaccagaaguggcaccugauugugggcaggugcccucacugguaccugaacagggccuuuucagccccaaggaucugcacuguggaugcuggauacuuggccagguuggugaggcugccagcaugugcgaugagacgugcaccuaccuggagagagagucaaggaagcagucagagaaaugaacugcugaccugcccaguugcacgacagcccugcuccccaccuccccaucaagcacaacuagggaagacauggugggucacgaaauacagcagugcaggugcacauggcaacaguccuuauucucccauuuuugaguccccugugacgcaccgcuuccccaauuagggcugacaggcugggggcuacuuggcucaucuuggagcgcagguaaguguguaggcucuggcgguauucagauaaagacaccacacgacuggagaagcucucgauguuuaucaagucaauggcagauauguccaugccuaggaaaaaccaagugugaaugcaagaggccagcuauuuagagccccauaccuuaugcagguugccaggcucugcacugacccauggaggaccgugaggcauccagaauagccuuagccuuggccccauccauugucagcuccuccagcuucuccagcuuguccucauucaguucccuucgguuuccaauaaacugggcaagacggcaguauguggcauugucguugaugaucuucaccagcuccggaaagugauacccguaccacucccugcaaagagccacagucacucccuggcccagcugcuucaucaaaaaccauagagcuacagccuugccuucuccacaccuacucugccuggaggaaaugggacaaagauccaaaucuuccucaauucuauguucccccauucacaauacagaccaggcacagggccugagcugagguguauaugggguagguuuacucuaccuccucuuucuauacagucaguguaagaacacagccugugguaagcaccaggaggccuacacccagccccagcccacaugguucuacccacaggauggucaguccucaucaagacucaaaauuaacugaacuacagaccaaaggcuccaguauuauggguggccccugcacuuuaccugacacgcauagagaagguauugauguccuuauccagcugguccaggaggcuaauggacuggaugaucauauuguccacccgguucacauuaaacuuaacuuuggcacgggaauagcugugucccagccccagcugugcuuuacaagcugacagaucggucagacccuucaccagauuguggaagugcagacgaacuccuaagaagagggcaagacggugagcaacaaggggcucugagcuagcucccgcacccacgggcaccagcccagccugaaggccuucccagaaaucacaacaagcaaccaaguuuccagaaccuccucccccaaaauguccaggauaacaggaauauaacagaugauggucucaccucgcaggaucucagcuaugacuccuccagucuggcaguuguacccuaacuccuccuguauugcggcaccaaucuugggauccccaacucccaagaguacuuucuucuuuuuggacggcaggugggucuccaagagcaggcggagguccucaugaacaaccccucaggggaaagaacacaguucccacuaacaggcugaaggacgaucaacucuaacaucccucagcugacuacccuggucccaccgagcacgcugggauggcauaccuagaucccuccccaucaggcauugcucagagacauggagacaucagugauugcacucaggggauugacagauuugauucgcaagucaucacugcaaagccuggcccagccaugggaacaacugcauucaggucugauagcacaagugggcaauaaauaauagcuuguaacacacccucgaguauuucguagaauuugccuucuggaaccaaaccuuuuuuucucagccuguguuuacccaacugcccuuuccaaucgaacagaaagcagagaaccagacacuugauuguguuuaggcaaaaccucaggcacaaguagguguuaagccgacccccuuuaagaaaccccccuuugucggccgggcaccgucgcucgcgccugcaaccucagcaccuugggaggucgaggcgggcggaucacgaggucaggagauggagacuagccuggccaacauggugaaaccccgucucuaccaaaaauacaaaauuagccgggugugguggcuggcacaggccuguaaucccaguuacucgggaggcugaggcaggagaaucgccugaaccagggaggcagagguugcagugagcccagaucuugccacugcacuccagccugggggacagacuccaucucaaaaaaaauaaaaauaaaaaauaguuugucacuacagugcccacaaggaaacguuaacacacauuccacaucgucugcuuaaacaguuuggucuagcacaguucccagaccuugagcucugugaagacaauuauuucaaauuacacauuguauggcucaaauacugccucacgccuaucagacucagagccagccaaggacggcaaauacuaucacaagcugcccgagaggauaccgaaaggaaccacaucucucugugacacuuggcgguggccgacuuaccuucagacacggcguuggcauuuuccaaggcaaccugggaugaggcaaagggacaaaaggccaccagacgaacgaugcuguggaauuugcccagguugagcacagacuccuccaccuggggggagaaagaggcuaagugguuuccuucccucccuccugccucugcggcgcagucaagcagcgguucucagccuuggaagcucuuaaaauaugcugauaccugggccccacaucccagcuucugcuuuaaucguucgggggcggcguccgggaggcuuauuucuaauugcuagagcgauucuacccaugggucaagguaaagacccccggaucuagagcuuuccaggcccguccccccgccccgaaccgcucggccggccacgugggagcgcgcugugcaugcugggacccgcgcgaugagggucugcggggccgccaaaggagcccacggaucucacccaccugcggcugcagcagacugaucuccuccacuuccuucagcgccagcagcgcguagccgaccgcgugcucaaacagcacgugcaacagcaccuggaacgggagccggggcgcgagcgucaacgcaaccucagcgucugccggaacccguucccagggcaggcgcaggcgcaggcgcaggcccaggcccaggcccaggcccugucugcggcccgaacgcaggccgaaacccccaccgucgcgucgcccgcgccccgcaaccacuccucaccauggcgccagcucccggguucggcucgcaaugcggcuagcgcgcuccggcgcgcggaaccaggcuc

SEQ ID NO: 13404 - RNA, 6170 nt, Homo sapiens
cagugaguacugguuaaaagaauaacaaacgcauugacacacaaauuuuaacagcuucccaaggauuuucucucaaucgcuuguuaagcucagguccucgucugauaaacaugacgcuacauuuuucccccuaauguuauuuugaaguuucgacguagauuaaauauggcgacugaaaacaaagcaagagacaaagugcuugcgcaucccaugaccuccccaccggcaaggaaaaggagaaacaggcgugagcaagcagugcugguuggcgcagagagagaaauaccaggaacucaguacaggccggaagucgggguacggggccgcgccagcuucaggcgucacuucccacgcgacuuccugcgggaaacauggcggcauugagcggaguccgcuggcugacccgagugaggccccgggacaugucgggcaggggcgggcgaaggagcggagaguuuguccuaggguuuccuaaacagggcaaagucaacuguaguguucggggucuggaugucucaaagcugaccuuacaggcuugugugucccuguugcaggcgcuggucuccgccgggaacccuggggcauggagaggucugaguaccucggccgcggcgcacgcugcaucgcggagccagguaugcacgaaucuggcuggggucucucuuacgacccugucccuuccucgcugcucccuccccuggcuuuuccccaccccucccgggucucccuacuucucuacucccaggauccgugcucccgccccagcucuaucuuuacuucuccccucuucccccaauugaggccgaggacgugaggguggagggcuccuuucccgugaccaugcuuccgggagacgguguggggccugagcugaugcacgccgucaaggagguguucaaggugaguggccucggggaucagacaguagaggacaguaguguguuggaaaggacuuggccuugacugugauguuuugggaaccugucucugaaggcugccgcugucccaguggaguuccaggagcaccaccugagugaggugcagaauauggcaucugaggagaagcuggagcaggugcugaguuccaugaaggagaacaaaguggccaucauugguaugugugcccucuugccacuuguccaugugccauuuaaaaucaaaugaccaaauguuuauuaagcccuucuccccacaugcuaugcaauuauauuaacuccagggcaaccaccauugguauuuggacauuuguuccuucccauugggagcccaggaguugagagaucaugucagcugucuaugcagaaaaguuccagggguucugagucuguccugaggcuacaucaacugucaucaaaucuuauucauugcauuucuggaauaccacuuuuagcugccccuuuucuuuuuuuuuuuuuccccucccuuccuuccucuuuguuucuucuugcucugucgcccaggcuggagugcaguggcgcgaucucggcucacugcaaccuccccgucccugguucaagcaauucuccugccucagccuccugaguagcugcgacuacaggugugcaccaccacacccagcuaauuuuuguguuuguuuuguuuuaagacagagucucgcucugucgcccaggcuggagugcaauguugccaucucagcucacugcaaccucugccucccggguucaagugauucuccugccucagccuccugaguagcuggcugguauuacaggagcgugccaccaugccuggcuaauuuuuguauuuuuaguagagaugggguuucaccauguuggucaggcuggucucgaacuccugaccuugugaucugcccgccuuggccucccacagugcugggauuacaagugugagccaccaugcccaggcuaauuuuuguauuuuuaguagagagaggguuuuaccauguuggccaggcuggucucgaacucuugaccucaagugauccacccaccucugcaucccaaacugcugcgauuauaggcgugagccaccgugccuagcugccccuuuucuuuugucuuccgcgcuuuaaucuccucauuugauuuuuuuggcuucuaguucugccccuauaguucaucuuccauaucucuucuuggaaagaacagccugauuuuccaggcccagccuuaccauaggaaagucaguacuuuauaaguuggcccuuaauuuucugccuugguuccacaacucuuguucugugcuucaaucacacuagauuguguguuagauuccaaauauguacuaccugacuuauauuguucccuccacccagaacguucuuucuuuggugcuaccuguuagaguccuucucacucauucacuguauuaguuucccauagcugccguaacacacuaccaugaaccugguggcuuaucauuaacagaaauguauucucucacagugcuggaggccaucagucugaaauuaagguguuggcagggcccugcucccucugaagguuuaggggagaaaccuuucuugccucuucugguggcucuugcuguuuuuugacuuguagaugcaucacuccaauaucugugguuuucuucccucucugucucgguaucauuuuucuccucaaauauuuagcccuggaugggacgauuuuuucucaagauccuuaacuuaauuacaucugcaaagccucuuuucccaaauaaggucacauacauagguucuggggcucaaggcauggcugaagugccagcucuucugugcuguauccugauauuacuggagaggauuuccucuuuguguugcuaugcaaguuucccaugguacuuaucaugucuuucauauuuucugucuuucccaguguaccguuugcuucucaagggcaggaguuguaugguuuuaguuguuauccuuauugccugacauauaauugauauucaucaguagguguuggguuaaaaaaugucaaauaaggagaaggcacagauaaaaagaucacagaucugcuagcauuguuuuucaacuuguuguuaaacccaggcucuuuuuugauaaauagaaaaaaucuguucuccguuuugaaguuucaacauaaauuaaauauguugacuaaaaauaaagcauuaaggccggggcggguggaucacuugaggucaggaguuugagaccagccuggccaacauggugagacacugccucuacuaaaaauacaaaaaauuagccaggugugguggcacaugccuguaaucccagcuacuggggaggcugaggcaggagaauugcuugaaccugggaggcagagguugcagugagcccaggucgugccacugcacuccagccugggcgacagagugagacccugugucucucacacacgcacacacacacacacacacacacacagaaaaugcaauagaugaaauguuucuggcuuuaacuacauuauucucuuuugucccuugcccccagagacaauuuaaaaguuuacugaugugggaaugggagaugggagucuggguuacaugauguuccuaaggggguuagacacuggucugaguucccuugggcuuggccuguggcugacacuccuuuucccacuuuguuuucacaggaaagauucauaccccgauggaguauaagggggagcuagccuccuaugauaugcggcugagguagguggucuggguggggugaaugguugagaggugccagggcaccaggagcagagcugauggcccugcccacccucaggcguaaguuggacuuauuugccaacguaguccaugugaagucacuuccuggguauaugacucggcacaacaaucuagaccuggugaucauucgagagcagacagaaggggaguacagcucucuggaacaugaggugaggccccagaaacugggggagggcaaggaugaagaugggagagagguggagcuccuuguuucccuucccagugucaccuagcugcugcuuucuucuuacccagagugcaaggggugugauugaguguuugaagauugucacacgagccaagucucagcggauugcaaaguucgccuuugacuaugccaccaagaaggggcggggcaaggucacugcuguccacaaggccaacaucaugugaggggcauggcuuuguguaggauggguuccugggaagguagccccuguacuuucuuggcugauucuguccccuuuggcccauggacaggaaacuuggggauggguuguuccugcagugcugugaggaaguugcugaacuguaccccaaaaucaaauuugagacaaugaucauagacaacugcugcaugcaggugaggccuccccacaucucuacucauggggcggaggaggaggguggggaguggaauuuacuucaugccugcaucucacccucuagcuggugcagaauccuuaccaguuugaugugcuugugaugcccaaucucuaugggaacauuauugacaaucuggcugcuggccugguugggggagcugguguggucccuggugagagcuauagugcagaauacgcagucuuugagacggugaggcugcuuucucccucggcccuuccucugaccucaaguccgccauuccucucccaucccaauaucuccacuuccuaagugaucuuggccuguucuucccccacgcugcccaccaugccucuuuucagugacccuggccugagcucccccucccauaauguccuuuuccaaccuaagccucugcauaccccuccugccuccucccagugucuagccugccccucucuccacagggugcccggcacccauuugcccaggcagugggcaggaauauagccaaucccacggccaugcugcugucggcuuccaacaugcugcggcaucuuaaguaggucaugggaggcugucggcagagguugggugucgugaggaggagcagguggggaaauuagcgggaggugucuugggggagucacaguuucuuccuguccauauccacagucuugaguaucacuccagcaugaucgcagaugcggugaagaaggugaucaaaguuggcaaggugaguugagaagaguagugcuggcuucaggauuuagaguaguucuggugucagcaccucggcacuacccucuggggaaccugaaugggggucuccuuuccccccagguccccagaacaucugcucccugacaucccugcaucccucucagggcuguucuucaucucccuucucuuggcuguuucauccucuugaucucuuuugccucuuagaucccaucugcuguucccucuuuccugcuccauccacugcccuuuucaugggccaucugaaugcagaacuugcagcucuccuuggggguggaacagcaagggauacaggcaggcugaagcaucagcuucaccuucacgccccaucuccuuuucgcugugauucuuuccuuccaccuggucuugucucuauuucuuccaaggaagguagccacauccugccucugaucugcguuucccaucaucuuugccugcucagccuccuguccugcccuggcugcagcacagcuaauaguggcuuaagaggaguggcagguccaugugcuucccauccuggcuccuccuuccauuccugugcauugccuuuuuucuggcugucacgcauucuuggcuuccauuuccucaaucacauugcccuaccucccuucaugggcucucuuuucucccuccccacggcuguugccggugguggcuguaggugcggacucgagacaugggcggcuacagcaccacaaccgacuucaucaagucugucaucggucaccugcagacuaaagggagcuagagcccuuuauuucuuccaaccuugcaaggaccacacuccccauacccuucagugcaguguaccagggaagagaccuugugccucuaagcaguggaccauggucaccuugcuggguagagccuagguuguccuugggccggcuuccuuaggggacagacuguuggguggugauggggauuguuaggauggagcccaggccacauggaugaugaugauucucccccacagguucgaaccucugacauggguggcuaugcuacuugccaugacuucacugaggcugucauugcugccuugccccacccauaggcccuguccauacccauguaagguguucaauaaagaacaugaaccaacucuu

SEQ ID NO: 13405 - RNA, 849 nt, Homo sapiens
cugaugaagaaggguggucauuguauauuugaaggacacugaguuguggggaggggcucucaggcccaaggauggaggcagaaagccaggccaagcagggucaagggcaugccacaggcucucaggagcgggcccagccccaugagcagcagcagcagugcguccuggaggcuaaguuguccugagacuguacccauuugcaggaguagagccuccugcuguccaggaccuucaccggcccccugacucuggccccuggugagaaguuugcgcuguggcagagugugaccugcgggccuguggagagagaggguggugacugggcuuagggaaguuguccacuggcccgcccgccuacaaugcccaccugccaggcugcugcccacuuaccuauggagcaggucaaaggugaggaagcugaccagaagcagcagcagggcugggccagugguggaaaagacugccuggauugucaguccuagugcccccagccauaggacacuguccaggagcugggcccagcuagggccccagguggauacagguggacgcacuggacuaccugaccccuccccagcacccaggccccuuggaggaacugggaucggauccucacgugcuucgggucuggguaagcagagccgggucauggagagagguggaggugacgggaagaccuagugcugaaaaggauuauaagggugagaguaggggaagggguagggcccgggcagacagaagggugagcucagaguggggaauuaggcuccugcagagucucccccucccccauacccacccagcaaacccuccucaccuccucccacuuuggucagcauucugggagug

SEQ ID NO: 13406 - RNA, 3013 nt, Homo sapiens
agguggugacugacaugugcacuaggaacaucucagggacugcagagcuccccaagaccauagcagaagacaggcguggggaaaugguuugcuacuguuuugcaaaucaaacauuuacagugcaucaggagagcccgguaacuaaagaagaaagugguuaguuccuaugaggcaaugucuuaccgccugauuuguguguaugugcugagguuucuaugcgucaggcuuguuuaggguggacaagagggcaugcccaagggagcuggagauccccacacuagcuggauccucaggcuucuacgggaggcggggggcguccugcugugggaggccacauggggacugggggggacgagaggggagagaaccaggaagauggcagcucggcgguuacgagaccaguguccugagacaugaccgccaccucucccuccgcagaccgcagcccgagagccccgccccgccccgccauccuccaauaaagugugagguucuccgaagcuguugcgucgaguucuguccuucguccccucccugucuuccccgcugagacccuucccugcgugggggcuggagggacgcggguccggccccgcgggcgggaguaacuaagggauggccccgggcccuggcgggaaggccgggccagagccugggggcgggaugcggacguccgcagggucgccgcuucgguuccagaggccacacggccgggcggggcgugagggacagcccgaggacuacaggucccaagguuccccgcgccgcuuccggggcacgguggcgucccggcaccgcggccgcagugaggagacucggccaugcuacgcgcgcugagccgccugggcgcggggaccccgugcaggccccgggccccucuggugcugccagcgcgcggccgcaagacccgccacgacccgcuggccaaauccaagaucgagcgagugaacaugccgcccgcgguggacccugcggaguucuucgugcugauggagcguuaccagcacuaccgccagaccgugcgcgcccucaggugugcggccggggggagguggccgcccgcgcgcgcuggugacggugggagugggcggagagggugcugauuccuggcgcgucugcacccaggauggaguucguguccgaggugcagaggaaggugcacgaggcccgagccgggguucuggcggagcgcaaggcccugaaggacgccgccgagcaccgcgagcugauggccuggaaccaggcggagaaccggcggcugcacgagcugcggugcguggggcgggaggcggggcggggcggcgcggccuggccggccugggagaagcccgggccccgcucagccucggcccuuugacccucacaggauagcgaggcugcggcaggaggagcgggagcaggagcagcggcaggcguuggagcaggcccgcaaggccgaagaggugcaggccugggcgcagcgcaaggagcgggaagugcugcagcugcaggugggcaacgucuccggagggugggacuccagccggggacgcggcuugcggggcacugggaauucugggcaccgcgacgcgggcgcuggcuaugugcagagacuuacaguuggcagguccggauuuggagaggagagugccagucaggcgcaaagacccggaggugagcggaguaauuggacaguguucagguaccuagcaggucugugggagggacccugcguuccacaaagagguuguauuuugcauaacaggugaugaagccaugaaggguuaaguauuucaggcuaggauuagcaggugugcgacuuaaaagcagggagaccacuuaggaguaaugcagugagaauggaugaggcuugauuuaaaguauagaaggguggcugggagcggugguucacgccuguaaucccaguacuaugggaggccgaagcgggcguaucacuugaggucgggaguucgaguccagccuggccaagccccgucucuccuaaaaauacaaaaauuagccgggcguggugugcgccaguaaucgcagcuacucgggaggcugaggcaugagaaucgcuugaacccaggaggcagagguugcagugagccgagauggcgccacugcacuccauccugggcgacagugagacuccgucucaaaauaaauaaauaaauaaauaaauaaaguaauggggggaaggaugaguuagagugauucagaggggaccacugagggacggauuucaccuaccaggacgugagauuuucauagcuggcacucggggcuauggcugaagugucugagaaaagaggaacguggaaaagcaaccugauaucacuccacugggaggccagaggggcucucaaauaggaccuggguuccaggcaugcuuccccagggagagcaggagcugcuuucucaguggggugagaggccagcaggcugggugggcuggcuggcaugugcccaaggcuccuguucagcugggcuuuucucucccgauaggaagaggugaaaaacuucaucacccgagagaaccuggaggcacggguggaagcagcauuggacucccggaagaacuacaacugggccaucaccagagaggggcugguggucaggccacaacgcagggacuccuaggggcccaguaaggacagugcccgccagggaccauguauguaucauggcggaagaguuggcccugaccuggaauaaagcaguugguguugcuuaugaggaagguucagccuuauccagcacagccuucacguuuugcccucugcugucaccacuuggucagaaacuuccaaacgcagugcccuguucugccgguguguacagccucagcgcaccaggagacccuagagugguuuccaucucacagagaaucagacagggccacagcccccucaggcagccaggucaucugaguaucauuaagaguagugaugggaagauuacagucugagggccaaacgugccugcuuccuguuuuuguaaauaaaguuuuguuggaacacagccacaccca

SEQ ID NO: 13407 - RNA, 42115 nt, Homo sapiens
aaagaauaccacucaagaggcuuuuuccguuuuauuucuuugggaaaggaaaacaaaaagucuuuccaucacauaugguagagauauauauuuauauauauuuauauauaauuucuuuugugguuggacgucccaaagcugagucuguucauauuuuuuucuauuuuuuucuuacuaaugccuucucuucucccugccccuguggccuaggcccagguucuagggcagguacagugaggggugaauggaaugggcaguggucgccaggauggccucccacccagcucagagaccuggugaggaccacccagaagggcugugcagaggguuagaggccacacagaggggcacucauguuuuugugggggaugcacagcucauuaaacagucaccagucaugggaggaggcuggucaggggcuaggggacuugcucacaguaguugccagcucucuccaccuugccccccaaaacucagucuugggggugggaggaagagagugaaaaagagagagauauaagggcugagggccaagccuccuccaauuuuuauugcuggugaauuagaaauuugcuuuucccuuccugucuuggggagauagacucugagagggccccaagagaagcagcugacauuggcugaccuaaccccucaugccaggccuacccugggcaggugcugagccaccucagggcgccaggaaccucucaggucagccuuguucuucaagggcaaucacauccaacucuccccccgcccccaaaacaagggccuccggcucagacuugggccaguggagcugggaagugggcagugcaccaaaggucaagcggaauuuucuauuggaagaaaaggugagacuuuggggaagagacugccuaggaagaugaugugcugagcaugaaagcagaaagaggcugggggaauagagugcgggaagacaucgcagacacucgucugaccucagaaacugggcgaggagagugccugagaggcagguagcacuuaauagcuguguuagagccggacagugguccuggguguggggucagccaagcagauggggcuguugcccugcgggauccuggccagaagggugaggguagagccgagaagccgucaggcaacgcuucccaagaacaggaggacagaucuucccugggugcuggacuuccagccccaguccuccccucccgcaacacacacacagggacacacacucacaaccaggccaggcucugaggccugaguccaagagaucuuguugggggaggggcugggcagguagcccucucagccaaaggcaggccaucugcucccacuuguccugccaaucugcccagggagggagagcacuguaggagggagagaggucuggagcccaggcucugucaguuucagcaaaccuggugcaggcccccucaggcuccauggccuaggaggugagcacagagagcaucacuagacacaggguggccaacaguagcagcccaggccuccagaaggacuggggcaccuuauggcacugcacgucugcugccuccaucuccaacaagggggugccgagaaagggagcaugacucccccaccaccuaggauugcccccacucacccugcccuccuccuauucccuccuuuuagggggguccaagugggcugccacgggggcagugcuggagcuaggagggcagguggggagggaggaaccuggucacagcugcuuagagaaccucuuuggucugggguuauggggucuauggggaagagagauggaggggaggggacacuggggacucuggccuuuugacaggacaugugucaaaaugccgagugcccaggucgaucagauuucuguggacucaaugcgcucgaggcgggaggggguccaggccuucuucuccucgccaugcuggggagugggcgugcuugcacccccugcggccccgcgcucccgcagccugcgcuccagcugcugguugcgcugguacaucuccacguagcucagcugcagcugcuucugguacucgaucaccuucuccuucuccuccagccacacgcggcgcuccucggcgaagcuggcacccuggcgcucccgggcccgccgcucagccgccagcucggccugcagccgccccaccucccgccgcagggcccgcgucccgcucuccccgccagccuccgccuccccguccacggaaaccaaggaggcggcagcggccaccccggccugacggcgcaucuuagccucgucgcucucgcagguggccagagcauccuguggcucggccggguccacgggggucagcgccggcuugaggcaggcggcaggcagcucgccuucgcccagcuccaggcuggccugcuugcugcugaaggagucccgcaggcugagcagcugcuccuccuucucccgcagcgaagcccggcccucccgcagcugcgagcgcagucccacgaucucacucaacuucugcgacacauccgccugcgaguccuucagcugcugcuucaggagggagaucucgccagccuucuggcacaccugggcaggaacaggugagaggagaagccagguaaaggcagagcucugcucaccccaacccagcuaccagaucuggagccaggggcaccaagcuucccggggcugcaggcucagccccucaucagcagcgacgcacccgauucccugccuggacucaagauggacaugucucacccagcggauggccucggguccucacagacacucccaauugauuuuuguccccccugcuccuuucauccccccccccaucccaccguuaugauagugaggggcaacugcucugggguuucccagagggacagaagggaggcagaggggaggcccagauccccagcccgcaccucccacuuaguuuccucuauccggggcaggaagucggccugcuccuucuggcaggcggccaccuuguccuccagcucuucccgcugccgcaucagccgggccgccuccuccugcagcugcuucuuguccugcugcagccgcaacaccugcagcuguaggcccugcugggcgcgcugggcacgucgggccaccugcuguagcuucccgcugcagcccugccgcagcucggccagcucccgcucccacgccuucugccgcuccuccaguaccugggccacagccgccucgcucugcuccaggcugcgccgcagagcugccaccuccugcuccuucucccacagccgcuccuccagcuccuggaugagugcacugggggagggcggugagcaggccgcgaaaggcaggccuccaccuccgcccuccccagagcccagguggccuggccgccccauagaugacgacgacccacucuugcuggaggcccguccacuaucggagguccccagguccugguagcccgaccccccaccgcugcugccgccacuaccacuaccauagcuggcagugccaaugcgguuaauguggcugguggaggcacugaggggugccaggugcuggcuguagcuggagcuguaggugggcaggcuugugagggaguuccggccugagucugagaggccacucccacucccacccgcuggagucaugguccgagacuuguccaguccgccuuugaggccaccagggcccugccgucccucaggagucccauuggucugcggggggcacaaauucugcauggaguggaaauucuuggguacgacaggcuugaaggccgacggccgaacuagugguucugagcacugcaggaaacgcaggagggggcugggggucaggaugaggccuugggcuuggcccaggcucuucccucuggccaagacuuguccagccccaccucccaccccuacuggauuuccacccugagguuccccauccgggguucuaccucauggcucccugauaccagaucucuguccuugaucuacccgcuagacuuggccccagguccccaguccaugacuccccagcccagccuccauccugcccccacaacccaaccuccaagaaggcccacuuugccuuccucucuggguugccucccacccccagaaaaaggcugugagggucucaggcccugcggacugaccuggucuagcuugccagagguggccaggagcuuggguggguggcugggcucacgauacugcgguggggcuuugucacugccaccacugcugcugcugccuccgcugcugccaaccacguugccacagacaucgguguggucacugccccgcagcucaccauugagguagagggaguuggcgagacccuuguccucugagggguagcggcccggccucucccugcuggccccacugccacugccucgggggccagggaaacugcccuggcugcccccacccccugugcggguacccacgcucuucauggcaaacuccugggcaugggccaccccacugcccacgcugcccauggccaggcggggguccggggguccaagcucggagggccguggggcaaaggccaggagaggaucccgcccugggucagcgcgcacaggcagcgucuccagcuucgccaugacuaagccaggggggcacugugggcacaggugggaaggcagagauagguaagacccuacuccuauucccaccaccccagccaagucaacccggcaccgcucugccccucaguguccccuucccuacaauggguacaaaaaguucccaggcauccaaggugaaggaauaaggcugggauaaaagagagaacuugggaaugggggcugccuguugcccaccugauaaagcccaacccccagggcuccaugcacauagcccccagcguugcucagcucagcucagcucagcucagcucagcguuccauuccuaaacuucugccuuagccccaccuccgccaugagcuucccaggcucagugacccucucaacucuuugcugcaaccccagaauuuugggguucuuuaucuugggucugggacccuaauaucccaaccucaugggcuggggaaaugggguuggaaggggagagcaguaccugaauccaacagggaaccaaccucagaaauuaggggagggagagaaauacaccccuauccaaaaauugaggguggggguccuucccagcccccuaaccuaaguguugcagucagggcagaaguggaagcucacuaccagcgcaggcuucucuccuugccuuuccaagggguugaggggccgacggguccucaagccugggacccuccgaggcccggucugcaggggccaugugccucacucucgcagucggggcucggcccgaaccagcugcgcgacuuuggaggggccgacugagccaucccggacugcaguuuucuccucugcgaaaugggaggaaugaaggaccuaccuugcggggcugccgcgugccaggcgccccgaggcggcgagcgccugaggaaacgggggucugggggaggguggguaggcgacgcacaucugggucgcgggugggcgccgccaagggcacagccugucccucccggauggacgggggccgcggcugcaguagguggcaggccugcccuccccaaggucuucccagcucggccgcaccggggcccugggaagacagggcccccuucccgggaucaguccuccgcagaggucccagggcuggcugaggccggggcaggggacgcaguggcgccagcugcuggcacugacggagccucucucagggccugcguuucccacaggugggaggggggaggggaggggaggggccgcugcagggugcgcggccccaaggauccugcgccugccgaaccccgcaaagaauucacugccaccaggaagacuucccggauuacuacccucucccgcucccuguggaccuugacccugcucagcuuaccgugaagcccucugaguccuucugugggugcgcgucccccucccccaaggccggcccacaagcgcagggggagccaggccucggguuaccugugcucagggaggccgugcuuccucguuccuuugucucaaguucgcaccugggaacaccugccccagagaucugcauaaugcagccgggcaggagcaccaggcagugucugccucggguuagacccucaaauaagugugugggaaaugggagagggcgcccuucaggccuuuucccacuacacccugcauaaaccaggcagggagcccuccuucccuaucaaguuaaggggcccacguggcacccuauggccccacagaccgucuucuacccagaugcccaguucuaaugcugagucccuggcccagaccaagggcaccugacaaaacuguuguccuucgggagucuucuggcccccacaccaggaaugagagcucuagguuguuggaaaguucacuaccaagccuguccacugucucuguagaauuccauucucagcaucuguccccacagguguggagaagagcacuucgccacccuccucccuuggacccgucuguccccauaagcaagggccaggacuaggaugaggacagagagccacguagggcacaaaugaagggcacaaacagcaaguacacagcccugagggugacagccuccuucccuuugugccuugggucccucucuggccucacucuagucccugcucugccucuacuccccagcauacuccagcccccuaugccucagcccugcaacccccuccuaccuuaaguauggacccuucucuugccaccucugggugcaauguggggagcagcuggggacugggaggaugaagccugaaaggccugaggcuuggaaccaguaggaaggccugggcaggguuugggaaagaacuggcaaaauuucauacagaugaggucaggugguggggacaagggauaaugcuggacugggcaccagcgugcgugugacacuguuaacaugauagggggagacugcuuggggaaaauaguugcuuugggaaacaccagaggaagauaccucucaagcacuaaauggaggccaagcaagguggcucaugccuguaaucccagcacuuugggaggucaaggugggcagauuacuugaggccaagaguucaagaccauccuggccaaauugguggaaccccaucucuacuaaaaauacaaaaauuagcugggugcgguaugcauuccuguaaucccagcuacuugggaggcugaggcacgagaacccccuugaacccaggaggcagagguugcagugagcuguaauugcaccacugcacuccagccugggugacagagcgagacucuuuccuuaaaaaaaaaaaaaaaaaaaaaaaaagcacuagauggagagagauugagaucaucaguuuucaagggugcuggggguguaggccagcacugagccagggagcaaagccccagaagucuggaaggcacucugggagcaggaagaaggccaggagaaggugggcccugaaggccaagauuggggggauucaagaauguggggacaguuuccaguguuaaaaauaacagggccagguaacacugggguuggagagugugcugcggauuuaggagcuggucucgagacaucaccaaugucuaugucagaaugguuucagaaaagugguacaagugccggaugcgguggcucacaccuguaaugccagcacuuugggaggccaaggcaggcaaaucacuugaggucaggaguucgagaccagccuggccaacguggugaaaccccgucucuacuaaaaauacaaaaaauuagcugggcgugguggugcgcgccuguaauccccuacucaggaggcugaggugggagaaucacuggaacccgggaggcagaaguugcaguaagccgagaucaugccacugcacuccagccuggaagacagagcgagacuacaucaaaaaaaaaaaaaaaaaaaacagguuggcgcgguggcuuacgcuuguaauccuagcacuuagggagguccaagacagguggauccccuaagaucaggaguucgagaccagccugaccaacagggcgaaacccugccucuacuaaaaauacaaaaaaauuagcugggugugguggugcaugccuguaaucccagcuacucaggaggcugaggcgggagaauggcuugaacccaggagguggagguugcagugagccaagaucgcaccacugcacuccagcauaggugacagagcaagacucccucucaaacaaauaaacaaaacagaacaaaaaaagugguacaaaacaaaggcaguccacaaggcuagaggagugcagagaaagacauggcagaguuccugcuaaaagagaagacaguuauuuaaggagguuugagauucaagggcuuuuuuaauuuuaaaauuaaccaugguagaaaccuguguguuaauaugcugagggaaguugccaauagugagaugaaagaucuaggcaaggggauagcaaggugacugcaccagauaccuggaucugggcaggaauaaaccucaacagugaucauguugaccuugagugacaggguauaauguuugggaaggugcuuuguaaacuauaaggggcaauacaaacauguaguacaccuucucugagauccgggaaaggacaaccugagcauagguuggggcuggucauaggccacucuccccuacuguuucucuagaguguguguagucccuagcaagucucagaugccucgagucguggauggaaacaaggucccaggaccauuguccugagccuccuuucuccgugcucuaccuggggaaugcuugacuaucaacccacagaagcucucucuggagccucacugccuaaagagcuucuugucguaauuguaaccugucaugguuaaccccuugcaagcaugcccugccccuugucucucccaagcuuuggcugcugcagcuucuuuccacaaaaucccagcagauagccgggcgucguggugcgugucuguaaucccagcuacucgggaggcugaggcaugagaaucgcuugaacccaggagguggagguugcagugauauugcgccacugcacuccagcagccugggcaacggagugagauacccccucaaaaaaaaaaaaaaaaaaaucccagcaggacaccggcaggacaaggaaggggauguuucccugguaagcaggaacugaacugagaggaaaggucacgguccugaacuaguccagguaacugagcauggucugcaaaggcagccuccuggcaucagugcaccacccugagaugacagccuguugccugacugccucgaucucugucaccucagcccucagugccuggggcauuauacacaguauuagcgucaugagggggccaaacggacucuaccugacaguuacauguacagguaccuccaacccaccccucaaccugugucucucccaaagcuaggaacacuuggggucucagaggccccaaccccagcccauucuaucuccuaaaaaucucuagccagccccuccauccagcaccccugcugggggcuccucaauggacuuucuucuccugcacucccucccccaggcagcugccaggggauuccuucuaaagggcaaagcugaucuugccccugcucuguccaaauccuuccaugagcaagaccaagugcaguagacagaguucuggcagcaucagcuccaaguguaaaucccagcuugacugauuaggggugcaaccucaugcagguuauuucaccucggguucucacaccuacauugcaggcauuuuaagaaguaaauguaugaugggugaaaugccugguauuccucuugguccccagaaccagagcagagcuugcagcaggguccccaaggacucuccugaugccccuccucuaucuacccugaccugagccccucucuacuucacacacaagcucuugccagcucucugugcccauccuacaugcuucuagaccaguucaaaggcuggccucaggacagcaucccugaucuccaccccccagagggggcaucuuggagcacuuggcugaggacaccccagggagauuucacucugaggccuccccagggcuggccuauagguuucccaggagcacagagggcagaguccugggggucucugggcccugcaccaaggaaaugcagggcaaaugccugugggaaugcuaguuaugggcaaugcaaagaggcagugaauccgggcagggagagcaggagggguuuccaggaagcaggacugagggaggaaagggaucugggggcacugcagggcuuuuggggugcagagauauccagaacuucuugguugggaugagugaggggagauccgucuucccucgguggccuaagcacuggcagcggaaugggcccaucaccuagcuacuggcucugaugaagccaguguuucaggacugagggggccgagagcgcccccuccaccccgagcacacacacgcgcgcacacacgagcuucugcugggggugggagggggggucgccauucaccagcagcccacggcccgcagagccaacugauagagaccccagccacaggccacaggaccugggagucccugcgaugggggaaaccccgcccgcaccuccccaggcuccccaccaacgcguguggccccggggggcggggcgcagagggaagaggugacauaauccgagccgcacccccucuggccgccaccuccccccaggccgggcgaagcauccaugacaucauccgccuccucuccgcuccccucccccuugggacccuagcagcgggacgcgcccccuacccaguccgggucaggucagacaugccgcgcagugcagcaggcacggcggcaggucggagccgggagggaugccacgaugggccugccucacuuacucgcugccucaggguccggcgcggggucuccgacacgggcgccaccggccccgcuugcuggcgcagcccgaagcacgcccggcggggcgcgcugcgcgggcccggcuccgcuccgcgccccuccugcuccccgcccgagccccgcccaccagcggcugcggcaaacgcgagcccgcccuccggccacgccccccagggcagccaaugcccgggcuggggcggggugaggcgccuuaaccccuucgucgcugcgccccgcccgcgcgugggaccccucagccucacccucucuagggcgcagcaaguccgccgcgagccccucugcucaucgcucguuaccccccaggcccuugggcuugggcucaggcccagucguuccucugcaacaaauccaauggaaccgcgcccucccugaaucccacgucuaggaagaggaggaggagccccucuugcuugggggaaggggcucccgacucggagccccgagccccauuccucucccgcgccagcucuucgggacgcggccucccagcggacgcccugagaccuugcaaguccgcuagggaggggucgggacgagccgucgcggguggauccgcccggccgagcaacgacccgcccgggcgcgaggaccacgggcugucgugcgggaggcgucgaggggcaguaaacuccguucgugaccaaacggagacgauuugaaacuugcugcucacacuggaucaccgucuggaaggugcgacggggaaaaaauacacauuacacuccagcaggauugaacgcuuucacccugugccccgcgccuggcguaacgcguggccccagaccacacgcuguaacccggggugagagggagugaggugggacuucguaccggacccggagcgccggccucgcccgcgcgggcagcguucacuguggggagugcucacucagccuagggcggcccgggaggacugccgggaggagggagucggccuugaauugaggccucagccuugaauaggguagggaggcaagccuagccgagaguuuagcacuagcaaaagccuggaggcaccagggucugcccuaagaacugcagcgccucugcucuggcugggauuuaacgcauuacgucucugcuguuuauagguguuguguuuggucuuacgacuucguauucuauaguuuuuauuuauuccuguuuucugaauuuucccacauuugcuuuuaucuucuaucgugauuuucaaggcagaaaguauuuuuaauucuucucgcggcugccuuuagauuuaucaaaugaaaauaguuuacauuucacacauuaguaaagucagugacaaauaauucguuuuuauauucccccaugagaaauuuugugugcuuuucugccuccuaccugccgcccucacuacuuauauuuguccacuuaaucaggacgacagaccuaacuuuuguuuacacuuuuuuuuuaagccacaacauucuuuuucaauccuuguuuuuggcuuuugccaacucuguuuaauugguuucaauguuacugccgguuuuuugugcucuaauuuuucuauuccucauuuggacccaucucucacaugacuggugauuucagggaggacucuggaauguuguauuuccuaagccuuugccuuaggugagaaugccuuuauaaugauuuccuguuuauaggauucuugagucucaagcuuucccccucaaaacucuugucuuuauuucauugucuucuggcacugaaaaugcaaagcuggguuugucuguuuaaggucagcaguuugcuuggugcuugcaaggguuuuucuuuacccucaaaagucaaacauuuugccaguauaaaucaauaugggccuuaucuauuaauuuuccagaaacaaaagaggucuucuuuguagcuuagaaaaguuuucuuccuguccauucugugaaaagauuuggguuuuuuucuuuccucuccucuaaaacuaucacauuggaucaccaaugucaaauaaaucuguuuguuuucucugcacccugggagacuauaucaaguuuuucuucaccauuacggauuuaauuuucuucagagccaagaguacuguuuauuuucuccaauaagacauuugauucugcuuguuuuauuuuucuuucagccaauuuccauuccaccucugucuugaucucaacuuaaucucucuuuguagucuccauuccuauuucauagacuaaugugguuuugcaucuuuaaaagaacaccaggaaaauaagagaauacuaucuauaucugacucugguccaaugcauaugaaaacuuuuuuguuuuuuugagacagagucucacuuaaaauuuacacaaacucuagcauaguguguaacuauugaaugaauaacuaaugcaauccccuuccuuucuuucagagcaacuaugaacuagacuuuuuuuuuuuuuuuuuuuuuuuuuuuuucugaaauggagucucccucuggaaugcaauggugcaaucucagcccacugcaacguucgccuccuggguucaagcaauucuccugccucagccuccugaguagcugggauuacaggcaugugccaccaccacgccgggcuaauuuuuguauuuuuaguagagacgggguuucauuauguuggucaggcuggucucgaacuccugaccuugagauccgcccgccucggccucccaaagugcugagauuagacuauuuguaucuagguucaucaguucagugaacuaaucaauacuuuguuuuguuuuguuuuguuguugcuuaagaugauuugucaccugcugauuaaugaucacacaaguuguuuuuuuuugagagagucuugcucugucacccaggcuggagugcaguggcaugaucuuggcucccugcaaccuccgccucccggguuuaagugcuucuuuugccucagucucaguagcuggcauuacaggcgugcaccauuacacccagcuaauuuuuuguauuuuuaguagagacaguguuucgccauguuggccaggcuggucucgaauuccuggccucaagugauccacccuccuccaccuuccaaagugcugggauuacagaacugagccaccgugcccggcccugaaaaccuugauaaaggggcucauuuucugggaaauaaaauuacaaggauaacaaagauauuaaaaacaucauccaagaaauauguccaaaaaagguucugguggccggcaucguugcucacgccuauaaucucaacacuuuaggaggccgaggcaggaggauggcuugagcccaggaguucaagaccagccuggacaacauagggagacccugucucuacaaaaaaauuuaaaaauugggcugggcaugguggcuuacaccuguaaucccagcacuuugggagaccaaggcagguggaucaccugaagucaggaguuugagaccagccuggccaacauuagugaaaccccaucuuuaccaaaaaauacaaaaauuagccaguugugguggugaaugccuguagucccagcuacucgggaagcugaggcaagagaaucacuugaacccaggagguggaaguugcagugagcugagauugcgcuguugcacuccagccugggcgacagagugagacccugucucaaaaaaaaaaaaaaaaaaaaauuaaaaaauuagcuaggcacaguggugcacaccugugaucucagcuacucaggaggcugagguuggaugauggcuugggccugggagguucaggcugcaagugggccgugaucgugcuacugcacucuagucugggcagcagagcaagaccuugucucaaaaauaaauaaaugaaauuuuaaaaaggcucuggccucagacaguuuaauggaagaaaucucucaaacucacugaauagauaauuuucacccuacuaaucugcaucagaacccagaaaagauagaaugcugucuauuucauuuuaugaagccacaauuccccuuauaccaauuccuaauaauagcacaggaagaaaggaaaacugaaaaccauacucaucagucaucaguuccagggguggaaaauccuacauacaauucaagaaaauaaaacuguagauuauucuguaugaaauuaauaagccaugaguuugucaacugagaaaaaaaaacaauuaucauaauagaugccaaaaaaaucagucaaaaaugaauacccaaaaagaacccuccuaauuaaccaggaacaguugaaauuaagaauuauguauuaccggccaggcacgguggcucaugccuuaaucccagcacuuugggaggcugagguggguagaucaccugaagucaggaguuugagaccagccuggccaauauggugaagccucaucucuacuaaaaauacaaaaauuagcugggugggguggcaagugccuguaaucccagcgacucaggaggcugaagcgggaggaucaccugaacuugggaggucgugacugcagugaacagucaucaugccacugcacaaugcagccugggcuacagagugaguugccaucucaaaaaaaaaaaaaaaaaaaaaaaagccacgugagaugugaguuccuguuucccuacagccucaccagcauaggauaucauuagucuuuuaaauauuuguuuuaaucacgucuucuuugccccauagcugacggagggguucccacucucaugugauggcaguggccaaacacaacaccugacacugggcaggugagauuaaccgcaguuuauuaguuacaacauacucaaugggaaaggacaccacaagccacgcagggccacacaggggguguacucaggagugaagagaacaaccagggguuguggagggcaggcuuuguagugauaagagagugaggugcucccugguuccugcaugggagguaacuggcuuguuugaauaauucuacaggcuggcagggaacugaagccuacuacuaagagauaagcaggaacugcuccugguucauuugaugaaaggauuggcuaggggaccuuacccacagaacacagcaggagggcagcuuacagcuagaccauuugaggcccucuugauuuuaccagaagucaagucaauaguucuuuuuauuuuuuacauuuuuauuuauuuauuuauuuuugagacagagucucacucuucuugcccaggcuggagugcaguggcgcgaucuugucucacugcaaccuccgccucccggguucaagugauucuacugccucagccucccgaguagcugggacuacggcauuuacuagcauguccagcuaauuuuuguaguuuuuguagagacaagcuuuugccauguuuuccaggcuggucucaaacuccugagcucaagcgauccaccugagagcugagcacucccacagugcugagauuacaggugugagccacugcaccuagccucacauagcauuuugaggguauaaauugguacaaccuuuugggaggacaauuugguaguauauaaaaauaugaaauguguauauccuuggacccagcaaucucauuucuugggaagagauaccaucacaaauaauaugauguaugucugaagacagucacuaauguacugaauguaaaaguaaaaaaaaaaaaaaaaccuccuaaauacaucaaucuauuaauagaagauugauuaaaugaauuacaaggcauccaaugcaauguaacaauagacagcuauuaauauuuaaaaggacauggaugccuauguguugacacagaaagaugacuacaguaagugaaaaaagcuguggcauaucauauguauaccuaucaaccuacuguacucuaauuuuucuauuauuauuuuuuauuuauugagcagcccccaaagcagagaguccuccuacucuuuuuuuuuuuuucuuuuuuugagauggagucuuacucugucaccaagacuggaaugcaguggcaugaucuuggcucacugcaaccucugccucccggguucaagugauuuuccugccucaacuucccgaguagcugggauuauaggugccugccaccaugcccagcuaauuuuuauuagaaauuuuuaguagaaacaggguuucaccauguuggccaggauggucucgaacuccugaccucaggugaucugcccgccuuggccucccaaagugccugggauuaaagaugugagccaccaugcccagccccucuauucuuuuucaaagaauauauauguacgugcauagaaaauucaggaaagauacauacaagauuaaacaugggccaccuugagauggugggaucauaggucauauggcagaagaaaggagucuaggcacuaauguaauuuuugcacuuuggcacaaucagcucacugcagccucgaauuccuagacucaagugauccuccugccugccucagucuccugaggaggcaggacuacaggcaugcccagcuuccuuuuaaaaauuuuuuuguagagaaggggucuugcuaaguugcccaggccggucaugaauuccugaccucaagcaauccuccugccucugccucccaaagugcugagauaacagaugugagccaccacagcugggcaaauauuuaauaucuuaauacuuugcuauuucuacauuuucagagcuuaccuguuuauucguccacauaaacuuauuuuccuuuuugacugucuuuaaaaauauauuuaaaauauaaauuuaaaaaaucguaucucuuaauacucuagaguaagcagaauaaugccccccacccaaaauguccaaauccuaauucccagaaccugugaauauguuguuacauggccaagcgaaauuaagguuguagauagaguuaaggcuuugaucagcagaccuuaaaauaggaagauuagccuggauuauccaggcaggcccagugucaucacaagcguucuuaaaagugaaagaggacggcagaaagagugagauggagaugugacuaggaaagaaugaucagagagaugcaacauaacuggcuuugcagauggaagaagggggccaugagccaagaaauguggguggccucuagcuggaaaagaaccuccagaaagggagcacaguccuuccuugaaagggagcacaguccuuccuugauuuuagcacagaagacccgcacuggacuucuaugcuacagaagcagaagauaauaaguuuguguaguuuuuugccacuaagauucggucauuuguuacagcagcacuagaaaaugaauacaaauacauaauagacacaacauuccuuaguugaaugaugaaugaaaucacaaaaacccuaggucuacagauaaauagguaaaagaaauauaucacuuagggccggguacgguggcucacgcuuacaaucccagcacuuugggaggccgaggcagguggauuaccugaagucagaaguucgagaccaggcuggccaacauggcaaaaccccgucucuacuaaaaauacaaaaauuagccaggcgugguggcacgugccuauaaucccagcuacuugggaggcugaggcaggagaaccacuugaacccgggagguggagguuguagugagccaagaugccacuccacuccagccugggugacagagcgagacucugucgcaaaaaaacagauagauagacagauagauagacagauagauagauagauagauagauagauagauagauagauagauagauuuuuuuauauaucuauauauauauauaucacuaugaauccagauagccaauaaguaguugaaaacaucuauauccucgcugauacugaagagaugcagaucaaaaccuaucaaauuaggaaagacuauugcaauccuuugggguccuacccaccaaguuguccagaaggggaucuggguuuaccucucugagaugacugcuugcaguuaccucugaacagcaaauuagggggcagacaaggcacuuuaauucaugcuaaaguucgaauguuuguacuaaagccuuuuauagcuaugcuuacuuuaugaggaaaugaaaacuucuggaauugggccaaaaauuccugggaauuaccaguaaaggucuuggggguuaucuaaaccaauauaaaaguaacugaaaugauuauaauccaagaaugcuggggucuuuuauuaccguuugauaagcugauguguuuuuuguuuguuuguuuuuuugagacagagugucacccugucacccaggcugaagugcagcggcacgaucucggcucacugcaaccucugccucuuggguucaagugauucucccgccucagccucccgaguagcugggauuacaggcaccccccaccaugccuggcuaacuuuuguauuuuuguagagaugggguuucaccauguuggccaggcuggucuuaaacuccugaccucaggugauccacccaccuuggccucccaaagugcugggauuacaggcaugagccaccgcacccagccgagcugauguuuauacacacacacacacacaugguccaugaaaaauaaaauuuaaggcugagugugguggcucaugccuauaaucccagcacuuugggaggcugaggcggguggaucaccugaggccaggaguuugagaccaggcuggccaacauggugaaaccccgucucuacuaaaaaaaaaaauacaaaaauuagccaggcgugguggcaggcgccuguaaucccagcuacucgggaggcugaggcgggagaaucacuugaacccaggaggcagagguugcaguaagcugagaucgugccauugcacuccagccugagagacagagugagacuccaucucaaaaaaugaaaaauaaauaaauaaauaaauauaaaaguuaaaggaaaaauauacaaaaaauuaaaaacuguauucucuuucuuaaaacuauucuuuacuaauugcacauuuuaccuaagauagaaaaugguuuauguuuuuccuguguuccacagggucccccuguaacaucugauucuguuuuuauauaauugaugcauuguuuauaugauacuaagggacucaucuguaccuauacccuguaagccucauuucaagauauuuagauacaaagcgaaaaggaacacaagucaccacuucaagugagugccucugcaucauacauguacaugugaaacauguagguccuuuuuuuuuuuuugguuagauggggucucacucuguugcccaggcuggaguacaguggcgcaaucacggcucacugcaaccuccaccucccaggcucaagugauucucccaccucagcuuccuguagcugggacuacaggugcacaccaccacgccuggcuaauuucuuuuuuuugguauagaugggguuucaccauguugcccaggcugaucuuaaacucuggggcucaagugauccaccugccucggccucccaaagugcugggauuauaggcaugagccacugugccugaggcgggaggaucaugcugaaacuccaucucuacaaaaauacaaaaauuggucgggcgugguggcucacaccuguaaucccagcacuuucggaggcugagacgggaggaucacuugaggucgugaguucgagaccagcaugaccaacauggugaaaccaugucucuauugaaaauacaaaaaaauuagccaggcauaguggcacacgccuguaaucccagcuacuugggaggcugaggcaggagaaucacuugaauccaggaggugaacguugcagugagcugagaucacgccauugcacuccagccugggcaacaaaagcgagacucugucucaaaaaaaaaaaaaaccccacaaaaauuagccaggcaugauggcaggugccuguaaucccagcuacucgggacacugaggcagaagaauugcuugaacccaggagguggagguugcagcgagccgagauggcaccacuguccagccuaggugacagagcgaaaguccaucucaaaaaaaaaaaaaaaaaaaaagacaacugcccaacuagacggcaagcacauguccgcacaacuacacuauuaugugaacaacacagggaaccguggaguuuagcucaacaaggugacuugacuuaccuugcugagaaacagcuaaagggaaaucucuuacagcaauugaggaauuaagucucaguuacucaguucugaacaguuagaacauuaagaguuuuaguuuuauuauauuauagauguguuuuugugucauaugguagaaauguaaauaguaaauguaaaauagaaaguuaaaaugacuaaaaaaccagucagcguaaaucuaccaagcuauacgcaaaagguuauauuuaaauaaguuuaauguuacaguauugguauuugguagguuuucuuauaagguucccuuauccauuuugcuguaauuaacaaucggauaauguauuagccagccaaaaauuauguaugcugucaggauaaaucaagucaaaauguuuuucaaugucacuacagaaauuguuuuugguucaacuauaugacuaucaaagguuauguacaacgcacaacucuacccagauacucauccuugcacuguucuaaauaaaggaaacaagacucuucaguacucuguuuuucaaacuguaggucaagaucuguuagugaguuguaaaaucaauuuagucaccauuggcaauaaaauagaauagagaggcaaguaucaacaugcaucaaaccaaaaggauuguacugugaaacgccugcuucauggaucuauaugcauacaugcacacauaagaaaauggauuucuuacuaagagauacuguuaaaagagucugaaaacacagccuuaguggaauagcugucucuaaucuuggggcugaggcaugcacgcaugaagacuugagggauauucucaaauaguccaguggcuuguggagggagaaguugaugguauaaugacaauuugugggauaaagugauguaaagguuuaagaaaugaguuaacagauucaaaacacuaaguaaauaaacauucccacuucuuccccacccagacuuaacaaacauagcucagaucucugggcucagaccuucccagccaggucccagccuccuuuuccagcuuugucucucauuugcccuggccuuuccuccacccaacacuccaugcuccccucagggaaccacaggccuuauucuccacuccagaucucugcaccuguccuccuucuagccuggaaggccucuccuauuauccacuggucccuuucauacacuccagcaucuggcugugcacuugcuagcuugugauugauuggucucucugucagauuaauaccacugcacuggccgggcgcgguggcucaagccuguaaucccagcacuuagggaggccaaggcggguggaucaugaggucaggagaucaagaccauccuggcuaacacggugaaaccccgucucuacuaaaaauacaaaaauauuagccgggcgugguggcggacgccuguggucccagcuacucgggaggcugaggcaggagaauggcgugaacccaggaggcggagcuuucagugagcugagauugcaccacugcacuccagccugggcgacagagcgagacucugucucaaagaaaaaaaaaaauaccacugcacuaaccccuacuuguggcuggggccauguuuugcucacuguacuucccuaggguguucaaaaucaugccuuguacucaguaagcuccccauaaauuacguuauuuuuuaacaacauauuucagauguguuuaaauacuuuucuguuacaaagauucaauacaggcugggugcagugguacacggcuauaaucccagugcuuugcgaggccaagguaggaggaucacuugagcccaggaguucgagacuaccaugagcaacauagugagaucccgucucuaccaaaaagagaaaaaauauauauauauauuagcugggcaugguggagugcuccuguaguccuagcuacuagaaaggcugaggugggaggaucacuugagcccagaaguuugaggcagcagugagccaugaucacaccacuguacuccagccugggcaagagugagacucugucucaaaaaacaaaaauccaacaugcauccaguaucaguaucacugugguagccugggggaaucacugaacugccaccauauuaccgguggcuucacauaacccagcuacuuuagcuccacauaacccagcuauuuuagcuccuuuucuugagguuuagcaugagccaaggauacacaaggccaucuaggacucuuuauguuuuguuauagaaaaguuuaaacauguaggaaaauagauggcugggugcaguggcucaugccuguaaucccaacacuuugggaggccaagauagguggauugcuugagcucaugaguucgagaccagccuaggcaacauggcaaaaccccaucucuacaaaaaguuaaaaaauuagccgggcaugguggugcacaccuguaagucccagcuacucaggaggcugaggugagaggauggcuugagccugggaggcagaggugcagugaccugacaucgugccacuguacuccagccugggcaacagagcuagaucuuauccuaaaaacaaaaacaaggccaggcgcgguggcucaugccuguaaucccagcacuuugggaggccgaggcggguggaucaugaggucaggagauugagaccauccuggcuaacacagugacaccgcgucucuacuaaaaauauaaaaaauuagccgagcgugguggugggcgccuguagucccagcuacgcagaagacugaggcaggagaauggcaugaacuugggagacggagcuugcagugagccgagaucacgccacugcacuccagccugggcaacagagcaagacucugucucaaaaaaacaaacaaaaaaaccagaaagaagaaagaaaaugagcacaaccuccauguacccauucccaguuuuucaguaauuuucagcucaugguuaaucuuguaaauaacuauuuuuugaaaaauuguguaauauaacuccaaucuagaacuugucaauaauaagccuugaagauccacaagaaagagaaguuacuggacucuauagggcgcaaguaguaucacaauagaccuguguagggcugggcugugaagauaaggcacccaggacaagcacugcuugagaguuacaaaaaucaaaauguaucugauugguuggagccaagagucaaggguuccaaaaucuaacuaugaaaaagggaccaccaggcugggcacgguggcucgugccuguagucccagcacuuugggaggccaacauggugaaaccccgucucuacuaaaaauacaaaaauuagccgggcaugguggcaugugccuguagucccagcuacuuggaaggcugaggcagaaucgcuugaacccuggaggcggagguugcagugagcugagaucgcgccacugcacuccagcuugagugacagagugagacugucucaaaaaaauaacaauacuaauaaaaaaagaaaagaaaaagggacuacccaacaaguaaaagacucagguagaauuccaaugaaguuggcugggcgugguggcucauggcuguaaucccagcacuuuaggaggccaaggcggguggaucaugaggucaggaguucaagaccagccuggccaacauagugaaaccccaucucuacuaaaaauacaaaaaauuagcagggcgugguggugggcacauguaaucccagcuacuugggaggcugaggcaggagaaucgcuugaacccgggagguggagguugcagugagccgagaucacgccauugcauuccagccugggcgacagugcgaggcugucucaaaaaaauaaaaauaaaauaaauaaaaauuggccgggcgcgguggcucacaccuguaaucccagcacuuugggaggcagaggcgggcagaucacgaggucaggagaucgagaccauccuggcuaacacagugaaaccccgucucuacuaaaaauacaaaaaauuagccaggugugguggcgggcgccuguagucccagcuacuugggaggcugaggcaggagaauggcgugaaccugggaggcggagcuugcagugagccaagauugugccacugcacuccagccugggugacagagcaagacuccaucucaaaaaaaauaaauaaaaaauaaauaaauaaauaaguaaaaaugaaaaagaauuacaaugaagucuugaguccuugguucugaaucaucauccaucagucauagcuauguccucagcuaucacgguaacccuggcgcuccagaguaagugaaaacuacccucagacaaaaauaaaaauuaaaggccagguguagggguucacgcuuauaaucccagcacuuugggaggccaaggugggcggaucaccugaggucaggaguuugagaccaaccuggcaaccauggcaaaauccugucucuacuaaaaauacaaaaaauuagccaggcaugguggagggcgccaguaauuccagcuauucaggaggcugaggcaggagaaucacuugaacucgggaaguggagguuucagugagcugagauugcgccacugcaccccugccugggcgacagagcgagauucccucucuaaauaagugaaucaauaaaauuuaauuagagcuagcaaggcugggcacaguggcucaugccuguaaugcagcacuuugggaggcugaggcggggggaucacuugaagucaggaguuugagaccagccugcccaacauggcgaaaccccgucucuaguaaaaauacaaaaauuagccaggugugguggcgcaugccucuaaucccagcuauuugggaggaugaggcaggagaaucacugaacgugggagguggagguugcagugagccaagauugcgccagugcacuucugccuaggugacagugagacuccaacucaagaaaaaaaaaaaaguagagcuugugaaguguuuaugaucaguuuuagugucacauguacagaucaguaauguaaucauuauaauacuaugucuggucuacggcugggcgcgguggcucacgcuuguaaucccagcacuuugggaggcugaggcaggcagauugccugaggucaggaguucgagaucagccuggccaacaaagugaaaccccgucucuacuaaaaauacaaaaauuagcugggagugguggcacgcuccuguaaucucagcuacucgggaggcugaggcaggagaaucgcuugaaccugggugguggagguuguaguaagccgagaucacuacagccugggcaacagagcgagacugccucaaaaaaaaaaaaaagcauuaaauuucauuuuauuuucauuuuucccuuuauuuuuucauuuuuuaguugugaaaguaguucguauauauuuagaaaaauguuuacuuuuaauaaacuauucauuuaauaaauguauuaacugagcacuaaauaaugcucaaaggaucauagauuuuuuuccuccacacuaagcccaugggacaugaagaauaucugggugcuuccaggauauaaggaaggaaugugccuuuucccacuccuggccuuuggguacuguccugagcaugggaugcuggggcaggggcugccuuggccaucuugccaucugcauggcaguggcagaggauagcugagggaaaggacuagagagcccuggagcugccgccuugcucugugagaagccccuuccaauggagauuugaauuacuugcaacuuguuggccugccucuccaccccacccccaucuguucccuagcucucaacuuuggcugcacacuggaaucuccuacucaugcucccugacuaugcccucacagauucugauuugacugguccugggugcaacggggcuggcaugagacgacuaaaaacuccccaggugaauccaaugagcaaccaggcuaaggaccagugaucuaacuguaagucauucucuucuuuucccuuuguaauuuuauguuuccaccucauacugugguuggcuacaucuguuucuucccucuccuacuagaauguaggcuccagauggccuuccaaacaauacauguggcccuucacgcuccaggugaugacaaguacccguugcugauggaaguagcagagucauaccuuucuuggaauuuagguucuacagucaaugcuuauggcacccaaugagucaaaaacacccuuggcaacuccuaaggaaggcucugcccuggaaccugauguacuguuuccccaucaccauccagggagaguuuccuccugggccggaacagaaagcugccuccuccaucaggcaccagaggaaguagggggcuucuguuuagggaccacuuugcauaaauacacauuuaaacaugugccucacccucagcacagcaggaugcucacgccaugaacagccaacaggaaccagagugaccgacccuccaggagguacacaccucccucccaucccacccacuucugagcauaugguucucacauccaccaguggguggaaucacccacaccauuuaaacuuuuugucaaggauguagagcugaauucaugugauuucccacaugagcaaugucccucccuccacugcacaauuauagccagcucaagcagguccucuccuuccuucuaccugcccugcaaauggcucucuccuucacugaccccccgcccuccuucuuaaaggcugaugcucccuaggacucuauccuugaugcuucucauuaauucuucuccccgcuggcucucagcccuacuuagggcuccugaucaguuaaaaaagacccaugagaccuccccuccccaguuaacagagauguggcccaagaggcuccccacuucuaauuugagugggggcaaaagaagagaaagaucuuaucuaggucuugggggcagggcuugcagggcacaaagaaacagaguaaaugugcaacaggcuauuuucuugaaugaauggauucauaauaagaacaggacuucaccagcuuccaagggacccuccccaccucucggauauauucugaagccuaaauuucaccugcuuaucuaggauccuaggccaggccuucugccacaccaagccacaccaagcucagcaguacucacaggccuuuaaucuauaacugccuggccacaccaucacuuccccaggaugguggggagggaugaagauguauagccagguaggccacaccaacucugaguccaagagggaaggacuggggucaggcuggggcuugggcaggggacucccggccccaggcgaugagggaguugcuggcuugggcaagcucggcgauggacacccggccccgcugucggaugaaguuggccacggcggccaguuccucugggguuauguagaugaacuugccccggucgucaaucacaccuguggggacaugcagguuguggggcugaggccuccugggcguuccccaucuggccugagaaugcccaccuacuccuucacagcuggcucagggcccuuccggccuccugccugccuggacuuuccuggcugcauccaguccugcuaggagagucgaaucaggcugcccugccuguccucucccacugcugccaccuccaggcccuggcauguccuccuuguaacugcauccagcuacucagugccccuccuugcacaccccuccccccaucuuggguggucauccugccucugcagcacaucccugcagccccuguggcuagacacucuccaaggccaggacugcagugauuggcucucaucaucucaccuguuauaguccccucagccagcagguccuggaugcgauuuaugguguccuaugaggagaacaacucucagaauagagauaggcaccaauguccccagaaaaagcacugaaaccucccucccacuacagccaaaucucuuuauuucccucucaugccacgcccaaaugugacucugugcuuugccuuuggaagggcccuggguagaaggggcucugguccugggcccugcaagacccccaaaagaguaucucuuccuguuagaagcggggcagugauguuugcaacacaggcuggugcagucugugcaugagaguugucaagguaacugauuugggcugcuuuggucacaggggcuggcagagugaugggguuuggguuuuuuuuuucuuuccugccuguucguccauuaaaaaugcaggauucccagggugccaggagacuucugugcacuacucacucuugguuggggacaagguagacggugcaucaagacucuaucuuuagggcagguccucucugcuagccacagaccccuggccacacugcacacagcaggccacguuccagggcuuaccugagugcguaggcccaccugggaagccaggucuuccaagagcacaaccuuggacugcuacaaaaagaaggaggaaaagaaagagaggcugagcuugggcaaaucccucuaagcaugggcacccuccagguuugcauucugaucugaucuguucucgguggcuggaaaaacacuguacacacuccuguaggacagccuugcuccccugacacacacacacacacacacacacacacucacuaucacccauugacagagacccgcacaaucauaaacccucucauuccccuucuugcgaggaaggaaucuacccaaaacaaccaccugccucaugggcccuguccuggacuccgagacacacgagugguaaucagagcacagcagccaccauccucugcauccagccaucucuuuuuaacaucauggacaaguucaaggggacgcaccauagggaggaaggaggcggugagagucaccaaaagcuauuuuaaauaacugucaccaggacuuaugcuugcugaggaccuacuagaacaaggcccugagaagguaggagggacacaugcugaacaagccauaguccccgcccuggagcucgcaguccggcuggugagacaggugaguacauggacaagagggagagcagauaaaagcccgagcaagccaaggucucucaguagaggcugugggggcccacuccugccuugccuucgcuggccgccccacuggccuggucccccacaaccugacacacccacacuuuuuauccauccucuuuauaccaucugaggcacugagcccacccuugaaaucacugucacuaauaccgcugagugcuuuccagcacagccacguucugugcuccaagugcuucuucauacccucaguagaaaccugaguucccaagggcgcagcgaaggguccaccgcuguguccacacaggcaccugcccccacuaccccaacacacagcacaggacuugagaaaaggcaguucuuuugcauuucugugaauccuccaccgcaaaugagcugggggaggacugacauggugacaccucccugacugcagauagcaugugacuuguuugaaaugccaaagccguauguacaagcaagaaggcaagcgagaggcagcugggucaggaugggcaaggacaaagugacguggucagcuggucucuaccuacaaaacagggaucaggcagcgggcucucagugacaguguggugcgagaacaugaagucaccccaggugcucccugaugaccuggccugaggugcugcuggggccaaaacacguuugauaaaacaagcuaggugugguggcacccaccugcaaucucagcuacucaggaggcagaggcaggaagaucgccugagcccagccauggucagacaggagaauggaacaagaucgagugaacccuacaccucucauaaacgaugcugggugcaggcauguuccuccaguucugaaaucuuaaggcaaaaaaggucuauccccuuggagcaaggaggaaagcagacagacugaauuucagaaguccuccuuuuccuugcaagacagcagcucuagaagaauuagccagcacaggcuggaaaaacuuuuuuucuuuuuuuuuugagacagagucucacucugucgcccaggcuggagugcaguggcaccaucuugccucacugcaaccuccaccuccuggguucaagugauucuccugccucagccuccugaguagcugggacuacaggugugcaccaccaugccuggcuaauuuuuguauuuuuagcagagaugggguuucagcauguugcccaggcuagucucaaacuccugaccucaagugaucugcccgccucggccucucaaagugcugggauugcaggcgugagccaccaugcccggacaagcuggaaaaacuucuaagcuccaaaagaguuuggagaacucccagagaauaguuaccuccagggagccaccaaaagugagggcuagaacuggggaccuuucuucugguuucugcagaguaaagggggauguugaagcugacccccuccucuaauuccaccugggaaggcuuccuggggaggggcuucaggaccaucuuacugccuacuggguagguggggacaaguuccaaacagcagcaggcaagugugagaaauaaccugcccggccacagccccuaaucaagugugccaggguagagagagggcuccaugagaggggagugcacacagccugaacagacaggacccucucaaagcugccagcauuucccccacuuaagaaccccagacucaaggcugugagcccagccccucgcugcuggcaggcgucuaaacccugcucucuuucaggagagguggcgggaggauuaugcaagcccuggguccuuggcagccccugguagcacccccaccaccgcccccgcucccucugcacuccuucccucagccgccucugcaccucugaguugcacuugaaaaccucuccccucauggcauccuucgugggagagaaguugcuuagcagcaaagcaaaguaggaugugcuuaugcaaccuggagcagcaucgaggcggccugcgcaguggcugcggacagaaggggacacacugccgccccacccuaaacuccaaaggaaacaccauccuguucccccugaaagacccaaguucccagucaggagcacauggcagaggaugcuuguuucaacucaguggagccucagugugacagaacugacagaaaacacaugugaagagacuugaaaacacacugacucacugagcguggggucugaagagcagggaaacugucaaacugagugugaggaagugaucaaaggcuugcgccucccacacagacccagguccuucuccaccuucgggguuggagggagagaaacucuccuggccaggacccugcggcucugccccucugggccccccuguccacuccugcaugagccugaaugcccugccugcagcccccgcuggaggcauccaaccugcacaugccaggcagggagcugacacucaggcucuguucaguggcuucuuaccuugauguaguugaugaacucugucaggaagcucugggacuagagaagcagagaaaucagggugagcacccccuagcaagcccacaggguucuguacccauucacccaaguaccaccugcucacuugagggccaccugccugcagccugccuuuggcccgcccaaccaccugcacauaccgcuugccuacacaagcagcagagccuuccagggugagaguuucggaggcaccagccucugcugaggacaaggccucuggccacuaaagccugcugguacugaugcccacccaccucucacugccuggccaggggcgucugggaugggguggcuagccuugcgucuggcacaggcugcacugaugggugcagagaggggcuucccaggggcagcaggcccaccuguuccucagucauggucucuccuacgccuuccuccuccaccacaaaggccuccuucaguuucagguacuccucaugcucccgcugggccugcuccucgcgggccuuccucuccuccuccuccuguggacauaggaggcaaaagucagguaucgggggcagaacagggcaggcaccuguucugguugcugcuaccccugcaggacaccagagcauauagcccagccuuuucucagagacagagcuccuucaggacccccauuucuccauucccccaagcugaaccaugggccgaggccccucuugucaucgguuucaucaucaccuggacaaaugcugcucagccccuucucccgcccuccgugcucaggggaucuuagcaaaaaucuguugaaaacccugccaugaccccacucuacaauacccuccaaucaccugccccauccucuccuuguguaacucaccaagcauaccccgucauguccacaccucauaagcaaaugugaacccugcauuuccucaccacccacucacccagucagcccacuccagucuggcuucuguguucccaguucuaugaaacaacuccugccacagucucacccaugcccuccacucaccaaacucaagguacaaccuucaggucucauaugucuguccucucagugauccuucuuuccucccuuggcuuccagaucccacccucuccuggauuuccuccugcuccuugggccauucuucccgccuccuucaucauucagcccugccucuucucucuccuccacauucucugggccaccucgcccaugcccaaagcaucaaccccuuccuugccagugacuaccacacuuguagccccacccgaaucucuucucccaaacacacaacgguccaugugacacagcuacugggccaucucacaggcagcagacagacccugggaccuacucuucuacguuuagaccuccuccuaggucccuggcucugugaauuaacacagccaacuggucagaaaugagguccuauugaccccuucuuucucuaacuuccagaaaacucccuggucugucuauguugcuccaucaccacuacugccugguaaaacagccucccucaacccaacacauuuuccagagcacucagaaaaauuuuuaaauggaaagcuagccgggcgugguggcucacgccuguaaucccagcacuuugggaggccaaggcgggcggaucacgaggucaggagaucgagaccauccuggcuaacacggugaaacccugucuccacuaaaaauacaaaaaaaaaauuagccgggcgugguggugggcgccuguagucccagcuacucgggaggcugaggcaggagaauggcgugaaccugggaggcagagcuugcagugagccgagacugugccacugcacuccagccugggggacagagcgagacuccaucucaaaaacaaaaacaagaaucagaaagcuaaagcugaggcaaguaauauacaagaugagucuggggcaucuugcagugccagaaacuaagugcucaaaaaacaaaacgaguguguguuaaagguacacaggagccaacugaaagggcucccaauggucaaagcuggaacaaucucaacaacguaauaaauaacguuacuggauuauaacacaaaguacaaaauaaauacucaugagucuauacaaauauaaaaaaaauggcuggucgggcacgguggcucacgcugguaaucccaccacuuugggaggcugaggcaggcggaucaccugaggucaggaguucaagaccauccuggccaacauggugaaaccucgucucuacuaaaaauacaaaaauuagcugggugugguggcgggugccuguaaucccagcuacucgagaggcugaggcagcagaaucgcuugaaccugggaagcggagguugcagugagcccagauugcgccacuggacuccagccuggaugacagagugagacuccaucucagaaaaaaaaaaaaaaaaaaaaaagacugcaugaauauuuaaugaauagggaaggagagacauaucuccuguaagagauuuccauauaauuuauguaagaacucuaacuccccaacccuuaagugugggcugugcacagugacuucuuuccaaagaaauacgggaagaggggaaaaaaacagucacauuacaguggagaaagcuggcaaacaaaaccgcagccaggcgaccaagguuaacaacauuagggacaagugaagcggauaacuugcauauuugguauguugcauugaagauggaacuucacuuauugucuucuucagucagauccauaaccccagucuaaccaugagaaaaacaucaaccaaacucaaauuaagggaccuucuacaaacuacuugcccaggacuccucaaaauuguuaaggcuggacacaguggcucacacauguaaucccagcacuuugggaggcugagguggguggaucaccugaagucaagaguucaagaccagccuggccaauacggugaaaccccgccucuaccaaaaauacaaaaauuagccaggugugguggugcacgucugucauccuagcugcuugggaggcugaagcaggagaaucauuugaaaucugaagguggagguugcagugagcuaucgcgccacugcacuccagccuugagagcaagacuguaucucaaaaaaaaaaaaaaaaaagguuaagaucaucaaaagcaaggagucuuagcugggcacaguggugcacaccuguagccccagcuacuagggaggcugaggcaggaggauugcuugagcccaagaguuugaaggugcagugagcacuccagccugggugagagugagacuccaucucucuuaaaaaaaaaaaaaaaaaaaaaaaaaggccgggcacaguggcucaugccuguaaucccagcacuuugggaagccaaggcaggaggaucacaaggucaagagauugagaccauacuggccaacauggugaaacccucucucuacuaaaaauauaaaaauuagcugagcgugguggugcaccuguagucccaccuacucgggagaaugaggcaggagagucacuugaacccaagaggcagagguugcagugagccgagaucgugccacugcacuccagccuggagacagagagggacucugucucaaaaaaaaaaaaaaaaagccuggugcaguggcucacgccuguaaucccagcgcuucgggaggcugagguggguggaucaccugaggucgggaguucgagaccagccugaccaacauagagaaaccccgucucuacuaaaaauacaaaauuagccgggcgugguggcacaugccuguaaucccagcuacuugggaggcugaggcagcagaauugcuugaacccaggagguggagguuguggugagccaagaugaugccacugcacuccagccuaggcaacaagaguggaacuccguuucaaaaaaaaaaaaaaaaaaacaaaacagaaauucugauaaacugucaugacacagaagagccuaaggagacaugaccacuaaauguaacauggcauccuagaugggacccuggaaaagaaaaaggauacugggaaaaaacaaauaaaauaugaauaauggggucaggugugguggcucacaccuguaaucccagcacuuugggaggccaagggaagagaauugcuugagucuaggaauucaaaagcagccugggaaacacggugaaacccaaucucuaccaaaaaaaaaaaaaaaaaauuagccaggcaugguggugcacaccuauagucccagcuacucgcagggacggggaacugaagugggaggauugcuugaggcugggaggcagagguugcagugagccaagaucgugccauugcacuccagccugggcaacggagcaagacccugucuuaaucaaucaauaaagaaaaaucugaauaauguuagaguuuaguuaacaauaaugugucaauauuaguugugaggaagguauuaaagugagguaggacguuaaggauaagggaaacugguuacaggggagaagagccaggauauuuaagguacauuaagcgggaccaauauucagaaaggaaaaaacccucucugcuaaugccucccccaugcuguauucuggcuuaucagccacagcacccacauccaggcuuccugccauccaggauccugggacaacaggucagucagaggucacaggucuucccagcuagggcagcccuggcucuaacccuauguaccccacaucuuuaugguguucucuuuuugggaaaccugguucucagaacaaagaaagcaucuggcaaacaaauguucauuagucacuacugcaguggaccccauucccugagcaccuucuguaugccaggcccucgauguaagaaccaucucuuacaaugaucuuccucagccucaaggccuucaggauccagacccccaucaccucucugccaucuucuccuccucuccuggcuuucucugcccagcuauccuccucgccucgcguuccucacaugcuccccgaaaguucaauagucacgugcacaaaaauccccacuccaggcucugcuuuucagcaguggcuuuucuaggcugugguggagccuagggaccaaauaaaccaggaccugcccuugugccaggucuauggcccaccuucuagguuggaggugccagggagcugcauaagaagcaaggcugccuugccuggucaagggucagaggucaggguaggggcuggccucaccuucugcuccuccuccaggcgaagccgcuccuccuccuucuuccacucagcuucgcgcugggacucgagucguuuccgcuccucacguucagccuccucugccuggagagaggucuucauaggggcacaucccucacccccggcuagagugugcccaccgcccagacagacuagggaaggcaaugccugggccagggcacagacccaggcggcaggagacagagccagggaagcagcaaacaccagcccagcaggcaacaagcccucagucugccuuagggaaaaaggaaggcagugcccuuucgcacuucccagagcugcaccccaucccuccggcuugccucacgcugggccuuucgcgcuuguuucuccuccagcuuccgcaguuucuuagcuccaauuuuccccgacaggugaguuuccgcuggcuucucgacaccuuccuccuccugggcuggguauggucaaagaaagacaguucagguucugaccagagaggacugaugacgauggauccccaaccccucgucccuccccuaacagggggauccccuuccacccaccugcaaaugucacuagcccagcucugcccuccagaggcaucugccaugagugcgugugugugugugcaugaauauguagggaugggagaacggugaggggcccauagggcaagggaaaagaugagaacuuuaggccgggcacgguggcugaagccuguaaucccagcacuuugggaggccgagguggguggaucacaaggucaggagauugagaccauccuggcaaucauggugaaaccccaucucuacuaaaaguacaaaaaagggcugggcacgguggcucaugccuguaaucccagaacuuugggaggcaaaggugggcggaucacgagguuaggagaucgagaucauccuggcuaacauggugaaaccucaucucuacuaaaaauacaaaaaauuagcugggugugguggcgggcaccuguagucccagcuacucaggaggcugaggcaggagaauaaugugaacccaggagccggaacuugcagugagcugagaucacgccacugcacuccaaccugggcgacagagugagacacugucucaggggaaaaaaaaauacaaaaauaauuagccgggcaugguggcgggugccuguagucccagcuacucgggaggcugaggcaggggaauggugugaacccaggaggcggaacuugcagugagcggagaucgcgccacugcacuccauccagccugggcgacagagcgagacucugucucaaaaaaaaaaaaaaaaaaaaaauuagccagguguggugguggccacccguagccccagcuacuagggacgcugaagcaggagaauggcaugaacccagcaggcagagcuugccgagaucugcugccaaguggugugagccgagaucacgccacugcacuccagccugagugacagagcaagacucugucucaaaaaaaaaaaaaaaaagaugagaacuuuagauauugcauagccacaaagaaggagguaucagauuaaaauaugcaagugucucggggucacagauagcgcugccuggauauuuaagguacuguggcugauaagccagaauacagcauaggggaggcauuaggagagaggguuguuuuuuuugguuuuuuuuuuuuugagacggagucucgcucuguugcccaggguggagugcaguggcgcgaucucggcucgcugcaagcaccaccuccuggguucacgccauucuccugccucagccuuccgaguagcuggaacuacaggcgccagccaccaugccccccugauuuuuuuauuuuuauuuuuaguagagaccggguuucaccauguuagccaggauggucucaaucuccugaccucgugauccacccgccucggccucccaaagugcugggauuacaggcgugagccaccaugcccagcccagagaggguuuuuuuuguuuguuuauuuguuuuuggagacggagucucgcucugucgcccaggcuggagugcaguggcgcgaucucggcucacugcaagcuccaccucccggguucauggcauucuccugccucagccucccaaguagcuggaacuacaggcacauaccaucacgcccggcuaauuuuuuguauuguuagccaggauggucucgaucuccugaccucgugauccacccuccuuggccucccaaagugcuggaauuacaggugugagccaccacgcccggcccagagaggguuuuuuaccuuucugaaugcuggucucaccuaauguaccuuaaauauccuggcuaaugaacuccagaguucucuggcuucugucucuggugccaaacccccaggcaagggaagucccaugaggaaauuuaucccgccucaaaucugaaauccuccucacaaucgucaggaguugcugaggauucugggcuuagucccuggccaggauuaucccuuugcccaucaaacccuggcugaaaugacagucccaacacuaugacuaccucagggccagcugcaaguuaaagacccacugaugccugugcagcaagggucucugaacccaagucugagccagaagguacggcaaagaaagggccucuucuugagcuaaagggauaauccccaaagguacaaggcaaaagccucaaaugcccccaguuucugagaaacgcccagacgcccccuccucaggcucaagccagcugccaaguacuggagaagacaauccugagggcucuccuggucuccuggaagcagggauauggaggccucugugucaacagaaugucucuaucuuuaaacuguuuuccugggguugugggugaccccacuccaggaacugcagaaacucuuggccaggcacucugccucuagggugaaauccucagggaauaagugugcccauaacaggaagggugcgaggauagaaggggugaauugaggaacauucugaaucaaacugaagacccuugcccucugcuuggacacugagagccaagaugaagguaggggggguugacccaguggaacaaaugccaggucccaagucccccccuacucuaccguguggcucccagacgucccuccuacccugaggcuucauacccuacucccccacuuagcuuugggggcccuuuuaucccccccuccaacccaaacccucuccccaccaggcugggccccucucaccuaggaugacagcuuccuccucguucucaucugcuucugcccaggccacccgcugggcucgacgcugggccuguaggcggcugcccaggucccuccggcgccgaggccugccuccagcucucggcuccucaggcuccaggggcccaggcugggccacccggccugcuccugccagcuccucauugugcaguggcucuuggccggcuguagggaagacagaaaugacaaugcugccuauaagcccagcccggcccauggcaggaggagcggcagcccggaagccucaccuccucugcuuagcggccugcugcccacagcacaaggccccgacuucucagucugacuggcaaggccuuuuccaccaggcccacagcuuggucccaggcgggggcucagcccuucccucgggccugugugaauacuccucuccccucccggcuccaccuuuccagcuggccugucaggaggccccuauccugauguccccagcucucaucgaguacccccugcaggaauccacugauuucucgccuaacaccaccugugguuuuaucuggcuccccagccagagaguacacuucccggcgguggccgagccucccccgggaagaccugcuggaucuccgccuucccucagcgugucccuuccgcuccugggagcgcgcaggugcucagagguagcuugugggcccagggagcaggaaaacacauauacaaacccgcccgcugaccagaaauggggggaaagagggaggauggguguaucuguucugugcccuggccaaugacauggccuucugaucggggagcggauuggggagggagagugggcccucuccuuggcgggaagggagagagcuucaggaauuuccuggagccgccucgcgcuucuccagcucgugggggacaggcagaaaauauucagaugcccccuuccuggcaccugcucuggagccaggcugggaggaauggaaaaccccugcggccucccuaacaggugcagagggaaagggccccgacggugacggaugggagugugcgccggccagggccucaggccuuuggagguauggaguucccgggggugaagagagggaugaggccagacucuggcuuggagucgagagaaagggguagcggcgcggccaccgauuccagguagggcacugcggaagccccacccggcacacgacuagcgcacggacgcgcaugcgucccgcccgcccaggugcgcacgcgcaggagccgcggcgcgacgguccacaaaggcucagaaggccagaaaacccgguaccaccaacccuggugcagcggcaucuccuaccugaugccgcccggccccggcugcgagucaggaagaggauaaagccgacuagcagagccgccgcuaccaaguaccacacaggcgccaccaugacgagggccucagugcagaaccacugcguccacccugaggccgggaucucauaggccccgccccuauuucccaaucuagacuccgcccacuacucgg

SEQ ID NO: 13408 - RNA, 42115 nt, Homo sapiens
ccgaguagugggcggagucuagauugggaaauaggggcggggccuaugagaucccggccucaggguggacgcagugguucugcacugaggcccucgucaugguggcgccugugugguacuugguagcggcggcucugcuagucggcuuuauccucuuccugacucgcagccggggccgggcggcaucagguaggagaugccgcugcaccaggguuggugguaccggguuuucuggccuucugagccuuuguggaccgucgcgccgcggcuccugcgcgugcgcaccugggcgggcgggacgcaugcgcguccgugcgcuagucgugugccggguggggcuuccgcagugcccuaccuggaaucgguggccgcgccgcuaccccuuucucucgacuccaagccagagucuggccucaucccucucuucacccccgggaacuccauaccuccaaaggccugaggcccuggccggcgcacacucccauccgucaccgucggggcccuuucccucugcaccuguuagggaggccgcagggguuuuccauuccucccagccuggcuccagagcaggugccaggaagggggcaucugaauauuuucugccugucccccacgagcuggagaagcgcgaggcggcuccaggaaauuccugaagcucucucccuucccgccaaggagagggcccacucucccuccccaauccgcuccccgaucagaaggccaugucauuggccagggcacagaacagauacacccauccucccucuuuccccccauuucuggucagcgggcggguuuguauauguguuuuccugcucccugggcccacaagcuaccucugagcaccugcgcgcucccaggagcggaagggacacgcugagggaaggcggagauccagcaggucuucccgggggaggcucggccaccgccgggaaguguacucucuggcuggggagccagauaaaaccacaggugguguuaggcgagaaaucaguggauuccugcaggggguacucgaugagagcuggggacaucaggauaggggccuccugacaggccagcuggaaagguggagccgggaggggagaggaguauucacacaggcccgagggaagggcugagcccccgccugggaccaagcugugggccugguggaaaaggccuugccagucagacugagaagucggggccuugugcugugggcagcaggccgcuaagcagaggaggugaggcuuccgggcugccgcuccuccugccaugggccgggcugggcuuauaggcagcauugucauuucugucuucccuacagccggccaagagccacugcacaaugaggagcuggcaggagcaggccggguggcccagccugggccccuggagccugaggagccgagagcuggaggcaggccucggcgccggagggaccugggcagccgccuacaggcccagcgucgagcccagcggguggccugggcagaagcagaugagaacgaggaggaagcugucauccuaggugagaggggcccagccugguggggagaggguuuggguuggagggggggauaaaagggcccccaaagcuaagugggggaguaggguaugaagccucaggguaggagggacgucugggagccacacgguagaguagggggggacuugggaccuggcauuuguuccacugggucaacccccccuaccuucaucuuggcucucaguguccaagcagagggcaagggucuucaguuugauucagaauguuccucaauucaccccuucuauccucgcacccuuccuguuaugggcacacuuauucccugaggauuucacccuagaggcagagugccuggccaagaguuucugcaguuccuggaguggggucacccacaaccccaggaaaacaguuuaaagauagagacauucuguugacacagaggccuccauaucccugcuuccaggagaccaggagagcccucaggauugucuucuccaguacuuggcagcuggcuugagccugaggagggggcgucugggcguuucucagaaacugggggcauuugaggcuuuugccuuguaccuuuggggauuaucccuuuagcucaagaagaggcccuuucuuugccguaccuucuggcucagacuuggguucagagacccuugcugcacaggcaucagugggucuuuaacuugcagcuggcccugagguagucauaguguugggacugucauuucagccaggguuugaugggcaaagggauaauccuggccagggacuaagcccagaauccucagcaacuccugacgauugugaggaggauuucagauuugaggcgggauaaauuuccucaugggacuucccuugccuggggguuuggcaccagagacagaagccagagaacucuggaguucauuagccaggauauuuaagguacauuaggugagaccagcauucagaaagguaaaaaacccucucugggccgggcgugguggcucacaccuguaauuccagcacuuugggaggccaaggaggguggaucacgaggucaggagaucgagaccauccuggcuaacaauacaaaaaauuagccgggcgugaugguaugugccuguaguuccagcuacuugggaggcugaggcaggagaaugccaugaacccgggagguggagcuugcagugagccgagaucgcgccacugcacuccagccugggcgacagagcgagacuccgucuccaaaaacaaauaaacaaacaaaaaaaacccucucugggcugggcaugguggcucacgccuguaaucccagcacuuugggaggccgaggcggguggaucacgaggucaggagauugagaccauccuggcuaacauggugaaacccggucucuacuaaaaauaaaaauaaaaaaaucaggggggcaugguggcuggcgccuguaguuccagcuacucggaaggcugaggcaggagaauggcgugaacccaggagguggugcuugcagcgagccgagaucgcgccacugcacuccacccugggcaacagagcgagacuccgucucaaaaaaaaaaaaaccaaaaaaaacaacccucucuccuaaugccuccccuaugcuguauucuggcuuaucagccacaguaccuuaaauauccaggcagcgcuaucugugaccccgagacacuugcauauuuuaaucugauaccuccuucuuuguggcuaugcaauaucuaaaguucucaucuuuuuuuuuuuuuuuuugagacagagucuugcucugucacucaggcuggagugcaguggcgugaucucggcucacaccacuuggcagcagaucucggcaagcucugccugcuggguucaugccauucuccugcuucagcgucccuaguagcuggggcuacggguggccaccaccacaccuggcuaauuuuuuuuuuuuuuuuuuuuuugagacagagucucgcucugucgcccaggcuggauggagugcaguggcgcgaucuccgcucacugcaaguuccgccuccuggguucacaccauuccccugccucagccucccgaguagcugggacuacaggcacccgccaccaugcccggcuaauuauuuuuguauuuuuuuuuccccugagacagugucucacucugucgcccagguuggagugcaguggcgugaucucagcucacugcaaguuccggcuccuggguucacauuauucuccugccucagccuccugaguagcugggacuacaggugcccgccaccacacccagcuaauuuuuuguauuuuuaguagagaugagguuucaccauguuagccaggaugaucucgaucuccuaaccucgugauccgcccaccuuugccucccaaaguucugggauuacaggcaugagccaccgugcccagcccuuuuuuguacuuuuaguagagaugggguuucaccaugauugccaggauggucucaaucuccugaccuugugauccacccaccucggccucccaaagugcugggauuacaggcuucagccaccgugcccggccuaaaguucucaucuuuucccuugcccuaugggccccucaccguucucccaucccuacauauucaugcacacacacacacgcacucauggcagaugccucuggagggcagagcugggcuagugacauuugcagguggguggaaggggaucccccuguuaggggagggacgagggguuggggauccaucgucaucaguccucucuggucagaaccugaacugucuuucuuugaccauacccagcccaggaggaggaaggugucgagaagccagcggaaacucaccugucggggaaaauuggagcuaagaaacugcggaagcuggaggagaaacaagcgcgaaaggcccagcgugaggcaagccggagggauggggugcagcucugggaagugcgaaagggcacugccuuccuuuuucccuaaggcagacugagggcuuguugccugcugggcugguguuugcugcuucccuggcucugucuccugccgccugggucugugcccuggcccaggcauugccuucccuagucugucugggcggugggcacacucuagccgggggugagggaugugccccuaugaagaccucucuccaggcagaggaggcugaacgugaggagcggaaacgacucgagucccagcgcgaagcugaguggaagaaggaggaggagcggcuucgccuggaggaggagcagaaggugaggccagccccuacccugaccucugacccuugaccaggcaaggcagccuugcuucuuaugcagcucccuggcaccuccaaccuagaaggugggccauagaccuggcacaagggcagguccugguuuauuuggucccuaggcuccaccacagccuagaaaagccacugcugaaaagcagagccuggaguggggauuuuugugcacgugacuauugaacuuucggggagcaugugaggaacgcgaggcgaggaggauagcugggcagagaaagccaggagaggaggagaagauggcagagaggugaugggggucuggauccugaaggccuugaggcugaggaagaucauuguaagagaugguucuuacaucgagggccuggcauacagaaggugcucagggaaugggguccacugcaguagugacuaaugaacauuuguuugccagaugcuuucuuuguucugagaaccagguuucccaaaaagagaacaccauaaagaugugggguacauaggguuagagccagggcugcccuagcugggaagaccugugaccucugacugaccuguugucccaggauccuggauggcaggaagccuggaugugggugcuguggcugauaagccagaauacagcaugggggaggcauuagcagagaggguuuuuuccuuucugaauauuggucccgcuuaauguaccuuaaauauccuggcucuucuccccuguaaccaguuucccuuauccuuaacguccuaccucacuuuaauaccuuccucacaacuaauauugacacauuauuguuaacuaaacucuaacauuauucagauuuuucuuuauugauugauuaagacagggucuugcuccguugcccaggcuggagugcaauggcacgaucuuggcucacugcaaccucugccucccagccucaagcaauccucccacuucaguuccccgucccugcgaguagcugggacuauaggugugcaccaccaugccuggcuaauuuuuuuuuuuuuuuuuugguagagauuggguuucaccguguuucccaggcugcuuuugaauuccuagacucaagcaauucucuucccuuggccucccaaagugcugggauuacaggugugagccaccacaccugaccccauuauucauauuuuauuuguuuuuucccaguauccuuuuucuuuuccagggucccaucuaggaugccauguuacauuuaguggucaugucuccuuaggcucuucugugucaugacaguuuaucagaauuucuguuuuguuuuuuuuuuuuuuuuuuugaaacggaguuccacucuuguugccuaggcuggagugcaguggcaucaucuuggcucaccacaaccuccaccuccuggguucaagcaauucugcugccucagccucccaaguagcugggauuacaggcaugugccaccacgcccggcuaauuuuguauuuuuaguagagacgggguuucucuauguuggucaggcuggucucgaacucccgaccucaggugauccacccaccucagccucccgaagcgcugggauuacaggcgugagccacugcaccaggcuuuuuuuuuuuuuuuuugagacagagucccucucugucuccaggcuggagugcaguggcacgaucucggcucacugcaaccucugccucuuggguucaagugacucuccugccucauucucccgaguaggugggacuacaggugcaccaccacgcucagcuaauuuuuauauuuuuaguagagagaggguuucaccauguuggccaguauggucucaaucucuugaccuugugauccuccugccuuggcuucccaaagugcugggauuacaggcaugagccacugugcccggccuuuuuuuuuuuuuuuuuuuuuuuuuaagagagauggagucucacucucacccaggcuggagugcucacugcaccuucaaacucuugggcucaagcaauccuccugccucagccucccuaguagcuggggcuacaggugugcaccacugugcccagcuaagacuccuugcuuuugaugaucuuaaccuuuuuuuuuuuuuuuuuugagauacagucuugcucucaaggcuggagugcaguggcgcgauagcucacugcaaccuccaccuucagauuucaaaugauucuccugcuucagccucccaagcagcuaggaugacagacgugcaccaccacaccuggcuaauuuuuguauuuuugguagaggcgggguuucaccguauuggccaggcuggucuugaacucuugacuucaggugauccacccaccucagccucccaaagugcugggauuacaugugugagccacuguguccagccuuaacaauuuugaggaguccugggcaaguaguuuguagaaggucccuuaauuugaguuugguugauguuuuucucaugguuagacugggguuauggaucugacugaagaagacaauaagugaaguuccaucuucaaugcaacauaccaaauaugcaaguuauccgcuucacuugucccuaauguuguuaaccuuggucgccuggcugcgguuuuguuugccagcuuucuccacuguaaugugacuguuuuuuuccccucuucccguauuucuuuggaaagaagucacugugcacagcccacacuuaaggguuggggaguuagaguucuuacauaaauuauauggaaaucucuuacaggagauaugucucuccuucccuauucauuaaauauucaugcagucuuuuuuuuuuuuuuuuuuuuuucugagauggagucucacucugucauccaggcuggaguccaguggcgcaaucugggcucacugcaaccuccgcuucccagguucaagcgauucugcugccucagccucucgaguagcugggauuacaggcacccgccaccacacccagcuaauuuuuguauuuuuaguagagacgagguuucaccauguuggccaggauggucuugaacuccugaccucaggugauccgccugccucagccucccaaaguggugggauuaccagcgugagccaccgugcccgaccagccauuuuuuuuauauuuguauagacucaugaguauuuauuuuguacuuuguguuauaauccaguaacguuauuuauuacguuguugagauuguuccagcuuugaccauugggagcccuuucaguuggcuccuguguaccuuuaacacacacucguuuuguuuuuugagcacuuaguuucuggcacugcaagaugccccagacucaucuuguauauuacuugccucagcuuuagcuuucugauucuuguuuuuguuuuugagauggagucucgcucugucccccaggcuggagugcaguggcacagucucggcucacugcaagcucugccucccagguucacgccauucuccugccucagccucccgaguagcugggacuacaggcgcccaccaccacgcccggcuaauuuuuuuuuuguauuuuuaguggagacaggguuucaccguguuagccaggauggucucgaucuccugaccucgugauccgcccgccuuggccucccaaagugcugggauuacaggcgugagccaccacgcccggcuagcuuuccauuuaaaaauuuuucugagugcucuggaaaauguguuggguugagggaggcuguuuuaccaggcaguaguggugauggagcaacauagacagaccagggaguuuucuggaaguuagagaaagaaggggucaauaggaccucauuucugaccaguuggcuguguuaauucacagagccagggaccuaggaggaggucuaaacguagaagaguaggucccagggucugucugcugccugugagauggcccaguagcugugucacauggaccguuguguguuugggagaagagauucggguggggcuacaagugugguagucacuggcaaggaagggguugaugcuuugggcaugggcgagguggcccagagaauguggaggagagagaagaggcagggcugaaugaugaaggaggcgggaagaauggcccaaggagcaggaggaaauccaggagagggugggaucuggaagccaagggaggaaagaaggaucacugagaggacagacauaugagaccugaagguuguaccuugaguuuggugaguggagggcaugggugagacuguggcaggaguuguuucauagaacugggaacacagaagccagacuggagugggcugacugggugaguggguggugaggaaaugcaggguucacauuugcuuaugagguguggacaugacgggguaugcuuggugaguuacacaaggagaggauggggcaggugauuggaggguauuguagaguggggucauggcaggguuuucaacagauuuuugcuaagauccccugagcacggagggcgggagaaggggcugagcagcauuuguccaggugaugaugaaaccgaugacaagaggggccucggcccaugguucagcuugggggaauggagaaauggggguccugaaggagcucugucucugagaaaaggcugggcuauaugcucugguguccugcagggguagcagcaaccagaacaggugccugcccuguucugcccccgauaccugacuuuugccuccuauguccacaggaggaggaggagaggaaggcccgcgaggagcaggcccagcgggagcaugaggaguaccugaaacugaaggaggccuuugugguggaggaggaaggcguaggagagaccaugacugaggaacaggugggccugcugccccugggaagccccucucugcacccaucagugcagccugugccagacgcaaggcuagccaccccaucccagacgccccuggccaggcagugagaggugggugggcaucaguaccagcaggcuuuaguggccagaggccuuguccucagcagaggcuggugccuccgaaacucucacccuggaaggcucugcugcuuguguaggcaagcgguaugugcaggugguugggcgggccaaaggcaggcugcaggcagguggcccucaagugagcaggugguacuugggugaauggguacagaacccugugggcuugcuagggggugcucacccugauuucucugcuucucuagucccagagcuuccugacagaguucaucaacuacaucaagguaagaagccacugaacagagccugagugucagcucccugccuggcaugugcagguuggaugccuccagcgggggcugcaggcagggcauucaggcucaugcaggaguggacaggggggcccagaggggcagagccgcaggguccuggccaggagaguuucucucccuccaaccccgaagguggagaaggaccugggucugugugggaggcgcaagccuuugaucacuuccucacacucaguuugacaguuucccugcucuucagaccccacgcucagugagucaguguguuuucaagucucuucacauguguuuucugucaguucugucacacugaggcuccacugaguugaaacaagcauccucugccaugugcuccugacugggaacuugggucuuucagggggaacaggaugguguuuccuuuggaguuuaggguggggcggcaguguguccccuucuguccgcagccacugcgcaggccgccucgaugcugcuccagguugcauaagcacauccuacuuugcuuugcugcuaagcaacuucucucccacgaaggaugccaugaggggagagguuuucaagugcaacucagaggugcagaggcggcugagggaaggagugcagagggagcgggggcgguggugggggugcuaccaggggcugccaaggacccagggcuugcauaauccucccgccaccucuccugaaagagagcaggguuuagacgccugccagcagcgaggggcugggcucacagccuugagucugggguucuuaagugggggaaaugcuggcagcuuugagaggguccugucuguucaggcugugugcacuccccucucauggagcccucucucuacccuggcacacuugauuaggggcuguggccgggcagguuauuucucacacuugccugcugcuguuuggaacuuguccccaccuacccaguaggcaguaagaugguccugaagccccuccccaggaagccuucccagguggaauuagaggagggggucagcuucaacaucccccuuuacucugcagaaaccagaagaaagguccccaguucuagcccucacuuuugguggcucccuggagguaacuauucucugggaguucuccaaacucuuuuggagcuuagaaguuuuuccagcuuguccgggcaugguggcucacgccugcaaucccagcacuuugagaggccgaggcgggcagaucacuugaggucaggaguuugagacuagccugggcaacaugcugaaaccccaucucugcuaaaaauacaaaaauuagccaggcaugguggugcacaccuguagucccagcuacucaggaggcugaggcaggagaaucacuugaacccaggagguggagguugcagugaggcaagauggugccacugcacuccagccugggcgacagagugagacucugucucaaaaaaaaaagaaaaaaaguuuuuccagccugugcuggcuaauucuucuagagcugcugucuugcaaggaaaaggaggacuucugaaauucagucugucugcuuuccuccuugcuccaaggggauagaccuuuuuugccuuaagauuucagaacuggaggaacaugccugcacccagcaucguuuaugagagguguaggguucacucgaucuuguuccauucuccugucugaccauggcugggcucaggcgaucuuccugccucugccuccugaguagcugagauugcaggugggugccaccacaccuagcuuguuuuaucaaacguguuuuggccccagcagcaccucaggccaggucaucagggagcaccuggggugacuucauguucucgcaccacacugucacugagagcccgcugccugaucccuguuuuguagguagagaccagcugaccacgucacuuuguccuugcccauccugacccagcugccucucgcuugccuucuugcuuguacauacggcuuuggcauuucaaacaagucacaugcuaucugcagucagggaggugucaccaugucaguccucccccagcucauuugcgguggaggauucacagaaaugcaaaagaacugccuuuucucaaguccugugcuguguguugggguagugggggcaggugccuguguggacacagcgguggacccuucgcugcgcccuugggaacucagguuucuacugaggguaugaagaagcacuuggagcacagaacguggcugugcuggaaagcacucagcgguauuagugacagugauuucaagggugggcucagugccucagaugguauaaagaggauggauaaaaagugugggugugucagguugugggggaccaggccaguggggcggccagcgaaggcaaggcaggagugggcccccacagccucuacugagagaccuuggcuugcucgggcuuuuaucugcucucccucuuguccauguacucaccugucucaccagccggacugcgagcuccagggcggggacuauggcuuguucagcaugugucccuccuaccuucucagggccuuguucuaguagguccucagcaagcauaaguccuggugacaguuauuuaaaauagcuuuuggugacucucaccgccuccuuccucccuauggugcguccccuugaacuuguccaugauguuaaaaagagauggcuggaugcagaggaugguggcugcugugcucugauuaccacucgugugucucggaguccaggacagggcccaugaggcaggugguuguuuuggguagauuccuuccucgcaagaaggggaaugagaggguuuaugauugugcgggucucugucaaugggugauagugagugugugugugugugugugugugugugucaggggagcaaggcuguccuacaggaguguguacaguguuuuuccagccaccgagaacagaucagaucagaaugcaaaccuggagggugcccaugcuuagagggauuugcccaagcucagccucucuuucuuuuccuccuucuuuuuguagcaguccaagguugugcucuuggaagaccuggcuucccaggugggccuacgcacucagguaagcccuggaacguggccugcugugugcaguguggccaggggucuguggcuagcagagaggaccugcccuaaagauagagucuugaugcaccgucuaccuuguccccaaccaagagugaguagugcacagaagucuccuggcacccugggaauccugcauuuuuaauggacgaacaggcaggaaagaaaaaaaaaacccaaaccccaucacucugccagccccugugaccaaagcagcccaaaucaguuaccuugacaacucucaugcacagacugcaccagccuguguugcaaacaucacugccccgcuucuaacaggaagagauacucuuuugggggucuugcagggcccaggaccagagccccuucuacccagggcccuuccaaaggcaaagcacagagucacauuugggcguggcaugagagggaaauaaagagauuuggcuguagugggagggagguuucagugcuuuuucuggggacauuggugccuaucucuauucugagaguuguucuccucauaggacaccauaaaucgcauccaggaccugcuggcugaggggacuauaacaggugagaugaugagagccaaucacugcaguccuggccuuggagagugucuagccacaggggcugcagggaugugcugcagaggcaggaugaccacccaagauggggggaggggugugcaaggaggggcacugaguagcuggaugcaguuacaaggaggacaugccagggccuggagguggcagcagugggagaggacaggcagggcagccugauucgacucuccuagcaggacuggaugcagccaggaaaguccaggcaggcaggaggccggaagggcccugagccagcugugaaggaguaggugggcauucucaggccagauggggaacgcccaggaggccucagccccacaaccugcauguccccacaggugugauugacgaccggggcaaguucaucuacauaaccccagaggaacuggccgccguggccaacuucauccgacagcggggccggguguccaucgccgagcuugcccaagccagcaacucccucaucgccuggggccgggaguccccugcccaagccccagccugaccccaguccuucccucuuggacucagaguugguguggccuaccuggcuauacaucuucaucccuccccaccauccuggggaagugaugguguggccaggcaguuauagauuaaaggccugugaguacugcugagcuugguguggcuugguguggcagaaggccuggccuaggauccuagauaagcaggugaaauuuaggcuucagaauauauccgagagguggggagggucccuuggaagcuggugaaguccuguucuuauuaugaauccauucauucaagaaaauagccuguugcacauuuacucuguuucuuugugcccugcaagcccugcccccaagaccuagauaagaucuuucucuucuuuugcccccacucaaauuagaaguggggagccucuugggccacaucucuguuaacuggggaggggaggucucaugggucuuuuuuaacugaucaggagcccuaaguagggcugagagccagcggggagaagaauuaaugagaagcaucaaggauagaguccuagggagcaucagccuuuaagaaggagggcggggggucagugaaggagagagccauuugcagggcagguagaaggaaggagaggaccugcuugagcuggcuauaauugugcaguggagggagggacauugcucaugugggaaaucacaugaauucagcucuacauccuugacaaaaaguuuaaauggugugggugauuccacccacugguggaugugagaaccauaugcucagaagugggugggaugggagggagguguguaccuccuggagggucggucacucugguuccuguuggcuguucauggcgugagcauccugcugugcugagggugaggcacauguuuaaauguguauuuaugcaaaguggucccuaaacagaagcccccuacuuccucuggugccugauggaggaggcagcuuucuguuccggcccaggaggaaacucucccuggauggugauggggaaacaguacaucagguuccagggcagagccuuccuuaggaguugccaaggguguuuuugacucauugggugccauaagcauugacuguagaaccuaaauuccaagaaagguaugacucugcuacuuccaucagcaacggguacuugucaucaccuggagcgugaagggccacauguauuguuuggaaggccaucuggagccuacauucuaguaggagagggaagaaacagauguagccaaccacaguaugagguggaaacauaaaauuacaaagggaaaagaagagaaugacuuacaguuagaucacugguccuuagccugguugcucauuggauucaccuggggaguuuuuagucgucucaugccagccccguugcacccaggaccagucaaaucagaaucugugagggcauagucagggagcaugaguaggagauuccagugugcagccaaaguugagagcuagggaacagaugggggugggguggagaggcaggccaacaaguugcaaguaauucaaaucuccauuggaaggggcuucucacagagcaaggcggcagcuccagggcucucuaguccuuucccucagcuauccucugccacugccaugcagauggcaagauggccaaggcagccccugccccagcaucccaugcucaggacaguacccaaaggccaggagugggaaaaggcacauuccuuccuuauauccuggaagcacccagauauucuucaugucccaugggcuuaguguggaggaaaaaaaucuaugauccuuugagcauuauuuagugcucaguuaauacauuuauuaaaugaauaguuuauuaaaaguaaacauuuuucuaaauauauacgaacuacuuucacaacuaaaaaaugaaaaaauaaagggaaaaaugaaaauaaaaugaaauuuaaugcuuuuuuuuuuuuuugaggcagucucgcucuguugcccaggcuguagugaucucggcuuacuacaaccuccaccacccagguucaagcgauucuccugccucagccucccgaguagcugagauuacaggagcgugccaccacucccagcuaauuuuuguauuuuuaguagagacgggguuucacuuuguuggccaggcugaucucgaacuccugaccucaggcaaucugccugccucagccucccaaagugcugggauuacaagcgugagccaccgcgcccagccguagaccagacauaguauuauaaugauuacauuacugaucuguacaugugacacuaaaacugaucauaaacacuucacaagcucuacuuuuuuuuuuuucuugaguuggagucucacugucaccuaggcagaagugcacuggcgcaaucuuggcucacugcaaccuccaccucccacguucagugauucuccugccucauccucccaaauagcugggauuagaggcaugcgccaccacaccuggcuaauuuuuguauuuuuacuagagacgggguuucgccauguugggcaggcuggucucaaacuccugacuucaagugauccccccgccucagccucccaaagugcugcauuacaggcaugagccacugugcccagccuugcuagcucuaauuaaauuuuauugauucacuuauuuagagagggaaucucgcucugucgcccaggcaggggugcaguggcgcaaucucagcucacugaaaccuccacuucccgaguucaagugauucuccugccucagccuccugaauagcuggaauuacuggcgcccuccaccaugccuggcuaauuuuuuguauuuuuaguagagacaggauuuugccaugguugccagguuggucucaaacuccugaccucaggugauccgcccaccuuggccucccaaagugcugggauuauaagcgugaaccccuacaccuggccuuuaauuuuuauuuuugucugaggguaguuuucacuuacucuggagcgccaggguuaccgugauagcugaggacauagcuaugacugauggaugaugauucagaaccaaggacucaagacuucauuguaauucuuuuucauuuuuacuuauuuauuuauuuauuuuuuauuuauuuuuuuugagauggagucuugcucugucacccaggcuggagugcaguggcacaaucuuggcucacugcaagcuccgccucccagguucacgccauucuccugccucagccucccaaguagcugggacuacaggcgcccgccaccacaccuggcuaauuuuuuguauuuuuaguagagacgggguuucacuguguuagccaggauggucucgaucuccugaccucgugaucugcccgccucugccucccaaagugcugggauuacaggugugagccaccgcgcccggccaauuuuuauuuauuuuauuuuuauuuuuuugagacagccucgcacugucgcccaggcuggaaugcaauggcgugaucucggcucacugcaaccuccaccucccggguucaagcgauucuccugccucagccucccaaguagcugggauuacaugugcccaccaccacgcccugcuaauuuuuuguauuuuuaguagagaugggguuucacuauguuggccaggcuggucuugaacuccugaccucaugauccacccgccuuggccuccuaaagugcugggauuacagccaugagccaccacgcccagccaacuucauuggaauucuaccugagucuuuuacuuguuggguagucccuuuuucuuuucuuuuuuuauuaguauuguuauuuuuuugagacagucucacucugucacucaagcuggagugcaguggcgcgaucucagcucacugcaaccuccgccuccaggguucaagcgauucugccucagccuuccaaguagcugggacuacaggcacaugccaccaugcccggcuaauuuuuguauuuuuaguagagacgggguuucaccauguuggccucccaaagugcugggacuacaggcacgagccaccgugcccagccugguggucccuuuuucauaguuagauuuuggaacccuugacucuuggcuccaaccaaucagauacauuuugauuuuuguaacucucaagcagugcuuguccugggugccuuaucuucacagcccagcccuacacaggucuauugugauacuacuugcgcccuauagaguccaguaacuucucuuucuuguggaucuucaaggcuuauuauugacaaguucuagauuggaguuauauuacacaauuuuucaaaaaauaguuauuuacaagauuaaccaugagcugaaaauuacugaaaaacugggaauggguacauggagguugugcucauuuucuuucuucuuucugguuuuuuuguuuguuuuuuugagacagagucuugcucuguugcccaggcuggagugcaguggcgugaucucggcucacugcaagcuccgucucccaaguucaugccauucuccugccucagucuucugcguagcugggacuacaggcgcccaccaccacgcucggcuaauuuuuuauauuuuuaguagagacgcggugucacuguguuagccaggauggucucaaucuccugaccucaugauccacccgccucggccucccaaagugcugggauuacaggcaugagccaccgcgccuggccuuguuuuuguuuuuaggauaagaucuagcucuguugcccaggcuggaguacaguggcacgaugucaggucacugcaccucugccucccaggcucaagccauccucucaccucagccuccugaguagcugggacuuacaggugugcaccaccaugcccggcuaauuuuuuaacuuuuuguagagaugggguuuugccauguugccuaggcuggucucgaacucaugagcucaagcaauccaccuaucuuggccucccaaaguguugggauuacaggcaugagccacugcacccagccaucuauuuuccuacauguuuaaacuuuucuauaacaaaacauaaagaguccuagauggccuuguguauccuuggcucaugcuaaaccucaagaaaaggagcuaaaauagcuggguuauguggagcuaaaguagcuggguuaugugaagccaccgguaauaugguggcaguucagugauucccccaggcuaccacagugauacugauacuggaugcauguuggauuuuuguuuuuugagacagagucucacucuugcccaggcuggaguacaguggugugaucauggcucacugcugccucaaacuucugggcucaagugauccucccaccucagccuuucuaguagcuaggacuacaggagcacuccaccaugcccagcuaauauauauauauauuuuuucucuuuuugguagagacgggaucucacuauguugcucaugguagucucgaacuccugggcucaagugauccuccuaccuuggccucgcaaagcacugggauuauagccguguaccacugcacccagccuguauugaaucuuuguaacagaaaaguauuuaaacacaucugaaauauguuguuaaaaaauaacguaauuuauggggagcuuacugaguacaaggcaugauuuugaacacccuagggaaguacagugagcaaaacauggccccagccacaaguagggguuagugcagugguauuuuuuuuuuucuuugagacagagucucgcucugucgcccaggcuggagugcaguggugcaaucucagcucacugaaagcuccgccuccuggguucacgccauucuccugccucagccucccgaguagcugggaccacaggcguccgccaccacgcccggcuaauauuuuuguauuuuuaguagagacgggguuucaccguguuagccaggauggucuugaucuccugaccucaugauccacccgccuuggccucccuaagugcugggauuacaggcuugagccaccgcgcccggccagugcagugguauuaaucugacagagagaccaaucaaucacaagcuagcaagugcacagccagaugcuggaguguaugaaagggaccaguggauaauaggagaggccuuccaggcuagaaggaggacaggugcagagaucuggaguggagaauaaggccugugguucccugaggggagcauggaguguuggguggaggaaaggccagggcaaaugagagacaaagcuggaaaaggaggcugggaccuggcugggaaggucugagcccagagaucugagcuauguuuguuaagucuggguggggaagaagugggaauguuuauuuacuuaguguuuugaaucuguuaacucauuucuuaaaccuuuacaucacuuuaucccacaaauugucauuauaccaucaacuucucccuccacaagccacuggacuauuugagaauaucccucaagucuucaugcgugcaugccucagccccaagauuagagacagcuauuccacuaaggcuguguuuucagacucuuuuaacaguaucucuuaguaagaaauccauuuucuuaugugugcauguaugcauauagauccaugaagcaggcguuucacaguacaauccuuuugguuugaugcauguugauacuugccucucuauucuauuuuauugccaauggugacuaaauugauuuuacaacucacuaacagaucuugaccuacaguuugaaaaacagaguacugaagagucuuguuuccuuuauuuagaacagugcaaggaugaguaucuggguagaguugugcguuguacauaaccuuugauagucauauaguugaaccaaaaacaauuucuguagugacauugaaaaacauuuugacuugauuuauccugacagcauacauaauuuuuggcuggcuaauacauuauccgauuguuaauuacagcaaaauggauaagggaaccuuauaagaaaaccuaccaaauaccaauacuguaacauuaaacuuauuuaaauauaaccuuuugcguauagcuugguagauuuacgcugacugguuuuuuagucauuuuaacuuucuauuuuacauuuacuauuuacauuucuaccauaugacacaaaaacacaucuauaauauaauaaaacuaaaacucuuaauguucuaacuguucagaacugaguaacugagacuuaauuccucaauugcuguaagagauuucccuuuagcuguuucucagcaagguaagucaagucaccuuguugagcuaaacuccacgguucccuguguuguucacauaauaguguaguugugcggacaugugcuugccgucuaguugggcaguugucuuuuuuuuuuuuuuuuuuuuugagauggacuuucgcucugucaccuaggcuggacaguggugccaucucggcucgcugcaaccuccaccuccuggguucaagcaauucuucugccucagugucccgaguagcugggauuacaggcaccugccaucaugccuggcuaauuuuugugggguuuuuuuuuuuuuugagacagagucucgcuuuuguugcccaggcuggagugcaauggcgugaucucagcucacugcaacguucaccuccuggauucaagugauucuccugccucagccucccaaguagcugggauuacaggcgugugccacuaugccuggcuaauuuuuuuguauuuucaauagagacaugguuucaccauguuggucaugcuggucucgaacucacgaccucaagugauccucccgucucagccuccgaaagugcugggauuacaggugugagccaccacgcccgaccaauuuuuguauuuuuguagagauggaguuucagcaugauccucccgccucaggcacaguggcucaugccuauaaucccagcacuuugggaggccgaggcagguggaucacuugagccccagaguuuaagaucagccugggcaacauggugaaaccccaucuauaccaaaaaaaagaaauuagccaggcgugguggugugcaccuguagucccagcuacaggaagcugaggugggagaaucacuugagccugggagguggagguugcagugagccgugauugcgccacuguacuccagccugggcaacagagugagaccccaucuaaccaaaaaaaaaaaaaggaccuacauguuucacauguacauguaugaugcagaggcacucacuugaaguggugacuuguguuccuuuucgcuuuguaucuaaauaucuugaaaugaggcuuacaggguauagguacagaugagucccuuaguaucauauaaacaaugcaucaauuauauaaaaacagaaucagauguuacagggggacccuguggaacacaggaaaaacauaaaccauuuucuaucuuagguaaaaugugcaauuaguaaagaauaguuuuaagaaagagaauacaguuuuuaauuuuuuguauauuuuuccuuuaacuuuuauauuuauuuauuuauuuauuuuucauuuuuugagauggagucucacucugucucucaggcuggagugcaauggcacgaucucagcuuacugcaaccucugccuccuggguucaagugauucucccgccucagccucccgaguagcugggauuacaggcgccugccaccacgccuggcuaauuuuuguauuuuuuuuuuuaguagagacgggguuucaccauguuggccagccuggucucaaacuccuggccucaggugauccacccgccucagccucccaaagugcugggauuauaggcaugagccaccacacucagccuuaaauuuuauuuuucauggaccauguguguguguguguguauaaacaucagcucggcugggugcgguggcucaugccuguaaucccagcacuuugggaggccaagguggguggaucaccugaggucaggaguuuaagaccagccuggccaacauggugaaaccccaucucuacaaaaauacaaaaguuagccaggcaugguggggggugccuguaaucccagcuacucgggaggcugaggcgggagaaucacuugaacccaagaggcagagguugcagugagccgagaucgugccgcugcacuucagccugggugacagggugacacucugucucaaaaaaacaaacaaacaaaaaacacaucagcuuaucaaacgguaauaaaagaccccagcauucuuggauuauaaucauuucaguuacuuuuauauugguuuagauaacccccaagaccuuuacugguaauucccaggaauuuuuggcccaauuccagaaguuuucauuuccucauaaaguaagcauagcuauaaaaggcuuuaguacaaacauucgaacuuuagcaugaauuaaagugccuugucugcccccuaauuugcuguucagagguaacugcaagcagucaucucagagagguaaacccagauccccuucuggacaacuugguggguaggaccccaaaggauugcaauagucuuuccuaauuugauagguuuugaucugcaucucuucaguaucagcgaggauauagauguuuucaacuacuuauuggcuaucuggauucauagugauauauauauauauagauauauaaaaaaaucuaucuaucuaucuaucuaucuaucuaucuaucuaucuaucuaucugucuaucuaucugucuaucuaucuguuuuuuugcgacagagucucgcucugucacccaggcuggaguggaguggcaucuuggcucacuacaaccuccaccucccggguucaagugguucuccugccucagccucccaaguagcugggauuauaggcacgugccaccacgccuggcuaauuuuuguauuuuuaguagagacgggguuuugccauguuggccagccuggucucgaacuucugacuucagguaauccaccugccucggccucccaaagugcugggauuguaagcgugagccaccguacccggcccuaagugauauauuucuuuuaccuauuuaucuguagaccuaggguuuuugugauuucauucaucauucaacuaaggaauguugugucuauuauguauuuguauucauuuucuagugcugcuguaacaaaugaccgaaucuuaguggcaaaaaacuacacaaacuuauuaucuucugcuucuguagcauagaaguccagugcgggucuucugugcuaaaaucaaggaaggacugugcucccuuucaaggaaggacugugcucccuuucuggagguucuuuuccagcuagaggccacccacauuucuuggcucauggcccccuucuuccaucugcaaagccaguuauguugcaucucucugaucauucuuuccuagucacaucuccaucucacucuuucugccguccucuuucacuuuuaagaacgcuugugaugacacugggccugccuggauaauccaggcuaaucuuccuauuuuaaggucugcugaucaaagccuuaacucuaucuacaaccuuaauuucgcuuggccauguaacaacauauucacagguucugggaauuaggauuuggacauuuuggguggggggcauuauucugcuuacucuagaguauuaagagauacgauuuuuuaaauuuauauuuuaaauauauuuuuaaagacagucaaaaaggaaaauaaguuuauguggacgaauaaacagguaagcucugaaaauguagaaauagcaaaguauuaagauauuaaauauuugcccagcugugguggcucacaucuguuaucucagcacuuugggaggcagaggcaggaggauugcuugaggucaggaauucaugaccggccugggcaacuuagcaagaccccuucucuacaaaaaaauuuuuaaaaggaagcugggcaugccuguaguccugccuccucaggagacugaggcaggcaggaggaucacuugagucuaggaauucgaggcugcagugagcugauugugccaaagugcaaaaauuacauuagugccuagacuccuuucuucugccauaugaccuaugaucccaccaucucaagguggcccauguuuaaucuuguauguaucuuuccugaauuuucuaugcacguacauauauauucuuugaaaaagaauagaggggcugggcaugguggcucacaucuuuaaucccaggcacuuugggaggccaaggcgggcagaucaccugaggucaggaguucgagaccauccuggccaacauggugaaacccuguuucuacuaaaaauuucuaauaaaaauuagcugggcaugguggcaggcaccuauaaucccagcuacucgggaaguugaggcaggaaaaucacuugaacccgggaggcagagguugcagugagccaagaucaugccacugcauuccagucuuggugacagaguaagacuccaucucaaaaaaagaaaaaaaaaaaaagaguaggaggacucucugcuuugggggcugcucaauaaauaaaaaauaauaauagaaaaauuagaguacaguagguugauagguauacauaugauaugccacagcuuuuuucacuuacuguagucaucuuucugugucaacacauaggcauccauguccuuuuaaauauuaauagcugucuauuguuacauugcauuggaugccuuguaauucauuuaaucaaucuucuauuaauagauugauguauuuaggagguuuuuuuuuuuuuuuuacuuuuacauucaguacauuagugacugucuucagacauacaucauauuauuugugaugguaucucuucccaagaaaugagauugcuggguccaaggauauacacauuucauauuuuuauauacuaccaaauuguccucccaaaagguuguaccaauuuauacccucaaaaugcuaugugaggcuaggugcaguggcucacaccuguaaucucagcacugugggagugcucagcucucagguggaucgcuugagcucaggaguuugagaccagccuggaaaacauggcaaaagcuugucucuacaaaaacuacaaaaauuagcuggacaugcuaguaaaugccguagucccagcuacucgggaggcugaggcaguagaaucacuugaacccgggaggcggagguugcagugagacaagaucgcgccacugcacuccagccugggcaagaagagugagacucugucucaaaaauaaauaaauaaauaaaaauguaaaaaauaaaaagaacuauugacuugacuucugguaaaaucaagagggccucaaauggucuagcuguaagcugcccuccugcuguguucuguggguaagguccccuagccaauccuuucaucaaaugaaccaggagcaguuccugcuuaucucuuaguaguaggcuucaguucccugccagccuguagaauuauucaaacaagccaguuaccucccaugcaggaaccagggagcaccucacucucuuaucacuacaaagccugcccuccacaaccccugguuguucucuucacuccugaguacacccccuguguggcccugcguggcuugugguguccuuucccauugaguauguuguaacuaauaaacugcgguuaaucucaccugcccagugucagguguuguguuuggccacugccaucacaugagagugggaaccccuccgucagcuauggggcaaagaagacgugauuaaaacaaauauuuaaaagacuaaugauauccuaugcuggugaggcuguagggaaacaggaacucacaucucacguggcuuuuuuuuuuuuuuuuuuuuuuuugagauggcaacucacucuguagcccaggcugcauugugcaguggcaugaugacuguucacugcagucacgaccucccaaguucaggugauccucccgcuucagccuccugagucgcugggauuacaggcacuugccaccccacccagcuaauuuuuguauuuuuaguagagaugaggcuucaccauauuggccaggcuggucucaaacuccugacuucaggugaucuacccaccucagccucccaaagugcugggauuaaggcaugagccaccgugccuggccgguaauacauaauucuuaauuucaacuguuccugguuaauuaggaggguucuuuuuggguauucauuuuugacugauuuuuuuggcaucuauuaugauaauuguuuuuuuuucucaguugacaaacucauggcuuauuaauuucauacagaauaaucuacaguuuuauuuucuugaauuguauguaggauuuuccaccccuggaacugaugacugaugaguaugguuuucaguuuuccuuucuuccugugcuauuauuaggaauugguauaaggggaauuguggcuucauaaaaugaaauagacagcauucuaucuuuucuggguucugaugcagauuaguagggugaaaauuaucuauucagugaguuugagagauuucuuccauuaaacugucugaggccagagccuuuuuaaaauuucauuuauuuauuuuugagacaaggucuugcucugcugcccagacuagagugcaguagcacgaucacggcccacuugcagccugaaccucccaggcccaagccaucauccaaccucagccuccugaguagcugagaucacaggugugcaccacugugccuagcuaauuuuuuaauuuuuuuuuuuuuuuuuuuuugagacagggucucacucugucgcccaggcuggagugcaacagcgcaaucucagcucacugcaacuuccaccuccuggguucaagugauucucuugccucagcuucccgaguagcugggacuacaggcauucaccaccacaacuggcuaauuuuuguauuuuuugguaaagaugggguuucacuaauguuggccaggcuggucucaaacuccugacuucaggugauccaccugccuuggucucccaaagugcugggauuacagguguaagccaccaugcccagcccaauuuuuaaauuuuuuuguagagacagggucucccuauguuguccaggcuggucuugaacuccugggcucaagccauccuccugccucggccuccuaaaguguugagauuauaggcgugagcaacgaugccggccaccagaaccuuuuuuggacauauuucuuggaugauguuuuuaauaucuuuguuauccuuguaauuuuauuucccagaaaaugagccccuuuaucaagguuuucagggccgggcacgguggcucaguucuguaaucccagcacuuuggaagguggaggaggguggaucacuugaggccaggaauucgagaccagccuggccaacauggcgaaacacugucucuacuaaaaauacaaaaaauuagcuggguguaauggugcacgccuguaaugccagcuacugagacugaggcaaaagaagcacuuaaacccgggaggcggagguugcagggagccaagaucaugccacugcacuccagccugggugacagagcaagacucucucaaaaaaaaacaacuugugugaucauuaaucagcaggugacaaaucaucuuaagcaacaacaaaacaaaacaaaacaaaguauugauuaguucacugaacugaugaaccuagauacaaauagucuaaucucagcacuuugggaggccgaggcgggcggaucucaaggucaggaguucgagaccagccugaccaacauaaugaaaccccgucucuacuaaaaauacaaaaauuagcccggcguggugguggcacaugccuguaaucccagcuacucaggaggcugaggcaggagaauugcuugaacccaggaggcgaacguugcagugggcugagauugcaccauugcauuccagagggagacuccauuucagaaaaaaaaaaaaaaaaaaaaaaaaaaaaagucuaguucauaguugcucugaaagaaaggaaggggauugcauuaguuauucauucaauaguuacacacuaugcuagaguuuguguaaauuuuaagugagacucugucucaaaaaaacaaaaaaguuuucauaugcauuggaccagagucagauauagauaguauucucuuauuuuccugguguucuuuuaaagaugcaaaaccacauuagucuaugaaauaggaauggagacuacaaagagagauuaaguugagaucaagacagagguggaauggaaauuggcugaaagaaaaauaaaacaagcagaaucaaaugucuuauuggagaaaauaaacaguacucuuggcucugaagaaaauuaaauccguaauggugaagaaaaacuugauauagucucccagggugcagagaaaacaaacagauuuauuugacauuggugauccaaugugauaguuuuagaggagaggaaagaaaaaaacccaaaucuuuucacagaauggacaggaagaaaacuuuucuaagcuacaaagaagaccucuuuuguuucuggaaaauuaauagauaaggcccauauugauuuauacuggcaaaauguuugacuuuugaggguaaagaaaaacccuugcaagcaccaagcaaacugcugaccuuaaacagacaaacccagcuuugcauuuucagugccagaagacaaugaaauaaagacaagaguuuugagggggaaagcuugagacucaagaauccuauaaacaggaaaucauuauaaaggcauucucaccuaaggcaaaggcuuaggaaauacaacauuccagaguccucccugaaaucaccagucaugugagagauggguccaaaugaggaauagaaaaauuagagcacaaaaaaccggcaguaacauugaaaccaauuaaacagaguuggcaaaagccaaaaacaaggauugaaaaagaauguuguggcuuaaaaaaaaaguguaaacaaaaguuaggucugucguccugauuaaguggacaaauauaaguagugagggcggcagguaggaggcagaaaagcacacaaaauuucucaugggggaauauaaaaacgaauuauuugucacugacuuuacuaaugugugaaauguaaacuauuuucauuugauaaaucuaaaggcagccgcgagaagaauuaaaaauacuuucugccuugaaaaucacgauagaagauaaaagcaaaugugggaaaauucagaaaacaggaauaaauaaaaacuauagaauacgaagucguaagaccaaacacaacaccuauaaacagcagagacguaaugcguuaaaucccagccagagcagaggcgcugcaguucuuagggcagacccuggugccuccaggcuuuugcuagugcuaaacucucggcuaggcuugccucccuacccuauucaaggcugaggccucaauucaaggccgacucccuccucccggcaguccucccgggccgcccuaggcugagugagcacuccccacagugaacgcugcccgcgcgggcgaggccggcgcuccggguccgguacgaagucccaccucacucccucucaccccggguuacagcguguggucuggggccacgcguuacgccaggcgcggggcacagggugaaagcguucaauccugcuggaguguaauguguauuuuuuccccgucgcaccuuccagacggugauccagugugagcagcaaguuucaaaucgucuccguuuggucacgaacggaguuuacugccccucgacgccucccgcacgacagcccgugguccucgcgcccgggcgggucguugcucggccgggcggauccacccgcgacggcucgucccgaccccucccuagcggacuugcaaggucucagggcguccgcugggaggccgcgucccgaagagcuggcgcgggagaggaauggggcucggggcuccgagucgggagccccuucccccaagcaagaggggcuccuccuccucuuccuagacgugggauucagggagggcgcgguuccauuggauuuguugcagaggaacgacugggccugagcccaagcccaagggccugggggguaacgagcgaugagcagaggggcucgcggcggacuugcugcgcccuagagagggugaggcugaggggucccacgcgcgggcggggcgcagcgacgaagggguuaaggcgccucaccccgccccagcccgggcauuggcugcccuggggggcguggccggagggcgggcucgcguuugccgcagccgcuggugggcggggcucgggcggggagcaggaggggcgcggagcggagccgggcccgcgcagcgcgccccgccgggcgugcuucgggcugcgccagcaagcggggccgguggcgcccgugucggagaccccgcgccggacccugaggcagcgaguaagugaggcaggcccaucguggcaucccucccggcuccgaccugccgccgugccugcugcacugcgcggcaugucugaccugacccggacuggguagggggcgcgucccgcugcuagggucccaagggggaggggagcggagaggaggcggaugaugucauggaugcuucgcccggccuggggggagguggcggccagagggggugcggcucggauuaugucaccucuucccucugcgccccgccccccggggccacacgcguugguggggagccuggggaggugcgggcgggguuucccccaucgcagggacucccagguccuguggccuguggcuggggucucuaucaguuggcucugcgggccgugggcugcuggugaauggcgacccccccucccacccccagcagaagcucgugugugcgcgcgugugugugcucgggguggagggggcgcucucggcccccucaguccugaaacacuggcuucaucagagccaguagcuaggugaugggcccauuccgcugccagugcuuaggccaccgagggaagacggaucuccccucacucaucccaaccaagaaguucuggauaucucugcaccccaaaagcccugcagugcccccagaucccuuuccucccucaguccugcuuccuggaaaccccuccugcucucccugcccggauucacugccucuuugcauugcccauaacuagcauucccacaggcauuugcccugcauuuccuuggugcagggcccagagacccccaggacucugcccucugugcuccugggaaaccuauaggccagcccuggggaggccucagagugaaaucucccugggguguccucagccaagugcuccaagaugcccccucugggggguggagaucagggaugcuguccugaggccagccuuugaacuggucuagaagcauguaggaugggcacagagagcuggcaagagcuugugugugaaguagagaggggcucaggucaggguagauagaggaggggcaucaggagaguccuuggggacccugcugcaagcucugcucugguucuggggaccaagaggaauaccaggcauuucacccaucauacauuuacuucuuaaaaugccugcaauguaggugugagaacccgaggugaaauaaccugcaugagguugcaccccuaaucagucaagcugggauuuacacuuggagcugaugcugccagaacucugucuacugcacuuggucuugcucauggaaggauuuggacagagcaggggcaagaucagcuuugcccuuuagaaggaauccccuggcagcugccugggggagggagugcaggagaagaaaguccauugaggagcccccagcaggggugcuggauggaggggcuggcuagagauuuuuaggagauagaaugggcugggguuggggccucugagaccccaaguguuccuagcuuugggagagacacagguugagggguggguuggagguaccuguacauguaacugucagguagaguccguuuggcccccucaugacgcuaauacuguguauaaugccccaggcacugagggcugaggugacagagaucgaggcagucaggcaacaggcugucaucucaggguggugcacugaugccaggaggcugccuuugcagaccaugcucaguuaccuggacuaguucaggaccgugaccuuuccucucaguucaguuccugcuuaccagggaaacauccccuuccuuguccugccgguguccugcugggauuuuuuuuuuuuuuuuuuugaggggguaucucacuccguugcccaggcugcuggagugcaguggcgcaauaucacugcaaccuccaccuccuggguucaagcgauucucaugccucagccucccgaguagcugggauuacagacacgcaccacgacgcccggcuaucugcugggauuuuguggaaagaagcugcagcagccaaagcuugggagagacaaggggcagggcaugcuugcaagggguuaaccaugacagguuacaauuacgacaagaagcucuuuaggcagugaggcuccagagagagcuucuguggguugauagucaagcauuccccagguagagcacggagaaaggaggcucaggacaaugguccugggaccuuguuuccauccacgacucgaggcaucugagacuugcuagggacuacacacacucuagagaaacaguaggggagaguggccuaugaccagccccaaccuaugcucagguuguccuuucccggaucucagagaagguguacuacauguuuguauugccccuuauaguuuacaaagcaccuucccaaacauuauacccugucacucaaggucaacaugaucacuguugagguuuauuccugcccagauccagguaucuggugcagucaccuugcuauccccuugccuagaucuuucaucucacuauuggcaacuucccucagcauauuaacacacagguuucuaccaugguuaauuuuaaaauuaaaaaagcccuugaaucucaaaccuccuuaaauaacugucuucucuuuuagcaggaacucugccaugucuuucucugcacuccucuagccuuguggacugccuuuguuuuguaccacuuuuuuuguucuguuuuguuuauuuguuugagagggagucuugcucugucaccuaugcuggagugcaguggugcgaucuuggcucacugcaaccuccaccuccuggguucaagccauucucccgccucagccuccugaguagcugggauuacaggcaugcaccaccacacccagcuaauuuuuuuguauuuuuaguagaggcaggguuucgcccuguuggucaggcuggucucgaacuccugaucuuaggggauccaccugucuuggaccucccuaagugcuaggauuacaagcguaagccaccgcgccaaccuguuuuuuuuuuuuuuuuuuuugauguagucucgcucugucuuccaggcuggagugcaguggcaugaucucggcuuacugcaacuucugccucccggguuccagugauucucccaccucagccuccugaguaggggauuacaggcgcgcaccaccacgcccagcuaauuuuuuguauuuuuaguagagacgggguuucaccacguuggccaggcuggucucgaacuccugaccucaagugauuugccugccuuggccucccaaagugcuggcauuacaggugugagccaccgcauccggcacuuguaccacuuuucugaaaccauucugacauagacauuggugaugucucgagaccagcuccuaaauccgcagcacacucuccaaccccaguguuaccuggcccuguuauuuuuaacacuggaaacuguccccacauucuugaauccccccaaucuuggccuucagggcccaccuucuccuggccuucuuccugcucccagagugccuuccagacuucuggggcuuugcucccuggcucagugcuggccuacacccccagcacccuugaaaacugaugaucucaaucucucuccaucuagugcuuuuuuuuuuuuuuuuuuuuuuuuuaaggaaagagucucgcucugucacccaggcuggagugcaguggugcaauuacagcucacugcaaccucugccuccuggguucaaggggguucucgugccucagccucccaaguagcugggauuacaggaaugcauaccgcacccagcuaauuuuuguauuuuuaguagagaugggguuccaccaauuuggccaggauggucuugaacucuuggccucaaguaaucugcccaccuugaccucccaaagugcugggauuacaggcaugagccaccuugcuuggccuccauuuagugcuugagagguaucuuccucugguguuucccaaagcaacuauuuuccccaagcagucucccccuaucauguuaacagugucacacgcacgcuggugcccaguccagcauuaucccuuguccccaccaccugaccucaucuguaugaaauuuugccaguucuuucccaaacccugcccaggccuuccuacugguuccaagccucaggccuuucaggcuucauccucccaguccccagcugcuccccacauugcacccagagguggcaagagaaggguccauacuuaagguaggaggggguugcagggcugaggcauagggggcuggaguaugcuggggaguagaggcagagcagggacuagagugaggccagagagggacccaaggcacaaagggaaggaggcugucacccucagggcuguguacuugcuguuugugcccuucauuugugcccuacguggcucucuguccucauccuaguccuggcccuugcuuauggggacagacggguccaagggaggaggguggcgaagugcucuucuccacaccuguggggacagaugcugagaauggaauucuacagagacaguggacaggcuugguagugaacuuuccaacaaccuagagcucucauuccuggugugggggccagaagacucccgaaggacaacaguuuugucaggugcccuuggucugggccagggacucagcauuagaacugggcaucuggguagaagacggucuguggggccauagggugccacgugggccccuuaacuugauagggaaggagggcucccugccugguuuaugcaggguguagugggaaaaggccugaagggcgcccucucccauuucccacacacuuauuugagggucuaacccgaggcagacacugccuggugcuccugcccggcugcauuaugcagaucucuggggcagguguucccaggugcgaacuugagacaaaggaacgaggaagcacggccucccugagcacagguaacccgaggccuggcucccccugcgcuugugggccggccuugggggagggggacgcgcacccacagaaggacucagagggcuucacgguaagcugagcagggucaagguccacagggagcgggagaggguaguaauccgggaagucuuccugguggcagugaauucuuugcgggguucggcaggcgcaggauccuuggggccgcgcacccugcagcggccccuccccuccccuccccccucccaccugugggaaacgcaggcccugagagaggcuccgucagugccagcagcuggcgccacugcguccccugccccggccucagccagcccugggaccucugcggaggacugaucccgggaagggggcccugucuucccagggccccggugcggccgagcugggaagaccuuggggagggcaggccugccaccuacugcagccgcggcccccguccauccgggagggacaggcugugcccuuggcggcgcccacccgcgacccagaugugcgucgccuacccacccucccccagacccccguuuccucaggcgcucgccgccucggggcgccuggcacgcggcagccccgcaagguagguccuucauuccucccauuucgcagaggagaaaacugcaguccgggauggcucagucggccccuccaaagucgcgcagcugguucgggccgagccccgacugcgagagugaggcacauggccccugcagaccgggccucggagggucccaggcuugaggacccgucggccccucaaccccuuggaaaggcaaggagagaagccugcgcugguagugagcuuccacuucugcccugacugcaacacuuagguuagggggcugggaaggacccccacccucaauuuuuggauagggguguauuucucucccuccccuaauuucugagguugguucccuguuggauucagguacugcucuccccuuccaaccccauuuccccagcccaugagguugggauauuagggucccagacccaagauaaagaaccccaaaauucugggguugcagcaaagaguugagagggucacugagccugggaagcucauggcggagguggggcuaaggcagaaguuuaggaauggaacgcugagcugagcugagcugagcugagcugagcaacgcugggggcuaugugcauggagcccuggggguugggcuuuaucaggugggcaacaggcagcccccauucccaaguucucucuuuuaucccagccuuauuccuucaccuuggaugccugggaacuuuuuguacccauuguagggaaggggacacugaggggcagagcggugccggguugacuuggcugggguggugggaauaggaguagggucuuaccuaucucugccuucccaccugugcccacagugccccccuggcuuagucauggcgaagcuggagacgcugccugugcgcgcugacccagggcgggauccucuccuggccuuugccccacggcccuccgagcuuggacccccggacccccgccuggccaugggcagcgugggcagugggguggcccaugcccaggaguuugccaugaagagcguggguacccgcacagggggugggggcagccagggcaguuucccuggcccccgaggcaguggcaguggggccagcagggagaggccgggccgcuaccccucagaggacaagggucucgccaacucccucuaccucaauggugagcugcggggcagugaccacaccgaugucuguggcaacgugguuggcagcagcggaggcagcagcagcagugguggcagugacaaagccccaccgcaguaucgugagcccagccacccacccaagcuccuggccaccucuggcaagcuagaccaggucaguccgcagggccugagacccucacagccuuuuucugggggugggaggcaacccagagaggaaggcaaagugggccuucuuggagguuggguugugggggcaggauggaggcugggcuggggagucauggacuggggaccuggggccaagucuagcggguagaucaaggacagagaucugguaucagggagccaugagguagaaccccggauggggaaccucaggguggaaauccaguaggggugggagguggggcuggacaagucuuggccagagggaagagccugggccaagcccaaggccucauccugacccccagcccccuccugcguuuccugcagugcucagaaccacuaguucggccgucggccuucaagccugucguacccaagaauuuccacuccaugcagaauuugugccccccgcagaccaaugggacuccugagggacggcagggcccugguggccucaaaggcggacuggacaagucucggaccaugacuccagcgggugggagugggaguggccucucagacucaggccggaacucccucacaagccugcccaccuacagcuccagcuacagccagcaccuggcaccccucagugccuccaccagccacauuaaccgcauuggcacugccagcuaugguagugguaguggcggcagcagcgguggggggucgggcuaccaggaccuggggaccuccgauaguggacgggccuccagcaagagugggucgucgucaucuauggggcggccaggccaccugggcucuggggagggcggagguggaggccugccuuucgcggccugcucaccgcccucccccagugcacucauccaggagcuggaggagcggcugugggagaaggagcaggagguggcagcucugcggcgcagccuggagcagagcgaggcggcuguggcccagguacuggaggagcggcagaaggcgugggagcgggagcuggccgagcugcggcagggcugcagcgggaagcuacagcagguggcccgacgugcccagcgcgcccagcagggccuacagcugcagguguugcggcugcagcaggacaagaagcagcugcaggaggaggcggcccggcugaugcggcagcgggaagagcuggaggacaagguggccgccugccagaaggagcaggccgacuuccugccccggauagaggaaacuaagugggaggugcgggcuggggaucugggccuccccucugccucccuucugucccucugggaaaccccagagcaguugccccucacuaucauaacggugggauggggggggggaugaaaggagcaggggggacaaaaaucaauugggagugucugugaggacccgaggccauccgcugggugagacauguccaucuugaguccaggcagggaaucgggugcgucgcugcugaugaggggcugagccugcagccccgggaagcuuggugccccuggcuccagaucugguagcuggguuggggugagcagagcucugccuuuaccuggcuucuccucucaccuguuccugcccaggugugccagaaggcuggcgagaucucccuccugaagcagcagcugaaggacucgcaggcggaugugucgcagaaguugagugagaucgugggacugcgcucgcagcugcgggagggccgggcuucgcugcgggagaaggaggagcagcugcucagccugcgggacuccuucagcagcaagcaggccagccuggagcugggcgaaggcgagcugccugccgccugccucaagccggcgcugacccccguggacccggccgagccacaggaugcucuggccaccugcgagagcgacgaggcuaagaugcgccgucaggccgggguggccgcugccgccuccuugguuuccguggacggggaggcggaggcuggcggggagagcgggacgcgggcccugcggcgggagguggggcggcugcaggccgagcuggcggcugagcggcgggcccgggagcgccagggugccagcuucgccgaggagcgccgcguguggcuggaggagaaggagaaggugaucgaguaccagaagcagcugcagcugagcuacguggagauguaccagcgcaaccagcagcuggagcgcaggcugcgggagcgcggggccgcagggggugcaagcacgcccacuccccagcauggcgaggagaagaaggccuggacccccucccgccucgagcgcauugaguccacagaaaucugaucgaccugggcacucggcauuuugacacauguccugucaaaaggccagaguccccaguguccccuccccuccaucucucuuccccauagaccccauaaccccagaccaaagagguucucuaagcagcugugaccagguuccucccuccccaccugcccuccuagcuccagcacugcccccguggcagcccacuuggaccccccuaaaaggagggaauaggaggagggcagggugagugggggcaauccuagguggugggggagucaugcucccuuucucggcacccccuuguuggagauggaggcagcagacgugcagugccauaaggugccccaguccuucuggaggccugggcugcuacuguuggccacccugugucuagugaugcucucugugcucaccuccuaggccauggagccugagggggccugcaccagguuugcugaaacugacagagccugggcuccagaccucucucccuccuacagugcucucccucccugggcagauuggcaggacaagugggagcagauggccugccuuuggcugagagggcuaccugcccagccccucccccaacaagaucucuuggacucaggccucagagccuggccugguugugagugugugucccuguguguguguugcgggaggggaggacuggggcuggaaguccagcacccagggaagaucuguccuccuguucuugggaagcguugccugacggcuucucggcucuacccucacccuucuggccaggaucccgcagggcaacagccccaucugcuuggcugaccccacacccaggaccacuguccggcucuaacacagcuauuaagugcuaccugccucucaggcacucuccucgcccaguuucugaggucagacgagugucugcgaugucuucccgcacucuauucccccagccucuuucugcuuucaugcucagcacaucaucuuccuaggcagucucuuccccaaagucucaccuuuucuuccaauagaaaauuccgcuugaccuuuggugcacugcccacuucccagcuccacuggcccaagucugagccggaggcccuuguuuugggggcggggggagaguuggaugugauugcccuugaagaacaaggcugaccugagagguuccuggcgcccugagguggcucagcaccugcccaggguaggccuggcaugagggguuaggucagccaaugucagcugcuucucuuggggcccucucagagucuaucuccccaagacaggaagggaaaagcaaauuucuaauucaccagcaauaaaaauuggaggaggcuuggcccucagcccuuauaucucucucuuuuucacucucuuccucccacccccaagacugaguuuuggggggcaagguggagagagcuggcaacuacugugagcaaguccccuagccccugaccagccuccucccaugacuggugacuguuuaaugagcugugcaucccccacaaaaacaugagugccccucuguguggccucuaacccucugcacagcccuucugggugguccucaccaggucucugagcugggugggaggccauccuggcgaccacugcccauuccauucaccccucacuguaccugcccuagaaccugggccuaggccacaggggcagggagaagagaaggcauuaguaagaaaaaaauagaaaaaaauaugaacagacucagcuuugggacguccaaccacaaaagaaauuauauauaaauauauauaaauauauaucucuaccauaugugauggaaagacuuuuuguuuuccuuucccaaagaaauaaaacggaaaaagccucuugagugguauucuuu

SEQ ID NO: 13409 - RNA, 12195 nt, Homo sapiens
caggggccggccgcguacuuaaagcggacgcgggggaagcccucccggggucugccucagucgcacagcucggugggcucguggcgcagucgaacguuuucccagaagcuccccggccccguccagccccuaaacucgcgacgcugggucugcuggguccggcgcgcacaggcucgaaggagccgggucuacucgguuuggcccagcagcugcgggcggcggggagcagcccagcccggcuggagcagccucccgcgggugagggcgcggggcgggcggccgggucccagcccucggcagcucugccuaccgcgcccgggcgcggcgucugagcggcauuaggacccaggcgcggcgugggggugugucgccggcucccgccgccggcccgcccgagucgccgaguuugggguccagaagcgccggagcgccgcgugaggagcccggccgugagugcgcgagugugccauggccgcggccaccaggcgcguguuccaucugcagccgugcggugggugccugaacccgggggcgcggcgggaaggccgcccgggucuccgccaccgucucccgucggggaccccggggagaacgcggaugccgucugccugcgcgggccggggccggugggcgagagggcugcgggauucccagccgcggggaggagggcgcgggugcgggaggcccgggcgcggcuucgcggccaccgcgcgcuugguuucauuagggcucugcugucgccgucuugaauuucuuaccagguuugaacagcugaugcagcgggucgagggcggggagcucgaaagugggcagggcggagcuguggggcucccagcgccccgagcgccgagcuuuugggagccuggcgggccgccgccucggaaggucucauuuuaccuuccgcccgggcaucuucccguccggcgccgcggugggagccccggaaccccuggaguuuugggagucccgggaccccugaccgugcccugcgcggccgcagcgguuucucccuugcucugacacgggagggccagcccuggguccccgccaggacccagguuuguacgacccuuuaccugcacgugggccgccgggacggaagcggagugugcaccggcccaacccucccagacccucgucgcccacggccugggacgcgccccagcgcccccgccccccacuucaggaugcagccccggcucccgccccgcgccugcauucacauccugcgccccgacccccggggucuccgagucuggaggcgcuuuccucucgugcacgcggccccuccugucgcuuccuuccuccgacagcgaggcacaaacagccgggaccauccggggaccggcccagggagggcgcagccucccccgacccaugugucccucagauacuccucccacccccaauuguucucccuuuuggaccaacggcucuggcuuccaggcggccgggacgcggucccaggacuggagaccguugccugucggcccccgugugacccggggcgcgugacgggggucgggggaacugcgccugcaaugggcguuuauggcccccaggaccggucugagagugagaagagggaugugcagagagaucccccgccuuggcauccgaggagagagggggagaggcccgcucgggcccggucccuuccucucgcugcagcggggcaggguuuucucaggaaaaccuggauuagcgaacaugguacugguacuaacucggugggaagacaucccuggaacgucucuccuccucgccucuggcccgccugggcagccccuagcagaugggcuaagcaauugaauuucugagauuaaggcuggcuuccccugcuauggggcccccucccgagcacuguccccugcuucccuuucucccuaggguggcguggguugcaucccucggaagagcgaaggaaugagccaggucggggggcggggagacaggugcacacaggagguccagggcuugguccauggggcuggugaccuuucugcuucccuugcagaaaacucucccaccaugucgcagaauggauacuucgaggauucaagugaguaccucucggggagugugugugugcagagagagcuugucgggcaaaagccuccagggugcauagccuacccaccagaguccuguggcuuugcucgccuaucugggccacucuagugcuggaaugcuuuuggcuuccacucuucgggaagcuagacaugggcggaucccccguggaccugagagggcaggcugcccauucuccugggcuacuuggaccaggugaacccucugggauucuuacccaagguuuucugugacaauggccuguuaucugacuagccuugggccaagaauucugugugccccugucccucuguccucacccagcccuggagggaauaucugucguugucucuuuaaagaaauauaaggccucugugcugcagucccucgggcaccuuccugcugucccugcuuguaccaguccagcugucuuccuccucaugucucugggcuggcuucaggcuguguccugugccuagccccaugagugaccugaccauucgaggguuguuuguagagcagugcguagacacagggcugauguucccuuacccagagcccucaggacauggggcucugugugcuaggcugcuggugggcagguuacguauggggcugggacuaggacuuggcauugcaggagccccccaggaaccugguagugucagcugggcagguccuuaaucuaggggaccugagcacuaagucuaagguagagcugagggcaucaggggaagaaugggggaagaacggggcugugugaagggcaguggaggggacuagugggugcugguugaggggcagaggggaggcugggacaaguucgggccaggggaaccagacaguuuaaacaaggcaagccugacccggggaggaaggaguuuaucaugagcuccagaaccaaagcagugaggacgucuuuuguuuuguuuuguuuuguuuuguuuuguuuugagucucgcucugucgcccaggcuggagugcaguggugugaucucggcucacugcaagcucugccuccuggguucacaccagccuccugccucagccucccgaguagcugggacuacaggcgcccgccaccacacccggcuaauuucuuuuuguauuuuuaguagagacaggguuucaccauguuagccauuguuagccaggauggucucgaucuccugaccucgugauccgccugccuuggccucccaaaggcaaggaugucuuuugaccuaauauuucuucucugggcucuggagguagugcaggccugggccugggagucaccagucccuggggacuuugaugcaggaggcacuagggcuuccuacccagaaggggcccaggcuaaacucaggacacugggggaacagggccugggaugugccaaggaaacuggcggcgggaguagaagugagucagggugagucacucccuggcaggugcaggcgugcugcugacccauccuuguuucugcacaggugucugucaggcaucaguggggucugggcuauaagggccccuuuccugggaguaccuacaagugaggaaccuuaggggacccacaagacaggaagggcugccaguggccaggggugaggcagggaucuaggaggacuuccuggaggaggagguuccaagugagucuugaaaaaggcccuccagggagggaagcccucagcuuggaggacaggaccuugcaugccuagggugcugaccggauggccugaggagccaguggucagggcagggggagcagggcuggcucaggcugugaucuguaggcugcagggagccacugcagggcucagggcagaggaauauuugcauguuaccaggaaaucuuccuguaggaagaggggugugcugcuggccagcugcaggaauugaggaccaaggggagcaggcucucaccucuggggucccacaucccacaggugccauuacacacccucacucuccaugugcccuuacccagggcccccagaacaugaagaggagcacgaugggggcagggcugacaugaggccuugggguccucuccccugucagccccuggcucuguuucccugguuuuccugcucccuagaccuugucugauaccuguccugggucucucagccucgaugcuucuccccaccugcccuccuggggaggcggagcucuaagacccugugcccacaaggcagcgugugugugugugugugugugugugugugugugugugugugugugagagagagagagagagagagagagagagacguggauacugcagcuucucugccuucccuguguucccuacuuugggagggcaggggccaggcagucucaucugcauuauugcacuccgugccugccccaaugugucuggaguggacauguuuuucucacgcugaagggucaaagcugcgcaggguccuggucucagcggcuagggaaugcuggagacucacuuuguggcagcugccauguccuguguggggcuggggcaggacuagaagcugccuuccucgccuaugggauggccucucccaccacggcccgagagugggacaguccaggggucccugcucccugggcuuggagccccuccuuccuguguguggcacuuuaacagccaggcccucuugcucuugggggucucuaggcuacuacaagugugacacagaugacaccuucgaagcccgagaggagauccugggggaugaggccuucgacacugccaacuccuccaucgugucuggcgagaguauccguuuuuuugucaaugucaaccuugagaugcaggccaccaacacugguaugggggcugcagcaggggcagacugggggaaggcacgggacugggcaggugugacucgccuuacuaagaaagaccugaggagaggguggcacccugagcccuccccgcuuuucuccggcagagaaugaagcgacuuccgguggcugugugcuccugcacaccucccgaaaggugaauggccuguccugcaggugguccuggggccucuaccugggggcugaggugauggcuucccugagaauccucccgcugcuccccucuucccaugccuccaggagcagcucaacagggagcucgcaccagcccagggcugggggcugggggcugggggcuggacugcugcggcuggcugggagggagggaccaggcagugacagcaucucauacaugggcccgugugguucugucccugggguccccucaguaccugaaguuaaagaacuucaaggaagagauccgugcgcaccgcgaccuagauggcuuccuggcgcaggccagcaucguccugaacgagacggccaccucccuggauaacgugcugcggaccaugcuucgccgcuucgccagggacccugacaacaaugagcccaacugcaaccuggaccugcucauggccaugcucuucaccgaugccggggcacccaugcgggguaaaggugaggccggucucccggcccgggcgggggcguugggaggggcuguugacccaccacccucccccucacucuuuccucaguccaccugcugucagauaccauccaaggggucaccgccacagugacaggggugcgguaccagcagucguggcucugcaucaugugaguugccaggccacuuggccccccuucuugucgcaguggaacugggugucccauguccccugugcccugcagaggccagcccaccugugaguccuggggcucuggcggcccaaccaacuugggagaagagggcuggagcacugccaaggaacgucccauuugcucuucuuuucccucccuagcagaggucgccaggggucaaggucgaggggguucugggucggggagccccagcucccuggggugcaacugugcacuguguccuccccgccccugccagcuguaccaugaaggcccuacagaagcggcacgugugcaucagccgccugguucgcccacagaacuggggggagaauuccugugagguucgguucgucauccuggugcuggccccacccaagauggugaguggguagugccguguccuggggaagaaggagggccccggguuacccgcccucugcuugggguccccucccacauguccuggccucugaaggccugguccucacccuccccuucgccucggcccugugggugugucagaaacauguugcuaggcccggcaaguccucauguccccggggauugccgaaaaguucguauuuccuugacugaaaggaaacgcuuuugaccacuaucccuauucaaacacgcggccuucucuggccugcccgcccgccagcccuucuuugacuugguugacuuugcgauuugcuagcugagggucccugcuccuuccugggccacacacccccuggccgggacaccaugcuuuuugugggagccggaacugauacaauuucgggagucuuuuaaggaaaaggauuuaacaagucucaacagaugauugccaggaccccucccaaggccuuggcagcgccuucagcuucagcuucccuuagcuucuugugcuccugccccuggccuucugugugcaaaugggguucucagggaucucagacauggcgggaaccuccacaaaugcaacugugcuggugugagaggaagggcagccccuggguuggaaggaguggcccccagcagggugcccacacagaaggagcaauagcccagagcugaguuaaagccuggugccuugaggcagaucccccagcccgacacugggcuccuccucaggagcauggacuaguucuuuugggguuuuguauuuguuuauuuguuuguuuuauuuauuuaucuuugagacagagucucacucugucacccaggcuggaauguugaggugugaucucagcucacugcaaccucugccucccagguucaagcgauucucccgccucagccucccaaguagcugugacuacaggcacccgccaccaccaaaaacuacagccagcuaauuauuuuguauuuuuaguagagaugggguuucaccauguuggccaggcuggucuugaacucuugaccucaagugaucugccugccuuagccucccaaaaaaguugguauuaugggcgugagccaccaugcccugccaggcacgggccucuucuacagcaaacaugcacagugccccgggacuagagcuuugagcaacagacgggcagacacugccccuaggugagcagguugcugugaugagggcuggacacugaguucgugaguucaugguucacggacgggcuucaccuuggccgggcgagagagagagugccugacgggcuuggacccucucugaaagucaaaccagcagacagugcaaauaccacuggggaaacguagcuggggaaacauuuuucuccacugugguuucauuaucugugaucacacagacuuuuguugcuuaggacaaaaguaauaucuugaguuuauaagaaaucaugaguuuauaacaaaaauauagaucgaugguaguugcggugaucugcugaccugguugaaaucauggcagaguacacuaaugccugaacuuuguggaauaaaaccugcuaccagcaucugggcacaguggcucgugccuguaaucccagcacuuugggaggccuagacagauggauugcuugaggccaggaguuugagaccagccuggucaacauagugagaccucgucucuacaaaaaguuaaaaauuaaaaauugccuggcaugguggugcgugccuguggucccagcuacucaggggacugaugugggagaaucacuugagcccgggaggucgaggcuacgauaagccgugagugugccacugcacucagccugggugacagugagacccugucucaaaaaaacacaaaaaacaaacagacaaaaaaccugcugccaguucauggggagagcaccuucaccugcucggcccgggcagggccuccucuguuucuaggggugacucccauccuccaccccuagaaaagcacuaagacugcgauggagguggcgcgcacguuugccaccauguucucggauaucgccuuccgccagaagcuccuggagacccgcacagaggaggaauucaaggaggccuuggugcaucagagacagcugcucaccauggugagccacgguccaguggcgccgagaacgaaggaacgcagcacagucucccucccugcccacagacacccagagguacaggguagaggccggcgggggccggcagggucggcgggggcaugggccggacagggcuaacaggcgcucuguccucuccuccagcccccaaagugcaaggacuuugucccuuuugggaagggcauccgggaggacaucgcacgcagguuccccuuguaccccuuggacuucacugaugguacguggccucugcuuuccaggccuugggcccacacgugugccuguccugcauccccagcaaacccucucucccaucccccauuccuaggcauuauugggaaaaacaaggcugugggcaaauacaucaccaccacccuguuccucuacuucgccugccuccugcccaccaucgcuuucgggucucucaaugacgagaacacagacggggccaucggugaggggcuggcggugggcgguggguggggguaugcugggcugggcccugggcugcggcgcccaccugaccuccgcacccccacagacgugcagaagaccauagccgggcagagcaucgggggccugcucuacgcgcucuucucugggcagccauuggugauucugcugaccaccgcgccccuggcgcucuacauccagggugcagugggggcugaggcgggagauggugccugagaccccugguuccugccgggcccugacccgcccugcccccugccugcagugauucgugucaucugugaugacuaugaccuggacuucaacuccuucuacgcauggacgggccuguggaauaguuucuuccuugcgcuuuaugccuuuuucaaccucagccuggucaugagucucuucaagaggugacuggcccuuccgugagcugcugggacccucaaggcuugggaucugguucagcccccuguaaccccaggguggugggggugcccccaccauauugcugccccaaggggcuggggugggcucaggcaaggccuggggcccuggccuucuuccuggcagggggaggcaggggacugugcaggggcucagggaggccucccccaccugcccccugaccacacccacucugaugaggcucauggccuccuggcaggucgacggaggagaucaucgcccucuucauuuccaucacguuugugcuggaugccgucaagggcacgguuaaaagugagugcggcugggggccaccugcugaacagggcgcucagccgagaugggagguucugcacugccccuggcugggggcacauaggacuggcucaagcugagugugugcccgugaucaagggugcggugcucugggagccuugggcuggcagagggcagagcccuccacgcuggagggugacggggccgccccaggugggaccagccgugggggcagaggcacugggccgacugugauggggugucagagaugggacagggacagugggcaggagugugggugcaugggcacgucggcaggguccccucaccuucccccuggagcccuuucucccugagauccccucccuccagggccucccccugccacacgcuggagagggcugaggccuguggguguguguccacagucuucuggaaguacuacuaugggcauuacuuggacgacuaucacacaaaaaggacuucaucccuugucagccugucaggccucggcgccagccucaacgccagccuccacacugcccucaacgccagcuuccucgccagccccacggagcugcccucggccacacacucaggccaggcgaccgccgugcucagccuccucaucaugcugggcacgcucuggcugggcuacacccucuaccaauucaagaagaggugaggggcugcauggggaggggaggggccgcaugggucaaaggcugugcucaugcaccugcuguccccagccccuaccugcaccccugcgugcgagagauccuguccgacugcgcccugcccaucgcggugcucgccuucucccucaucagcucccauggcuuccgggaaaucgagagugaguuggggccgggcggugggugacgugggguagcuccccaggcgcugcaggcauagcaguagccuguccccuacugcagugagcaaguuccgcuacaaccccagcgagagccccuuugcgauggcgcagauccagucgcugucccugagggccgucagcggugccaugggccucggcuuccugcuguccaugcucuucuucaucgagcagaacuugguggccgccuuggugaaugcaccggagaacagguguggagggugggugaggguggggugggcggggcccgggccucugcuguggggcucuguccacgagugcccgucugcugcaggcuggugaagggcacugccuaccacugggaccuccugcuccucgccaucaucaacacagggcugucucuguuugggcugccuuggauccaugccgccuacccccacuccccgcugcacgugcgagcccuggccuuaguggaggagcguguggagaacggacacaucuaugacacgugagugugaggcuggcaagagccguggacccugaggaguggggagccucuggccacaugggacauagggaggagugaggcccuguggacaggggcgcagaggugacacucgcggcucgggccaccgcaggauugugaacgugaaggagacgcggcugaccucgcugggcgccagcguccuggugggccugucccuguugcugcugccggucccgcuucaguggauccccaagcccgugcucuauggccucuuccucuacaucgcgcucaccucccucgauggcaaccagcucguccagcgcguggcccugcugcucaaggagcaggugagcgcuuggcccugcgagggaguggcguggguggggacacagccccaugccugcccacacccggucccugccgcccacagacugcguaccccccgacacacuacauccggagggugccccagaggaagauccacuacuucacgggccugcaggugcuucagcugcugcugcugugugccuucggcaugagcucccugcccuacaugaagaugaucuuuccccucaucaugaucgccaugauccccauccgguacaggcgggugggcagugggcaggaggggcccagucuagguguggagaaugggcgggcuggggcagcggcugggaggaggggucccaccuaggggcggagaaugggcggguuggggugggugcccaggaggagggguccugccuagggguggagagugggcgggcuggggaggcuggcgggcaggaggagcccagccuagagguggagagugggcgggcugggguggguggugggcaggaggggcuccagucuaggaguggagagugggugggcuggggguaggcgggcggggaggagaggccuagccuggcccugugggugggcuggggugggcugggauggguguccacugccuucucucugacccaggcucauccuccugucccucccuccccacagcuauauccugcugccccgaaucauugaagccaaguacuuggaugucauggacgcugagcacaggccuugacuggcagacccugcccacgccccauucgccagcccuccacguccucccaggcuggcucuggagcugugaggggagguguaggugugugggugacugcucugugcugcgccuucucauggcugacucaggccuggggcaucugggcauuguaggggugcagugguaugugcccaccccucucccauuauccuuuagcuuuaggccaagagcguugcucagggcagcuucugcccagggugggugggacugagcaggauggauuuucuuuugauaaaagagucgaugccugaaagagaaaccauuuccuugauuguguaaggaacuugcuggacgcacauuagagaauaaagcuccuguuucuaggcuccuaugugcc

SEQ ID NO: 13410 - RNA, 963 nt, Homo sapiens
ccggacuugagcuaaaaaaguauuuuccuuucuugaauaugaaagacgagcacuuuaaauuccuacucccuucuggucuucccucagccaaaccugaaggagacaccauagggauuguccaaaucuucauuaguguaggaaggauuuucagccaguguuguaauuuaagugaucuagcaccaauuacugugggagaaaaauagcucuaauuauugcaauuuaguguaaaaagaugaauacaggacauuuaaggcauuccgacgaggucaacgaaggacgcaggccaauaaucauuaaauacguccuguauauacaggacuccuggcaacuaucagugcaguauuucccaaguuucuuguacaugucccugcagaaaccgguagagcuaggaucuuaacaguaaagguuaggggucuucugggauccugugcgccucuaacgcucaugcccugcgcagggcugggugcgcacugcugcgcuaacccgaggccggcuaggaaucuauuggauguuugaagggugggugcggaauugaugaccaggaagcgggaagacaccguuccggagaacagggaagcgagccggguacuggggaggugcgcuggguacuggggaggugcgcuggauccugacgccggagcggaagacuucgcuggaggccggggcuggucgggcggggcggggcgggcagaggcggaggggcggggccgggcugggagaggcuccgcccccgggcgcguccgugugcguggccggggggcgccgcgcagagccccgcucuaugaugccgggcuugaggacgaggccgggcggcgcuguggcaacccucacccugcggacacgcgcucccaacauccgguccggcggccucgcagcuuaagaaguggggucccuguggccgugcgccgacccccaacuccagccgcucccaacgcccccauccgcucucggugcgcgcgcccc

SEQ ID NO: 13411 - RNA, 16978 nt, Homo sapiens
uaguguaagccuuuuuccuuuuauuuagaauaaucuuuuuuuuuuucuuuuucuuuuuuuuuaagcaauuuccccacucccaaguugggccaguaaagauuacaugaaaacuggcacaccuauuggcuggaauacagaugcaccaaaugaggauuuaaaaacuuuccgagcgaaaaguagaacaaaaagaaaaaagaaucuccuagcauuuucccccaagguuucacucucccgccacacacacucuccaaaggaccgcuacagauccaacucugcaagagaagacagagcagugucaaucaggaagccaugaggacaccaggaggagguuuucagucucgacacgcagaagacagagcugcccagcccugggguccugaagccagcacucaccuaugucaguuucuuggcuuuguuguagagggaauccacuacuuugcucauguucugaauuguuuccagagcagcuucguaaguuuuaucuacuggggguucaucgaaaauaaucaggacacccucccccugguccaaaaucccugcaagaaacacaagggcaacccagguaaaagaugagguuagacacaaaaguguuugugaagcagcccacucccuaguugacucacuguguccagaaaagaagggaaauagaauucaucucccuauuccauguacacaugcuuauuacacauucucaucacagggaagaggggccaggaccccagggugaaccaucgggggaaacaaauagaacaucuucuuugaaaauaaacuucuucaaccaucucaucaccaccaccagcccccuugccugugugacuguuacuuaccaugaaauuucuugucaagaaucaucugugauaauuuccuuuccacgucggccuaaaaucaaagcacaugauuaaagggaccaguauccacuagucagagaucacccugacacaguagcuuuguuggaggggucuuaggccaaauggacugaaaacaaaauagcaacaaugcaacuccuacucuaguccacacugcccauuccccacugagaagcuggggagcuuuccaaugaggccaaucaggugcaugugccaccccuccucgccaccccgucccauuccucccugcagauggccuuaagacuccuuaccuuggagaguuugaugagacuagauauguguucaaucuaaaaggaaaggcagagagacaccaacacugaaaguuuuacuuuugccuccaauaagagaagggagggaacagggggagaacugcuguauuucucaaaauucuaauguaagacccuccuuggccgugcuuaagucucuuguucucugcccaucugccugcccuucacugcuacacacaauaaacagacucuuaucccacacacccaauacagaaaacagguacaacacaugcagugacuaaaagcgaggaggaaacugcucagaacacaugcaggggcaacccacaugccucuacccacagcaucucucuccucgauuuuuguucauuuuaucaacagaggcccaagcucuugguggccucuugcccaccaggcacaccccuagaagugaguucccauucuggacagguguggaagggagguggcuacagugagaaugccuggccagaaauggaguccccagaggguucucaccuguacucuggaaaaaggcucaaugacucggaucagauucuguucuaguaaguuaucauacaacuuggccaagugugugcugaugauugggucaucccggagcucugcccgguaaucugucagagccugccaaaggaaccaguugcagagauuggcacagagaaucacuuuaaagucaugcuacuccugcuuccuagauagucugcuggcccuuauaaaacuacaugguugaaugaaguuaggggagaucuggggagaugcaugauacaaagcagaaaaggaaugucaagaacugaaagggaaguuuggcuugguggcacgcaccuggagucccagucacucgggaggcucaugugggaggacugcuggagcccaagaguucaaguccagcuugggcaacacagagagccuccaucucuaaaaauaaauuuuuaaaaaugcuauuuuaugguagucucuaagagaaaaaaaaaauacaaaauagaacaaaaagguggagucacccuagggaccaucuuucugucugcaggcuucaggugaacagcucaaaccauguaagccccaagagcaacucagcucaugaaccaaauuagcuacacaagcauuucucagcauguauucuacagaauaaauagggucuccaugggggggaaaaaaagaacauugagguuaaagaauaggaaaugcugaauuccacaacuagcucuugggaguuuuaugaggaccaucagcauaacauggcucugcaaugauuaagcaaaauuagguguuuuaauuauuauuagcccuaguauuuuguuuagcccuaguauuucccaaauaucuaaucacagaauccuucuuccaaggaacuauuuggaauaaaagugucccaucaaacaucucagacauugggauaaaaugaucuagaccaaguauucaugugugugauuuacuggaccaucaguaauggucucaacaucccagccucaugucagcugugcuacaagguguuaagggaagcaggcgaaucaugccaaguaagacgcaauaggaauuggcaagagcccuccaggaagauggugaaucucagggacagucaaagccacauggucuagucuccauccacacuaaguuuuucucucuggaucuagguuuuguuuuuauuaaguugaucauuauacucagacuaaaaggagagagguucaggaaagacuauauaauucucacccuaaugcccagacaggcuuuucucccuuuucaaaacucccaaacaaugagcaaaaugcaccaggguuaaagaaagccuagaucaucacccugaggacguuucuuuggguccaaguacgcacaucaagacuucccuucuguccacagaggagcagaccuggcauuucuggagcugaaggaaugccuacaacugugucauguggaacaagcacuaggccuagagucaaacucugacccuaugcugugugacuuugaguguccuccugaaucccaguucccuuaaccauaaaaugcagauaauaaauagguguguugugaaaaaucaaagugaaaaaaggacagaaagaacuuuugaaauagaaagguauuauguauaaauaauauauauuuuauaucaacucaguaaguuucauuguacaaagugcuuaacuauuuccugguuuuaauacuguccuaggugaaggauacauggaaucauuugcaacuucuuuugaaacuauaauuauuuuuaaaaguguguuuugaaguacuuaaacgucccucucuuccacucacauuccauaccaacccaauaucauacucaccuuuucaaaaucugccagugaucuguucuugcuagccugagccacgcauuuuaaugcuucugucugagaauaaagagacaaaccaugaaagcgauuuauucugcacacuaacauuuacccaagucucauaagcaguaugcuguguccacacaacuucugccaaaaggaagaacccgccccaccaucguucuucuucagacgcccgggaagaagagccgcaaguacugaauaccacuauaugccaaccuguuucccuuugaaaccugaaaugacuuaauaauacuaggaaacagaaauuuuccaaacagaccgacccuaauauagcauucucuagagaugacaagcuaaaaggaaaaaugacaagagaacugugauuucuucucccuuccuccaaggcuuguuaucgccacauccacccaaacuccuucuugcccuuagacccuauuauaucugugcuuuaucaagauucauucugcuagguuuggaacaaggcacugaacaaggucuaccucauuaacacugaggcaucaaggccaggcacaguggcucacaccuguaaucccaccacuuugggaggccgaggugggcagaucacuugagguucaggaguucgagaccagccuggccaacauggugaaacucccuucucuacuuagccgggcauagugguggacgccuguaaucccagcuacuugggaggcugaggcaggagaauugcuagaacccaggaggcagagguugcagugagccaagaucaugccacugcacugcagcugggugauagaaaaagaauccgucucaaaaaaagguugcggcauuaacauauuacaccaaauguuaagaccccacagagugaugaagguauaaucaauaguugagaacaacuucuaacaugguuaaaaaaggcaccugaccaagcuauuaagucuccacucagcaaaaaaucugcaacacucaucuuucugggagauuagccuaucuccugcuuaaaagcuaacaucaaaggcgcaagggacuaagagaagcugcucuuuuaucagccuacaugcuuauauaagaacagugugucuuauacaguagacuacauggugcaaggcuaaucauuaguguguuugucuccagcauuuguccuauagacagaaaaaagugucaaaaugagaaaagccuggaacuuagagccaaugacccuaauucaaagucuagcuccaccauugauuagcuaccugaccuugcccugaacacuuggaugucccugagccugucuccucaacucuaguuauagugagaguagugcaucuuucuuauuuauuauuuuuuaagacagagucucacucugucgcccagguuagaguacaguggugcuaucuuggcuuacugcaacuuccacuccccguuugaagugauucuccugccucagccuccugaguagcugggauuacagccaccaaugcacuaccaugcccggcuaauuuuuguauuuuuaauagagcugggauuuugccacauuggccaggcugcucucaaacugcugaccucaagugauccgcccaccucagccgcccaaagugcugggauuacaggcaugagccaccacguccagccccuaauuggcuuuuuaucagcaaaaguuucaggucagcuccugguuuugaccucaagaguaccgguuauuacuauacuggaagaugcguggcuggaugcaguggcucacaccuacaaucccagcacuuuuggagguugaggugggcggaucacuugagguuaggaguuugggacagccuggccaagauggcaaaacccugucucuacuacaaaaaauuagccgggcauaguggcggaugccuguaaucccagcuacucgggaggcugagacaggagaaucacuucaaacugggaggaggaggaugcagugagccgagauacgccacugcacuccagccugaaugaaagaaugagacuccaacucaaaaaaaaaaaaaaagccaauuagggccacuuguagagagggaagaaaucaucuauguggccacuccuccagagauacagugagauuauauagacagccaaucagucuguguuuagagaccacugcaguugaaauccagaaagauuacacuuacuuuacuagugauaaucaagcaaaauacaaagaggagacagucuagacgucaucuuugcguagguccuaacugucugcucucagaagucacacucauaccuacuugggcauuaagguaacaaaaaaaaaaaaagggccucuuuuugcaccacacccaaaauucaaagcacgaguagaaagguacugaucugagaagcacagaaguaaaucucaaaaccuaguuucugcaccaagcaaucagaccucucuaaagcacauaugcaccagaccuuaccaggcuccuaaccuggagaaucuaagauuucauacccugccuauguuaaauucacaacucagacucgugguagauaaaucuucuggucaaagccaaaugcaaacuaacucacugcaaaugcuacaguucaguucccuaagucccucaaacaacgugauguccauaagagcaccaaacgcugacuuuccaggccaagaauuuaacagucugggaaacacacugaaugggcuuaagggaaggaagugaguggggcagaaggaagagaguaguaugaagaucugaagagugcuggucucaucaaacguugugacucugaaaacaugcuggucucagagugagcagaacugcagucaagggagucccuaccugccucccugcauaccgaagugcaagcuucccgcucaccaaagccuggacaucuucugggcuagaaaaaaagacauacuuggucaauugcugcagauguuaugcuucuaaaggaagguuugggcaaauuucuuuuuaacagaauuccauuguaauaaagacucugcccacacagacaaucagcccaaccccuaaacccauaugcccaucacauugcaaaagcuagguuuucuccacucugggucacagcucagccugaagaguagaaaaacuccaauguuagaaagcugaacugaaccuaccaaaagcaauagacacaacaagcagaacuauaaguuuaagucaaaucccaguguaacagguauuauuaaaacauagcccuuauguaauccaaagauccagagagaguucuuagucaauauuucauuuauucccaaaagaauugaauaauucuguagacuucuuuauaaguaggucugucauacuuuuguuguccacuuuuucaaaccucuccuuaacccuuccuuccucauucuggguggcucaguuggcuguuacuggcugaucuguaagcuauuuccugacccucuguccugugcucugcaccuaugaggacagaauauuuaaaggaugaggagaauucuccaagaggagcugggaaggggauuucuaaaaugucugccugauucugaaagacuagcaagcgaaaguuuucuggaccacuuuugauccucccgcucuaccuuagccagcccuagaggccgcagcugcugcuguuucuguaacuggccaaacucccugcucaggccaucucugccauggcaaacagacuugcugaaggaucugaguucuuguaguccagaguuaaggugcaccuacguguugagcaugauuuugcacagcaacauguacuucagagaugugauggccuuggggcugucgauggagucauaacccucaaaugccucauagaaguaugaguacgcaguuuuccaguccuucucuucugcugcauggauaauaccugggcauugaaaagaaaggaauaagaacauauaaaauaauagagccauaaaagaucagagcugggaggcagcuuagacaucuaccuaaaugggcacgguggcucacaccuguaaauccacacuuugggaggcugagaugggaggaucaugugagcccaggaguucgagacaagccugaguaacauaguaagaccccaucucuugaaaaaaaaaaaaaugcugggcacgguuucagcucacgccuauaaucccagcacuuugggaggcugaggcaggcggaucaccugaggucaggagcucaagaucagacugaccaacauggacaaaucccaucucuacuaaaauuacaaaaaaaauuagcugggugugguagcgcaugccuguaaucccugcuacucgggaggcugaggaaggagaaucacuucaacccaggaagcggagguugcggugagccgagauugcgccacugcacuccagccugggcaacaagggcaaacuuccgucucaaaaaaaaaaagccaggugcagggguucacuccuguaaucucggcacuuuugagaggcugaggcaggaggauagcuugagcccaagaguuugagccuaaguaacagaguuagauguugucucuuuauuuuuuuuuuugagccgagucucacucugucacugaggcuggagugcaauggcgcaaucucagcucacggcaaccuccgccucguggguucaagcaauucuccugccucagccucccaaguagcugggauuacaggcacccacuaccacgcccggcuaauuuuuuguauuuuuaguagagacugguuucaccguauguucgccaggcuagucuugaacuccugaccucaagugauccacccgccucggcuucccaaagugcugggauuacaggugugagccaccacacccagccgaccuugucucuuaaaaaaaaaaaaaaaaaagaaaaaggccgggcaugguggcucaugccuguaaucccagcacuuugggaggcagaagcaggagggucaucugaggucaggauuucaagaccagccuggccaacaugguaaaaaccugucucuacuaaaaauacuaaaccagccaggcaugguggcgggcaccuguaaucccagcuacuugggaggcugaggcaggagaaucucuugaacccaggagguggagguugcagugagcugagaucacgccacagcacuccaacuugggcgacagagugagacuccgucuuaaaaaaaaaaaaaagaggucaggcacaguggcucacgucuguaaacucuaacgucuauaaucccagcacuuugggaggccaaggcagccagaucacuugagggucaggagaucgagaucagcuuggccaacaaggcaaaacgccaucucuacuaaaaauacaaaaauuagccggccuuggugguacaugccuguaaucccagcuacucagguggcugaggcaggagaaucacuugaauccaggagguagagguugcagugagccgaggucacgucacugcacuccagccugggcaacagagcaagacacugucucaaaaaaaaaaaaaaacucuacgucaacuccaccaaccuacugaugaggucaggaaaggauaaagaaccugcucugccaggcacaguggcucacaucuguaaucucaacacuuugggaggccaaggcagguggaucaccugaaccuaggagcucaagaccagccuaggcaacagggugaaaccccaucucuacaaaaaauuagccaggcgugguggcacaugccuguagccccagcuacuuacucaugagacugagguaggaggaucacgugagccugggaggcugaugauagcgaugggagcugugauagcaaaaaugcacugcagcaugggugaaaaagugagaccgucuaaaaaaaaaaaaaccugcccaaagucaccauagucagcaauuugacagcugagauuagaagaugagaauccaagucucugaccucccagcucaaugucauauugccaauauaaguucccaaaggaguuagagacucaacuuaaaagggaccugaaaaacacauacuguaccaucuuucuuccaugcuucucaccaccauuccaguccugcuaucuuuuggagccacaggaaaaggccauguuuacccuccaugacaucacauucacaggucagggaguugaccuaaacaucucuagacugccugaaugaccuguucuaauaauauuaacuacuuuaagauagcuuuucuaagccugauaguuuuauauuuaugcaacugucauggggcaugggagagggaauccaacaucuuauauuuucauuucaaauauuuaucauuuguggaugugcuuuugccuaaaugcacucaguguacagcuuucacauaaugccaaauccaugaacuuaauuauacauggcuaagcaguauuucuucagacugauauaccauaguugaccuaaccaauccccuauugcuuagaaguugaguugcucccaaugagcuuaacuuugauugaaccugcuacuacugccaaccuaugcuaucacuugggauaacauaaaaauuaguucuuuccaagcuugggaggcaucuaaacccuaaaauucucuauuuguguauauuagcucuaacucugccccagcccuuuaagaaguuacagaccucagccccauccauuuguuuaccacaacugcuucccaacaucuuucacaucgagauacauguagaaaguauuuagcacacuagagucaaaggaugacgcugcugacacaugauccaaagaacucaauaccagcaggaaccuucugacuucaccauuuauugagugaugcguccuuccagccuacucaaaaaaccucccacuuuggguuugugggaaucagauccuuuuucuacuacuguuaaguauagaggccucaaggaauaucugcucuucucuguagcuaaggaaagccccuucaacaacccaacaaaccauuaaugcugcuaaacuaaaugagacacaucuccauuuuuccacaucucccaguauagagagagaauaagccagacccaaaaauauguaugguuaaaaaacaaauaaauaaaauaaggcccaagaacugguauacugcuuugccaaacacauuaguuaacaggggccauaucagcacucugagugucauggcuggcacaugagguuuauuguuaaaaacagaaacaggccaggcacaguggcucaugccuauaauccuagcacuuugggaggcagaggcgugcagccagccuggccaacauggugaaaccccaucucuacuaaaauacaaaaauuagcugggcaugauggcaggugccuguaaucccagcuacucgggaggcugagacaggagaaucgcuugaacccaggagacaguggaugcagugagccaagauugcgccacugcauuccagccuggguggcugaacaaaacaagaccccaucucaaaaaaaaaaacagaaacaaaggccaggcaugguggcucaugccuauaaucccagcacuuugagaggccaaggugggaaaauugcuugagcccaggaguucaagaccagucugggcaacauggcgaaacccuaucucuacaaaaaguuagcuuggcauggugucgcgcuccuguagucccagcuacucaagagacugagauaggaggaucacuugagcccaggaaguugaggcugugguaagcugugacugcaccacugugcuccaaccugggcaacagagugagacccugucucaaaaaaaaaaaaaguaaaaacaaaacaaaaaacuagacugucacucauucaacacaaacauuaaugaggcucuaucaugugccaauuauuaccauuuuacagaugagcuaaacauaaauuaaguaacuugcccaaagucacauacuagaaagcagcagaacaaaaugucaaccuaggaaagccugauccuagaucaguacaucccugacagaugagucgaguaggcauuaucuuuuacagaugagagguaacacaagcacuuaaacucgucuucugcuuccaauuccaacauuccuucaauaaugacgccuccaguaaaaaaaaaaacugcugaauacaaaagaaaguauuccaccugccaauccauggcuucccagccucacauucacgcacuccaucggaaaacuacauaccacacucagcugaaauuggguuaucauuccucagcccugauuugaggcccuuuggaaaagucaaccaacuuuacaaagaucuccaagagucaacagacuugggguaggccaaucccaaaggaaaaugcuacuauucugaguaaguggcuaagagcuaagggagucuucuacgugcgaccuuucuaaguuugguucuaaaagucagauugccuggucaaccacagauagguauguucuuaauacauuuuaggcaguuaacaggaggggagcagcuaguuagaaagguagcuuucuaacugguucucugaagaagcuagagccaaaucagccaauuuuauucuccagccccaacccccauuccuuccaccuauaaaauaagaugagcuuuaagaaaacacaucccaggaauagcuacgucuguuacccgacugcauguccaagguggccugcaauuuaggggggcaguagauggcauuugcugugguucgagcagaaguuaaggcagcucgggcuuucggcagguugcucagggcaugguauguuuugcuuucuaaaagcuguacuuccaccaaaagagcuuugucguccaucuuuuucaacucccgcagcagcugagaaccugaaaaaggaaaagacauucuccuuuauagccaucagcuuaauaccuaauaauagcucacucucccacccucauaacacucaggauuaaaaaaaaaaaaaaauuccugaacucaaaaaagguuaccucuagaccccaugcaauaauuaaauuuuccacuaaugugcuaucuuccaagagaaaaacacaccucuuugaaguuuucugcuuccuaaggacaauauuagagccaacaguccuaugagcuuacuccuaagauuuaaauacagugggaaucucuaccuauaaaaugcuaaaucuaguuauccaguucagaaagacacaaucucgcucucuucuugucuagcaaucacaaggcuauauaagaaacacuggggcacuagguugaugaaggaaguaaagaguucuagauauaccaauguucuccaaauauaccuucuucccugacucccccaucucaaacuagaauaucaaauucaaacagacuuacaccauauacauaaauugacucaaaauggaucaaagacauaaauuuaagagugaaaccuauaaaacuucuagaagaaaacagaaauaaaucccuguggcuuuggauuuggcaaugguuucuuagauguaacaccaaaagcauaagcaacaacaaaaaacagguaacagaacuucaucaaaauuaaaauguacuucaaaggacgucaucgaaggaaaaaaacaacccacagaacaaagaaaaaaaaauugcaaaucauguaucugguaagggacuuguauacagaauaaaaaauaaaccuaaaugcccaucaacggcagacugaauaaagaaaauguacauauacaccacagaauacuaugcagccauaaaaaagaacgagaucacguccucugcaggaacaugaauggagcuggaggcuauuauccuuagcaaacuaaaauaggaagagaaaaccaaauaccacauguucucacuuguaagugggagcuaaaugaugagaauaccugaacgcggaggggaacaccacacacuaaggccuaucagagggugggaggaggaaaaggaucaagaaaaauaacuaauagguaccaggcuuaacaccugagcaccaaaaaaucugaacaacaaacugcaugacgcaaguuuaccuauguaacaaaccugcacauguacccgacauuaaaacaaacuuaaaaaaaagaaaagaacuucagaauaaaaaauaaaaacaagagcugggugugguggcacacgccuauaguccuagcuacucaggagacugaggcaggaggauugcuggagcccaggauuuccaggcugcagugagcuaugacugcaccacuguacuccauccagguugggugacagagugagacccuguuucuaaaaaauaaaaacacaaauaaccaauuaaaaaauaagcaaaggaucugaauauuuaucugaagacauacauauaaaggaggccgggcgcaguggcucaagccuguaaucccagcacuuugggaggccaaggcgggcacaucaccugagguuaggaguucgacaccagccuggcuaacauggugaaaccccgucucuauuaaaaauauacaaacuagcuggacaugguggugcacgccuauaaucucagcuacucgggaggcugaggcaggagaaucacuugaacccgggagguggagguugcagugagccgagaucgugccaccgcacuccagccugggagacagagcaagagugucucaagaaaaaaaaaaaaaaaaaaaaggccgggcaugguggcucacgccuguaauccuagaacuuugggaggccaaggcgggcagaucacuaagucaagaguucgagaccaggcuggccaacauggugaaaacccgucucuacuaagaauacaaaaauuagccgagcaugguggugcgugcccauaaucccagguacuugggaggcugaggcaggagaauugcuugaacccaggagguggagguugcagugagccaagaucacgccacugcacuccagccuggguaacaaagaaagacugucucaaaagaaaaaacaaacaaacaaacaaacaaaaaaacaagacauacgaaggagcaaaaagcacaugaaaauaugcucagcaucaucagucauuagggagaugcaaaacaaaaacauaaugaaaugcuauuuaggauggcuaaaauuaaaaaauaacaaguguugguaaggauauggaaaaauuggaacccucauacaauguuaaagagaauguaaaauggugcagccacuuuggaaaacagcuuacuuagcagcuccuuaaacagcuaaucaguuaccacaugacacaguauaauuccacuucuagguauauacccagaagaacauguccacauaaaaccuguucauagcaguauucuuaagagcuaaaauguagaaacaacacaaguguccaucaacugaugaauggauaaacacaugugauauauccuuacaauugacuauuauucagcaauaaaaaggaaugaaguacugacacaugcuacaacauaaacccugaaaacauaaugcuacgugaaagaagacaaucacagagaaacaaauauuguaucauuucauuuuuaagaaauacccagaacagacaaaucuacaaagauacaaauagcuuaguaaucgcccagggcugcuaaugaauaggaaguuucuuucuggggugauaaaaauguucugaggccaggcacgguagcucacaccuguaaucccaguacuuugggaggccaaggcaggcagaucauuugaggucaggaguuugagaccagccugaccaaaauggugaaaccccaucucuacuaaaagauacaaaaauuagccaggcauggugacaggugccuguaaucucugcuauucgggaggccgagacaggagaaucgcuugaacacaggagacggagguugcagugagccaacaucacaccccugcacuccagccuggacgacagagugagacuccaucucaaagaaaaaaaaaaguucugaaauuuuuuucuuuuuuuggagacagagucucgcucuguugcccaggcuggaguacaguggcauaaucuuggcucacugcaaccuccaccucccggguucaaaugauucuucugccucagccuaacaaguagcugggauuacaggugugcaccaccauguccugcaaauuuuuuguauuuuuaguagagacgggguuucaccauguugccuaggcuggucuccaacuccugagcucaggcaaucugccugccuuggccuuccaaagugcugggauuacaggcaugagccaccacgcccagcugaaaacuuucugaaauuaaguaguggugaugguuguacaacuuagugaauacacugaaaaccacuggauuauacacuuuaaaagugaauuuuaugguaagugaaccauaucuuauuaaaguuauuuuuuaaaugcuccuauuugaaccauaugaaauugccacuuuugcaguccaaaaauugaauauuggaaacucuucaaccuaauagaucauaagagccauguucuuuuguucggaaaaaauaguccagaucuacccacucauaaaaagcaagcaguggccggacacgguggcucaugccuguaauccuagcacuuugggaggcuaaggcaggcagaucacuugaggucaguaguuugagaccagcauggccaacacagcaaaaccccaucucuacuaaaaauacaaaaauuagccaggcacaugccugcagucccagcuacucaggaggcuaaagcaggagaaucgcuugaaccugaaaggcagagguugcagcgagcugagaucacacugcugcacuccagccugggcaacagaguaagacucugucucaaaaaauaauaauaauaauaauaaauagauagauagauagauuaaaaaaaaaaagcagagaagauuucaagguguuuaaaggccacacaggaaaaaggcuucaguuagccacuccagcuuccaaauauauuuguacccaauuaauuucuugauuuuuaaaauagauuuuaaguauauaagcagauauaguaaauaggacaguaagccaaacauuugccuuuaaaaaccuaaaucugaaauuuaacagaguacuauaugcaaaauauagauacacuuuuuuuaaauuucaguuauuaaaauggaauugauuuuacugcuccaaauucaaguaaacuuaaaacuacccauuuguccucuaaauuugacagauuaacucuagcuaguuuuuuaaacuuucaaaugacauuuucccaugacaaaugcagaacuguaagcuacuuuaaauccuucuuagaagucaguagaauauaaauuauuaacagguaauuaguaagaguagccaggugguuuagaauacauucauuuagcuagcugagaugacuuauuaccagcuuacuuacccaaaugcaaugcuuccugguaccucuugguaucaaaguacaaagacaccagucuugccuaggaaagagaaaaggcauugauugaaggggggggaaaaagccacagaaagaaaucaaagauugacagucacagaacuguuacuguuaaauaugcaauuucugaugauagcaucaaauucagcauaagagacgaucuagccaauguauugucuccuauuauagccagcaaaugacuguuaacuuuaccauguuguugcuuacuacucugagccaaguagcaaaucugucucaaaacuucaaucagagcaauuaucauaaguggggcuaccaucaauaaucuuucgguaucuagguaauuacaaaguugcugaagauacuuuugauaaggaugguacugcuuacauucacccucugucucaugcuuagagaccugaaaugaguacuaauguaaaaccuaccuccaaagcuuggcguaagaaaguucuuuucucugacuuggcccauucgaugcacucuaaacacagcucgaccu

SEQ ID NO: 13412 - RNA, 14909 nt, Homo sapiens
uggcaugugggagcuguuuucacugccuggccugaggugugggcaacggugggagcugauucugggggcugggauaauaacucaguacuuuccuuucucacaguuguuuccucucuuugcuccugguggcugcugugguuuggaagaucaaacaaaguuguugggccuccagacguagagagguaagcuucaguggguaaagauuaaagaaucccuggaagagcuuuuuuuccuucuuuuucucuuaagcaaguggguuuuagcuauuuagugauaauggacagacagacaucuccacggaaggaauaaugcagcccuuucugcaguccaugguucugcagcauauggucaguagacuuagaugagugcuacauaaaguguaauuaguucugcaccacagugucuuaccuuccgaaaaggaaacucugguauugacuuggaaaugccaguuuuauccuucagaccagaacccaaguccugacugaggccagagauccaagggcguauuagcacagccaccgcgugauuaggcaccgccuucaugagaacuugucaugcgagagggaaaucagccauuuaagcaucucaaaaauuuuucauuauucaaggaaagauaaauguguguguaguuaaguuuuuaacuugaguuuuauuuuuaaauaagucuugauuuguuuccagagcuucauuccaaaaguaauaagcaaauauuuacagcugacaaauuuaaauaaauaaacuugguugcaaauuacaacauaucaaaugcccaucaaucaaugaguggauaaagaaaaugugggguguguaugugcguguguauguauauauauauauuuauauacauuugcagcaaccuggauggaauuggagaccguuauucuaagugaaauaauucaggaauggaaaaccacacuucauauauucucacuuacaagugggaacuaagcccugaggaugcaaaggcauaagaaugauacaguggauuuugaggacucgggggaaagagugggagggggaugagggauaaaauacuauacaucggguacaguguacacugcucgggugauaggugcaccagaaucucagaaaucaccaugaaagaacuuauucauguaaccaaacaccaccuguucccccaaaaaccuauugaaauaauaaauaaauaaauaaauaaauaaauaaauauuuuaaaaauaaccaccauuaaaauaauuacaacauaaaaacuuuguguauugcaacuuucacuugcaucauuacuuugccuuucauuuagucaugccuguggcauuguuggcauuguugcuaauggaaaugcucacguguauauaagaucuagacaaagaagcugucugggguuuuuuuggaucuacucaugccuuuuucuauauaaaaauguauuuauagauaagauuuagaacagaagggaaguauguaaaaucacaacucacaagcacucagcacuguugauaggauauucaugucugaauaggguuaagacaggcuccaggauaugggccucuuguugugggccacaguaccaccuuuucugacccacauaaagaugauguuaucauagagggaauguugcacacucuuuauuauuauuuuuuaaauaaguggauaacauauucaaaggguuuuuuagauaacuguauuacugauauacuuuaaaagccuaaugaauuacgugauguucugaaaaaaauuauauuuucaauuuaauuuaaauguauauuuauucacaauggaguaagaaagaaguaagaagccacaguaaaccaguuaucaagaaaggaguugaaaacuuuugagugcuacucucuccaagaaggacauuagacccagggaguuucaagguugagaugagcuuauggagauuaugauagccuguuccucccugagugcuuaugagaauuaauuguuucuaaaaucuguaaagcaaaggaacagauggaaagcuugaaagaguccgaauugauuuuauacacagaaaucuugguaccaaaaccugacaaagguagcaccaaaauacaaagggcagcugcauagugaauguaugugcagcagucuaauugcaguguaaugaaagagucacuuaauaccagaaaaccuauuagaauauaucaugucaaaaaaagaauauaucaugucaauggggaaaaaauaacaccugaauucuuccuaguggcccagaaaucauuucgucauuuauugaaacucaauauccauuccuaauuugaaaacaaaacucacaguaaaaucaaaaauaccuuuuuaacgcuaugaagaauaucuggauaaccagcaucacucaugauaaaacaaacaaacaccagagguuguauccaggcuaguuaguuuuaacaagagcugacaucugagcauuuaaaaauuccaggcacugaguucuaagugguuuuacguagauuaacuaauccuuaucucaaaccuaugaaauagguauugucccucguuauguuuuauggaugaggggacugaggcucagaaaggugaagugacuuacaccacauaguuaacuaagaggcagacgaggcuuuaacuagggacuucugucuucacagcccaaguucguuaucuucguguaauccuacagucauucagcuuugugcuagauguucuagacugugcacuaagugaaagggcacuaagaaguguuguuacuauuggaaaggaaacaaaauuauuauuuucauauaaaguuauuaaaacaauguaguagagauuugccugcauaaaaaugaaggcuuaaguauaucaaaaaauaaaugaauaacacagaagcuaaacaaucaacuggaaauuguuugcagugugcaugagagaaaguaagaugcacagccuacaggaaaaagauuaaaauauauauauguguuuaguauggaguuggucaucuaauaaacuaugcuuuuacccgugugauuuggaauuucucuguaacugugaagcugaccauucagaauauauuucaucauuuuuaaaaugucagccauuauuuauucccucucagaauuguagaagcaaugauuugauguuauuuuuaaaaacaauaguaguagcggcugacgcuguuuaguccuugcuacacaccagccccgguuuuaagugcuuuuacacauguugccuccugaacccugucuuauugugaccccagcacuuaagcacagaccccaaggagcauugcugcauauauuagucgaguaaauggaccuacagcuuuaaaaaauguaagaauguugguauuuuaagaaaauauuuauaaaaaugcccuucuagaacagagccauaucuauccaggccaagauucugucuucuacaguaguuccaaggaggcaguuugaaguaaggccuacuuguaucccaaggcauaaccucaaagcuucagcaucaugcccagaaagaucucuaauauccuuaaugauaugugaacggccguucaccaugugcuaggcgcugugcuguaguaucucauuugaucccagugacaaccuuaugggcuaggaacacauuucagagggaggacacggaugcccagagacuucaaacaccuuucuuaaggucacacagcuguagacuauuggagcaggaguucacaucaagccucccuaaaucccgagccccuguuugucccucuacucugcaaaauuucacauuuguuuguuuuuagcuuauaccaccucucugaaggaaggguucuuucaguuccuaucugccguauaaugaggcauagguuuuuguuguccugugaauccuuggugccaguuucaguaggaagaaagcaagccugacuuuaguaguagaaauacgaggagauagagccacaccauuuuauguauuugacaagucgacgucauagcauuaaauccacaguacuuuuauuuuuaucuuuauuuucuuauuuuacuuuaaguucugggauacauguacagaacauguagauuuguuacauagguauacaugugccguggugguuugccgcaccuaucagccuguuaucuagguuuuaagcccugcaugcauuugguauuuguccuaaugcucucccuccccuugcuccccaccccugacaggccccagugugugauguucccuucccuguguccauguguucucaugguucaacucccacuuaagagugaggacauggaguauuugguuuucuguuccuguguugguuugcugagacugauggcuuccagcuucauccgugucccugcaaaggauaugaacucauuuauuuuauggccgcauaguauuccaugguguauaugugccauguuuucuuuauccagucuaucauugaugggcauuuggguugguucuaagucuucgcuacuguaaauagugcugcaauaaacaucguacguuaauauguaucucugacaggggcuuuuaaaaaauauaaggacaaugguguuaucacauccaacaaaauuuaguaaucccuaauguuaucuaauaucaagucuaaaaaguaucauuuuggacuugauuuguuugaaucagggaggaugagguguuuuuaacauguagcauuaacuaauaaaaccccuucaguacucauuccauuaauggcuuugccauauuauuuaucagcaacuucuucgagagaugcaacagauggccagccgucccuuugccucuguaaaugucgccuuggaaacagaugaggagccuccugaucuuauuggggggaguauaaaggugagaaugugacucagaagucccuauaacuugacuuuuuaaaacuuaggcuccuaagucugggaaaccagagagagcaaaagcccuauuccauuaccuccuuuuuuuccucucuuucuuuuuaacaauaagcuaaaaccugaaguugcuggguacucuuuugcuuuuguuuuucaaucuuuguuucaugucgcugagcagucuuguguucaggggauuuuaaaaucuaaaugauuugucugcuuuucuuuuaaguauucuguggcauacaaaacuuuuauuugaaaagagcuacauugaacaucgaaucauuguuuuuuuguuuguuuguuuguuugagacagagucuuacugugucacacaggcuggagcgcaguggcaugaucucggcucacugcaaucuaccucccggguucaagcgauucucuugccccagccuccugaguugcugggauuaccgaugugcgcaaccacgcccagcugauuuuuguauuuuuaguggagaugggguuucaccauguuggccaggcuggucucgaacuccugacuucaagcaauccacccaccucggccucccaaagugcugggauuacaggugugaaccaccgcacccagccuauuuuucuuuauauuuuggggaauuuuuuaagcagcaaaaugauaauacacuguguauuaauacucuguggaaaauauuuaucaccccccuccccaaaaugaugaagaaaaugguaagacuuucuccuugggcaaaaugauggaauauuuaagauacgcuggagaaauagcuauguaucuugaauaaaacauacuuauuuaaaauguuacugagcucacaggaaguagguaaaaucuccagggaauacucuccuucccuacccuaaaaagaacaaaccauaaaccaaaaccagaaccaugauuuguccuaagugguuccagaugguaaacacaacacccaccugaauagauggaaauccucucuauagaaaaacaucuucaauucagcgcuguugaagucccacagaucaagaugaaguaauuaaagaucaccagggacaagaggcaagccgccauaaauaagaguagcagaaacaacagaugauugauguggacaggacuccaaauguuagaauugaaaucuaaagaauauaauauaacuguguaugaaauguuuaaagaaauaaaagaugaaaucauaaagaugagagucaaguauggccaagcagaucugaagaagaaccaaauggaacuucuagaaaugaaaaauauacuuguugaaauuuuuuaaauaaauaaacucaauuuacauguuaaauagcauaucagacauaagagaauuuacgaaguggaagaugaaucugaaaaaaguacgcagaaugcagcucagagagacaaggagauagaaaguacaauagauacuaagaauauggaggauagaaugagaagauccaacucauauauauuuccagaaucccagaacaaaggagaggcaauauucagaaaugauagcuuuccagaacugauggaaaacaugaauauacagauuccagaagcaaaacauauuguaagcaugauuaaagaaagaaagggaaggcaggaaggaaagaaaacaaguuggauuucucauaaugaaauuguauaacuccaaagacaaagagaacaucuuaaaaucagccagagaaaaaguaucacauacaacauggagaaacugaacguuagugcacuguugauggaaguauaaagugauggagccacuguggaaaacaguaccacuauuccccccagaauuaaaaguagaauuauauaugaucuggcaaucuggguuuauacauagaagaacugaaagcagagucucaaagacauauuugaacaucaguguucuuggcagcauuauucacaguagccaaaaaguggaagcaggcccaaguguccauggauggauaaauggauaagcacaacguggucuaugcauccaauggaauguuauccagccuuccaaaggaagcaaauucugacccaugcuacaaugugaugaaccuugaagacauacuaagugaaauacuccaguaacaaaaaaauaaacauuguaugauuacacuuuuaagagauacacuugugguagucaagcucauaaagacaggaaguagaacagugguucacaggggcugggagaaggggaaaauggggaguuaguguuuaauggguacgaaguuugaguuuuacaagaugaaaagaguucuggagauggauaguaaugaugguugcacaacaaugugaauauacuuaauaccacugaacuguacauuuuuaaauggucaagaugguaaauguuauguguauuuuaucacaauuuuuguuaaaaaugggaaaagaggccgggugugguggcuaacaccuguaauccgagcacuuugggaggccgaggcgggcggaucacuugaggucaggaguucaagaccagccuggccaacauggugaaaccccaucucuacuaaaaauacagaaauuagccaggcaugauggcacacaucuguaaucccagcuacuugggaggcugaggcaugagaaucauuugaaccuagaaggcagaguucacagugagcugagauugcaccacuguacuccagccugggcgacagaacaagacucugucgcaaaaaaaaaaaaaaaaaaaaaaaaagggaaaagaucaccugcaaaggaaugacaagcugaccgcuaacuucucagaagucagaagagagugagagaaugucuuugaaguacugaaagaaaccuccccaccuagaauagugugcccaguaagcaccuuccgagaacaaggaugaaauaaagauaucuucaaauuagaauaaaaauugagaauuugccaccagcagaccugcacaaaagaaaugucugaaggaugugcuaaaaugaaggaaaauuacccccaggaggauagacuaaaguguaagaaagaauagugaguaaauaaaaguauaaucauauauagaaaucuaaacaaacauuauccugguaaaauaauauuuguggguuaaaaaauagacaagccuaaaguauugaacaacaugauauaugucagcagcauaugacacaguuaguugcuccuuaaaacauuuucuugauuuucuuccaggacaccacacacuugccuucuagcuguucuugcucaguggucuuugcucaauccucuucaucuuuugacaguggugugcgucaggcccugccuuuguccccuucuugugucuuuuacacccacuucuucagugaucuucacuaucacagguuuaaguaccaugauccucucaccuggacugcucccaugagccuccaacacaaacaucaguugccuacucaguguccccacuuggauaucuuaacauggccauggccaaacugagcuuuggauguuuauuucucagacuugcuccucugacauaccuuccgccuuucagcacauaacaccuccaucacccuaguugcucaggccaaaaucguggaauuguucuugacucauucuugaugucauguucucauuggacagccagucuaucagcaaaucuugacuccguauucaaaaauguuucccagccacugugucccaucucugccacuauucccacuugaucuaggccaccgcugucucucaccuggauucuugcaguuacuucauaacugaucucccugccucugccauucacccaucuagucaguuccuugugccacagcagagugguacuggaaauuauuuucuucagccaaacugaagaaacugaugacauuuguggguauagucagcagaauucuaaagguggcccucaagauuuccaucccacguuuauucagucacacacuacucuagguacugcuagagggauuuugcagauguaaugaaacaagggaguugacuuuaagauacagaaaguuucucuggcugguggcagaaagaggaagccagagagauuggaaacaugagaaggacuugacacaccaucccugguuuagagauggaguggccacagaaguuuuuuuguuuuugugagacagagucuggcugugucacccacacuggagugcaguggcaugaucauggcucacuguagccucaaacucuugggcucaagggauccucccuccugggucucccaaagugcugggauuacaggugugagccacugcguaagcccugaaugcauuucaaagcagagucuuccccagagucuccaacuaagagucccauccagcugacaacuugacuucagccugagagaccucaggagauagcugauaauuccccagaacucauggaagacaugaacagaccugucucucucggcagagaacccuacagagcuugcugggacuucugaccucuaaagcugugagauaauaaguggguguuguuuuaagcaacuaaguuugcaguaguuuguuacacuaauauaagcugggugcgguaggucacaccuuuaaucccagcacuuugggaggcugaggugggaggaucgcuugagcccaggaguucaagaccugccuggacaacauagugagaccccauuucuauucuuuaaaaaaaaaaaggaaaggaaagaaaaagagaagaaacuaauauaggggacaaaucucaucuaaaggcugcaacagaagaugaaaacauauuuuccagagccaaaugcauccagagaguagacaaagaaucuacuuggucagccaacccagcuuuuacaagcuuuuacauccagcaggcuugucuacuuagugucuaaaggacagacaaaauagaauguuuuuuaagucuccaugauaucugcaucuguguuugagccagguaugcagaacuaucugacaaaucuaccaagcacucaccacugccauuccugugaccuacaguuaugaauuagaauuucaaaucgagccaaaguacagcauccagaagaaacccacuuggcguggccccuucccuacaguucaagcagcccucuggaaggggacugcgagaccucaguggaagguagcaagcaguaccacccgugucacuggugcucagagaguacuguuagcucucuccugcccuuuuucauuaucuuaaaaacugcaauguaccuuuuuuauauaccugaaauugaugguucuuauaagcacaaaugaccguuaaguuguccguauacauuaaagcuugaguaucacuuaagguaauuuuguuuucuucugccagacuguucccaaacccauugcacuggagccguguuuuggcaacaaagccgcuguccucucuguguuugugaggcucccucgaggccuggguggcaucccuccuccugggcagucaggugaguagaugcgguccagcgaaagacaccuucuaagcaugugagggagcuaagcaugggauacuucccuuuccuagagaacaagguuauaaaggugauaaccaacagugccugcccaugccauggcaaggauucagugagauaacccauuuucaccuauaugcccaaaacuguuuucccgaggucaucgucccuuccuggggggacgucccgggaccuccucaccguucuggccuccccagccucucagugcucguggaugccucugaccacaccuuccuuugcugucggaguuucuggucccccuuugccucugcugcucuuucccugucucuuuugcccuguccugccccugaaucugggugugcucccuucacccugcauguucuuccucaguugccuucuccacuccacaacuuccagccaucuccccugggcugguguuucuucaauugguauuucuagcccuccugcauuucuuuugcuuuuucacuguuuuaaauauaaggcacaaacacaacgauaacauaaaggaaacgucugaaaauccacgcacaguucugcuaucccacaacccaccaauuuucauuguucuguguucuuuccagcccuggccagcaauuuaguugaaaugauuguauagaucuaauuuuuauucugcuuuuuucauauaacuaucuuaaacauuuuuauagccuacuacauaauauuuuaccaaugcaugugacacuucuccaucaaauauaugaaucaugauuauauaaacuucuauuuugaagacagaaaauauggaauacaguuuugaaaguaucucgcuuaauuacagagugcuuuggaggaugccucaaugugaucauuuuagacaacuuucaguugagaugauucuggagucaggguuaccuuagccagagagcacccugugucugguggaaaggcugccccaggauacugguccaggcccugagcuccacugucccuucagugcacccucagacccagaagauccuccagcccagcuuuagaaugguuaggaucuauaguaucuucacgagggaggccuuucgacauggcucggccaggauucauugucuucaucucaccuagggauuccugugaguugagccccuaacucggccuugccuguguugaggacaggacaacucucucgucugucacucaagugcaguuugugucuccugccaccgcccagcccagcaaacaguggcuggugugcccugagggcaggguggcggcuggggcggcaaggugacaggugugcagcccuguagccuuuccugcuccagccuuugccugacaugccccaaccaccugaaacaccuaauaaaggucugcucaaugcuugagacccacccaacaguggggccguccuugcugccccuucuguacccccuguuuuaaguggugcccuuuucuaggcucccagagcauuccccacugugugccaggcacuuacagcugucuacccccacccccacuccccuucacaggcucaacaaggcaaguaacacgcuccacuaacacaacuccuggcaggucucagcagagcuccgagccugcgcuggccauuucccacguauauuaggaauccagcucccccagaaccgugccuucccuaauggaugucagauuacuccguuaucaauacaggaaggaaaaugggauugcaaguccccaaagcaaagugggcggcggggcagugaugagcauaaaggguaguugcuauugaucguggguugcugcgcgccagauacuaagacuuuaugcaugccagguacuaagacuuugucaguucacucauugauucuucacacuagcccuguacuacuauuauccccauuuuacaaaugaggaaacugaggugcagggagguuaaagaaccuugcuuauuccaaagccuggccccagagccugcccugccuguaucgugguauggaauggaagugacuaaugcugacugagugauaggggugaaucugaaucucgucauaaagcgugcugcuguuucucggcuccuuuuggaggaaggcaggagaaauugggcacuuagcacacgucuacaaucucauuuauauguucccaccaccaagcagagcacugugcuugguugaugugcugaaaagcaaacugcaccuuuuguguaaaaaguagggaaaggagaagaauguguauuuguauuugcauaaguauacccucaaagaauacauaaaaauuagugaaagcguuuacccagauggaggggaaggcggagggagggucaggguggaaggaagacuuuucccuguguauguguaccuuuuuggggguuuuuuguucugguuuuuugguuuguuuguuuugcaccaugggauugaaaaauaaauguuuaaauuauuuuuuaaaacaaaauaaaagccagcugcucccagcauauguucucucugugguucucccaaggucuugcuguggccagcgcccugguggacauuucucagcagaugccgauaguguacaaggagaagucaggagccgugagaaaccggaagcagcagcccccugcacagccugggaccugcaucugaugcuggggccagggacucucccacgcacgagcuagugaguggcacaccagagccaucugcagggaagggcguggcggggaaauggcugugcggugcgggacggaagacuggaaacccucaaagcaucugacucaccugcaugaucacaagcuuucuuugacgguuucucccauccguguuccagcaucuaaccuuuuacuuuugcauaggaaauacuugauuuaauuacagguccagggaugagcugaugguugcuggaggaggccaguguagagccagugagagaacuaggaaugacacucagguucacuguggaaaacuguucuugggacugucucaacugugcaaaaaacaaaagauggaguguuuacaaguagacauucgucaucaguuguucuugaacauggucuuuuaaaaacuagucagaugaauuguuuucaucugaagccugcuaucuuuuuuaaaagaugugcuauuuauucuugcacgauuuaggcaauuaucucucuuccagggaguaccuuuuuuucuaguugagaauuaauaaugguccaucucuuuugaucauaucaagcuaggauagaaggggggcuauuuuaaaugucaaggucagcaguguuacuuugaauguaaacugguauaauagguaguuuucuauaguaacuugauuaauuuagucuuaauccauuugaaacucucucuuccuuucucucugccugucccucuccuucuccaucucacccucccucucucacacauacacacacaaacacauacacacaacacuaagugccuagacuuuaaauagaucuagcaauuggaaaguuaguaagccuaaguuuuuacauaauugcauuccuacauucuuguaaaauuuaaauagcuaccauuggcaaucugcuuuuuuucuaaaaucugauuugcagccaggaaagaauuuucucacccaaggaacauuugaucuagcagcagggaugagaggaaagcagaaaugaaugaacugugaaagcuccuguuuuuauuaucaaaaaggacacugucaagaaggcgcccccugcccccacccccgugucacccuaggccugauaagcgaucagaggaaaggacucauucaugucacgcuuccuugagcagaaaagagcacugagagcacuugggaccccuggaucagagagcaucuguguguccugcagccuccucugaacuugugguucauucucaggcugggguggacucagaugccaggaaagggacagccucccauugucaggcagaagcugcccaaagccuggagaaggacuuguuugcccucuuucccccaggaggggcucgacccacccacccucccucucagaccaaggugguggcugugaggagggcagcaaaugcugacaaggaugaaaagcacauggaaaaaaauggaugaggagggaaaacucugccaaauggaaaaugaccaaauuuaagagggugggacaguccccugcuccucucccagagggcacugcuuggaaauuguguuuuccccauuuauggugcucuguauucuggcauuaugcagcagccucccagaagcucucuucugcuucaaaaccugggaucucuggcauuacccuauugggauggaccgcuggacagcaaugcucgaguuugugaauuuggagagauacucaaaagagcuaaaacugcagcauuuuaccuuuaaaugcagugccuagagagagaguauugucucuuccccaacacuaaccccacucccaugaagaauugccuggaaagauguuuucaaggaauuugaaccauaaaacacuaucugaugcacagaacaccucuacuuugagacucaccucucauaaagcuucuuuuucacauuacuguuaaagaccagacguucuagaaaagaccccuccucucaugagcucccccaucccugcuacagaacacagcacccauggcgccugcaguggacuggccccuuaauucccacaggcccccccagcaaggccaaagggaggccccuggguauuguccuccuacaaggaagauccucuuuguuuguucaaaggaccaguuuuccuaggccaaagaagucucuuccccauguuaguccuaugccuugaaauaucaugcaccaugacccacagccaucugguuaugucuuauuuuuuuccuaaaagauaauguuuauuuuuaaaaaggaaggaaggagcaagugaaguuucauucugcuccagcgguggggaagccgcugaauccaccugcuucuccu

SEQ ID NO: 13413 - RNA, 2925 nt, Homo sapiens
aucagcuuguucccauucaugcacugagccaagccacaaaggccagcuuauggauuggcuaacuuugggucaggucugaacagugagggcgggcacaugggagugagcgagauggaucauguggggcaaaacacagccaucugggcaccagcaucugagggugggggcggggcagauaaugaugacaucccuagcacaccggaucagcuaagagcacagcugcaggcaauaaggaaguggaucaauagcugcauaaaccuggggcauuauuuuucucacuuggcaaguuauagaacaggugguugcugguauugccagucaagaacccaagcucgcucuuuuuuuuuuuuuuuuuuuuuuuuuugagacagagucucgcucuguugcccaggcuggagugcaguggcgccaucucagcucacugcaaccuuugccucccggauucaagugauucucuugccucagccuucagccuuccaaguagcugggauuacaggcaugaaccaccacgccuggcuaauuuuuucuuuuuuuuuuuuuuuuucugagacggagucucgcucugucgcccaggcuggagugcaguggugcaaucuuggcucacugcaagcuccgccucuugguuucacgccauucuccugccucagcggcgucccaaguagcugggacuacaggcgccugccaccaagccuggcuaauuuuuuguauuuuuaguagagaugggguuucacccuguuagccaggauggucucgaucuccugaccuugugaucugcccuccucggccucccaaagugcugggauuacaggcuugaaccacugcgcccggcuaguuuuguauuuuuaguagagaugggguuucaccauguuggccaggcuggucucgaacuccugaccucaagugauccaccugccucagccucccaaagcgcugggauuacaggcauaagccacugcgccuggccugaauuuuacauuuuuaaaugauuggaggggaaagucaaaagaauaauauuucaugacacacuaaaauuguaugaacauuacuacauaauauucucaaauuugccucuuggcucacaaagccuaaauuuuacucucuugcccuucacagaaaaaguuugucaacccucgcuuuaggaugauugaggaucauugccaaaaucaggauucuggcagcaagaagaaacagagaauagauuucaggugggcauuccuggugucugcuacacauuccgucaacacauuucaagccuguauccaguuaucuaauuugcaagcaacauaagcuaagaagucccccucucaccaagaaccuagcaaaaacaaguuaucucagaagccaucuucuucaaggauaucuucccagauugaccagauguuuagguuuuuggguuuugguuuuuguuuucuuuuuuugagacggagucucgcucucccagacugaagugcaguggcccaaucucggcucacugcaaccucccccucuaggguucaagaaauucuccugccucagccucccagguagcugggccuauaggcacaugccaccauaccuggcuaauuuuguauuuuuaauagagacaggguuucgccauguuggccaggcuggucucaaacuccugaccucaggugauccaccugccucguccucccaaagugcugagauuacaggcaugagccacagcccuggccaaauguuuaggauuuugaaagacagcuagccaggcgcaguggcucacgccuguaaucccagcacuuugggaggccgaggcggguggaucacaaggucaagagaucaagagcauccuggcuaacauggugaaaccucgucucuacuaaaaauaaaaaaaaucagccaggugugguggcaugcgccuauagucccagcuacucaggagggcgagacaggagaaucgcuugaacccaggagguggagguugcagugagcagagaucguggcacugcacuccagcuugggcaacagagcgagacucagucucaaaaaaaaaaaaaaaaaaagaaagaaagaaaaagaaagaaagacagcugugaaaaggaaagggggacaccaggaaaucccuggcuagccgcaucccagaagacugcaguauuauuugcucagugaacuugcccccagccagucauuuaucuauucuucaguauuacagguccagaaagcggaucuggugaccagucucauauaagcugauauggacuuccuaacucacuaggaaguaaaguuuguaagcccaaggccaauaugcuaauuuuuagugggauauauaacuuaaccaucaacaagccaauguauuuaugacaauaaaugagcuugaugggaagucaguccauggucugaaagcugcuucaugagcucacaggcaaagcugaggaguuagugaacaguuauuuauuuaguguaccaagcacaggacuugaucccugggccaggguuccaccuccuggugccuccugccucuguuuccaauacauccccucuccauccucccaucugacucaugcuucauucacagccuuuaauuuugcucugugccuuuaaguucacauugcuugucucuaaucuccuccauugcggguccauuucagaguagaacucucagaagacaaucuuaagaacuuuucuuuccaagcucuuaaggggcaucuuacagucacccuaguggacaagccuacaaugccuaccacaugggcuucauacagguuagguagucggugucccccugacuccagcuaugaacugcaccuucacacguggggcauaggggcccucugacacccuucaaccagccaguacucuccaaccaucaacaaauggccaggugaggucaucaaaugcaugcauuugguaguauuuacugaacaccuacuaucugcgcaguagauggggauacagcaguguguaaaa

SEQ ID NO: 13414 - RNA, 28337 nt, Homo sapiens
ggaccccgacgggacccgugcgcggagcugcaucuggagccccgcggcuaugcccugugcuccccucccugccggccgcucguucugugccccggcccggccaccgacggccgcgcguugagaugacuuuccgcgaucuccugagcgucaguuucgagggaccccgcccggacagcagcgcagggggcuccagcgcgggcggcggcgggggcagcgcgggcggcgcggcccccucggagggcccggcggugggcggcgugccggggggcgcgggcggcggcggcggcguggugggcgcaggcagcggcgaggacaaccggagcuccgcgggggagccggggagcgcgggcgcgggcggcgacgugaauggcacggcggccgucgggggacugguggugagcgcgcagggcgugggcgugggcgucuuccuggcagccuucauccuuauggccguggcagguaaccugcuugucauccucucaguggccugcaaccgccaccugcagaccgucaccaacuauuucaucgugaaccuggccguggccgaccugcugcugagcgccaccguacugcccuucucggccaccauggagguucugggcuucugggccuuuggccgcgccuucugcgacguaugggccgccguggacgugcugugcugcacggccuccauccucagccucugcaccaucuccguggaccgguacgugggcgugcgccacucacucaaguacccagccaucaugaccgagcgcaaggcggccgccauccuggcccugcucugggucguagcccuggugguguccguagggccccugcugggcuggaaggagcccgugcccccugacgagcgcuucugcgguaucaccgaggaggcgggcuacgcugucuucuccuccgugugcuccuucuaccugcccauggcggucaucguggucauguacugccgcguguacguggucgcgcgcagcaccacgcgcagccucgaggcgggcgucaagcgcgagcgaggcaaggccuccgagguggugcugcgcauccacugucgcggcgcggccacgggcgccgacggggcgcacggcaugcgcagcgccaagggccacaccuuccgcagcucgcucuccgugcgccugcucaaguucucccgugagaagaaagcggccaagacucuggccaucgucgugggugucuucgugcucugcugguucccuuucuucuuuguccugccgcucggugagugaccccucucccaccggccccuccuguucucccugagccuauggcggugcccuccuggcacccagacuugggcgacccccaccugaaccuagaagguugacuuagcaaguccugagucuccuaagaggcaggugugcaugcaccauuuuguggagugccaaggaacgguucuucauccucgccagguucguuucacaggcuucuaacuuuucuguccuucccuucuucuuuuccaagccuugggcuuaugcugcuggccccucuaaaaauaaaacgucugugaaaaucugggcgggcaucugcccauauguggucggcaguguaugugucccccuacagaucccccucccgggaggugggugcacagagugggugggccuacauguguucauucauggguagcaagcccuggccagucagcagguacaucagcagaugccagaagccacccgcuuuuccccagcacucauucaguuuggaagcuggccccauuugggacccuccccagcugguguuucugagugccccgaguucucauuucugagauccccucuuggaaaggaaggaggcugaguggcaaugagaagcacagggauggggauaaauuaucaaauggaaaguucauauuguuaaucguuauuucuugagcuuacugaguccuugagcucuuccgaggaacuuuccugcuucuuucacaagcugugcugcaguccugggagguaggcagcugucuucagaggccgccuccuaccccuugaggccugucuuggaagcccugggucugggacuggaggcuggaccagugcaaggaguagugggggaacagcaucucuggggaugaauuugcccggggucagauccacccauggcugcaaccuccgcaggcccaagccgggccuucucugccucucccaggccuggacccuuccacacugccaggcugagucaggaaagagacaauggccuccuuccugugcccccggaagcccuuuccacacugcagccacagugaacuuuauauauuauaaauuagaugugucacucuccuauuaaaagcccucaaugcuuucccacuguccugagaacaaaauccaaacucucuaucaucaccuaugagagggugaccuucaaauauauuauuguccgaaccaaaauaggacacuaugaauauuuacacugggaccacaggcuggaacuggggccaugcagacauguggucccccuuccuacaauggagaucucaaaugagagccaucucccucucugcccucccccucucugccgucacggucuugccgcuucccucugcucugggcuccuccccucugacccuuucugguuucuugcuggagccccugccuguccucaggccuuugcacuugcuauucucuccgacuucgcuguccuucccaaucucuccuggccaacucuauccuuuaggucuuggcuuaaauguucccucuucagagggaccuucuuggacccaugacccucagugguguccuuguuuucucccuugaagcacaagguucgcuuccuucacuagaucauugguuguaauuacaucugugugcugcuuguuuuguuucugggacuggcccagaagcugugugagggcagggcugugucaccugggucaucacugaguccacggcacucagcaugggccugguauguggggagcaaaagagagcacugcagugaggaucacaggcucuggcgccaaucccagcucugccucccucccgcuagcugcguaaccgugggcaaaucccuuaaccccucucugcuggcuuuuuuaucuauaaaauagagauggggugaugguaaucaugccuaucuauagggccaucguggaacuguagcuuuuguaguggauacucaauauaggguaaggaaugaauaaguaacccuugaaaaucauccagccaaagguuguugcagggauggggcaagcaacggacccuaagcaacacacuaggagaagcaggcaaguaagcagggaagagaaaguuggugcccgccccuuuagacauccaagcccaucccccaggcccaucgccccagccccugcuccagccuugcccagcugugcugggcuccugggugcccucauucaaccccugccccucgguucacacugggccccuguagggaacgcccaaccuguguagaaugccagcucccuguuuuuuuuuccuuuuaacuuccuuuaaaauuuuagcuuaaugcacaaauaaggagaaaacaauaaaacaagcacccacaugccuguaaucaccuauacugaacagauguuaacauuuugccauauuugccucagaccccuuccucucucuuuucaaauaaauagaacaagccauaacuagauccccuccuccugucccuuccucuuucucucccugccucgccagagauaaaucuggaguauaucacucuuauacagauguucauacucuuacuacaaacaucuguauccauaauaauauacuguuuuguuugucuuugagauuuauaugaauggcaccuugccaugcguaucaccguucuucaauuugccauuucacccaacauuauguggcugagauuuauccaugcugggccauuuucacagcaguacauuugagaguauuccacagugcguugauccugcugaauguuagguuuuucuaacucuuccuuguuccaaucaacacugcaaaaggccacugcuuucuuugagguccacgucacgugacucccucuuccaggaagucaucccuuaauuuccaugaccuuugcuccuugcuggcacgcacagcucuuucucaauccuuacauuucugcugcgccucacaugugguguagggaauugggggguggaggaggcccuaaauccuccuuccuaauggucugugcugcaccaggcuucucagggcaccuuuccgagugccucagagcagagcccagggacacugguggagcugaauugaguugaaucuggcaaugaugagcaaacaggacagaggccaaacaaggaaacaaaauauuccgaucugccccaguauggcuuggagggcagaagcagcagagagggagggcagagcccauuuggagcaggaggggucuggaggcugugcaggaaggagagggggccaggagguccugacacccccagcaugaggcccaggccugggaggagggagauaccuuugaaggaacagggaacacugagcagcaacuuuuggggggaauguggacccccaggggcugguauauguugguguggagguaccaggugugugguaggggauagagaacauuggaaacuuggaugcagggaucaaagauggggaugguugcaggagcauggagugcagucucccagaaagaggaggagagagaaaagaggaucucaggacagagcuuuggggagcauugacguugaaagacccaaaggaggcagaaaaagaggcagccaggaggagcaggauggcuguugagguggcaccugccuccucccagguccuggucaccacacuagcugugacgagcaccagagacggagagauugagaaacaauguauaugccagcaaggaaugggcccacauaggcccuggaaguaaaggcacccaguagggccacagcagaccuggggugcccucacucacacuuccgcacacaaagccaggugguagcagcagccacagcggccuggagggcaucaagagucucagggaagggcccggaguuccagaggaacauuggcacugugagccaugggcugucaccuguaaaccuggaaugcuguggucaggccagaggggcagcaccacaggagggcuguccugaacugugggggcaucuaaggacccaagucacuggcugggagacacugggacacagaugugggcaccuaaaauccagagaaucccagagaguagcuggggaucauccccuacacuuccagcugccccgcuuucccugugaggaacaacugcagagcauguccccaaggcaggcagagggucaaccagcucauuagaccgcaagugccccgaugcugcgauuucagggagcaaggcuggggagggcagcaccagcuccucugggacccccaggaagcugcuggugccagaggugcggaggugcguguagaacgccccucaccgagagagaggggagggcacccuccugcccacguuccguggugaugcccaguugagcugccugcuccgugcauagugacccaggacagucccguuccuugccugugaccggugggauagcuaguagugcuccccuuucagucagagaugcuccacuuuggagauagaacguagugacaccaaucccuggggccugugaaggaagugcucuuggcagccccgcccaugccagguacaauccccuacccucaccgcagcaagcuggugcgggcugggugccacggaaaaucacagggaauugucuaaaucugcccuccucaucgggauccuucagccggaugccccgaggagcccagacuuguagagugagugugggaggggccgcagugagagccugcugccugcggacuuccagagaggacccagagagagggggcguggcugcggcggggcugcgucguugggacaguuggguagguuggaaaagucccugauaaaagccucugaagccucugcgcugagaagcuucgugcaagaauccccugacccuagaggucuaggccaauuguguagaaugcagaucauccucccugcgggugugagggguaccggaggggcuggggaaacccugccccaggcaagcacccaacugcagagaagcuuccuccucucccgggagccuccagaggcccgugucccuccugcguguuuucauggcggcagcaucucacugcguuuggguuugggcugccugguaagugucccccagccacgcccagagguggacugucugccgagaccuacauacacacacaaacacacacacacacacaacagccccaccccugucacuccuagugaccacucacagcucccaggcuuucgaucccagcucucucuuguugggcagaucaccgagcaucacugaccuccaccuuccaaaugccauccacucaaagcagcccggagacucagagcccagggccccccucaaaugcaccucaaggcauacaagcugggcagaggcucugauaucagaagucccaggacagcccagccaaugucccacuccagccaucugugagccacaccugagccucucuccuaucuugugagucugugcucugugauagugccugugucgcugaccacccccagacuuagaugucccaugugcuucugaaacacucugcauguacuuuuaucacgaugcacuguaacugucaauauucagauaugcaucaugaagugugagggcaaagggaacuacacacacguaggcacaggaguagcaguauugcuggguugcucugugguuugggagacguaaaacguguagccuaugagaagaggggucaagagaugaggccagaugccaucugcaggagaauggauaaauaaaccauguauccauagacuggaccacgguacaaggaaaaauagcaaacuacugaugcacacauggaugaauuucauggauguuauacugcgcaaaauaagccaggucugaaacucaagguguacacaccuuuugauucuguguagaugaaguucaaaaacaggggaaacuuaucaauggugauaaaauccaggauagcgguuacccaucugugugugugcagugaguguacuaacuggaagagaaugcuagaaaacuuucugaagggcugggacaguuccauaccuugaccuggguagugaugacauuggugcaugcauaugcagagccaucaggcugugcugugugcuucagauacacacgcuuucuaaauuugacugucuacauguuaugccuuuguuacagugagagagaaggcaggaggaggcaggggggaggcugugagcccugcuuaguaauugguguccaggcuggaaggcauacuuugguggccccgugcggagaguggauuaugcauaugucugagagucggccaggugcuaaaggacucaucuccacaggcugccugagguugugcaggggucuguggaugaaggggagaggcaagggaugcuuugugcuaggucuucaguaauggcaucauugucucccggcccaaaagccugaagaaagggcuggcauuacaucuccuaccugugcuuuguggcaccuggaacauaauaggugcucaguaaaugugugcagaagaaggaaacgguagaacccauguucuauucccauccugccacaccaagggucuggguggcaaagcacagcccuccauuuauuuauuauuuuaauuuucuuuuauuguggcaagagcauauagcaugagcucuacccucuuaacacacuuuuaaguguaaauaucauaucauuaacuacauaucauuaacuauggauacauaucaugugauacuguugcacaucagaccccuagaacucaucuaucuugccaaacugaaacuuuaugcccauugauuagcaauucccaauuuccuagcgcccuuucucccuggaaaccaccaucccacucuuugagucuacgcauuugaguauuuuagagacccccauguaaguggaaucaugcaguauuucuccuucugugacuggcuuauuucgcuuagcauaacagcccucuauuuaaagucaacucucuuuacuuguuguggguugggggugaguccccauuuuuguggccuaaaaaaaaaaucuuuaacaggacaguuaauauuuauugaguaauuacuaugaauaagcaaugagcuaggguuggguuuuuuucauguuuuuaacauggaaaguuucaaacacauacauugauagagagaacccuguuaguauaaugaaccccuguguaccugugacccagcuucaccccaaagcuaaccuagauucuuuccauccucacccacugucccaucacuguagauucuuuuggauuuuuguuuguuuguuuuuugagauggagucucucugucucccagucuggagugcaguggcgcaaucucagcuuaccgcaaccuccaccucccggguucaagugauucucgugccucaaccucccaagaagcugggauuauaggugugcaccaccaugcccagcuaauuuuuguauuuuuaguagagacgggguuucaccauguuggucaggcugauaucaaacuccugaccucaggugauccacccaccucggccucccaaagugcugggauuacaggcaugaaccacugcacccggccacuguagauuauuuugaagaacauccagauacaguaucccuucaucuguaaauccuucaauauauaguucuagaagauaauaacuguaaaaaaaaaaaaaaaaagcccacaauccauuauaacacauaaaaucauuuaauaucaucaaauaucuacuuaguguugaaauguugcuggcugccucguaaauuuuugguugguuuguuugaagcagaauccacagaaggagcacacguugcauauggucgauuugccuauuagguuucuuuacucgguaagccuccacugcuuuuuuuucuuuccauuuauuuagugaagacaccagauuguccccagguguauccuguaguuuggaguuugcaucuccacagugccauuuaaugugucccucuguucccuguacuuccugggugcagauuuggccuggaaagaauucuucuuuucuguggugucaagauugaccagaauucaugugcugucagccugcucuguccauuacaaagugacccaucggccuuucaccugcugguuuuggcagccauugaccauggccuggacccauuauaucacuggggcuugaaguggggauauucuaauccuaucauaccuccuucauuuauucacuagcauucuaaaaugauuucaccacuagcuguuugguuaaauagaaucuguacagcaaaggcagggaagauguucaauauuccucuuuauuuaucagaggaagagucaguucucuagcauucuuuccagacgugaccacugaggcuguuugaguaccaugguaaugucauuauuuuuagacauccuugcuguuccaacacaucacagacaucauuguuuugggcuuggccaguggguacuccuuccaguuggcuucugagaucuuuggcagaaccuggagcaucuugagcucuucuuugcuuucugaucugauaagaugcuucaggcucagcuugcauuuuuucugcccuagaccuggaauuagccauuucccuaaagagcccuagucuguuucaauggaagaugacugagcuguucauugauacugaguuggucacugauucaauggacagaucuaggaaguacauuuuauuuucaguagaagaaaaacacaacacugauggggacuucuguccuuggacauauauuccuccuuccccuccccugaagaucuuguccucugcccagcuccugcugauauguuugucccaaacaucugaggaacuguugaucacccugcuccauucauuaaagaucugggcaucagaaucacacuguuuuuuccucacucccaccccuacccuggucaucagugugacuccacuguacugaggcugacccaugaugacacucuggccuugagacuacaaugaccuuccccuccuccccuccuccaaggccuaugcccugguccaugugcccauuuuacucucccucccccagaauccucagugaagcucuuccuccugaguccaucugcuccuguccucccugcuugguucccauuacaccugcucaucaaccccagccuugaccaagccuucaccucccugcccucaccuugucucccagucgauuacacaucccuuccuuagucagcuagucccagaggaugaucuguugcuucauccucucuugccgucuuuaauucccucacuuccuccuauuucugugagccccagauccugaauuagaccauuccucccuaugauguccugguaaauguuacacaauuggcucugggauggaggcugauuuauagcaucugccuauuuucaugguguaaauauuccaaagagagcucacagcauuucugaaauuguagcaagcuagugcaaaccagggucuagcugagcacuugcuguagaaaagucacacuuuccauagucaggcugcugccucgaggcagcccucagggucuccccauaaguccugcagauccucuguaagcucugacucucucucaacccuuuuuccuuucuaaggagccuuacucuuucaguuacuccucaacccucuuugucuccuaccucucuucuguccacacauauagcacaucgacauguccagagcuuucuuaaagauucucccucaaucccauggacccuuuuguccucagccuucccccacuuagcacuguagucuuuuccucccuuucaccuacuuguaagcauauucuuugcuacuuacccucuuaacucuuuuuuuuaaagauuaguagcugcuuuauuuuauuuuauuuguuuuuuauuuuuugagacagggucuugcucugucacccagguuggagugcaguggcaugaucuccgcucacugcaaccucugccucccagguucaagugauucuccuaccucagccucccaaguagcugggacuacaggcacccaccaccacgcccggcuaauuuuuuuuauuuuuaguagagacgggggggguuucaccauguuggccaggcuggucucaaacuccugaccucaagugauccgcccgccucggccucccaaagugcugggauuacagguuugagccacugcacccagccgacccucuuaacucuuaaaagaauauccucucaggcugggcacgguggcuugggucaggauuucgagaccagccuagccaacauggugaaaccccgucucuacuaaauaaauaaauaaauaaauaaauacaaaaauuagccaggaaugguggcaugugccuguagucccagcuauuugggaggcugaggcaggagaaucgcuugaaccugggaggcagagguugcagugcagugagccgagauggagccauugcacuccaaccugggugacacagcaagacuccaucucaaaaaaaaaaaaaaaaaaauccugacauuagucuugauuaggacaccuuuucccaccugccacaugcaucagcccuacucaggguagcuccugccauucucacaccugccccagggcuaagggcacacacuucccuggaucugccuuggcacugucaccggaggcugccagauccucacauucagagggcucuuuuucuuucuuuuuuuuuuuuuuucaagagauggagucucucagagcagaauaauggagugaaaauuuuguuuuaauuguuuuuaaagaaagagacagggucuuacucuguugcccaggcuggggugcagucgugugaucacagcucacugcagccuccaacuccugggcucaagcaauuccccacaucucagccuccccaguagcugagaccacaucuagcuaggggucucaaaauuuuaaguccuuucauucacuccuauaugucaguuugucccucuccccuuucuucuuaugacccuuaauaucucucucccaucucccuccugguccucuggcugcuccuucucagccuuccucggagaccccucuccccuucagauccacauuuccagacaaacccucuucagcuccagccccaaguccagcugcuaaggucccagcagccccucagacagccuguauucauuuccuguuccugcuauaacaaauuaccauaaacugagugacuucaaagaauauauuaccucccaguucugaaggccagaaguccuaacauccaagccucagcaagccgcauuuccucuggaggcucagggagaauucucuccccggccccuuccaccuucuagaggccacuggaugucuuggcucauggcccugccuccaucuauccgcagaaugguccgacugccgcuucuguugccacgucucccucucuggcucugagccuccugccucccuccuuccugucugaggagucuugucauuacuuugugcccaccuggauucuccagagcaaucugcccaucucaggaccccugugcaggugacauucacaggucuggacaucuugggggcauuauuccaucuaccacacuuccacgccccagccacaggggcucgguccucuccuaggcccaccuuucugcuucugcccucgagccugccacuucccccaaauucuucaucuuggcaaguggcaucucugucuguccucuggaguccaagccaggaaccugagcaucagucucaguuccuccucaugccccacucagacacuccaaccucccaaacaucccucagucuguucuguuuucccauucccacucucccaccuuaauuaacuaauuaaucacaaacccauauauccugugugccaggugcuguucaaaucauuuuaucccccuaacaguccuaugagguagaugcuauuagcagccccauuuacagaggagaaaacugaggcaccagagagguugaguaauaugaccaaaguccccccaguuuauaagugucagagccgacauuggaacccaacgacuuuggucccagaguccauguuauuucuugccugggucagaggucggccuggggccaggguuaagggccauaguuggaagccauguuuucagcuuuccaucccaccgaagcccucagccccuacacacaucccccaggcucacuuccaugucuuggauaccggccaagaggggaucuugaggacugccaugggacauggccccuuccugcauggcuugauccucucccagacccuggcagacccccagagucccugaggaagucucugagucccuaagcccaucucugcccccgccugagcccaggccugccgugcaccccccagccccaccgugcacccugagcacgcuggaggguaggacuucccucacuuugcaaguggucaccuaggagaacagggucuugagucucugaaagccaguguggaggccagugggcaaagcccaggcggcucagugcugggacucccggacagcauggucacugccugggaaccuucucuccccggguauuagugcugcucugcucacacccaggagccauuugucaguguggccccagagccgagaggcucaugcuuggaucaggggccagccuggccguggggcagaacugcagccguggucacucagagcuugggguguggccauuccaagaccacaaaucaggaaauaagugaguuaagaagugacaacaaagaggagaaagaagggggaggaagagggaaugugggaagagagaagggagaagaggagggaaaaaaagagucaaagagaaauggguggggccugguggagaccuagaggaugcaagaggaugcgggacaggccuauggcucaucucccugaacuugggcuccaccaggcagccuccguugcucuaggagcugcccucccuucaccugccccucagcuacagaagggagucuggggccagccccagguaguucaaggauccugaagcaaacacgagggcacagaaggacuucugaccuacacccggcgcaucucaagugaaaggacccugucaguuaccucucaccacagaaaauuggugaugcaaggaaugugagaggcucggcuugguauagcaggcccacggugcccucgacucaccccuucgagucuucacaauccauuugagaucuggaccauauccaggucaccucuuccugacaggcuuccaugacuguguccccuucaaaauggccuuaucucuuaccacucuccuccuccccuucuccacuuuggcgguccuaacuucccgggugucucuccaacuugucagguacccugcugccucagggccuuugcacaugcucuucccucugccuggaauuuucuuuccucaaauacaugcauggcucacucccucacagggucuucaggucuuggcucaaguguacuguauuagagaggcucgcugacccuuuauaauguagcgaagaggccugugaggggcagaggucccagccucuccuggggaaggcugcuacugagcuccaagguuagggccguugcgugagcagcugagcaaacugggggagaggaagggagucuggggcugggaauuccuucucuccuagcccugcuggcagggugggaggagacugaauaucuagaaggaugggguauuuuuacuccuguguaucucuguggacaggggaauggcuuacuauggauagaaaagucccaguggaggacaggguaggaagaugggggaggcuggggugcagccugauauuucauggucaucuacaaguuaugagcaaggcuggcugugaauucugacaaucugccaagaacaaguuccuucuggugaugccaaaagagugcuauuaaucacacaguccgccccuugacuucagcgccgucuguccucagcaaggcuuggccagucaguugcucagcuccagccaugucccucccugccuuagcagcgucccagcagcuccugcaggccuggccauuccuguuccuuaggaaaauggacuggcuuaugauaaucugggcuguaaacaaacccccugcuucaguuuccccaacaauaugugggccaggcuggcccagccaacaagccagagaguggcuuuucuugcugacacaggagaggccucaccucuucugaccagaggaugcccagucccccaaacguuagguuagacuccugacacgggcaccccaauacagggaauggggaaggcaggcuggagcagcccagccagcuggauggcgacucagcacaugggagaacaagaacaagaaacagagaggagcgggcaggaguucuguuuuuggucaucuccucccugcguccuuacugggucuccucagagguggguucaugcagccacacucacccccccaccccacugcaagccuccuguugaauggggagaaaugaacacaaacgugcacacucaggccccaccuuucccagcagggggcagaagagugaugauggccacuaagggcuaaucccuggucccaagguuuuggggaccacgaaaagcacuugaagacgugacacugcacugacaaagaaugucuugggucggguucccuagaagcagcguuugagauagggguucuucuugaaggauuuuuuuuucuaacagaucucauggugcuaggugaucuguucucuuguugagacagggucucaaaaaaaaggcagguacaugcagccaccaugcaaguggcugcauguacccaccucuguugcccagacuagagugcagugaugcaaucauagcucauugcagccucaaccucccacguucaagugauccucccaccucagucucccaaguagcuggggcuacaggugugcaccaccacaccuggcuaauuuuuauauuuuuuauagagauggaguuuuacuauguuacccaggcuagucuggaacuccugggcucaagagauucaccuacuucggcuucccaaagugcugggauuuauaugcgugagccaccacacccagccuggaugauuuuuuuaaaaauaaauauuuuauuuuauuuuuuagagucaggguuucccuaaauugcccaggcuggguuugaacuccugggcuuaagcaguccucucgccucagccucccaaguagcuaggacggcagacaugcaucacugugcccaguuaggaauuuuuugaaagaggaauuucaggagacaccugugagggagggcgggaagccagaggggaagagcuaaagccagggugugguugaggcaaagcuuggccuuagcccgaccccacagggaucccuggggcaagaaaggcagaacuggacugugcugaggcaagggggccggccuucucuaucaccacaucagucugucauuggcugcaggcuguccccuugggaagcaggugucauggacccaguugaagcagcucccauugacugagggcaguuguccagagaaggggcaacagcuagccucugacugccaacacagcaccuggggaccccugggcagggcaccaacaucaucugacuucaagccugaaagggacuuugugagcaaagacuugaaggaguugaaagagauggccaagcagcucuuuaggguuucucccaggaguuuggggucauucugauacucucuccagcuagcaagccccaccccagcccuucugagcagucuggauggauggacguggagcugaaccugauguggcaugcccugcaaggcgcccuugaggacauacaggccagcaaaugccacacggccugguguaagcagaaugaagcaugcuccgagcacgcacacuccagaagccgcuaucaccccucaaaccccaguggagcaggcaaucacaggaacacccuuggagaagguucuaggcugaguugaggcugagcuccaggggaaaugcccccuauggagagaggaggaggacuagccuccucgccagaccagccuugugaaaacccagaggcugccgggcgcaguggcgaaugccuguaaucccagcauuuuaggaagccgaggcggguggaucaccugaggucaggaguuuaagaccaaccuggccaacauggcgaagccccgucucuacuaaaaauacagaaaauuagccaggcgugguugugggcgccuguauucccagcuacuugggaggcugaggcaggagaauugcuugaaccugggaggcagagguugcagugagccaggaucacgccauugcacuccagccugggcaagagagcgauacucugucucaaaaaaaagaaaaaagaaaaagaaaacccagaggugggaugggcucacugcugguggggcagcugccaggaagaacaaagggaguggcugugccuccugaacccagcgccccuagaagcccaaggggaguucuguuucucuguuuaagugaugucaggagaggaccaggagcuuugggacuagaccaacucagaugcauguccugacccuaagggcuacuugcucucuggguaacuagaaucauucugcaaagcgggaugccaugaggauucaucgagaacuacauaaaaggcccagcauggugccuagaagguacugaacacucggaaagcgucagcucccuuuuccuuccucugcacauuagaggccaccuauucaagugccauuuacuuguucauucaagauauuucagagucccugcuucguucgagucaggcacuugugcuagaggcugggauaaaaagaaaaacauauuggacagugcaaaaacaugccuuuuagaaaauuucucaggccagacaugguaucuuacuccuggaaucccagcacuuugggaggcugaggcaggaggaucauuugaggccagggguucaagaccagccuaggaaacagagcaagacccugucuuuacaaaaauaauaauaauaauaauaauaauaauaacaauuagccagguguaguggcacaugccuguagucccaacuaauugggaggcugaggcaagaggcucacuugagcccaggaguucggugagccaugauugcaccacugcacuccaaccugggugacagcaagacccagucucuaaaaacagaaagagagaaagaaagaaagaaaagaaaagaaaagagagagagagagagagaaagaaagaaagaaagaaagaaagaaaaagaaagaaagagaaagagaaaagaaagcaaagaaggaaagaaagagucccauaccugccuucaagaaaccaagagucacauagaguagauggagcaauagcaaauuguaugaaccuguaguugcacgggaaaggacagcugagccaggcuggguggggagacaccugaccuggggcugcagggacugggggaggaggcuccugggagcagcaaguccuggcagaaaggcagaagaagcccagcuaugugggaggaucugcuugaggcuuaacguggcugaauuuggaggaaggcaggacaaagacagcacuggcccuagaaacguuguguuuccuugugagcagcaccauguuucgauugauuccucugagccacaggaagccacugacaguuuucagaagggaaaggagagaaaccaaguuuuaaggaaaagucucccagcagcugugugcagaguggagaggauauggguugaggccaggggcugugaggccaggggcugucaggggcugcugccgccaccuaagcaaaaugaaaugacagagcaagccaaggcuuaacaaacacagugaagugcaggggaccugcuaaaaaggacaucuaccgcacaggacguggugaccaguuggauguguaggauacagaggagggauucauucagcaaacucagcaaguguuaugcaccugcugugugcuugauaugccugugaggucuucuuggcaaugggaaugcagcaccaagcaaaacagacccuggccccaccccagggauguucauugcagggagauagaugauagacaaaugcaucaugacucaaauaggacagaaggugacaaguaccaugaggcauaacagagcaagcugagccagacagggagcacaggguuaggggauauugcaauugugaauacgaagucagugugaucucaucacaaaggugagggugugagccacauggauauuggaggaagaaaauucuggggaaaaagugcaaagggccaaggugggugugcaucuggcauguccaaaaagcaacagggaaggcaauguggcuggaacagaguaggcgagggaaggagaggagaggagagauuuggggggacauguugagcuguguaggucauaggcucuugcuaggaggaggcagaggagcuguuggaggguucugagcagaggagugacgugaccagucuuuucagucuuucuagcugccagggugagaaaagauucagggggcaggggcacaagcagugagggggcugcuggauucaucaaggcaagugaugauggugucucagacagggugggagggcgcauugagggugggugguugaguuccaaccucgucuccuuccucucugcccucaaucacugcauucuguccacaccaaccucgucaucguucuacaaacauaccggagccaccucagggccuuugcacuugccguuuccucugcuggaauguuccuccccagaucuccacacaccucauucacucacuucauucagcucuuuacucaaaugucacauucucaucaggacuuuccuggccaccuuauccagaauuuauaccaccaccccuagccacauaucacaagcacacucgcccccaucuuccuuccugcuucauuuuuuucuccuuaguauaccuuuacucuuugauaccuuuacauuuuccuuguuuauccuguuuauuuccugucuuccccagugaaauguaagcuucaugaggacaggauaagugugagauccacuagacucccaaguggagaugucuaggaggcagcuggaucuaugagucuggaauuaaggagagaggucugagcuguaaagucaauauuuaacaccaugagccuagaugacacugauaggagaaugcaaagacaggaaacugcaagacuaaaugaggcgcuccuacauuuagcagugaggaugugaggaaggagcagcaaggaaacugacaaggaguaggaaaaaccaagagacugucauccgggaagccacagaugagaugaguggcacccaggaggaugagggcagugucuacagguugagggccugggagggguggaacauguggggcaaagcagcagagcagagugaggucagguggggacaaggagacuguaggugagggcuggagacguggagagaagaaggugguggccagggagccagcaaaggggcagcagcuguaaccaaggcaggcuuguggguggcuuaaggaucgagggcuccaccauacaaguagggacacuaaccuuggguaggaggagcgaucccuuccuuaccaaagaagaugagaggugcagaaggcugggcgagugccuaguuucuguggccucugcuuucccugugaaacaggagguaagaucaacugcucuggagaagaaggggcaggcugcaaggcuuggaaagagggguaaagauuugguauaggaaagguuacacuguagguaacuauauguucccucucuauuucaccauuuaaggcuaaacuccucacaccgugcuuggcacguaguaggugccucauacauucuuggacucuuuguaucacaccuugcaccucauccauuaccaacuccuuuaggcugccaaauccccccaacuuugcacuaccuccuuaaugccaccuugaucaacacuuccaucauugucuaccugcgaugcaguaaagagccgguaaaggaaaagggagagagcuggcagaggacaggagccuagaucacuggaaauaugggacauagagcugaggucaaagaccccaagcguguucaaggagcgacuaaauugcuccagagucaggaucuggcuggaugagucucccuacauccagaaggaugaggggguugguggaaaagagaacaguuaaggugcuggugaguaggagucucagcuaagcagagaaggaggaauccaaggagcuggcaggaggucaaaguacagauaaggaagagagagaaaagacaggaaguugcacucaguggcuaauggauuuuaagugaagaaaugaaaugcucaggcuuauauuuuaaaaggauccccagcuguguacagagagcaagcuucggagccgggggcgggcacaaggcaggagcaggaaggccgcuuagaaaggcacugcaggggccaggagcaguggcucacgccuguaaucccagcacuuugggaggccaaggcaggcggaucaccugaggucaggaguucaagaccagccuggccaacauggugaaacccccaugucaaaaaaaaagaaagaaagagaagaaagagagagagagaagaaggaaggaaggaaggaaggaaggaaggaaggaaggaaggaaggagggagggagggagggagagagggaaggaaggaaggaaggagggaaggaaggaaagaaaggcacugcagguagacaacgaugguagccuggaccaagguaguaacaugaaggugauacaaagaaagucgaggggacuuaggggccaacaggaguuggugauggaugagcugcaaggugcgauacacagaaaagaguccaagaauguaucagguaccuacuagaugccaagugguaggaagagcuuagccuuuaaaggugaaauagacaggaaacugaucguuaccuauagugcuuuaggcacuuaaaagggagagugaugugcugcgggugggaggagaguaaaauagcucagcugggucaggagcgagugguguaagagagacuucagaaggagaugccacuggagcuagcacuaccagauauagaggaagggcauuccaggauaaucaugugcaagagcccagaggcaagacuggggagccccuuguggccagagugcaaagugagucagccuggccacuuggcuguugcacaugaagacagaggacugcagagagacauuggagccacaaaagaacaaggccugugagccaagugcccaugcucaggggucuuggggcaguuccccauuucacacucaugguaugccacggagaggaaaaugcccaguugucuuucugacuuccagagaucccugcaugaggcugugggcccaugagagaaugcugaggggugcagucaagagagugggcaagugcagggcgguguaggugguggauuggagcacugugggcagaggcaggugugaaauucaaaccggcaucugugagcggaacaggagaagucucuugagagccgcugccugcggaaucuggagcccaaugcacagauuguuuguauuuccaggcaacaugucugcaugcagugggcagagaacacauaaaacaaaguuguggcagaugccacugguuccccacccaucucccccagagcuuuagugcaugagggccaaauucuguuagagcacuugccugcauuucuuugcccagggacuuucucugcacacucauguggcagaaaggaaguguggaaaauuaacacccagagggagcagcccaaacaaugacugaugggaaugggcguauaaauaccccaccucccucacucuacuggugugagaacacugagguuugugcucuucauagccauccagagcucccccauugcccacagugauccguaacuugauaacacacuuuauuggcuuccuucuuuucccugauucuucuucccacucacucaagcuguuucauuuaccucccaaauuaaaaacuuguauuucuacucuugucagucugcucugggagagcccaaaguaagacaaaaccucaacaggauacagugggaaaaccuuggggcugaaaggcugaguuuguauuacagcuccuucucguguaaggacuucccagcucacagcagacuucagguugguugagcauaaauuaccauauuaauguuuacaacaugaccuggccauacuacaauaugccauguugcccaccagucugaauaaaaaccaugcaauaacaaugcccuuuggccagcuucaggcucaccacugaaaagcauaguccacugauuugucauccugggcuaaauauaaaagaauuguagcuugagucagaaggcuauuuucagcacucugucuuaguucgcggccauugagcgaugcuguucuugagggccacuuuccuggaggcugaggucaacacuaguggcccccacauuccagggauggcccaaccucucucccggggaaaauaaucucuuucacacauccugacuaaugcgccaguggccccuaaaacccacuaggucucagcugcuguuucuggccacucuccagagcuagaaacugggucccuucccagaugugaguucucuucacucaaaagccacagaaauggagguaaguaauagauacuaauaaaccaggcacgguggcucacaccuguaaucccagcacuuugggaggcugaggcaggcggaucacuugaggucaguaguucaagaccagccuggccaacauggcaagacacuacuacaaauacaaaaaguagccgaauaugauggugcaccccuguagucccagcuacucaggaggcaaggggaucacuugagcccaggagguggagguuguagugagccaagagcgugccacugaaguccagccugggugaugggagagaaacccugucucaaaaaaaaaaaaaaaagaaagaaaaaaaaaaguaauagcuaccaauacuuuuuaagagccugcuaagugcugggaccuaaaauauaugaaucuucacaaaauuccuucuagaaaaauaauauuaaaaggaaaguaagacuuagaugggccaggcacgguagcucacgcuuguaaucccagcacuuugggaggcugaggcaggcagaucacgaggucaggaguugagaccagccugaucaacauggugaaaccccgucucuacuaaaaauacaaaaauuagcugggcaugguggugcgugccuguagucccagcuacucaggaggcugaggcaggagaauugcuugaacccaggaggaagagguugcagugagccgagaucgcaccauugcacuccagccugggugacagagcgagacuccaucuauuuaaaaaaaaaaaaaaaaaaaaaaacuuagauggccacauaaccugcuuagggccacaugaccaagguuugagaagccugugccauaugaugcuaugggacccuccucuuccccugcggugucucuuagcaccagaaacugucucuguauggugggaggaggggugauaagcaaagccgauauuccccaggucaaagagaggggaauggugccucugccuccucaguagggaucccugcucuuuuuuuuuugaaggcaagaggaagagagagaaggucccauaauuuguuaaggaccccccccuaccccuggccugcuuggucucacaggcaccugcagccucuauccaggauggaacaccccuggcccgcuuggucucacaggcaccugcagccucuauccaggauggaacaccccuggcccgcuuggucucacaggcaccugcagccucuauccaggauggaacaccccuggcccccugcuuucuugccccuacugcugcugagggugagugagguugaaagaguggccucugcugccuggauugugccuuugcauuuggucaugugccuuucuggaaaaaugaccuuuucuggguccaugguauggaugucaggggagauguuuguggaaaggagggucuuccuggcacagcucagauccuagugccccugccccauccucccuggcacucuccuuuuucaaagccaucccagaagccuuuccugaccacuuccacuggaacagccccauugcccugcauuucaacagcccaugagcaguguguuuauggaggcuuaauuccaggcucuaucucucaccugcuuaaaaauauucgcggccccuaagcauccacaaaauaaaagcugaacuucacagcauguaagccccuucacuauuugucccaaaagagauuuucugaguuuauccuauaggauauucccaggacccaaacuugguauuuucuugcccgccuguccuucccaccuguaauacccucugcccugccucauccuggcugaccccccuaagcugucucugagccuguggcugccacccuacaugcacacacagcugcaguggggagcuacagugggaauuauguccuguuaaaccuguuguaaauugaaaauaucauaggucaaaaugcauuuaauacauauaaccuacugaacaucauagcuuacccuggucuaccuuaaacaugcucagaacacuuacauucaccuacaguuggguaaaaucaucuagcacaaggccuauuuuauaauaaaguguugcauaucucauguaauuuauuaacuacuauauugaaagugaaaaacaggaugguucuuuggguacuugaaguaugguuucuacugaacgcguaucacuuuugcaccauuguaaagucaaaaaauuaagucgaaccaucaaagucagggacugucuacacugagcaccaccaucaucaccccaccugcaucucaaagauauuuauucacauucuagcugggaaauaagggccauguguaaugccuccucgugugugugagcccagcacagcaccuggcagggagcaaaccuuggccaacauuuaauucgaggguccuuaccccuuuuuguuacagacuccuuaggcaccuggggaagcguaugggucccuucucagagucacgcuuucaaaagcauaaaacaaaauacaaaagauuacaaaugaaacugauuuuauuggaaaagccaucaaaauauuuuuacaggaaaugcgugacuugcuaaugaauaugcuucugcauuaagguauuacauaacaagaucuaguucaauuguucuaggaccauuugcugaaaagacaaaugaaaagacuacccuuucucuauugaauuaucuuuguaccuuuaucaaaaauaaauugacucugugggucuaaaaaaaaaaaaacaagaucuaguggugcauucuaaugacugucauuucccaaaagugaggagcauagagaauauuucaaaacaucugcaacaacugaaagugauaggaaaauauccguggggacggcuaauguucguuugaaucauauuaucaauuaaagaaaaaaaagcuuuuaaaaaauuaacauuaguuuuauuuagaagucuuauugaggacuauagacuaagcccuguagcccagcccuucagagagguuauauuagacugcuccagcacaguaguuuaaucuacuguuuauauauagguagcgcggguuccauauguacaaaauuuuauugaacuugcucagcaauucuauuaaagcagaauuauauugaguuuuggguguaagaguauaucuguucauagcagcauaauuacuagccuggucagacguuaucuucuguguaggaagaggcaaggacuagggucauuuaucauuucaggaaaacagugacucagacaggagauguggcagggaggcgggggcguauguucuauccuauuuuaucuucaaagcaucuuuccagagagccguacuuugucacagagucggggacuuugugaaauuaugcuggcacgcagaaaugagcaaacauggcuauguuugcuacuuugucucauaauacgaaacugccaauauugcaccgguuuugagcuacaaaaacagcaauugcacgugguuuugucuaacucuacucugguuuguugccuacauucauugaagguaauccucaauaucagguagaggugagugaaaacaauuauuauuuuucucuauccaaguucauggaccuccugauuuacagcacggaucccuugagaacuccuagucaaugacucagccaaggcuacugaagggucuccccuuugcgcccagagccgccuggccucccccuccccaagcagcuaaauaguaucggucucugcucccuacaggcuccuuguucccgcagcugaagccaucggagggcgucuucaaggucaucuucuggcucggcuacuucaacagcugcgugaacccgcucaucuaccccuguuccagccgcgaguucaagcgcgccuuccuccgucuccugcgcugccagugccgucgucgccggcgccgccgcccucucuggcgugucuacggccaccacuggcgggccuccaccagcggccugcgccaggacugcgccccgaguucgggcgacgcgccccccggagcgccgcuggcccucaccgcgcuccccgaccccgaccccgaacccccaggcacgcccgagaugcaggcuccggucgccagccgucgaaagccacccagcgccuuccgcgaguggaggcugcuggggccguuccggagacccacgacccagcugcgcgccaaagucuccagccugucgcacaagauccgcgccgggggcgcgcagcgcgcagaggcagcgugcgcccagcgcucagagguggaggcugugucccuaggcgucccacacgagguggccgagggcgccaccugccaggccuacgaauuggccgacuacagcaaccuacgggagaccgauauuuaaggaccccagagcuaggccgcggagugugcugggcuuggggguaagggggaccagagaggcgggcugguguucuaagagcccccgugcaaaucggagacccggaaacugaucagggcagcugcucugugacaucccugaggaacugggcagagcuugaggcuggagcccuugaaaggugaaaaguaguggggcccccugcuggacucaggugcccagaacucuuuucuuagaagggagaggcugcgggcuccguggggccuuuugcucccaaucccuauuugagaaacacugccccauccuccaugcccugaacccugaguagacagccccaagcauggccaggaaggccugccccuccucuucugggaaauaggcacagaagcuuuggccggcuaccccagugccucccuuagggaaaaagucagugggaccagggcuccucaguggacaaauuucuccuucuuacugccaacuggaggaacccaguggaccuaccaccacccacaagcuuugguggcagauuguauagccgucauacaagccugcuguauuuauccaugggcccgcuguccgccacccaggcuccuccgugcacaccccaucaccuggccccuaccccuuauuacuuccccucaagggccuuacuguuuacacucuguacauagcucaucgugccugugcccaucacuucuugcugggauuccaagccaccaauuggagagcuuuauuugucauuuugagacauauuuauugguaagaguacuucuauuuuguccaagc

SEQ ID NO: 13415 - RNA, 2788 nt, Homo sapiens
uaguauguacaaggauguuuauuguuugcaguggcaaaaaacuggaaauaaucugaaggcccaucaacaaggcaaugauucaaucaaucaugauacaucuguauuaagugagauuacguagcaauccaaaagaaugagucagcuaucuagauagcuguuguuccaaagaguuucaugaugcaauguuaaguuagggaagccaaauugcagaugaauaaauauuuuacauacauaguauuuuuaaaaggcauaaucaaguuaaaaagcccucacuuguguaucugagcacaguuaagguggagccuacaucucaggcuggaaggaggggacaggacgggggaaaauggguggggaggaaagaaaacaaagaguaggcagggcgugguggcucacaccuguaaucccagcacuuugggaggccgaggcagguggaucaccugaugucaggaguucgagaccagccuggccaacauggcaaaacacugucucuacuaaaaauacaaaaaaauuugcagggcuugguggugggcaccuguaaucccaccuacuugggaggaugaggcaugagaaucgcuuaagccuggaagguggagguuguagugagccaagaucacgccacugcacuccagccugggcaacagaaugagacucugccucaaaaaaaaaaguauagaaaaaugaguagaaagcauugaauuaaguuaaguaaaaauuuagaauauaaaagcucacuuuuuuauugcaaauaugaauguuuacauacgcaaaugcuuaagaacuaggaaagugcaggggaaacagcaaacacugacucaaucagaugcugggauuguuguauuauuuuggucuggaauaucuguuguaauuuucaugucacuuuuacaauaaacuuauauuuuaaaaagucaacacuuagcaggggcuacgaaagcaacgguuggcaaaauuaugcacacugcaaaaugacgauauccagaauaauucagaagccccucccaaugucucgcacauaguaggcaccccauugccccuuugcuaaagugaaaaacuaaacucagccuuuauuccaccccaugauucaucaacuugagcaagaauguucaggcacacacgcguucgauuaaaagccccauaaacaaauuuugcauuugaaucaccauauacacauucacgucaugccccacugaaaucugguugccgggacuauuaacagaaugagaaaaggcagcaauuacagaaaaugaacgacaucauggccuaagcguuuucacaucagaaaugaagucauuuggcugacguggcugcacgugcuguuguaauuaaacuuaggagagcgaggaagugaaaugucagugucagccucugaguacuuucucuuucuuucucucuugccaugguuauuauuuuuuuaauuagaaagcaggaaauaaccguagaggauauguucuguacuuuuuucuugcucucugaucuagaauuaacaggaccguggaagcagaaggcgaguguagcucuggcagugacgugaaccccaguccuggcugcaggguggacgucuccuccaugugcccaguguaaggcuguuucuuugugcugcucugcccccaaguccuccgcucacuuucaauguuaaaaccuuccaaauguguccuugagaagaacacugauagcugaggggacucagcacaagaggugcccucaucagcacucauguucugcaaugcuuuggauaaauugucugauaaaaugcauguuccccccuuacaaacucucuuuaaaggagaaaugauaauauucaguggcuguuuucuccaaauauaguucaacaacuccugggagucucugagaguggccuggagcgccuguaggagccucuuagagcauucaauucauuguuuuaaauuuaaaacagaucuuaaacauuacucauauuguguuauauauauuuuuagcuaauaaggugguguaucaacuccugcuuauggcauggauugcauucuuuauugggucucccuaaagacacagcuuuauuuuuuaaagcuuuuuggugaguaauuguauuuuuguagugacaagugguuuacagagaugauggccuucauuaggcugucuugaaagaaaugagagacuuugcauagaacacagauguaaagggauuauauuuaaagauacucauaugagugcacauaaaacaugcauguaggguuaggggaacauuagaagcaaauaugccacuaacauuuuguuuuucuuaaauacaugcaauguuucagggaugggaacagcaagcacuuacccuucuuuugaaaaaaaaaaaaaaaaaauugaaucccagcacuaugggaggcccagguggguggaucaccugaggucaggaguucaagaccagccuggccaacauggugaaacccugucucuacuaaaaauacaaaauuagucaggcaugauggcacacaccuguaaucccagcuacucggaaggcugagacaggaaaagugcuugagccugggaggcagaggcugcagugagccaaaaucaugccguugcacuccagccugggcaacaagaguaaaacuccaucuaaaaaaaaaaaaaaaagagaaagaaaaucuucaugccacaggcacauccugcuguauauguggucugcucugggaaucagcuuccaauaacauuuccuuacaguaugauuucugggccuuugucuagcuuuacuuguauuuuaguuuaauuccuuuaaucuauuuuaguuuaguuagaaggauuaaaauagccuccauguaccagu

SEQ ID NO: 13416 - RNA, 862 nt, Homo sapiens
uccuccaccaccuccaccauauccaccaccuugguuuccauauccugguccaccaccaccauagcccccucuacuacuauaaccaggaccacaccauaguugccaccaucaccuccaaauccauuauauccaccaucaccuccuccauaacuaccucugcugccaccaccuccaccaccauagcuccuccaccaccuccaaaguuuccuccgcgacccauaaaauugccagauccaccuccacgaccucucugugauccagcagacugcaucucuuguuuagaaagggccuuuuucacuucacaauuaugcccauuaauagugugguauuucugaacaacaauuuuaucaacuguaucaugcucaucaaaaguuacaaaagcaaauccucuuuuucccacucugccugucuuccguaacuucuaugguuucaauuuugccauacuuuucaaagaagucucucaaauuauauucuucuguaucuucuuuaauaccaccaacaaaaauuuucuucacuguuagaugggcaccaggcuuuacagaauccucucuagaaacagcugucuuugguuccacuacacgcccaucaaccuuguguggucaagcacacauugcugcauccaccucuucaacacaagaauaagucacaaaaccaaagccccuggaacguuuuguuugggggucucucauuaccacacaaucugugagugugccccauuucucaaaauguucucuuaaacuaucaucuguaguuucaaagcucagaccaccaauaaacaguuuucucaacuucucugguuccuuuggaucauggcccuccauuuugagaccagacucgccucuuccaacucgaguucaauauc

SEQ ID NO: 13417 - RNA, 561 nt, Homo sapiens
cucgaacuuccggcccuuggaguggacguaggguuugguguggcugugcgggguucccggggccuugccaaaaugcccguacaccuuucggcccuugagaggaccggagagcaggacggugcugcagcccuugcgggaguccacggccagcuggucgaaaagugaggaucuugcccccugcccugaggacgcggcugcgggccagguuggucacacucagcacacacaccuucaguuugggcaccuccugaacccgcacgucaucuguuaugcuccccacaaucacggccguuuuguuuucccggacaggaagcuucacucuucuggaucaucugggaaagggacagagguggccgguugguacgacucauaaacaaccucuucagcacaaccugguugaauguggagucgguucgucuggccagaaaacugcacagcuugaccaacagccucagguagauauccuggcucuugggcuccuugcgccgaaccuuucgguccuuguuguggcagaugucagcucccaugauggcgucuccugcucggccagguacggaaaga

SEQ ID NO: 13418 - RNA, 5454 nt, Homo sapiens
aaacugaaaaaccauuuaaacgaaaggguagcuguagcugggaauucaguaggauacuuccaacaguccuggucaaaaugaagacacugcccugugauguuugaaauucaaguaacuuuauuuaaauucaaaaacaauucuuaaaacugcauuuagagucaagacccuuuuguauuauaaaaaucacaaguauuucuaagagacaaaaauacuucuagguuaacuagaccagaucugacuuuggacuuuauucuuuaaacaaauugcagagaauagagaaaaaaauagguuauuuacagaaaacaauaucuacauauguacuuagagguacaaauuuggugacagaaaagacuucaguauaugcuggcaucuuagaagcaguucucaaagagcuuaguuuuauuuucuugaauuuuaagaaugccuaagauccuucuucauccucgaucuugggagccaaguaguauuuuaagugucccauauccgcaauuuuauacucuacaacugaaagacaggaagaugguuaauuacugaggaguauguaucacauaugacuaccuacaaaacaagguucaaauuuauuaucuuaccaagggguacaucugcagacauacugagugucaccguugaagagaguggaguggcuuuuguaaagaaguucagguaccucagugcaaaaguuaguugaacugguucauucaucucuaugguaaccuacaaaacaaaagauucaucauugaaaaacaucaagaaaguugcaaucuauuagcucauuauauauuuauaaaaacccacaaacacuuguauuggucacuuuggagggagcuaugaaaauuuugaagacugauacauaaagcaaaagacucgauuaucuagcuugucuuuccuauagcuauaauuuagauaaccaaauuauauaauaugggaaagcuuuucuuuauggaaguuuuucuaauaagcagccaauaagugaauaaaacguauuaauuucagcucugcaaacucuaauuaaugacuuaauggaucuagacaaugacuauuauagcugcuaacauugcaaacacauccagacacccugugccuccuacuagaggcacacaccaccaccuauauucuugcucucucacccccgaaacaaaacacccugaauaucaaggcuccagggcuauagcuaccagucuguaggacacacaggguagaggaauuuauguauacacaggaaugcaaucagcaaaauccaaacucuggaaaacuuaauaaaugaucuaauuucuucaacaaauagauuguaauggaagggggaaaaugaaauuaggggaaaccaggcuagguguguuggcacacaccuguagucccggcuacuugggaaacugaggcaggaggaucacuuaagcccuggaguuugaggcuguagugaaccgacugcaccaccgcacuccagccuggguggacagagcaagacccugucucaaaaacaaagaaaaacagaaaaagaaaaaaacgagguuggcaggaguggaaaugugauucaggaaacagauaaagaaucagcuccuagacuuuauuaauuuaaaaaaaaaccuuucaacugaauuuuaccuuuauuuaaacuaaauguugacuacccauucaagggacaagagagcaauauauaguauuuauuguaagcuuauaauaugccacacacagcauaugcuaagcucuuuaaugcuaccguauuuaauccuaacaagguuaugagguuaggaccuuuguccuugauuuacaaaguuuuaauuuaugcccagguuagcgaguuuuuuuuguuuguuuaagauggaaucuugcucugucacccaggcuggaggggaguggcaugaucugggcucacugcaaccuccgccuccucgguucaagucauucucccaucucagcauuccaaguagcugggauuacaggugugcgccaccacacccggcuaauuuuuauauuuuuaguagagaugggguuuugccauguucuuucuauuuugguuaaacaagggcucucuagguacucucaaaguugcauggagucugcuuucuagccuuagugagaagucuccuuccuguuuaaccuuugauuccuacagccugugacuuuggcuaaauugucacuuaagguugcucagccugcuucuccaccuuuaaaaugggcuaccaauuggacccacaacauguaagcuaauauuaggauuacauaagugcuccaaacagguagacuuuuacuccuaaccauauccuucuauugagcugcuguccuaugcucaauuauuugguaagagaguaaguaucuccagaaagcuaaagguuauacgccuaacuucccaauccuacccuuaagagccgguguggacuugauccauaaaccacuguucugugguauguacacgugcugaauuuguauucccuucuugcaaauauaauucuaaauuggaugacacuuauaaaucauucgcagauuucaacaguaucucaauuuucagaaauuacuugggauccaauucugucuacuuuuaauuuuagcaauuaaccuaauaagcaguauuauaauucucuucaaacuauuuucuuuuuacuuaaaaacuacuuacagcuuccuccucuuuaucgacauuacuugucugugacaauuuaauguuuccauuuccaaguucuccacuugcagaaaauuucacuccgucuuuugcacaggaaauuacaacagcaucuccaauauggcugagaucucggcauauacgugcaaauucaccagaaggcaucuuuacuacacagcuguacuccuguuccuauuaagaacaaaaauuuuccaaaaguuaauuguuagaaauuuaaugauuuggcacccucacuuucuuaaaaggcaacaccuaaacaacucagaaucaauauuuucugauuacuuuaaaauaugacuugcguaauuucuuaacaaacuccacucaaaaaaauaaauggcuauuaaaugcaccauccagggaacaagagccuccuccuccucauccuccagggauaaaguaagagaacauuagaguauggcacagaaaucaugauggcgcaagcaggccuaacuacuuucuaaaagaaagcaagagaauauauuaggcauuuucaacauucaaacauuucuucucuccuuugguguuuauaaaccuaaccuggauaaauuucuuccaagucagcuuuaaaauccacuuaauaaaaagcaagcauucuagaaggaaacaaauuuuaaaagagguucauggaaguuaaugcaaauagacaacuggcaguaaacaauaaauuuaaccugugaguuuuagacuuguggugaacaacuauccaaauacuaaaaucucucuuugaaacaugcaccaguagauauauuucuagaaaaaguuguuaugaaguaggcuuaaauuauauuaacauaucuugacggaggaggaucacuugaggccaggaguuccagaccagccugggcaagacugcccccacgcccacacacaaaaaugaaaaaauuagccagguguggugggacaggcccguaguccuuccuagccacuuaggagacuaaggcaagaggacugcuugagcccaggaaucccagguuagagagagcuauauggcacuacugcacuccagccugggcaacagagccaagacccugucuguaaaaauaaacaaacauucuaugacauaacuaucgugccuguguacagcacucucuacaaugagaaacugauacucacuggaauuccaaguuguucaacaucuaaauccaucaacuucauuucauagucugaaacuuucuccuggucuaccaaaagaaagcagaugcuuuugagaaauacugacacagaguuuugauuuucuguagcuucgugacucgguaaaaagguacgacuuacuuggugcuucaaauacuagcgccaagguauccgcguuaucuucggcccuuaguguaaugauaucuucauugccggcgcauuuuaguauuuuggacauacuagaagacaggagacacaugcuuuaaaaucaacgccgucugcugaagggcuguauuucgaacgcgguuagaagggguuaccacucucacccaucaggccgucucagaacugguggaggguaagcggacugcuggaggaugccauuauuaaugcagacguuuugggacgcaucuggcaguauuuauacuaaaauaccaccagcagugucccuucuggauagaaacaaucuccugccacuaaguaggaugacaggcugccacauuucucgcaagggcauuauaaagcauuuaaagucaaccgcgacugagccgggaggaucgcuugagcccagaaguuggagaccagcccgggcaacacaccgagaccgucucagaaacaagaaagccacagcuaaagcguccauucaaggccaacaggauuuagugagcaaagagcccuggaacaguguuccuggcacugcggaaaaacccuugauuuucccgccaccacccgcuuugugacuuuggcgcgaaaaagcagguucgcgcagcagccagcgcgggcuuuuccgaaccgcgcgcucagcugggccccaccccacugcguggcaggccaaugagaaggcgcggauggcccacgccagccaaugagggcuaggcucgaaagcgcucccgccaagcaccggaggugcaggcgggccggggccggcuucccggggccgcgaggcucaccuggugagguucacgcccauggccagguugcggucgcagcgguaggugucgaagcccucagaccgcagggugagcugcaccaaagagacgugggacgaguccaugcucugcagguuuacaccgcuggagcuaauaucccagcaggccucguugaugagguccuugagugccuccaacaccuucuugaggauggagcccuggaccaggcgcgccucgaacaugguggcggaguggcaacaacgccgcuacaggcaggcgggaaggaggaaagucuagcugguuucggcuucaggagccucagagcgagcgggcgaacgucgcgacgaccggcugagaccuagaaagacaacgaccacucugcuacgccugcaaccguuuaaugccgccgcguccgcaagcgcgcgcucucacccugcgccgcguugcgacgucaccacgcuguccagcccacggccuugcggggaagacuuuagggccaaucguguccaugcuccccgcgaggcccgcccccuagagcauacauuggaggaagcgggcgcagggcggggcagcgucgcgcaggucuccccgccucuuugacuccugaacccggccgcagaacaaguccgggcauauguggagaucgggucccggucccggcucgucaagccccagcuuuaugguggcuccucagccucccacuacguggguagaaaguuuccagccacgaaagugaaagugaaaugcaaaucaagc

SEQ ID NO: 13419 - RNA, 71155 nt, Homo sapiens
uggcguauuugcgccauugguggauauuccggaccgugaugguggcgcugcgcgugcgcacucgcuccgagcccugcucccgggagagggagcucucgggucggggcuagggaaggcugaccccgcucggcccgggugaaagggcggugacggcacuggguggggccgagcuccagggcuggcugcugggcugcuaagggaacugugagccgcucagagccgcgcgccucccgggcggggcggggccggccgugggaguccgcgcgugcccgcgccgagcugccugcuccggcggcuucgcugcuagcucgcggcgacgucgggccgauuuucccaggaugacagagcugaggcagaggguggcccaugagccgguugcgccacccgaggacaagguagcggcagcgucggggugggcgcggccgggacagcggcgcauccgggaggccugcgggggacgcgcgcagaggggucgucuuguucucugacccuuugucgcagccgacggcggccccgggcccggguagcgcgaagggcccucgggugcccggccuucgcggcgcgcgcgucaggggucggcgggucggggucccggcucagggucugacugaaguggcucccccggggcgcaggaaggagcuucucgggaguggcgcacggccuccugccucgcugggcuggcugcggggacuccccucucccccaacuccgugaggccuuccuggaggugaagauaugcagagccuucuuagggaggcggcuccucugagcgcaacuuaggcucuccguucccuuuuacaauguuauuauuuuggggggugggggaaucaggacaaggccauagcauuugccuccugggagauguaaaucccuucuugggcaugaaaucaucggcuuugagcaaagggguguuacccagugagccaguccgucaucagcagguguuggagggcguccucccgguugauggguuguuuccugcaccgugugggcucugguggguaggggaggagaguaggaaggaggccaucuuggcggggacaguggcgggggugacgggugggggaguggacuccuuugggugaagugaaagaucuguguaggggaguuaaggaagguagggauugguuuuauuacuguggagguugaauggcaguauaggacuuuguagcaguaguugugcuuuccgagauagcagugaucaggagcccuguguuugggaaacugaucagacagugauguguagaagggacugagggagccuggaccagacugagggagccugguucacucgggauugcccaugagugaccuguagauguuuucuuuggcccacauauugccuuaaaaaucagaaaguuucuccuaacaaucuaaauuucuugccugucuuagauaauuggaggguccaccaucacuuugucaccugcucaaugguuggcuggagcugaggaucaucgguucccaccaaucccuguugccuuacaccaggcucacggcuuccccuaaugcagccuguaacuuuuugaugacuggacgcaacggacauuagggagacacccagaaggaagaaagcacaagauuuggugacaggaugucaacagagcaguuacacuaggaggaauguuuuuggugaaagauaaugagaucauggguuuuuuuuaaacaacuuucguguuauugcaguugacaguggacuauccaaagagaacuguuccuaccgauuuuuagaacauauauuuuggccaggcacagugcugcucgccuguaauccuagcuucuagggaggcugaggcaggaggaucgcuugagcccaggaguuugagacccugucucaaaaaacaaaaacaaaaacauauuuuggagaacauuuagggcuggggcugaggauuuagcagucgcuugcagagacaagauacuuugaagucucuaauuuuucauuuggcuauccugguucagccugaaagaauucugacuuaccuuguacuacuaguuggugaguaugcagauguuuggaggcucuguagcucuguuuaagggugagaucaugcuugauguuagugggacuuuguggaccuagaaggugugaggagagagagaagaaagaaggcaugauagcuggugggccauguuuuugaaaagcuaacuauguacaauaauuagaaugucaaaaaacaaccuugggauuaugagaugcaacauaaagauucuacccuccuucccggacucguuggauccaucccccagagauaaagugcgaguugaaccgucuuacuuucacauccuguacuuuagacugggaggaccugaggagcuguccagcuagaggugcacuuauaucacuuauacagugacagaaugccuggggucaugagguccacuuguggcguguuguuuccuaaaagacagcugcuaugcacucuguuaaaagccugauguucauuaccgagaacaagacaaucaguuccucaccccauuauucagaacuucucaauugucacugaauugucauguaugggauuuuauuauuauuauuuuuuuagacggagucucucucugucgcccaggcuggagugcaguggcacgaucucagcucacugcaaccucugccucccagguucaagcuagucuccugccucagccuccugaguagcugggacuauaggcauccgccaccacgcucggcuaauuuuuuuuuuuuuuuuugagagggaguuucgcucuuuugcccaggcuggagugcaauggcaugauguuggcucaucgcaaccucuaccucccagguucaagcaauucuccugccucagccgcccgaguagcugggacugcaggcgugugcuaccaugcccggcuaauguuguauuuuuaguagaggcacggcuucucaauguuggucaggcuggccucaaacucccaaccuuaggugauccucccgccucagcuucccaaagugcugggauuauaggcaugagccacuguaccuggcguuuuuuuuuuuguauuuuuaguagagaugggguuucacuguauuggccaggcuggucuugaacuccugacuucgugaucugcccgccucggucucccaaagugcugagacuacagacgugagccaccacaccuggccauguuugggauuuuuaauaagggaacauuuuaaaaacugugaaaucuauuauuugucuuugaauguauauaguaaacuuuuguuuguugguuuguuuuuuuguuuuuuuuugagacagaguuucgcucuuguugcccaggcuggagugcaauggcacaaucucggcucacugcaaccuccaccucccguguucaagcaauucuccugccuuagcuuccccaguaccugggauuacaggugccugccaucacgacuggcuaauuuuuuuguguuuuuaguagagacgagguuucaccauguuggccagguuggucucgaacuccugaccucaggugaucuacccacuuuggccucccaaagugcugggauuacaggugugagccaccgugcccggcccauaguaaacuuuuaaaaaauccugauuuauucuguuucauaguuugggaaacaccuacuuccaugacuuuggcuuugccaauauucuuguguuagaacccaaggaaauuagaaauaauaaauuuuaaggaaaugcauuaugaaacaagaacuuuuuaauuucauaguagaagaauccagugaacaauuuucaagucagugcuuuaaaagcucuggaauaggcugggcgcgguggcucacgccuguaaucccagcacuuugggaggcugaggugggcagaucaccugaggucaggaguucgagaccagccugaccaacgggguuuuaguagaaaccccgucucuacuaaaaauacaaaauuagccgggcgugguggugcaugccuguaaucccagcuacucaggaggcugaggcaggagaaucgcuugaacuugggaggcagagguuccggugagccgagauugcgccguugcacuccauccagccugggcaacaagagccaaacaacgucuuaaaagaaaagaaaagcucuggaggcugggcgugguagcucacgccuguaaucccagcacuuugggaggacgaggcggguggaucacgagguuaggagaucgagaccauccuggcuaacauggugaaaccccaucucuacuaaaaauacaaaaaauuagccgggcgugguggugggcgccuguagucccagcuacucggaaggcugagaggcaggagaauggcgugaaccugggaggcggagcuugcagugagccgagauggcgccacugcacgccagccugggcgacagagcaagacucugucuuaaaaaaaaaaaaaaaaaaagcucuggaguaaacuugaaagauuccucaaaauguuacaguugcuuaacugcuguggcaaaacugucuuguaaauagaaaaucauuaguaucaaaauaaucuggagcauguuuauuuauaaaagucagaagguauuuuguuauauuuagcaucugagaauggaauuuucaaagccaauugcuaauaaaggaaauguucuccucugggaacugugcuuauaauuuuaaagucccaaagcacaguauaguugccaaacuaagaaacuuggaguuuaggcuuugggaaugauccucuuccuacccaaccauauuuuucugauggagcuuaggaaagcaaaggaugagauauggucugaaagauuggcaucuuaaaauuuaugauugaguuggcauuucaggagauuuuguuucggaaguuagcguauagguucugggguuuucugcuuuacuuaauugcugaagugcuauuuaaauuagagcuuuacuuauuucaaggcuuccuuucuagauagaugaaacccauauggagaggaaauagugacaucauuuagaaaggggaguuuaaaucuuaacugaagauagcguguaagagcaggggcuugggucaguuacaucuaccuugagccugggcuccgccacauaaaggcuguguaacuuugaguagaucauggaaguuguggcagccucaguuuguccaucauuaaaaugggggucauaaaauuguaugugcuuuacaggauauucauguggauuaaacguauguaugggcugacagcagagcuugucacauaauauguuagcuauguugcuacugauuaaaauagauuuuuauagaaaaaacuuuaauauucaucuuacacacuugaaaggugauuaaaucuucaaguuauauauauuuguagaaccuauucauauucauuaccuuuuaaggaaaguuuuauagaaaggacuuagccuucuaugaccuaucuucgguuuauuuucaauuuuaauuuuuuuuuuuuugagauggagucucgcugugccacccaggcuagagugcauugauguguucuuggcucacugcagccucugccuccuggguucaagugauucucccaucucagccucccgaguagcugagauuacagucacauaccuccacgcccaacuaauauuuuuauuuuuaguagagacaaaguuucaccauguuggucaggcuggucucaaacuccugaccucaggugauccacccgccuuggccuccugaagugcugggauuacaggcgugagccaccgcgcccggccucuuuuugguuuauuuucuuguggaauuuuucaguacuccgaaucacaggcuuuaacuguagaaggaccacugaacacuguuguaugcaauuaccuucuuuuauaauuaaaaaugguuuucaauagacuuugagauugaacuacucaaauaaaauauuaaagaacuauaacuacuucagguauaagagaaaugcuuaauuuuuuucaagaaaauuuuuuuauguugagaaauaauuuaggaauuaaaaaaaucaguaaaccuuaacuaugauucccaggcuuaacagggagaggaggugaaagauuauuuucucauauaaccaauuauuuuauguuucuuauuuuuguugcucaaacaguaugauuuuauuuuaaaaacucaauuacugcaugauuuuugacuauuuaaaauuaguuuuuccaaaaucuauuuuuaaaaaauguuuuguguuugcccagguuaacaugguauuucauuagaagaauuuuuaucggccgggcgcgguggcucacgccuguaaucccagcacuuugggaggcugaggcgggcggaucacgaggucaggacauugagaccauccuggcuaagacggcaaaaccccuucucuacuacaaaaaaaaaaaaaaauuagcugggugugguggcgcccguagucccagcuacucaggaggcugaggagaauggcgugauggcgugaacccgggaggcggagcuugcagugagccgagaucccaccacugcacuccagccaggaggacagagcgagacuucaucucaaaaaaaaagaauuuuuaucaucuuuaaaaaauguuaaauugcucuccuugguuguuaggacuagaagggacuuuaaagguguuuuuuauuuuuaggaacagggucucaccuuguugcccaggcuggaguguaguggcacagucauagcucacuacagcuuuaaacuccugagcucaagccauccuccuaccucagucuccugaguagcucaggacuacaggccugagccauggcacccggcuugagguaguuauuuuauagaagaggaugccacagcucagagaguuuaaguuauuagcucaagaugacuuaguugguuagauacagaaugguucguauuaugaaggucuucuauuuauuuauuuuuugagacgaaguuucgcuguuguuggcccaggcuggaguguaaugguauaaucucagcugaccgcaaccucugccuccuggguucaagcaauucuccugccucagccuccugaguaacugggauuacgggcaugccaccacgcccagcuaauuuuguauuuuuaguagagaugggguuucuccauguuggucaggcuggucucgaacuccugaccucaggugauacucccgccuuggccuaccaaagugaugggauuacaggcgugagccaccgcgccuggccuaugaaggucuucuaauucccgguuguuguuuuuuauuuuuuucucauagaauuaauuuacagacuuuaaaagcuucuuuauugauuaacauugauagauaugauacccaaauguuaccuauuuuucuuauuuggcuacaaaaucaaaaaaauacuauauaaaucuuucaaaauguuaaauguuaaaaaggucucagaguaaauguggagacucuuugcagaaaaaaauguauguguuuuauagagaaaguugauuaguuucaguuuuccugguuaucggaugacugugauuuagacauuugugagcacuuuccugggaguggccacucugguauccuugaaaggcacucccggcgcagugcuugaagaccacaaggcgccuuacccaggcagugggugagggugcuuggaagaaaugcuuuccaguuaaugacuguuagcaugagaaccauuuguucuaguaauaagcagucauucaguauucaacgcuucucuuuagaacauucacugacuguagggucugcuauggacggugucuguauuucugagaggggcugguguuaucaguguucauaaggauauuauucagaauuuuauugccuguuuugacuccacauaaucaauuuuuucccuacugauuuaaagaaauaauacaaucuuuuuuaaaucaauaauauuuaagaguuuuauuuuuauuuaucuauuuauuuuuugagauggaguuucucucuuguugcccaggcuggaguccaauggcgugaucucagcucacugcaaccucugccucccgaguucaagugauucuccugccucagccucccgaguagcugggauuacaggcgcccaccaucacacccagcuaauuuuuauauuuuuaguagagacaggguuucaccauguuggccaggcuggucucaaauuccugacuucaggugaucugccugccuuggccuucuacaaugcugggauuacaggcaugagccaccguacccagccgacugcauauuuaaauugguaagguagaaaaugagcaugagagucuaacagcugauggauaugggaacauaauacuugauaaaaucauucagaauauguuugauaaacaagaagauuguauaaaaccugcacuguccuacuaauguaaagcauuucuccucccucacuuuauucucaaccuuacaacugccagaaauuauauaaucuugaauauauuugagaaacucuuuuuaaaaugaaucuuguaacuaauuucuuuuuugaauuuauauauauaaauauauacauacuuauuuuauaauagagacagggucuuaaaauguugaccauugaacuccuggguucaagcgaucuucucgccucggccucucaaagggcugguacagcgugagccaccgugcccggccauuguaacuaauuucacagggcagauaaucauccuuuaaacuguuugaaaagauuugaguguuacuguuucugguuuucacacuuuuccaucuuuucuaggauccacguagguggaggagauuccucuccacaguuuguuaagcuacauucuauguuguuaaggucucccagcccuucuggacuggcacuagaggcuguugggggugaaaaaguacagcuguuugugugucauacugccucugguucagaaaagagacggacacugacucuucacuauuaauuuugccaaagucuccuugaaagaaugcuaauuuguuccuggcacugggcaggguuccugccuuccaagucuugucauguggugguuacuuggcugggguaauagugaggcacccccuccccacccccacguaugguccccaccgggcagcuuccuaugccagucacugauauuuguucucauguuguuugccccaacaguagggauggcauugagcccacuaaguugacugaccuuuugaagaaaguuaaacuuuaugguguuauuuugaguaggcagucuguggugcagaauuuguaggcagcaaaggguauucugugaaguuuccuuucucccgccugccucuccccagggacagccucaugccacacugugguucucaugagcacugcugucuguguggaaggaccugaccuguccuaccaaagucagacaucuuuuugauuuguugucuuuggcagaagcuccuuuguauuaaggucuccauagggccagcuuggggcuucucuguaaagacuuugcugagguuuugagaguuccugggacuugggauuuacgggcaacacucucugccccugggucucugauguggagaggaugucugccauugacaccgaaccccugagugggcaacucucagagccauaucuccacaguccaugccuggcuaguccugugguuucaguggucuacaagacauuccuaggugcaugcccuucaguccacacaaacugacuuugucucaaaucugaauucucucauucuacucuuaccacccuccuucaguuucuuucuucugcgauaaaaucccagaugacucgguuacucaggcuugaaaucuccuauuccuuuguucccgugcccagggcaggaugcagauucuaaccaggugugacuuggaauccuuaucuguuuguuguuuguugucuguuuguugcucuuggagacuucaacauuucaggacugcaguauuguaaaugccugcaguauccuaaauccgaauuccuuaccucuccuggaauccuuaucugucuuuuacucuuugagauuucccaaauuucaggauuuauugcuugccuuauuguaaacccugugaauugagcucccuccuguuaggauuugcucuaggucccuccuaauccaucuuguucuuuguaucuuucaggaguucugaaacugcccuaauaauuauugggggggugggguggagugauagaauucuggcucuuuuucauaaugcuuaaacuuuaagauccuuuguagucuucugucucucauuuccuuccaauucuuguuuuagguucaggggauacaugugcagguuugguacacgggcaaauugcacauugcugagguuugguguacaaaugauuuugucaccuagguagugagcauaguacuagauggguaguuuuucaauccucaccagccucccacucuccacccucaagcccuggugucucuuguuccccucuuuguguccauguguagcucccaguucacucugcaagugagaacauguaguguuugguuuucucuucuugcauuaauuugcuuaggauaaugaccccuagcugcauccauguugccacaaaggauaugauuuuauucuuuuuuauguagccuucucucuuaacuggccuuucucccugcuuggugccucugugucauggaucuugauucuugcucuuuccuaccucugaaauguguucuuucugucacccucccucauuucuacccuuuuuuuuuuuuugagauggagucucgcccugucgcccaggcuggagugcaguagcgugaucucggcucacugcagccuccgccucccagguucaagcaauucuccugccucagccucccuaguagcugggacaacaggugcuugcuaccacacuuggcuaauuuuuguauuuuuaguagaguuggguuucaccauguuagccaggcuggugucgaaggccugaccucaagugaucugcccgccuuggccucccaaagugcugagauuacagacaugagccaccacaccugaccuuucuaccuauuuaagucuuauuuuuucaaaaauuaucucagagcaucucuggcuagaagagacguaagcauguauuauuaaaaauuacagaaguaggucucuacaaaaauauuuuuuaaaauuugcugggcgugguggugcacgccuguagucccagcuacaugggaggcuggggcaggaggaucacuugagcccaggaguuugaggcugcaguguagcccacugcacuaccauaaccucaaacauuuaucauuucuuuuuuguuuuuuuuuugagacggagucucgcucugucgcccaggcuggaguacaguggcacgaucucggcucacuccaagcuccgacucccggguucacgacauucuccugccucagccucccgaguagcugggacuacaggcacccgccaccaugcccagcuaauuugcauauuuuuaguagagaugggguuucgcuauguuagccaggauggucuugaucuccugaccucgugaugcgcaugucucagcuucccaaagugcugggauuacaggcaugagccaccgcgccuggccacauuuaucauuucuuuaaauuuuuuuuuuuuuuuuguagaaacaggaucaugcuguguugcucaggcuggucucgaacuccuggccucaagugauccucuuuccucagccuccuaaagugcugggauuacacaugagccaccauacccagccucgaguugauuuuuguauauggagagagauaggauaggguucuaguuucacucuuuggcauauagauauccaguuuucacagcaccauuuauugaagaggcuguccuuuucccaauguguguucuugguuccuuuguggaaaaugaguugacuguaaaugcauagauuuauuucugaguucucaguucuguucuauuugucugggugucuguuuuaauuuaauuuaauuuguuaauuaauuuuauuuauuuuugagauggaguuuugcucuugucacccaggcuggagugcaauggcgccauuuuggcucacugcaaccucugcccuccagauucaagccauucuccugccucagccucccaaguaacugggauuacaggcaugcaccaccaugcccagcaaauuuuuguauuuuuaguagagacaggguuucaccacacuggccaggcuggugucgaauuccugaccucaggugauccacaugccuuagccucccaaaaugcugggauuaccugggaggcugaggcaggagaaucgcuugaaucugggagguggagguugcagugagccaagaucgcaccacugcacugcaguaugguuaaaaugaccguacuaccuaaaacaaugugcagauucacagauauuuuuuaaauccugaaaucuguaugggaucacaaaagaucccaaauagccaaagugaucccaagcaaaaagaacaaagcuggagacaucacacuaccugauuucaaaauguacugugaagcuaucgcaaccaaaacaacaugguauuggcauaaaaacagacacacaggcugggcgugguggcucaugccuguaaucccagcacuuugggaggccaagguggguggaucacuugaggccaggaguucgaaaccagccuggccaaaauggugaaaccucaucuuugcuaaaaguacaaaaauuagcccggugugggagccugcaccuguaauccuagcuacuuggguggcugaggcuagaacuuggauuugcuagaauugcauugcuagaacuugggagguggaggcuguaagugagccgagaucaugccauagcacuccagccuaggcaacagagccaagacucuguaucaaaaacaaacaaaaaaagaaaugcuacugauuuuuguauguuguuuuuguguccuacaacuuuagugaauuaguuuaucaguuccaagaguuuuuugguguuuuucaguuuuucuauaugugagaccaugccauuugcaaagaaggauagucugacuucuuccuuucuaauuuggaugcucuuuauuucuuucucuugccuaauuucccuggcuaugauuuccaauacuauguugaauaagauuggugaaaguggacauccuugucuucuagugcuuagaggaaggcuuucagcuuuugccuauucaguaugauguuagccuuggguuugucauauauggccuuuauuauguugagguagguuccuucuguacuuaauuuauugagaguuuuuauugugaaccguuguugaauuuuacaagugcuuuuucagcauccuuuuuuuuuuuuuuuuugagauggagucucacucuauugcccaggcuggagugcaguggcacgaucucagcucgcugcaaccuccaccucccggguucaagcaguucucccugccucagccucacgaguagcugggauuacaggcgccugccaccacgcccagcuaauuuuugguauuuuuuaguagagacaggguuuugccauguuggcgaggcuggucuugaacuccugacgucaggcgaucugcccaccuuggguucccaacgugcugggauuacaggcgugaaccgcugcacccggccagcaucaauugaaaugaucauaugguuuuuguccuuuauucuguugauauagcaucauuuuuauugaugugccauuuucauuuuguggcuguaucucaccuuauugaaccaagcaggcauuuaaguuguuuuaagguuuuugcuauuguaaguaaugcugcaguaugguauucuuagauaagugccuuuguuuggaacugcugacucaaagggauguacuuuguuuagguuuugauacaauuaauauauucccuucugcaguaaauuuguagccacucugaaugccugucuuugugaucucuccucccugcagaguaauacugaguauucacuuguuucuugauuuuagcagaggcauuuuagucuacugauuacaaucauaaacucaggaguuggacuccuugguuuauagccuaguucaaucauuaaguugugucuguuuucucaccugaacaauagggcugagaauacuaucaaccuuauaggguuguuccgaggcauuaucauuucuuuccuuuacaaauugugucuuagagcucaaguaguugauuagggaaaguuucucuucauagaauagaugaugaagugauauaauuaaaauacuuaaaauuuccaauccccaaugaauugauagaaugaggcaguaaucaucaaugcugcuaccaucacagaaacaaccaaauacuauguaccuccugauggagaaaucuugucauaaaaucauauuugagcuugaucaagacucuaguucuaagugcugguuuauaggaaauucaagagacugaagaucacauggaccugguugcuuuaguaaauaaguguguguguguaaauuucuuuuuccaugucugugauuuccuggcuuauaauucugaaagcccuuauuaaagucucuuguuauaacuuuggggcacuuggaaacucagaagcaggccuccaaaaauaaaaucucccucucugaccaucuccuccuccccuuucuccugcuccuuucucuccccaaggcaggaaucuucuccugccuuucuaucuuggagcuggccauaaaaaauuaucuggcuuuccuuguuugauugcuauaagacccucauuucaaaacccuauauccuggaggaaagacugcugcacagggaggcuaagaagaaucugaacagacaggccuugcuggguuuccccacuuagucuauuaguauuagauaguauccuuuuuguuuagucacauuucugcaugguuguccaugcaaugugugcaucuaaugaagucucuauaaaaggcuuuagaggacaggguucagggaacuccugaguagcugaacauguggaggcuuacaggaaggugaacacaugcuggggggguggugcaccccagcuccacugggacagaagcucuugcacuggagacuccgaagcucuugcaauggggacucuuccagaccucucccuauauaucucuucaucuggcuguauauuuguauccaauaugcaaauauuguauauuuguauccaauauacaauauuguauuggguggggggugauggggacuccagcuugaaacugguagaucagaaauucuugagccucagaucuacaacugauggaaaagaggggguggucaugugggacugagcucucaaccugugguuucugaagcuaucucuaggcaaauaguggcugaagugaauugaauuggaugguacccagcuacuguccgcugcagaauugauugcuuguugaguguguggggagacauccaaaacauuuggucacagaagucuucugugauuguuguuacagugugagaacagagggaaaaaaaacgaguuugaguuuuaccacuuucacacacuacucucucugauuucaaaaaacauggaagaguggggagugauagagauagauaugaaagguaaaacauauagauuaaaagacuuuaggugcugguucacuugugccuguaauuccagcgcucuaaaggcugaggugggaggauggcuugaggccaggaguucaagacaagccugagcaauagagugagacccuaucuccuaaauaaaauauuuaaggccgagugcgguggcucacauccauaaucccagcacuuugggaggcugaggcaggugggucaauugaggucaggaguuugagaccacccuggccagcauggugaaaccccaucucuacuaaaaauagaaaaauuagccuggcaugauggugcaugccuguaaucccagcugcucgggagguugaggcaggauaaucgcuugaacccaggagguggagguugcagugagccaagaucacgccacugcauuccgaccuggguaacagagcaagacuccaucuaaaaaaaaaaacuuaaggcauauuaaugauuucuggaucuaauuuggauccugauccaaucaaacugcaauaaagagaaagaauugaaguuauuggguaaauuugaauauuggauauuuaaaauaaaggaauuguuaauuuuuuaggugugauauuggcauggugauguauauuccuccuguauaaaaagcacuaaccauaaaagaaacuguugguaaauugagcaacauuaaaauuaagaacuuauguuuauugaaccacaguauuaagagugaaaaggaaggccacaggcaaugagaagauauuuauaacaaauguaucugaugcagggcuaauuucuagaaucuauaaauaauuacuucaaaauaaauguauauaaaaagacaacucaguagaaaaaugggcacuuuguuuuuuuauuuuuuuugagacagguucucacucuguugcccgguuggagugcaguggcucaccaaagccucaaacugcugggaucaagggauccuccugccuuugccucccuaauagcuggaaauacaggcaaacaccaccaugucuggcuaauuuuuguauuuuuuuguagaaacagagucucacuauguugaccaggcuggucuugaacuccugggcucaagcauuccuccugccucagccucccacagugcugguauuauuggugugagcuaccaugcccagccaaaaaugggcacuucagaugaucaauaaacaugaaaagaugccuaguaucauuagccaucugagaggugcaaaauuaaaacccucgauaagauacaacugcacacccacuagauuggcuaaaauuaaaaagaaugaaaacuuugacgguuggcaaguauauggagcaagaggaccuuucauagacugcuugagggaguauagauuggcacaaucauucuggaaaacugcuugacaauauuuacuaaagcuaaauauacacagacuuugugaccaagcaguuccacucuuaggugauugcccaguagaaaucuguacauguauucacugaaagucaaguuccagaacauucaaagcaguguucuuuguaguagccccaaacuucaaacaauccaaauugugaauaaugcugcuaggaacaugaguguacaaauaucuguuugagucucugcuuucaguucuuuuucuuuuucuucuucuucuucuucuuuuuuuuuuuuuuuuugagacagagucuugcucugucauccaggcuggagugcugugaauaaugcugcuaggaacaugaguguacaaauaucuguuugagucucugcuuucaguucuuuuucuuuuucuucuucuucuuuuuuuuuuuuuuugagacagagucuugcucugucauccaggcuggagugcaguggcaugaucuuggcuuacuacaaccucugccuccuggguucaagcgauuuuugugccuuagccucccgaguagcugggacuucaggacugugccaccaugcucugcuaauuuuuguauuuuuuguagagacaggguuuucccauguuggccaggcuggucuugaacugcuggccucaagugauccgcccaccuugacuucucaaacugcugggaucauaggcaugagccaccacgcccccgccugcuuucaguucuuuuggguauauacccagaagaacuggauugcuggaucauaugguaauucuguuuaauuuuuggggaacugccacacuuggguauucuuguauuuuagaaacuucuugguuuuaauuucuucuguagauauaaucuacauaaacaacuauugggauccucaguaauucaagaacuacuuuaaugaacuguauuaucaaggagaggguugaagcagccauugucagugaguguagaaagugauaacgugggugaguugggugacauacucuuuugcucucaagugacccaguuugggugauauauuauauggccccccuaguaauggaguucauauuaggcagauggucacacuugguaaugaggucgccuuaguguugguguuccuguggagcucccugaacucgcaaacuuuaaucuuccuaugauggccaaccuugguggaccaagguuuagaaugaaagaaauugcuuuggagacuacauaucucuuuugagauuugacauacuuaccaaaaugaguaaugauucugacguucuuccaguguuauuugaaauucaacaugaaacuuuuccuacauguuucuuuguuaaaaauguugaguaaauuuugagacaaaauguacauuuuuuucauauaaacauugaaaccaucauguugaggauuacaugcauucugugaaguuuguguauuaacaauccguguaugucuucccaggaaaauguuaacugcagaggguuuccaacuguguuggcuugauccgguccuuuccccucuggcuugcagaacauaacacuuccucccuaagugaggcagcaugaagccccauccaguuacuacuauugugaguggcucagaguucagcaucacaguuuaaugcccaguagucuccuucuuaggucuagugacugugcaccaaaggguuaucuguccucccuuuccccuccaacugcauuuguggaagaggaacaggauggaguagggcagaauaaccaaaauaagcuuuccuauucugacaaggaaagaauggggagacaagacacaguagugucuuggcucaccucucuccugaguggaaauuggacuaagaucucugggcgcguagauggagucuuuugcccgguagaccucauuuuagggcgaauggguagaaaggaaagacccccccccccgcccccgccaccaaauccaagaauugggagaguuccauucuagcgcucaauauucaugcuggaagcuuaaauuaacccagauggucuguuugguuuauuuaaagauaaaacuaguuuugagccuggaggaauagccacguucucugcaggugagucugggaauagagcuuguaauuugcauaguuguuucaguguacagaccuucaauuucuguuacaaucccuaguucuugcucucauccacuaucccguuugccagauauuggucuggagcuucuccaggguuucagagggcagacgcuccuucuuccuccagagccuuccugaaguacacucuuggcugcauuuucuguuuuguuucauccaucuuagcucuucagacuauuuugucauccagaaauuugcugaaaucucacauccacuggugaugccuguccccugcuguuucuaaggccauaguguccuuccuugcuguacuuacugacauucauuucauugggauauuggggcccaaagcaugggcuuuaucuccuaucuucugcaggaaguuccaaguuguguguuuugcuuuuuguguuuuuuuuuuuuuuuuuuugagacaaagucucgcucuguugcccaggcuagaguucagugguguaauuauggcuuacuacagccuugaccucccacacucagucaacccucccaucucagccuauggaggaucuggagccauaggcaugcgccaccaugcccagcuauuuuuuaaauuuuuguagagauggggucucacuauguugccuaggcuggucucaaacuccugggcucaagugauccucccaccuuggccucucaaaauguugggauuacagacaugaaccacugcgcccauccaauuuugagaaacugagcuggcauuacaacauagaagcaggcaguugcaacacuuuuguugacauuuuuuaguuuuguuuuguguaugugaugaaggauaaaaaugguuccucuugauugaugacacuugugaauucugggcuucugcucuuggcauuaagauaggcaggugcugacaaugacccugggaauugcuuguguuuaguuugaggugggugaugaagcagaggagucagggaaggaaaccgaugaaagagucaggagaguuuggggugcuaccaaagccugaauguuuuugagagggaggaagaggucagugucaagugcaaugggaggguguugaguagcguaaggagacgugguuuaucccacccuugugugcuucccacgguggcccagaugacagaugaagaugcugucaucuuagguaauaggaccuaaguuuuuuugagcaguaaaccuuuauaaaauacauuugcuauuuucuggauguugcuguuauuuaugauuuuuuuagcgucuauucuuuuaugaaauaacuaccacuuugcguuuauaaccuguuucuuuaaaccauuacaacaaaauuucaggcuuuuauaccaaaaaauaguccaugucuguuuaacugcaaaugaccaaaaacuaaauauaauaaacaagcuagaaguuuauuuuuccucacuuaaaagaagucuggaggucagaauucuagcagcuucacaguguguaggauucagguuuugacucucuugcccuucuaccuuccugaguguguggcuucuaucucuaguauaggauggcugcuagaauuccagccaucacuucauacuucaguaaggaggaaggagagagaggucugcuccuuuccuguaaggauacuuucugaaaaacgcaugauuucugcucacaugucauuggccagaacuaauuugcauguucuuaccuaacugcaagggaagcugggaaaugucccuccugaggggucaugugcuuggcuaagcauugagguuucuauuacaguggaagaaaaggagaauggauguugggagacaacuagcagucucugagaacucuuaaaggccugaagaugccuguuaaaaauggacagaucuaagaugcaauacagaggagaugcugggagauuauaaggauggagaguagaugagaccaguugugguugcugggagucuucauuaguagugguaagagcugauucaaugacagccaggcagaaagggaaggggaacuguuuuguagguuuggggauaggaaagaggggggucaaguauagucauaagcagcugccugcacaucaguaguggagcccaggagagcacaggccuugcagguccuuuggugugugguacauaaacgugugguaaauagagggauuaaucugcagaaaacucccugcaucucaguagcucucaaguauguccaggcccacuucuuucuuuuuauuuuuguaggggcucccuauguugcccaggcuggucucgaacuccuggccucaggugaucuacccuccauaaccuaccaaagugcuggaauuacaggugugagccacccugucuggccacauuuuuuuuuuucuuuuuucuuucuuuuuuuguuucuuuggugacagagucuugccauguugcccagguuggucuugaacuccuugccucagccuccugaguggcugggacuauaguggcacaccauugcacccggcagggcacacuuuucuaaaaguagaggaaaaaccagucuuucagcucugugucccucauugucugauuugugucuuuugaucucuaagagcagugauuguuuuuuuuuguuguuguugcuguuguuuuuucuuuugagacaaagucucacucugucggccaggcuggagugcaguggcaugaucuuggcucacugcaaccucuaagagcaguaauuguuaucuaacaugaucuugagcucuuacaaaauuguguggaaaugaccuguugaagagagcuaguaauggggcugcuuuaacaagaugacuuuggauucaaguuauugcagcugcacccccuuccugccauugcaacagaaauaucuccuccuuagaugcugcaaaaugacuugcuggagguggcacagguaccaguguggcugagauugaaacccagguguccuacugucuaaagggccuuuugaggaugccaugguuaggcucuuaucagcuuuaugggggcacuucucucuggggaaaugaaugggucacuaaugcaguuuaguagacagucuucaaaauaagaggucuuuggugcaacaauaugaaaggauaagguuaggaaauaggucuaggccaucuguuuuguuacauguggaaacugaggcucauggagacugguaggcuggccagaugucugauugcuucuggccaguuuuuuuccaugggcuuaacucugacggcuuaaaaaaugagucuuuagucccuucaacuguagguuuauggugucccauaaaucugcuuccagugugaggguggcauguagaugcccugcaaucccuccucauugcugaucuuuuggcacuuugaguagaaucucccccuacaaugcgguuugcaccgugguugggucaauaucuguccccucuugugauuuugggagcguaaaagccgccugagcuuuguuuucucacagggaugucagccaaacacccaguuuucucuugaacaguugcuauuucuaucuccugucuguuccacagaauucucgguacagagauuuuuuuucaguauguacgcaguggucucucuguugaaaacauaccacuaaggaguaacuguuuugaaaacuuaccaaggacuguuucuucagagguacuagucucuucuagggacuuuuuuuuucuuuuucuuuucuuuuuuuuccuggagacagggucuugcuguggucacccaagcuggagugcaguggcacgaucauggcucacuauagcccugaccuccugggcucaagcgauccuaugaaauggugccaauuuccauuuccaugaguacuauuugaguauaguauacuaguuuucuccaaaccuggcccaucaaccugaugugagaaaaauuguuucucguggccguuuuauuuuuuauaucauggauuauuagugagguugaauauuuaaauauacaugcuauuuguauuugguaaauggcuuuucuuuuuugcuaauuuuccuauuggcauguucacauuuuucuuauugacuuguaagguuuuuaaauaguugaagaaguuggacccuuuguuacaugcugcagauuuuucucaauuugucauuuuuaguguuguuccauuugaaguauuauuuuggcuaaaccuaugagucuuccuuuguuucugcuugugaugacaugcuuagaagggccuuaguccuccucuccuugcuucccccaccauauagguacuuaauuuauauguuuaguuuauuuuuagaaauggggucucacuauguugcucaggcuggucugaaacuccuggguucaagugauccuccuaccucgaccucgcaaagugcugggauuacaggugugagccaccaugcacagccuucuccuaguguuuuuuguuuuuuguuuuuuugagacagaacgucgcucuuuugccgaggcuggagugaaguggcgugaucuugacucacugcaaccuccgccccccggguucaagugauucuccugccuuagccuccugaguagcugggauuacaggugccugccaccacgccuggcuaauuuuuauauuuguaguagagaugggguuucucauguuggucaggcuguucucgaacuccugaccuuaguugauccacccacuucggccucccaaagugcuaggauuacaggugugagccacugcuccuggcccuccuaguauuuuuauaguuugcuuuugacauugaaaucuuucauccaucuggaauaucuuuuaauggggugugaaguagagaucuaaaaugugguauuuucuuaaaggaucuuaaaaaacgauccauuuuucaaagugcugccacugugauaacugaggagggcuuggggcaggguguggcuuuguguuggcuggcugcucagcagggcugaccaugcaaugaccaguugucugccuguguccauuucuagaaacaggcucacuggauuaucagaagcauuggcccuuguuuuaccgggaugagcaaacagaccugcaauucaguaacuugacauguuggaguuugaacccaggugugcugaaucucaguuccauguucuuugcguuacgauucugccuuccuagcuuccuggucuccgccagucauuuuucucccacggguuggccaaagagccccuaacacagggaagacuugcaaguuucucagggucagccagcagggccaugaggaguggggcagcccuugccuuacuuuguacccagucucggagagaaggggaggugacaggggccacuggguuccauggggccugcaggccgaaagcaagggcacccuggagcagugcaggccuguguggcacagugcccucaucccgaggcccaacucagccccagccccagccucugcuguggagcauuccugacgcucccaccccauuuccucaucucugucuccucucuaggcuucuuuggaaauugacuguccaaacccucauuaggugcugucuccucagcagauggucucuggagucagguucuuugucuucgauuucuguagcucccacgugauucaguaaaggcaugcugauucaucauaggguuccuggcagaagggcaaaacuaucaggggaacaaaguagccagagaucacaugcggagccaccuucugacuuggucaagaacuccuugcuggucagaccuggcuguuccuagcacguaugguugucaggagguugaguugguacuaaaucagcugugaagauuagcaacugccugggcagugagaaccaggccucugguuucgggaggaauuuguugugcagcaaaauaaaauauugccauguuaguguuuauuuuuaguguugaaaugccaccuuaaguugacaguguuaaugcuacauugacauaugauauacuuaguaucagucccaauauuucauuaaaaaguacuuagaauuuauaaaacugaaaaaguaaaacugaugcaaguguaccaaguuuggacacauuagagaauaucaaguaaaaaucaaauuugauacaaauuaaacgcacaacauaaauuaccauuccuguguaaguuaguagauaaaaauuaauguuuacuaagauguacuaaauuacauuuacuucauuuacuacauuuaauucaaaguuaaaacuaagauuuaaaaugcagugaucagugggcaaggugguauguaccuguagucucagcuacuugggaggcugaagugggaggauugcuuaagcccaagaguucgaguccagcuugguaagauagcaggaucccaucucuuaaaaaaaaaauaaauaaaauuuuuguagagguggggucuugcuguguugcucagguuggucucgaacuccugccucaagcaguccuucugucugcaccucccaaagugcugggauuuuaggcaugagccaccaugccuggccuagacuccaugucuuuuuuuuuuuuuuuuuuuuuuuuuuuuuuugagacggaguuucgcucuuguugcucaggcuggagugcaauggugugaucuuggcucgccacaaccucugccucccagguucaagcaauucuccugccucagccuucugaguagcugggauuacagguaugugccaccaugccccgcuaauuuuguauuuuuaauagagacaggguuucuccauguuggucaggccagucuugaacucccgaccucagaagauccgccugccucagccucccaaagugcugggauuauaggcgugagccacugcgccuggucugacuccauggcuuuuuaaaaaaaaaaaaaacaaaaaaacaaaaacaggcaaugaucuuuuaaaauacgcaucguuggugacauugauacaaguauauuuuuguucaaguuuuuuuuucuuuuuuuccuggugcugauaaacuaacuaggaguaggggagugaugagagcacugaacugcaacucauuccucuuaagcuuucaucucuaaagaaucccacccuuuuguuugauaacuuuaaggauuucuuuuuuuggccaagauugcagccuuuuaauugcuaguguccuaugguuuuuguuucaaagacagcauuuccuguuuaucuugguguacuuucguuucaucuuuaguuuggauacucuuugaacuggcauaagaauuagucuccaggcaggccagguacgguggcucacgccuguaauuccagcacuuuguggggccaaggcgaguggaucacuugagaucaggaguucgagaccagccuggccaacauggugaaacccugucucuacuaaaaauacaaaaaauuagccaggcaugguggcacacaccuguaaucccagcuacucgggaggcugaggcaggagaauugcaugaacucgggaggcggagguugcagugagccaagauugcgccauugcacuccagcccgggugacaaagugagacucugucucucacacacacgcacacacacaugaauuagucucuaggcagaaacuuugcuuuauugauugguuuucuuccuccucuugaggauuauggaggaaaagaggaagccuuuuaaaugaggacagcuugguguggguaagucucaaaauauaaguggaguaacuggaaaagcaugccauuuaguaugcauuuguaccacacgggcauuguugcuuuguguuuuagguucucaucuguaaaaggucagcaauacuauaucuccugucccuccuguuuugucccacaauaauagccggcuuuuguguaguuuaguuuacaauauuuugucuggauugucuuggggccuuuggggcuaguuuugaacuuugauccacaggaguaaauacaacuuacagugugucccaauaccaccuugcaugcacagaucacuuggaaacaaaaguuucaggaagcaguacuuacuguuugugauauauucggaaguuuucuuuucuguuugagucuaucuuauacuuuuuauguacacuuuuuauuaaaguauaacauauguauagagugcguacauaucauauuuuuacaaugacuuuucauaaaguaagcacaucucugcaaucaagauaaagcaaaauggcaccagucccagggaagcgucucuccugaugucuccuaaucacugcuccccucaggggagccacuagccugacuucuggcuccauaucuuauuuuauauuuugcuaguugugacccacugaauugauuucaagacccgguaggucucaaccuauaguuuaaacaacacaaccuuguuuuauuuucccaauaacucuuaggaauuccuuuuuauggaugaaaaagcuaaggcccaguggucagauuucucccaagaucguauagcuuguacuguuugcuuuuucccaugcauuugagcuacucuucuuccugagaugaggaaugacuugcuuuggaaagacaguugcagcccuuuuuguuuuaugucuuguuuaucacucucccuuaauguguuuacaagauugauauucauuauuaauguagcuuuagugaguuccugaucuuaccauucuuaaguacugagaauguuuuugguuuguguuuuugugacugagucagagacauuugcuuuugcuuuggagguuuguggcuuggaaacuuucaugauauuugucuuuggccucccccuaauaggaugaagcucuucagguggcaugcagguaugacaaaugaugacugugcacagcuucccaccuucauucacugugcugaccugcaguuccuuccuugccuguaggcuuuuccuauagagagauuucuuuccaccccguucccaccucaugucucccuuaggcuccagaauaccuauguggagggccugagugcuaagcuguccugucaucugcaagcuugucugauugugagauuguuguucccagccagcaccucugggaguagaagucccauagcccauaccuggaaacuuuuuccccaguugccgagccuggaggcucucuugggcugugaaguguucacuggcugugguaguucacagccgaggcuuucauucuaagagccuugaccuucuggguucaccacccuugguaguucucugccucucugggagagaggcagcuuggaaacacugucagggcaagugugucccaggcuguguuguaggccauggggauauagcagugaauaaacaaagucucuuccacucugagcauucguccaaauggaggagauagacaaaugugcagucauuucaggugguagugauguuagaagaauaaaacugguuuuucuuaauaggauguagccuuuugaagugccagugucugaaggagcauuccagugugcuguccaguuggcacaaaggacagaugucuuuuuguuuguuuguuuguuuguuuuaugagacaaggucuuagucugucacccaggugggacugcaguagugugaucuuggcucacugcagcuuccaccucccgggcucaagagauccucccaccucaaccucccgaguagcugggacuacgggugcgugccacuacacucauuuaauuuuugcauuuuuaguagagaugugguuucaccauguugcccaggcuggucucaaacuucugagcucaagcgauccgccugccuuggccucccaaagugcugggauuacaggcaugagccguugcgcucagcugauuuguuccgauucugcuuagagcauuuccuguuauucaagggaaacaaauggaaacaucuauagaccuauauguuccauagggcaagauugaaccgcuuaggacucuaaaaguuuuuacucugccuacuuagucauuaucccuggcagcaccuuugcugcugugggaaaugcaacucauuuauuaccacccuccauuuuauggugguuccuuggaggcacucccccaccccaagucauuuuaaccuuugggaagggcugaaaugcugugcuuuuagucauuaguugcauuuauguaacuguagcucuaagguugucuuucccgcacaaaugccggcaaagccaguauugcaggccuuguagauaaagguugacggauuucauucuuuuuaaaaaauuacuccuugagcuuuuaacagguucaaggcaaggagcucucaagguaaacaaagaugaauaaggcagucccuacuuuuuauaaucucaaagucuaaaauuauggaaggugcccucuuacuguaaauauaacucauaaaaaaucauaugggggcuuuagggaggauguagcugucucccuucuggcuucuguuggcauuccuuggcuguagccaugucgaucucugcucugucuucacauugcucucuccucugugucuaaucuccugccucucucguagggauauacaugauuauauuuagggcccacauggauacuccaggauaaaucccuucucucuuagcuuagucauaucuuuugccauguaagguaauacucuucuugccauguaagauaauauucacaguuuccagggauuaggaagugaauuaauuuuguuggggggaguuuucugccuacccauagacagcaaucacaggagguuuuucuuaguggcuucuagggaugugaacagggaggagaaaagacugagaguaaagggggagaugagggaagggugagauguaaucaggaacagagagcagcaguuuugcuuggcuggagcagguggugugagggauggacuaggauggauuguggaggaccucgaaugggaacaguuugucuaauucauuaggcaaaaaugaaugggggagggauguaaucagagcugugcuuuuugaagauuaauaugguaguguauggagaauaaaugagagaagggaggaauuuguggagaugccaauuaggaggccagcuuaguagugaaggguugaucugcaggcuucagcaagggugcuagcugugagaaugggaaagacccuaaaugaaagggucugcauagugugagaacugaggagguguguaggguaggggauuuggcaacagugaugcggacaguguuuuccauggggcacauuucagggagauuagggucuugaaggaaagcagaaggaugaacuagugugggugggaaagauggugguuguuuuugaacccacugaguuggagguaucuuguuggcagguugaaaguuugcacuggagcuuggaggagaggacauaacucguguuaugggagcugguccacagaagagaggcugaauggcagggucagcucacuaaggggcaguguggagauacagccugggggaguuacuggcauuuaggaagugugaggaggaagaacugagaagaugucauuggagaggauucagaugcgauuaauuguaaaugcaggcagccagucacauugacuaaaaagaaaaaaaggaauccauuggcucauguaacuuagaagacuaagguaauucuagcuucaggccugguuuaauccaggggcucaaaugucaccaagcuuuggucucccuccaucucuuggcucccccucauguuggcuucauuuuuggguuuuaaaugguaguagcuagauguagcaagauguuggccagcaggugaaagucccaugggaaaggucaugccuuccuccugguggcuccagaagcacaggaaauugcuguuacguguucuugucaucucugaccuggucacuguggucaagggagcacagugcucugaugaaucaggucuaaauuaugugccuacacuuggaguagggggugggaagaguacuccaaagcaaaauaaagggaccauuacugcacagaguggaacaaagcuagguaguaagacacuaaauguucagggcaccagggaucugggugggagggggaauggugguacgcaaagcaaggauugguuggaugcuacugagauggcugugaggaugcuggagaacaguguguggggcuugacagucagcaguuaaucuuucaggaaacgguuuucugacacaguguaggcugaagccagacucgggaaguuuggggacauaugguaggugcagacuuuguaaaauaguuuggaaguaaagagggggagaaguggauugguggcuccaggccaaauggaguugaaagaaaaaugguuuuaggacaaacaucugaagaguggaaaaaaaucugagagaaaggaucaugaugguagaggcagagaaaggaggaguugauuggcauaggagagcacuggaagaugcgggaccuggggccugggcagggaaagagaggccaugucucagucuguuugggcuacuauaaugaaacaccaugagcucaguggcuuauaaacaacagaaguuuauuucucauuguuuuggggucugggaaguccaagauuauggcgccagcagauugagugucugguaaggagcugcuuucugguucauccagggcuucucacugaguccuuaugugguggaagaaggauuucucugggaccucuuuuauaagggugcuaaucccauuaaugagggguucagccucaugaccuaaucaccuuccaguagcuccaucuucuaauaccauugagauggggguuaggauuucagcguaugaauuuuggggagacauaaauaugcagaccaccguaggccaagacuucagauugggguagguggcaggcacuuauuucacuucuuucugaaggagcuuguuacugacagauuaucauuuuagguccuuuaguucaagcuugucugacccacgacccaacacaaauucguaaacuuucuuaaaacauuaugaguuuuuuguuuuuuguuuguuugcuuguuuuagcuuaucagcuaucguuaguguuaguguauuuuauauguggcccaagacaguuauucuucuuccagugugggccagggaagccaaaagauuggcuccugcuuuaggucuuuuuuuuuuuuuuuuuuuuuaagacagaguuuugcucuugguugcccaggcuggagugcaauggcacagucucggcucacugcaacuucugccucucgagaucaagugauucucuugccucagccucuugaguagcugggauuacaggcaccugccaccacgcccagcuaauuuuuuuguauuuuuaguacagacgggguuucaccauguuguccagguugauuuugagcacgugaccucaagugaucuaccugccuuggccucccaaagugcugggauuacauguagguguaagccacugggccuggccuaggucaucauuuuuuaaacaacccuguaaaaucucaccaagauuuuucacuuguuuccagauuauaauggauucuguuugacucuggucuccagguugucaaaugacauauuuucaggauauaagacuauaaguagacuuuucuauuaacaguaaagcuugugaaucuugguuugauauguacaaacagagccaccacuauguaccccaguuucugguuggagugacagaaugagaacacagccaauuucugagcagcuagcgguuuggggacacaguaggaauuuaauacugggugaucguuguaucuuacaaggugcauccucaaguaguaauaacucauuugucagagauauauggugguguuuugcagugauuugcaaacuguguucucugcugauacguuagggguucuccaaacaaaauuuaaaucugacagugaagaugaauugagacuccuucacgcuguuaucucagcacaggugagggugaggcacuugauguuaggaaaaccuugcuuuaacccaugugucuuugcgauggaacagaaggauaagcgagccgcuuugaaaaucagauugaauuuuuuuuuuguaguaaaguuuuaucaaacauuuaagaccuuuacaaacuugacuaaauuuuguuauucauuucaaauuaauaucagaaaucuaauguguuacauuuucuuuuuuuuaauauauauuuuaaauuauacuuuaaguucuaggguacaugugcacaacgugcagguuuguuacauauguauacaugugccauguuggugugcugcacccauuaacucgucauuuacauuagguauuucuccuaaugcuuucccucccccuccccccaccccacaacaggccccagugugugacauaaauuuuaugucagauaauguagaacagagaagcaucaaaaaaugacucaauggucuugauaaauucauuugaagaugaaauuauguuaaaauuuuauaguucaguaauuuaaaaguauauuauaguuuuuuucuuuuuguuuuggaugauuugcauguaaacaaguguaaggaaucuuuguaaagcaucagaagaaaauuuuagguguuuugauguucauuaacagacuauuagcaagaugucaaaggaauaauaaugccugugcagaugguaacugcuuuguucuguuccucuuuucccccaaaacagauuuguaaaaauuguauuuguuacauuauucacaaaccuuuucuacaaaauauauaccaaacuggguucuuuugaaagauuuuucuaguaauuuuuaggucauuuccauauauauuaugugcaguuuaaaaagcaaaccaacccuaguuuguuaaauaauuacccuguuuuuacuuaaaaaaaaugggguugugcaccuguguaaaguuuguacaucuuagcaguauaaauuacugacacauuuuuaaaaaugaaguaaaaacucagaauccuugugauucagugcccuuauguuuuuaaaaaagaggaaaaaauaaugcaagauucagaauauuggagugguugauaugccuucuucauuuuaguuuuugacuggcugcucauaugccgaugaugaugaagcugagcuguuugugccacugccauuugaugcugcgagaaucacaacuguuucaucuguugcugcugcuauuaaaaggcagaguaguaacuggccacugaauuaaauuuaaaagaaaggcaggggagagccggcaucucugcugaggauggcuuugcuuaggucuuuucuuagcccugcaacuacuuaacacuucauaugcuugcugaagggguaggucugcccuugacugguugaaccuuguucagaauccuguucaccuggcuguugaggacuagaaguuguagguugcugaggugguguuggggguucuagcccccuccucacaguaguaggggaaccagaguuuuggggagccuuagcaguuuucuuccugguugcagguugggguggauacagcuguuagacugucugcauuguccaguauaguagccacuagccacauguggccaauuaaaccuuuucuuacuguggcuaaauauuauauauaucauaaaauugauaauuuuaaccauuuucaaguguaugguucuauggcauugaguacguuaacauuguuuugcaacugucaccagaacaaacauuccagaauauuuucaucuuccccaaaugaaacucuguacccauuaaacaacucuccccucucacucccccagccccugacaaccaccauucuauuuucugucucuacgaauuugacuacucuagguaccucauguaaguggaaucauauauuuguccuuuuguguguggcuuauuucacuuagcacaauguccucaagguucauccaugugguagcaugugugagaauuuccuuccuuuuuaaggcugaauaauaugccacuguauauguauacuacauuuuguucauuccuuuguugauagauacuuggauugcuucuacuuuuuuguuuauugugaauaaggcugcuaugaacauggguguacaaauaucucuuugagucccugcccucaguucuuuuggguauauacccagaaguggaauugcugagucaugugguaauucuauauuugauuuuuugaggaacugccaggcuguuuacuauagcagcugcauuauuuuacauucugaccaacagugcacaaggguuucaguuuuuucacaucuucuccaguacuuguuauuuugguuuuucuuuuuucuuuuuugaaaauagccacucuaguggaugugaaguguguggcaguuuaaauuuaauuaaaaauaaauacauaaauucacuuccuuagucucgcuagccacauuuuaauuguucaauaagccacacacagcuguggcucucauauuggacaguauagagagaacauuuccauuauugcagaaaguucuauacugacaaaaccuggagguagcaguggaccugaaagggauugauccaagcccagcagagucccaaggauucaaucaauugauaacugacacauacauugagaggcaauccauugauaacugacacauacuuuguguaaguaguauaauccaguauagacauaguuuuauauucugccuuuuucauguugcugcacgguguuuauaguagucuuguuaauagcugcacagaaaguugauuuaccguaauuuaccuaauaauuuuuccuuguuagggacauaaaaccaguuucuccuuuucaguacugcaguagaguaugcucauuucccaguugucuccaggccuagcccuucugguuucuucaucuguucauuuuaucgucuugcucuuuuuugucuccuuacuguuuuaaccacucuauuggacguacuuggccucuaaguaaaguuugacuaacgcuaacuagaaccagaccaugccuguguuaauauagccuaaaaugccauuagcuauuuuugcuguuugaacugcuuguaccaucuugggucaagugccuacuccaaaacagucaaggugcacauugccuuaggcugggguaaaugccuguucgugaaccuaucacuguggcagaggggcagaauuaaaaauaaguagacuguacaagcugcuguauaccaugaaauaguuuauggauuuuuaggagggaaccaacugcaguguccaguaccugggggaagauagggagauaagaauuaagggucgaacaucccaaaaucaaaaauuugaaauuuucaaaaucugaaacuuuuugagugccaaugugaugcucaaaggaaaugcucauuggagcauuuugaauuuaggauuuucugauuagggaugcucagccaguaaguauaaugcaaauauuccaaauucugaaaagaacucugaaaugcaaaacacuuccggucucaagcauuuugguuaagggguauucaaucgcuaccucucagguuucuggcuuaugcaggguauauagacucgcaugcugucaacugauugacuaggcaagacuucaggaucaguaguuuuacggacaaugucaaaaguguucuguuuagauguguuacuuuugagaugccuguaagaacuuucucguggagaugucaguaagugguuggaaauaugaaucugaagcuugggggagaaguugggguuggagauacaaauguuggggucauuggcauggaauugguaauuaaagccaaggggcuggaugaugauaccuagggagagagugugguagguccagaacugagcccagggcccauucaacauuuugaagucagguagacuucaaagucacaggagacugagaaagagcagccagucagguagagugagaaccugauaaguaugguauggagguagcugagaggagaauguuucaaggaggaaauggucaacuagaucugacauugccaagauauaugauaagaugaaggcaggggaaucugucugauuuggcagcauggagguuguuuuauuuacuuauguuugaagaugcacuuuagucuccagagccuagggagaucauacugaggccacauugacuuuucuuugcugggguaauggauauuugaaaguaauuugauggccagguacuguggcucaugcuuauucucccagcacuuugggaggccaaagcgugaggaucacuugaggccagaaguucgagaccagccugggcaauguagagaggcucuuuccuuuuaauuacugguuuucaaaaaaagauuugguguuucagcacccuucagagguggccaaaguaguuuuuuuuguuucguuuuuauuuuuauuuauuuuuuugagacagaguuuugcucuuguugcccaggcugaagugcaauggcuccaucucagcucaccauaaccuccaccucccggauucaaucgauucuccugccucagccuccugaguaucugggaguacaggcaugggccaccacucccugcuaauuuuguguuuuuaguagagacaggguuucucccuguuggucaggcuggucucgaacucccaaccucaggugauccacccgccucggccucccaaagugcuaggauuauaggcgugagccacugcgccuggccaguaguuucuuacaguuaucauuaugaacucauaaauuuucauauacuuguguuuaaaucacuuuuuguuuauuauuuuaaugcucaaauuguccuaucguuggccauuaggaauguuucuucaaagacuuucucauuuucaauuuaauuuuuuccccagguauccuuagugauuuaucaaaaagagaaagaaacuauuuagcauuguggcuuucauaauuucuuucuuucuuuuuuuuuuuuuuuuugaagcagagucuagcucugucgcccaggcuggaaagcaguggugcaaacucggcucacugcagccucuaccucccagguucaagcaguucucuugccucagccucccaaguagcugggauuacaggugcccaccaccacgccuggauaauuuuuguguuuuuaguagagacggaguuucaccaugucggccaggcuggucuugaacuccugaccucaggugauugcccaccuuggccuccugaagugcugggauuagaggcacgagccaccgcacccaccccauaauuucuucuauaacuaauaugacacauuugggauugagaacacuguuaauuccauguucuucaagggagaaacauacuaguuucucccuugaauaguuacagucuauuugauugguacuugauuccaugaugguugguuauaaaccaggaauacuacaaaagugacaauauaauguuccaauaugguaaacagccccagggugcuugucugcccacaggaguaggggagguuggggcaugagacacuggggacauuugcucucaugucuacuuauuuugucuaggaaucuuuguagaaaacacuauugugaggugagugacagugaagcagguaccagauggcgauuuaugauuuaggggcucgucgcauguggagcccagcagcuguccugguucuacuuccugacagaggucuggggagcacacuugagcccaguuuugagauugcgaauauauuuuucuucuccaucuuacuagaucuuuuggcaguauuagacauacucccuccuugggagagcuuuaucuuaauaaacugaaaaaaaaaaaaaauuccuuccuuccccaguagcgcugaaaacucauuuucccuuaaauacuaaauagagaugcccgacuaaggaacugauaauagaaggacccguuggacuccaguggggcuucugauuuuuggugucuuuccccuaacccuggaagacaauaggaaaacaagugaugucaucggaacagagccguuggcagagccuccuggggaccugagugguuuucuugucucugauagucucuguucugaauuaaguaauggcuugugauggagguugguacuuccugcagcuauuucauauuuauagucauaugcuugcuguuaguaaacagaugcaucuacuccagaaggaggcuucaaugggcaaggugggagagaguguugggagaaaggauuccuggucauuccuugucacaaaaauuauggguuuaauguaugagacuggcagucaugcagagguugggacucaguacaacuguacguauuugaguuagaaagccuugcauuccuagaagcuggauuucagacaggauuuccucauccuuucugagacauacagauucuguacuuuuuuuggaaacccccguauugcuuaggauacauuuggccacaaaugucuaagaagaaggggagauaaacagugggacagcuggcugcagcccuaaaaugccuccucuagugcuacugagugcaaaaaugaauugucagccuacgcgacauguagcccagcuacaccugccacuucagcaaacccuggauucucucagcaucauuggcucuggcugccucugcagaugugguucuaggugccaggccaggugcuggggguacaguggugaggaagucaacauggcucccccacagagaugauggucucgaggcggagacuaugcggugugggaagccgucuuuuuuuguuuuuuuguuuuuuugagacagggucuugcucugucaucuaggcuggaaugcaguggcaugaucaggucucacugcagccucaaucuccuaggcuuaggcgauccucccacuuuggccucccaaaguuuugggauuacaggcaugaaccacgguggggagcacuccuaaggaaggacaggggccgcugggacacacaggcaguuggggaagauuuggagagaaagggaacucuuaaaagaucaaggaaaauuugcuggaagagaaguggguuuuaguagagggugguuugcagacuguuuaaguaggaacacaggagcaaaaguccuaaagguaagaaaguacaaccuguucuagaaacugacucuaguucagaauggcuguaagagauaaggcuggaugaguagauaagacccugaucucaaggggcuuguaugccauuuugaagaccugucaucuagguacuggggagcuguggaagggguucaggauggagagugacacaaucagaauuucugggaagguccucguguugcaguggcgagagcguaggugggaguggacucuaggcugaaggugagguagccaguuaggcuguugcaguuacucaggagggaugauguuggcuugaauuaagggaaugacagguggcauaaggaguggaugcaacugaaagcuguuuuggagguagcaugaacaagcuuggugacagaucuacaagcugagaaaggagccacuaagggugauggccaccuuguucucuugaaaauucggggaaaggguaccauuugcuaagauaagucacauaguagaaggaagagguuugugggaagagaugaugagcuugguuuuggacacauggugaguuuuaggugucuguggagacaucuaguaguuauuuggauuuagggucuguagcucaagaagagacagcagggagcaugagaaugaauggggaaacucagggagagugggaggcagcagaagaauaagagagcuuaggaccaaccccaaggaacccucaaaugcggggacaggcugaugaagaggcaguuccuaaggagaaggucagcuaaagaugccuggccagagaggcaggcaucaacccagggggaggugcugcuuggaagccagaggaagaguguuuuucaauaguagcauuaaaagcugcugagggauugaacgaggugaggacugagucccugcuggguuucgugacaaaguccuuguugaccugggagagcugcuucaguggaacaggugggguugaaguuggguuguugugguuugaggaaugaugcacagccagggaggggacaugaaaugucgacagcucuucccagagguuuacccaugaaguggggaagaaagugcauugguuggaugagcugucagaaguuguuuguugagccugccuagaugguuguaaguagggcuguggugagggagagagaugagaagauggagagggcaauggagugagucucuaaggaggugggaggagaaggcauggcaagcacauggcugacuccgaguguggcuguccuggggacaguuguccuuugccaucaguguuguguccucuaccaaguccccugugguccuuuguaaauagcuuuaucuggagacagaauggcucacagccaguuagguuuuaagaagcugaaucugccacauucauguauuuucuuguccuuucucugagugcaguuaaccuguuagagaugccggaagugaagcuguccaucuggguagcugaauacauuuucuuugaaucccauuauugcugugaggcuuuugaaggacaggguauggccauacuggggaugacugugaacucauucagagugggguccuccuucuguuugguguuuuguucugacaauugaacuugucaaauggaguuaguauuagggcuaaaaguauuucuuuguuauucccaacaauauacacacacaaauggaugcugucacacacuggccagauauauguauauauauguauauauguauauuuuuuuucaguaggaacucagaugaaagccuacuuggcuuuuucauugagagggccaccuaagucccugacacuuauuaaggaugcuuauuaaggauaaacccaucucugguaauuucucuccuaggauccugugugaguggggaguugcccucccuggcagcuggucacagggcuugaucuagaagauggaggccaugguauucagcagaaaaguuaggcuuagacuaaugacuuuccuccaggagaaaguugauaauuugcauauaaagcagugcaaaaaauuguguagguuaugaaguuagucagugaaacuugugaauuugaaugcagugucagugggaaaggcagaguuguuggaggcauaacccaccagugccuugaagucugccuuuuaaugaaauuuccuugaagaagaaagaaaaagagaagaaaagcugaaugaugguacugcuuauuuucuuucccuaguuuuuaguuccucuuaggcaaauaugaacagaauauuaauauguuuucuuuaguguaguccagagcugagucauuaucugguaaagaaauagaguauggagcuggguacgguagcucacgccuguauucccagcacuuugggaggccgaggcagguggaucaccugaggucaggaguucaagaccagccuggccaauguggcaaaaccccaucucuacuaaaaauauaaaaauuaucugggcguguuggcgggcacuuguaauccuagcuacuugggaggcugaggcaggagaaucgcuugaacccgggagguggaggcugcagugagccaagauugugccacugcacuccagccuggaugacagagcaagacucuguccccccaaaaaaaaaaaaaaaagaaaagaaaaaaaaaaaagaaaugggguauaggguaggauagguuccaccgguguggagccugacacagugcccaagggauucucucuagccaugggcacagccacacuuuuuugggucaaacacugaccaucacuacuuugggugucagagucuugagaaauauccagguaggagggugggccccuggcaccaagugaagaccgaaagggagccucagaaggaugcuguccaggaagccucccaccaggcuggcaggaaacccaaacagcaggguuuucuucccagagaguugauagugaaaaugaguuccacaaaugcuguucuggacugagcuaggucccuccccaggaaaagccagaccuuaaccacaaggaacauccccuccugcccacugcucccucuggcccucccucacugccuucucuugcuucuguuauguucugaucuuugggucagugcuggguguggggaagcuucugggcaguugguggagaagcuuucugagcaugaguuucuccaaaaaugcuaauggcucuuaacugagccccugguacacaggacacuccauguguccuucauccuaagugcuucugccuuucucuagagggucuguguaaaccaaaagggguggacccucagaggagcuucccccuuccuuuaaagcagcacucuuguuuccuguuuauaccagcacuacaacccccuugggaaauggcugaggaacugugggaggcggugguugagagagaaccugagagggucugccccaccuggccucuguucccggcccucgggauugaaagggaaggaaggaggaggggugccugggagcuggguggauaugagucagaagaggcagggcagccucucccugcugugcuggucucaguacccaccaggagugaggcaggaguggaugcuggucugguccugcugccagggcugcugcaggggcaccagucaggcacaugagcaggaaaguggguacuaucauaucucaguguagucuggacacuuugguccaucauaggucaaguagaauuaauuagcucauuaguucaacaaaucuuggggcaccugcuauguuccaggcacugcucagugcaguggugaacagguaacuccuggccucugacacacugccgugucugacauguauaugguguuuuuaccauguucccaguuuacacucaugaacauaugcauaugucuugauaaugcccauuacaaagcauacaugggaaagaaaagaagaaugagguaaguagagaugaguucuaagauuuccucccacacuuuggcagaugguucagcuucagagucuacuagcauggacuguugcuuuaauggguagcuuuuguguuucagacaccaccuuacacaguuuugagucggggcuaccagugugaaagagcuugaagcaagguaggcaaaugcugugcccagaucauuuauuagcacuuggccccagcaaggccugaugcucuccuugggaagggugcccagcuugucugggguggguguuuuagggucucgugcuucuguccugugugcuguggucaggcuacucaggggagugcggcaggcaccugcugcuauucaguacuuuauaguuuucauagccuuucaucggggucgcauuggucaucccaacaaccuuccgagacagggauuccuucgccgcugaagaccagaggauggaggccugugcugugugucaugagugucagagcuggcccugggccuugcuuuccuggacuggccacugccuuauucugcagaaaguuuuucuugacaucuccccaccucgcugugcccagaggagcaaacugaugaauguguucagcauguaccaccuuucuugugggaaggagcauggguuccaggucccugccugcuuccagacccucuguggaagcugccgcuggcacucagcuuccuuuuccgggguaugagcaacugugucuccaagcagaaugccuuuguccacgggguggggaggagcuggaagacugcaggccuccagguucuuucucucagguuucuguucccuuuggcguccacaggacaucaggagccagguggcuggcugaccugucccccuccuccucugugucuuccccaggcugugcaguuuccccgcucacagggauuugccguuggcaccuguucggcccugucucagcaugugggagagaguggucuguagguugguguugguuuccugcucagaggaugcuuccucaguaggcccggcugaggcccagggaaccuggaguuacucacuuaaagguagcaaaaaccuagaaaguuaaucucuuucaggcuuguuuguucagugguuuuuugaaaagaucaacaaaauugauagacugcuagcaaggcuaauaaagaagaaaagagagaagaaucaaauagacgcaguaaaaaaugacaaaggggauaucaccaccgaucccacagaaauacaaacuaccaucagagaguacuauaaacaccucuacgcaaauaaacuagaaaaucuagaagaaauggauaaauuccucgacacauacuucauuucuuaguuguucagcucaguccgccugaggucuugguaacaauaguugcgauaucuuuguaacaguucucuaucuccuuuuacuacucucugccucuggauaccccucuucacuucaccccuuccuacaaggaaggagucaggucugacaguguugcaggaugcagugcugggcuaacggaagguccagagaggcucuuagcacggagcuggagcugccugcuccucccucgcaggacgcugccuggguuccguuccuguccuucccugccuggggaacuagcagccuuugugagucuccuugacaacaggauggauaaguuaaaaauaaccuugugccgggcuuucugugugugagugcccucuccccugcugcucuggagcgcagucccugcagcuucuagaggcuccugaaugcaucugugggagccucagugggguccaggugcuagcauuuugaagccccgagguuuuagaggucaaagccaggugaucaggcagcaucauuaccuuguaacucgcaaugauuaccguaauauuacuggcaacuggugguugccgauggugugugggugucaauguugaaauaaagauuggacagcuguugugaaugcuuugucuucauuuagucucccuggagagggacgacucuggagaccuuacuguguuucagaaacucuggagugguguacugggacacagcccugggugagaguuugguuaugucgcuucaaggaauccccaugggaaggaggguccuuaccuuauauaaggugaagacgccaaaguacagaggcacuugggugacuuauccagagccaccugucucgacuguggcagaguagggagcagucugugucuucagaagcuguggcucucucccuuggauccuaaugaugaggccgucuuuauugggccuuuaccaaagccagcugucucuuuuuuaucagcagucugcacuaggcgaggcccucuguguugcuaaucuguuuuguuuuucuguuuugcucaucugcacuaguuaaggcccucugucuugucacaguuguaaauuaauuuagaaagagcugucucccugagggcaggggcuggguuuuucuuuacacaccuggaccuaauucuucucuucuuccauccauuaguaaguguuuugcugugugccgugcauggggauaaugagaacaagaaguuauguucuugucuuuaaggaguuugucgucagccaaggagacauuuacaaaaguccccguuguggucagcgcugagagggagaagguucuaguguuaagagagcaaaucacuggggugucuaaccucgccugaggugaagguggggguuagagcagucugagagaacauauuaguaacacaaaguacucaaaucuggagcacauaaaccacuacaaaucaauaaaaaaaggaaggcagaaaacuccguagaaaaacuagccagugauuugacagacacuugacagaagauaccaaguggccagugaacaugugagacagucacaauuccguguauucaucagucaucagggaagucagaggaccuggguuaauaugagacauugggccacgcauugaacuucccagaucccguuucuuauuuguaaauggggcuucuccugucccuucccuuccucccaguacugcucugaagcuugcaugggaaaggcucuucagaccuugcagggcuauacagauacuaaguaguguuguuacucuaagugauuuacuuucuccuccaccucuucucauagcaacuauucugaauuccccuaugaaagaaaauacuugagugguaggaugguuccuaggauucagaauagccugucccuugauacuuuggguaaagagcuugcugcuggcauggcucugguucccucacccaggcugggagcagggugacuuccugugggucuuuugucacccagggccugguggcagggaaaggacugaggugcaccaguccuggcucgagcguugucuggaguaggcugucugguucguuguccacacugacugugauugaccuccucacagagugcucuagugaaguccggaaauaacacucuggacuugggacauguugacauuaacaggucuacaggggcaacagccucaccaccuggcuuccccugagagagccuggucagugccauuggcugcccuagcaggcucagggauaaccuccuguuaaaaccggucccagccucccuuuugcauucuuuggauacaaaggagccauguucucucucuuuuggaucugcccucugcgguuaagcagaugguacgcggugcagaugcacaccucucuuccagcagaguguggcuggccaccuuggcacaugucacaacagugucaggauugcugcuaguccugucagucccaucaccugacugugccagguucuuaggcccuguuuggagucuuuccccacagaucucucaugacaggcauagacuucucaauggucuacucggcacuuuugaccuuuuucucuucuguauuucugccacuuaggagucagagucagaagcaaagguagauggagagacugcaucggacagugagagccgggcagaauccgcaccccugccagucucugcagaugauaccccggagguccucaauagggcccuuuccaacuugucuucaagguaaccuggcuuaaugaugcaggugcuuguugggggcuuugcaccauguccaagugcccuggaagagccugcagagagcccguggucuugcagagcaggcccgcugucuugccucagccucccaugccacugcuccaggcuccauugaguguaaucuagugcuuagcaguggcagugagcacagugaccaggaggggagggcaaccaaggcuggaaggaucuggccccggaagggugcuucagacuggacuaggaagugcaguucaaagaggaagaggggacaggagggauggaggugggugaggucagcugacacugcacagcacaggaaaccagccuuggguuugcgauuaaugggcaggcugcuuuucacugaggaguccacguuuccaguucagaguuuaguuucucucacauccuuugugaacaguuccuuaaauucuccaggaagaacugggaaacaucuuaaccuaggugaaucuaguguuaaaacuuuuggcccuugagaaccugguucuuuuaacacagcuaugugaguagaucaaaaacacauuauaagaccccaaagcauuaucucaguguuccuaugugugccuccaacuguccccuugggagucugaauugugcagugguuaagggcguggacuuugcagccagacccuuggauucagaucccagcuuuacuguuugccagcuguuugaccugugccuccauuuccucaucuguaaaagcgaaguguguugaggauugaaggaguuaauauauguaaaguccucauaaaauuaccuuacucaggccggguaugguggcucacgccuguaauuccagcacuuugggaggccgaggcggguggaucaggaggucaggagaucgagaccauggugaaaccccgucucuacuaaaaauacaaaaaaauuagcugggugugguggcaggcgccuguagucccagcuacucgggaggcugaggcaagagaauggcaugaaccugggcggagcuugcagugagcugagauugugccacugcacuccaaccugggcuacagaggaaacucugucucaaaaaaaaaaaaaaaauuaugcauauuuaugguagcuguuauuaucauugcauaauguuacuauuauucccauaauuauucagggcagugcaguguaggauccugcugcuggaaaaaaauauuuuuuucuucagauagucagcuguagaaaccauccaaguggauacagaagcagagggcacuacauuucccuugguuuuuuuguuuguuuguguuuugccugauaccuucuuuaagauauaagcuagguuuauuuuuugccaaguuugguugugacuuaggcauugguacuagugguccugcuccugccagcauguggcuggugccuccgucacggugaaucuggaaaggacugagcucagggcccucaucucaggaagauccauaucccuugaguuugugcauugguuuuuuucugggcuccuaacugguguuuucuccuuccccugcucucugaccuagauggaagaacuggugggugagaggcauccugacuuuggccaugauugcauuuuucuucaucaucauuuaccugggaccaaugguuuugaugauaaucguaagugccauuucacacuauuuuaguuuucccuucaguuuuugcugcaggcccgguugucuuaagugcgagguguuggguugguugugggaauugacggggguccaggcuucucagaaaaccucugccauagaacaucugugacuucccacuucucaguagccaccuggagggucauugguguaggcugguuguuuaugguugaagaugucucagugucuuuucuuuuaaaaaacugacuuuauugccugugaucccagcacuuugugaggcugaggugggcggaucacgaggucaggaguuugagaccagccugaccaacauggugaaacccugucucuacuaaaaauacaaaaauuagccacgcgugguggcacgcgccuguaaucccagcuacucagggggcugaggcaggagaaucccuugaaccugggaggcagagguugcagugagccgagaucaugccacugcacuccagccugggugacagagugagacuccaucucaaaacaaacaaacaaacaaacaaaacugacuuuauuauuccaacucuguaaacuuuuacccugggcaugucucuauaugacuccugguuucguuuccuguuuuccuggggccucccuucugggcuuagagcuuuuguuaaggaaaucccaguccacagagcugcucugucugucuucccacuguccuggacagggucaggugaccaucagcugcaugugagcaaagcauuugacuuugaauacuugagacuuuucaaguauucagagucaaaaggagaauggauugguugaauccugggagguucuagaauaaaaaguuaaaaaggagguuuuagaauaaaguuaauugagggucaggcauggcggcucacgccuauaaucccagcacuuugagaggccaaggcgggaggaucacuugagcccaggaguucgagaccagccugggaaagaaggugaaaccucgucucuacuuaaaaaaaaaauccuuuuggcugggugcgguggcucacgccuguaauccuagcacuuuuggaggcugaggcagguggauugcuugagcccaggaguucaagaccagccugggcaacacggugaaacccugucuuaaaaaaaaaaaaguuaauugaaacaucaggguguguauuuuauugugaguggaaaauuggaucuacucccugugacauagagggcugcauugcucugugggaugguaugagagaggaagaaggagggaagcagaaccacuggaggcccgauauuuuucuuaaguauaauggguuuucuggaaggcucaugaccuguugguuuccauuuccaaaaaucauaagaauuggggugucagugaauguuuugugucccgcaggugaugugcguucagauuaaguguuuccaugagauaaucacuauuggcuacaacgucuaccacucauaugaucugcccugguucaggacgcucagcugguaagcucuccggccccacagaggcuuuuagaauuuggaugaugugcuuuguggcagguacuuacagugacgguggguauuucuaucacuugcuauagagauaaaugcuggagaggcaguuaucauguuaggucauacaaaguuucaugaagaaaaugguauuugagcaauaagugaagaaauggguaagagaauguuaggagaauguuaagagaaaguuaagagaaaaaggcaggagaaaagaggugauugccacagacucgcacagugccuuugagaccugaguauuucauaggccagacugugugguuggccuugcaggagucuuauaguuacuugaagucuggaaucuuccugagaagaaaccagaugggcugcauucugugacuguguuugccucgcuauuuggauuccuuaaacucugcaugaugaucccguuuuucuagaucaguauauuuuucaugccgucauaucucagcaucccacuagaguugucuggaaguuguuagguucugcugccggcuuugcuuguuauccuuggaacuugguuuccuuaucucuaagacagaugguugagacuuacugguuuccagacugugguguuugagcccuacuucaucagagguguuuugagugccagagugggcaggagugaggcugaaugcaugggaucugggcuccgcugggaaaguuggcuuucuccguuuccugggaaaggauucagcuuucuuaaagcaaaaagaaaaaccuguaacacaugucugagaccccuuucugaucugaaacucugcuuuauuggccguaguauucucagguggugacuuuugagcagagcacugcaccaugcugagaggaccuggggcaaauguggaccuucucaccccacugugcagggauacagggguugaagccaugacuuagccggcuggagagcagugguuuuugccccagcaaccuggucacugucaaggaagccgaugugcucagauguaggcugggcacccccuuccugagguguuuccugucacccaacagacaggcugccucccagccuccagauggaauugggauugccaccuggcuuaagaugcaggucccuuuuguggcuguucuuuagcuggaaagcaguguuuugcauuuuguuaacauacucaggaggccugacuccuggcuguggucacuuuacaaagaaaguuuuuuccauguaacagaaaagaaacccaauaugggaguuuuuguacuucauaauuuaaaaaaaagaaugggaaagaaaagcucuccacuuucuucucuaucucaggauccuugcuggggguuugcagugauggcugcauggugccauacucagcaguacuguggaggcugcaagggauggcuucucuucucaugaacgccaguugaggagagagaauacacaagugaagaguuaacgcuaauggaaggucuguuugucagagccaggcuucagagaggcagaugcaucauuaauugcuuagucagauaaucacauauuacuugcuauagaaauaaaugcaggggaggcagaugucauguuaggucaugcaaaguuuuaugaauaaaauggcauuugagcaaggagugaagaaauggagaagcaaagagaaugucaggagcaggaaaaaggcaggagaacagcagacagguguggcaaagccggaagaaaccauuuugauaggagugaaggaguuccuguugggaagaguggaaacgagacuggggaagcaggaugaggcguguuuuugaaggucauaugguucaaggaucccucaguuagguaugggaaugcuacaaaaggggcaaaaacggagucucaaguuugggagaaauggagagugaaugaaagcugcugucuguuucuagauaaauuucucaccuacggugucaccagagagcaggaaaccauggucugccuguugcucugugagcugucccgggggacucaagggugggggguauucugcugcccucugucccuuccucugggaugucugacugccuugcugugaaggcaagggugcuccccacggcaaugaccugucuucauuuacagguacuuucuccuguguguaaacuauuucuucuauggugagacagugacggauuacuucuucacccugguccagagagaagagccuuugcggauucucaguaaauaccaccgguucauuuccuuuacucucuaucuaauagguaugcauuaagcaguucaccauuucuugugucuguauuguuuuuguaugucugucagguaggaauuggggaauuucuugguuaguauacaguuuugugacauuaacugugaccaugcaggggagcagagcugaugcucuauguuaagcuguagcagcuguuaccuuuuuuuuuuuuuuuuuugagccagggucucacucugucacccaggccagagugcaguggcaccaucucggcugacugcaaccuccaccucccaaguugaagcgauccucccaccucaggucccgaaguagcugggacuacaggugccugcuaccaugcccagcuaauuuuuguauuuuuaguagagaccgaguuucgccauguuggccaggcugguuccgaacucccgaguuuaacuuauccgccugccuuggccucccaaagugcugggauuacaggugugagccaccacgcccggccuuguaggagcucuuuuaagagaagcagaguguaggggcaggacuguggccugugccaccugccccuguguuucagccaccauugaggaacagcacagcaugguccuguccugacucuccuguuggcaaagauucugcagugggaccgaaacaaaaaucaucuaggaacuuaccaucuuuaggggagucauuuuaggagaccgccuugggugacauuguagcaugguggaaauuuuacuggauuugggcguagacucugcaaccucagggggagcuaggaacauaauauuucugagucucagcucuuuuguaaucuagagcuaaaacugcaggguuacugugaggauuaaaucaaauacauuaaaacuucacaaacauuaaagcguuauauuaguauacauucagguaaggccacguacuaauucuaauaaugcugaugguuuuucauagcuaccuucaaagcuaguuugaggugcacgaaaaauuuguucugaccucaaugucaaucugaccuauuuuugaucagcuugauagcaauacuucugugaaugacaccugacuauuaaaauauaaaaucugcaaaggggucugcugccauugaggauauucagagaguaugcugcagaccccgaaagcagccuuccacagugggagguaaggggucuggaaaagcgacaugcuuauuucugggcagaacugcuuuugaggaucuccgcauguuuauggauaaagguuccuuuccuuccuggagaaggggucugcggacauguugugcuaccaucuaggucacugugagagagauaaaaagguggucuugacccuauaccauguggaucccucuucucccagcccuaugaauacuaggacagguauuggcaaacuuuuuuuuuuuuuuuaaggggaagcaaguuuauuaagaaaguaaaggaauaaaagaauggcccuuagagcagccccgagggcugcugguugcccauuuuuaugguuauuucuugauuauaugcuaaacaaaggguggauuauucauguuuccuuuuuuuagaucauauaggguaauuuccugauguugccauggcauuuguaaacugccaugucacugauuggaguguagcaauuaggacaagcagaggucauucucauugcuaucuugauuuuggagggguuuggccagcuucuuuacugcaguuguuuucucagcaaggucuuuaugaccuguaucuugugugaccuccuaucucauccugugacuuagaauaccuaaccgucugggaaugcagacccuguagaucucagccucauuuuacccagcuccuauucaggauggaguugcucuagcucaaaugccucugacauuucccccaucacuuuuauaagagaacccuuaauccuaaggguugcagagggacgaagauccauccucuguaacuucuucaggcugauuaggggcaaugauauuccugccuaccuaucgaggucucuuguauucaggguagagaggagcucagucagaaagugucaguaugguuagggcuauucacagcucggacacaaagugauaucuggaagauuuuguaaguguuuaagagaacauugaguaagcuuauccugcauuccuacacaaauaguacaacuauuccauaucaguaaagcaaaauaagcaaaacuaucccaaguaaacuaaagaaggcuuuccaugaacuggguaauuguuggaaccaagcugauacggggucgguagcugauugcaauauguucccagaauuagaauacugauucagauuuuuacaucaccaaucccucuuguuucuucugagcugcagccagagaucacugguugguucacaggaacaagcagucuaaauugcagaaaaaaaccaaagucagccaaucagugcugcagucuauuuccuuuggguugggggucuccucaguauugucccuuugggguucaccagaaagauguuaccagaaagggguccagacccggaccccaagagaguguuauuggaucucauacaagaaggaguuuggggcgagucuguggaggaaagugaaagcaagucuauuaagaaaguaaaggaauaaaagaauugcuacucuguaggcacaacaggcagcaaacuuuuuauuaaaguuccaaacaguaaauauuuuaggcuuuggggaccauagggucucuugcaguuacagucaugcaucguuuaaccaugggcuauguucucggaaaugcauuguugucauuuugucauugugcaaacauuguagaguguacuuaugcagaccuagaugguauagccuccuacacaccuaggcuauaauguguagucuauuucucuuagaguacaaaccuguacagcauguuaccuuacuaaauaaauacuguaggcaauuauaacacaaugguaaguauuuguguaucuaaacauagaaaagguacuauaugguaauuaguaaaucuuaugguauuauaaucuauggguauuauaaccuuagggaacuguuguuguguaugugguguguuguugacgagaaccucguuguucagagcaugacuguacucaguucugcugaguuguagcuugaaagcagccauagacaauauguaaacaaauggacauaacuguguuugaauaaaacuuuauuuauaaaaacaagcagcuggccugaccacuguuugcuggcccauguucuaggaauaaaacauuccuaucugaugaaccauguucuaaguuuaguguggucugcaugauuauaaaauauugccuuccuuuuacuguuugggaggaguuauuuuuuccuugugacuguuuaucuggguaauguuuuucuccccugggcuuugacauugugcacugguuagcugcugggaauaaauuagccaaagaaccacuuaacauagcuaaaggagggcaaagauaaaugcagaacauaauucauuuuucuuuucuccucccaccucaaacuaggauucugcauguuuguacugagucuggucaagaagcauuaucgacugcaguucuacaugguaaaggaaaugcaugcgugugugucagaauucuugauuuaaaugaaguuuuucaggaacucaacaagccuuucaugcuuucugugacaaaucaaaacucaggaacauggucugauauguaugcaucuagagcaugaaggaagaaugcccauuuagguuuaauggcucuacguugacuuagacccagucacuguuacuuacaccuuaagcagccucuccacuaggacccugaggugggcuccagagaaggcacaagcugaagcuucagacacugcccacagauguccugucugguacaucacuugcuaccacuuauucccugacucacuagagaacagcuccucucugagugcuccaggugcucaauaacuacuaagaaaaugaaaaauacccaggcuuucagagcaugggagagcucacucacuagugggcugugggggacaaaguauuacucucagaagccugaucuuaccuguucacuuucaauaagucagauacaaaagcagauauuuuuccuaccugcuucucagcaguuuucuauuugguauugauuguucuuugaaguuacuuucaagguaaacugguaaguaguguuuauuuuucuuuuuuuugcaguuuggcuggacccaugugacauugcugauuguuguaacacagucacaucuuguuauccacaaccuauuugaaggaaugaucuggugagaauugggaguuggauuuucccuuuuauuuugugaguguuucucguguacagauaccccccucuaagccaguggcccucaccuugagccacaucagaauccucugcaggguucauuauagcacagauugcuggaccccaccccugacuuuuugauucauuagaucugggguaggcuugagaauuugaauuucuaguacauuccuggguggugcuuauauugcuggacaggaccuaugcucugagaaccacuguucuagacuaauagguacaggaauauuuaaagacucaaagacaaugcaacauguauggcaacagauuugaaaaccuagaggaaauauucaugauuuccugacaaaauauauacuaaaagucaugaagaagaaaacgugaauagaucaguaacuguaaaugagcuuugaaaauuauguaagauuccauaucuggaaagagaaacaggaccaaauggguuaacagcugaguuuuaucuaaccuuuauaccaaagccaaugaggagagagaagcaggaaugauaaacccauuucugcuacgauuauagauaaaucauucuaaauaaaauacuagcaaauagaaucuggcagugugucaagggaauaauaugcaaauaccgaguggauuuuauuccaaaaaugcagugguuucauguaucagcauugauagaaaucacuggccaacugaagcagcuaggugaucuuagugaaaagguuaaagggcgggcgcgguggcucacgccuguaacccaacacuuuuggaggccaagguaggcggaucacgaggucaggaguugaagaccggccugggcaacauagugaaauccccgucucuacuaaaaauacaaaaaaauagcuggugugguggcguggcaggugccuguaauccuagcuauuccggaggcugaggcaggagaaucacuuaaccuggggguggagguugcagugagccgagauugugucacugcacuccagccugggcaacagagacucugucucaaaaacaaaaacagaaacaaacaaacaaaccuguaaucaaagaacuuuuuaaaaagugucagugucagggaguggagggugaggagagagagaacaaguguggaaaccaccucuuucauagugaggaugacuggaucagcaggggagugggcagaggggaaaucuagcugugcguguugggguuucacacucaaauacaguccuggggaaagauagggccaacuagagcuaguaauaaacagcaagaaaagucaguaaauaaugaaagagucauuaaagcauacuauuuagaauuggggagguaaccacuagaaaaauaaaaauuagaaacgauuagaagugguuauuuuugggaauggagauagggaugggagaaagaaggaaaacuuuuuguuccuuuuacaauuaaauuucucucauuguuuacguauauuucuuuaucaugaaaaaaggacagaugaccuuuuaguuugcaaccuccacuuauucaguagucauucaguaaacacuugaauauguacucugugcuagguacuagguaugacuuuuuugguauuuuuuauguuuuuaacuuacuccuuaauggguuaccagaauuuuaugggugauuuuggugcuggaauuuaagaauggcacuauuuuguguacuuuugagguacugucaccuugcuugaguugauccuuacuuugguucauuucuagguucauuguccccauaucuugugugaucuguaaugacaucauggccuauauguuuggcuuuuucuuuggucggaccccacucaucaagguaaauggauuacccuaaugugaaauaccacugugaggggaggguggugcucucaaugugaguagaucagccuggcagacagaagaaaucuagcuguguuguauuguggccaugucuucaugucuuccuggagaaaggccaaaggaaaacacugacaacugauuaaaaaaaaaaaaagauaauaaagaaaauaggcugggcguggugggucaugccuguaauccuagcacuaugggaugcugaggcaggaggauugcuugaggccagguguucaaaagcagccuggggaacuuagugaggccuugccuuuacuaaaacauuuaaaaauuagccaggcauggugguagcaugcaccuguagucccagcuccuugggaggcugagaugggaggaucucuugagcccaggagguugaggcuucaaggagcugugauagugccacuauacuccagccugggugauggggcaagaucgugucuugaaaaaagaaaggaaaauauuuuuacagauuuauauaaucuuuuuuggggacacauuuuuugggacuuugaucuggauuugaguguagucacuuaauuaguauaucguuuucuaauauaaaacuauucgaaugacugauugaaacagaaagggaaccaaagggaggaggauauaagauagggaacaaggaaaccauauuugggggagcuuuaaaaggugacaugguuaagagaaugggguuuuaugaaagaaagguucuuaacaaguaaucauuguucgcaaagcuauaguuaucaaaacacccuuugcugagaacuugcucucuguccacagcuguccccgaagaagaccugggaaggcuucauugggggcuucuuugcuacugugguguuuggccuucugguaggugguggcuuucagcuguguaagggauuggguggacagaggccucauaccaccuuccaaggccuguccagagcuggagagugucuuuggaggccaggacuguccugcugaauggcaaccuugcccugaagagggccacuggccaugccagccauccaccagcuuucaggcagggugcuagcaguuggagagcaccuucuaugcccucucgcgcccaggcauggugacaucagcagguagccuucuugucaggcauuugauguuccaaggucagggugagugcacccaagggaagaugagauacacagcuuuucuccuaugugugccuugcccagaggugggugauuuuccugcccuuuccagagcaccauucucugcuucugacccuugggccaguccuccuucuucagcacugucuggcugcccuucagugcucaccgcccagcuuuguugcuuuccagccuuguuccuccugagaucugccucucacugugccccuuccccauggccucucuccaguuaucacugacuucagagaucuugaggaaagugguccuagcuccccaaauggggagagucuucuuguaguucuuugccccagucccuucagguuuucccggauucuuucggggccuggguguuuggguuccuguauguaaccuuggugggucaugagccucuuuuuuuuuuuuuaauugagguaaaauauguaugguaaaacaugaaccucugagcacauagcucgcaguuagcaggguacuaggcacccucaggaacauggccaaaccaggugccugugucugggcuggaugguuggaacuuacuuccuugccggucucucuguuauuccuccucagcuguccuaugugauguccggguacagaugcuuugucugcccuguggaguacaacaaugacaccaacagcuucacuguggacugugagcccucggaccuguuucgccugcaggaguacaacauuccuggggugauccagucagucauuggcuggguaugugccacucacagggggugagcggccuccauggacaguggcuacaaagagagaucccccuccaucaccugcccucugaaaaaagcuagcuuccuccuucccaaagcuguaagccccaggaugaaggagaauugcucacgccaggucaggguaugggcaggacagcuuucccccaacaucagauuguuuagaccagugguuuucaaaguguguucuguggaucccuggagggcccugggauccuuuuaguugcggggguagggugggggggucugugaggucacaacuguuucauaauuagacuaugacauuauuuuccuuuuucaauguguugacauuugcugugauacggcgcaaaagcagcagugguuaaaacugcguuaaggcaguggguuccucaugccacacacucacaguacaaacaggccaguucuaaugaaugucuaugaaauaguaaaguuacuaauuuuguuaaaucuugaccuuuguacacacaccuuuuuaacacucucuacugaaauggaaaguauguguaaaacauuucugcuaaguacuguaguacagugcuugccuaaagggaaagcaugugugcaguuguuugaguugugagcuaaauuagcugcuuuuuuuuuagaaaagaaaguaaauuuuacuuggaaagaaccaacaaauuauaauuuuucagacuuggguauuuggcagacauuuuucuugaaaaggaugaagugagccuaucacuuuaaagaaaacaacugaggcuaggcacaguggcucacaccugaaaucccagcacuuuggaaggccgaggcaggcagaucucuugaggucaggaguuccagaccagccuggguaacauggcgaaaccccgucuuuacuaaaaauacaaaaaaauauagcuggggaugguggcgugugccuguaaucccagcuaccagcuacucaggagguugaguugcuugaacccaggaggcggaggaugcagugagccaagaucgcaccacugcacuccagccugggugacagagugagacugucucaaaaaaaaaaaaaaaaagaaaagaaaaaugacugacaguaauuguuaccaaggauaaaauuuggcuuucaaaugaaaauuagaauuuuggaaagcuuaaccugccacugugaacuugacagcuuccuaauacuuaaaagccuuuucugaugaggucugugaugauucuuaacguacguguguguguguguguguguguguguugaucacaugagaaaaaacacaaacauauuugacacgguauaaugaaaugugucuacauuuggaagauuuacauaacucagugaaccauuauuuucuaaauggcugaugcaugguguuauauagucaugcauggguaaaagauccguucaaguauaagauagaccaauggauuuuaauguaagagagaacaaaguccauugauagaauucuagauuccauaucacaccuaauauucaagaaaugacuacuugucaagcucugguguagugucagagaauacccaaaaccaucugaggcuacgacuaaaauacucuuuucaacuauguaucugcguacggcuggauuuucuuuauauacuuccaccaaaacagcauguugcaacagauugaaugcagaauauuuuaauguuuuccauuaacuuagauauuagaaauuuacaaaaugggaaaaauucacuccucuuauugauuuaaaaccuacauguauauaauuaguuucauaaagaguuacgagguuggaugucuuggucugucuaguguugauagaacacuuggggcuggguaauuuacaaagaaaagagguuuacuuagcuucuuucugcaggcugagaagugugagaaguguggcauuggcugcugccuggcuucuggugagggcuuuuuaugcugcauuguaacauggcggagaaggucaaagguggaagcagacacaugcaaagaggcaaaaccaggggcuucaucacuucauaacaacccauucccucgggaugccagugcuaaucuagucucuugacagaacucacuacuaggagaaaggcaccaagccauucaugagggauuugccccugugacccaaacaccucccacuaggcaucaccucccagugaggccacaaugaggaucaaauuucaacaugaguugacaacucaaaccguaacacugggcauguaugcaccuaaacuuuuacuucauuuacucuucucagaaaacgguccggauguaccccuuccagauucacagcaucgcucucuccaccuuugccucgcucauuggccccuuuggaggauucuucgcaaguggauucaaacgagccuuuaaaaucaaaguaggaaaaccgucuuacguuccucucaucucacucccucacccaucuucugccuuucucccccuucccugcccccuccaaaauacuaggcuguacacccuggcauuuaaugugugaucuugacccaugcacugaauuuaggugaguuaauuaauaacaauauuuucaggaaaaugcaaucguuguuuuucaguuuauuuguuaauauaucuuucuucaaaagaacauuuugggccaggcaguggcucaugucuguaaccccagcacuuuaagaggccaaggcgggaggaucacuugaggcuaggaguuagaaaguagccugagcaacauagcaagacuccugucuuuauuaaguaaaugaaauaagaacauuuuguaaugcaauaaaauuguguccuaauauagccucaccauuagauuucauacuucucaccuucuauugcccucagcuacucagcacagaagccugacauuggggugggaccauuaggcugggauugguuaguggcugagcccaaguucacccauccuuccccugccucuaacaggacuuugccaauaccauuccuggccauggaggcaucauggaucgcuuugacugccaguaucugauggccaccuuugucaauguauacaucgccaguuuuaucagguauaguaccuuuccaucugaaccaaguugguggauuuuuaaguacggugcaauucuagaauuuuagcggcaucuaaguuccagugaaaagcaucccaaauaaugcaguuuucaguuguuucugcuuacagauuuucugaggccuccugucaucuguuaauagauaacucucugauccagagaucagagcagccacucagauaaucaggcccuggaagcuuccgggcccuagcucagugcuguuucuucacauucuguuccagaggcccuaacccaagcaaacugauucagcaguuccugacuuuacggccagaucagcagcuccacaucuucaacacgcugcggucucaucugaucgacaaagggaugcugacauccaccacagaggacgaguaggggccacccagggccaggagaacaggaacagaacugagcaggggcaggucuccaaggcaagcccagcuggugugacuuagacaaugacgaggcuucaacucacugucuuuuuuuuuuuuuuuuggaggguauuuuuuauuuguggguucaaaaaaucuguauauacagucuauguguuuagaauuuguguuguaaguaaacuacagcuuugaguuggaaagaagucacggguuguaaaaccauuuggauuuuuuuaaaacaaaaguauuaauaaucuggaagacaguguugcccaggucaggaguguuuucuuggugguuccagcccccaucaauugaacuguuucugggcucagucagacacagacauucaucugugucugaccaaaucaggggacuuccccaccuguggugggaggcacagcuuagauguuuuguacaccuggucuuuucuagaaaucccugcuuggagcugcagaaggguugccuucuguaggucggaggaauggaggcuuacuaaccagguaagccuucuaugcauccacaccaaaauccugcagaauguaaguaagcucugcuuuauaagauggguucaccuucaucgcagacugaaaguuucaguuuuuauuuuuuucagaaagcacgaaaaauuauuuauaauagucuggagaaaaaacacacuguaauauuucaaguguaugcaguagaauguacuguaacugagcccuuucccacaugucuaggcuccaaugucuccuguagguccaccuaacuguguguuuucagggacaaugccauccauguuugugcuguagacuugcugcugcugaauccuuucuggggacuuucucaucgggcagggagcagagggcuucucguucaugcacccuuugccugaacacccauguagcugcuguguuguguauauauuacucuuaagaggagugugugugucuguguuuguuuuaaaagucacuuauuucuuacagugauuucaauugcaccaugacuucuucacuaaaaccacaaaguccugcuuaaaacuauggaaaaccuaaccugauuagagccuugacuauuuugaagauuaaaugcacacuuuuuauauaaugugaccaguuuaaauguaguuuguauuguacugggggaccuuucguuguuguuguuugcuuaaacugugauuuuuuuuccccucccuaauuucaggggugagauugacuuugggaagacagauuaguucuuugucaggccaacaagugauggagugcgggagagagaacuuggcacccaaauauaucaaacuauuccgugccguggauguuuucauugccaacgaggguguaaugauuugcuucugcaccuuggucuagugcugguuugugguguuuuuguuuguaaauuagccucacugccucccugaaagugcacagucagcccaggucucuagaguguccagcagaggauggagcccucgggauguuucagcucacacauccuugagugacuucccauauguguguggggcugaagcggcuucuuuccgcugaacuuuuauuuccauuucagccucguggcuucucuuauucagguccaaggccccuuaaaaacaaaacauauuaucgcaagggcuuucauuucaguauuggcugugucacuggcaggaugcaucacucuccagggccucuuuuucggagcuacucccaauuccacucuucugugauucuggcugagcaaguucaugccgguagaggcucauuaagugagguccugggcaccccccaaacaggaaguguuuucaggcccuuacaugcuuauccuuaaggugaguagguaucucagcagcacacccgaacaguaaaggugaucaauaacgaaacuguaguuuucagauugaagaaugaaccuggaucaccaaacuagauaccgaaagggcuccucauuugucucuuuugucccauugugggcauauggugggcuccuugagaggagggagucucagcuggggccuggcugcagagaccugcucuugaauagggcugccuuugggaucagggagccgagcauacugggcaaggcucaucauguuccuuuguggaagugguuacuuggugggggugggguggggaaggggggucuaggaagccgaagcugagugcgcacuagagcugcuagcaggcaggccagagggucagcuuguguuuuauuuucugauuucuccugcaugcuuucuggagaugaggauuuuuugucagguagcuaggagagcacugccaccuuguguccauauagcacaauguuucucuuuccuauucacagacaagauucaagaaaccauuuuuacguguguacauucaaaucuucaugaauggcaucacuugcuuuagacccauuuuuuuuuuauuggucagaaauaaaaugugacugcaacugugugcccucccuugucgugaauucccuguuuaucacuuccaugcaugguuuuaugcuucucauuuguuuauguauucaugaauacugcauaguccugauucagagacuuuugcuuugcuuuccaacuuguaucccuacauucucacaacagccuucuuaccucgggugagagucaugagcaccuuaccaggcagggagcuuccccaggauagugugguggagucaggacucacuccauccugcacuuuacccacaggacaccuggagggucccccagcccugcuugcuuuugugaacgucgugugaguacaccgagguguugcagcuuuccuucccucuagcucaggaggccuggccugagccagguuggagcuuaaauugcuguuggcuccugccugguggaacaagggggucauagaaaccagggcugaugggcaccccccagccccugggagcucugcucaugaccgcucacaggguaccgagucuuugccuuuugugugugcgcaugcugcccucuuaacugcuuuuaguauucagaaagguuccauuuauguuuuacuccugaaagugaaacccucuuaggcaacuuguuucauauucugggcauuuuaguagcuacaguauuuugcauuuaaaauguaauuacucuuaguauuguacagcccuauaauguaugagaacuaguuucacauccuuugaaacuaaucucuuucauuggggaggauacaacuuuugacuuuacacagguggacuuugaauccauuuuuauagaauuuuuuuccacuguaacuugaccuauauuaugcaagaaaaucccaaaaauauguuuuaagggagacuacacagaccuugugauuuggucugagcuaguugcugaguugacuggagccuuauuugaauggaucuuugaguugagaucuucacacugucagugagcccuuggcucagcccuugucaccuguuuguauggggaccauguuucccaaagcucagguucaucuccacuauugacagagucggguagugggagaguauaagugacuugagacagaguguccuugcucagaaaacugugaagcaggggucuuguuaguuacaaagccaguccuaguugcauguccaaggggguagauuuucaucacccuacuaaaugugguaugucacugcugaagccuuuuccuguuuuaguaauaucuuaggcacuauugucuuuugucuuccagaguaacauaucugggcccaccuuucuugcacacugugauuaugugcuaagaaaaggguggaguugggaggacaauuucacuugaacagguuucuguucuucugaggucaggguggggaggauguccaggugacuuuuauggacacauugcaagacaguaagccgcggauggacucucacuugugcuuuggaacacuggacuccaaagagcagguggaacaaacucuggccugaagaugauggcuaauacucaggcagagccccguauucuucccugacuuggucaaaacaaacuuccuuuucccuugaucacccugcacgcagcugcccagcuuccaguuuuuaaagagaugaacagcucucacuuccugacucaguuucucuuguugggugggggccuugugccacaaccugcauggggugcuaggguuuaaaccaaguggucacgaaggauucuuaucucagggcucugccuggcccaccuucucuugggccuggacucuccuuauccacaucccugcagaaggugggcccuauucucagaagaguccuggcugcuguugccaucugaaugcgcccuucccuuucagguugaccagcaguggccuuaccuggccucucagguggauggaggcuguucucaucuggggcugucucuugauuaaggcugucaccuguuuguauagggaccauguuucccaacgcacuuugagugcaguuuaggagguauccuuuggaugcugaaguguugggauuuugaggacaugcggaugauuuaugagaauagaggggcagaguuugugaagucuaggguuuuuuguccaguggguuucaaauuuguuggcuguuuaaagacccugucuccucccccacccuccccuuccuuuucccaucaaaugccuaccuacugaggcgccuucucuuuuuauucuugagccaaugagauaucaguguguuuauuaauaaggauugcaauaguauagugcuuaauaugugccaggcauagugcuaaggguuuacauacguuaucccuuuuaauccagaaaacagccuuugauuagguauuguugucuccauuuuauagaugaggaaacugaggcaguaugacugaggccgagagcagugguuaagacagacuuugggaucaaaucacccuaggugcgggcagguuucuaggcugcucuaagcuucuaccuugaaggcaguugggucugauaauaguaccuucuuccuggggugguugugaggauauaacgagguaaugcauguaagcauuuaguaccaugccuggcacauaguaagcacucaauaaaugguaguuacuuuuguugagcucagcugguaguuugaccuccguuggugcaaugccagagaugggauugucagccaccacacugccaccacccugcacacagucugggucccuccgagagaagcacgccaaccuuaacauccccuacagcaucuuggugcuucacacaccauuuaggaggccacccuaacgaggcaagaggacaugggggugugcagaaguucuguucuuagugagaauggcuggccugagaauccagcucaccuccucugcccacagucuggacugcuugugggaaggccaucuccuccugucuggugguaccuccacucugggcagggagggccugucugugacucgcucuggaccccacuucccgcucuggccaagggcugucuucugugcacauagcucaggagccugcagcaguucccuguauggguggauguccucaggggccaagaagagaagaauggggacaacagaaaccugcuuuguaggggauuauguagacuaaaagccuagaaguucugcccacauccuuaugacgcagccaaucuggagcuucauguuuccuucuaaaaguaguaaccggguagaagugggugacccauugaggacacaugaugugagguauuucugccggauucuagguuagcaaagacucaaaugggugacucaugaaugaagggagaacaggcacaggacuuaaugaaaagaguuucuugaacuuaguuuucugaauggggguggggaguuggggcacguguguguaaggggaggcugccucacuuugaaggaaugguguuggcuaacaggauccaugaaauuccuaggucaguugaauaauaacugaacuacugguuugacuguggauuauuuccuggguauuagugggacccaacagcacauugcuauuaauaguauggaaauaauggucccucuguuucauugaauugcugaaguaaugauaaugccaugaaccaggagaagaugguuguggggguuucuaggaagcagcugcugugacaggccaaucccaggcuugcccccgagcccuccuguccuucuggguuuguguuugccuugccuggugcuuccucccucauuguguuguugaauagaccuaggcagccuuguauccauagaaagccuccacugcugggccggggaggggguugugguaagggcccucuggaaaucaagcagagaaugccuuugcaguggucucccgggcauugggcagggccuagccuuuugcagcccccagaggaccuugccugcauaaagcacucagaaggguuagccaccuggugauuuugucucuagugaaacuguguuugccgauaaucauccacauagccaccucuguccucgcaguuuggaugccuuuuuuugacaccugcgcuagguucuuguaugcuggcuuuucuuaaaggaacagcagaguagaaaagagguugagaauguuuucuagcaggcagaaugugcauacauguuuucaugaguguccuuugggugcuguuucuuuuaaauccucugugcacagggcucuggccuuuaguaaacuguuuuucugucuuacgucaugcugacugggugcuaggggcugauuacaaaggggaagaguugaacagacaucaggggccgaugaaaccaaaggacuaggagucaggagaacaagucagggauuaggagacagcgguuugguuuauuguuauccagcuggaggacuccuaggggcagcagcaggaggaauaccagggccacggaggggccaggagucucacaguggagggcagacucuaacagaugccagcugaacgcucgcuggcccuggaugucauacgaguuggggaccagaaaucugggcucagagaacccguccagggagauuugaagccauggguuaucuucuagaguugauacugauaauauauuuuaauuuuuauugauguuuaauaccuucugaaacaggaggguaagaucagaugggaagccccucuguugaaggaucuugggaaccuuggugguuuuuuuuuuuuuuuugguuuuuuuuuuuugaucgagcuguggacauccuucuuaauucgauucugaggauuuguuuaacuaaaaaguucccaaacacagaaagggccuccccaccugcuuuggggagcugucugugcugggagugccaggcaucccaugggacccaucacugccagugucugugccucccagaggucagccgugucugcccuggcucugucuccucugugacagggcagagcauuucuggucaguuucuccauggugccucccaccccuuuguaaaguggauggacaugauggaauucaguugucucacccugauagccuggguguugauauucacuuuacccgcacucagacacaggcgaccuugaagcaguucucgguguguagaguccacgugacaguccccacagccuccccagauagcugugugccugugcgcuacugcugugccauuuucccaacuuggcguuucacuaaaugcagcugaucucucucucugugcacucgugauccauguugaacaauacauguagguucuuuuuccacgcaauguaagaacaugauauacuguacguuggaaagcauuuaccuuauuuauauaccugaauguuccuacuacacaaauaaacauauauuaaauucuagaucaugugugguuuucgaugg

SEQ ID NO: 13420 - RNA, 13651 nt, Homo sapiens
cggaaagcggaagcggcgugcaacacgugggggcggugccggucggagggcuccuagugcgccagguugugggaagugaggcuggcgguggcgacaaccgaggaggaggggcgggacgccguggagcacggcgaccggcugagcgucauggagggcucaggggagcagccgggcccacaaccacagcaucccggagaccaccgcauccgcgacggcgacuucguggugcugaaacgugaagauguguuuaaagcaguacaaguccagcggagaaaguaagucagaucgcugauuuuaggggucucccgcccccaccuuguagauacccccucccuccagguuucuccacagaauucuuccgccagggugccauucuuggcucucucgguccccauuccccgcccucguugucuccucgggucuuucugucacagaaggcuuuuccaccaggaucccgucuucgaaccucauaaucucccuuaacccuccuguuuuucccggagcccccuccaugauuucauaucuggccguccaccuucagcauccuuuucagucuuuccacagaguuccuuccccagaauuccauucuuggcccuagggugccaaugccucccucuccacacccuaaucaccuguccugaaguucuuucccuaggaccuugggaucuucacugucuuuccagagacacccccuccuuucuucacuuuaggaucucauccuugucuccagagucuccuucagguucccccuuuuuuuccaccauagauccuccuucuucccuaaucccccagucaggaucuaucccacaaaaaaugaaacgucuccuaccuagucuggcuuucuauccucuucucuacccaagcaggauacacagaauagaugaaggagacaauucaccacagaguguggaaucacuuugaguuucccucguuuuacucaccaaaggauucaacgcugggaaaauugcuaaaaagcaauuugcucaaggccucagaacuccaaauuagguuugguuugugcaccugcuggcuaguaucgcucuguuuuauagaaguaaagaagugggauuuugauaacuuucuggaagggcuggugagguuguuaaguccuaagagcuuauuaauggugaaaauuuauugggauauuuggauuaauuuaucugagaaauacaaccacaguguuuuuguuuuugagacggagucuugcuuugucacccaggcuuuagggcaguagugcaaucucggcucauugcagccucugccuccgagguucaagcgauucuccugccucagccucccuaguggcugggacucuggcaccaucacacucggcuaaucuuuuuuuuuuuuuuuuguauuuuuaguagagacgggguuucaccauguuggccaggcugaucucgaacuccugaccucaggugauccacccgccucggccucccaaagugcugggauuacaggugugagccaccgcaccuggccacaguuucuuuugagcuagguuauuguauuacuuuugacagagauaaguugaaugcaaugucaggagaacagcuuucugcagacugggaaguaugagauuuggaauuucugauaaguacuuacuucagaugaauucuuuuacuccugguuuaagcaaacuguugacugguauuuaaggugaagcaagcaucauaaaauagucaagaaacaagucuccagagcacuaagcuggugauaaccaagcuuuuugcacaagcacuaauuuaguaaagauaaaaaguuucuuuuaugagggguauguuucuuuuaguccggaaauguaauaccugcaccaaccuuuaaccauuuuuaaauucuucuuuuuuuucuuuuuuaaacuaauuaauuuuuuuugcagagacagaguuucacuauguugucuaggcuagucuccaauuccugggcucaaguaauuccggccaccucagccucccaaagugcugggauuacaggcaugaacaguaguugaccuuccccuuuuguggugccaaaaggguuggagaccacugcccuaaacauuuauuuggaaauacuuuucaacaggcccucuucuucgcagaagucauaguggcaguuuccauuuuauuuaggaaaugacucucucagcucagcugcaucccaggucagacucccucaucacccuuggggcuacacucaucugauugggcaaaaaacaguccaggcucucugagaaguagacucugcaaauccuacuccuucccaguaaagauguggccuccuuaucccucuaacggggccccacauucccgacuggggcagugaccugucaaaccagccaguuuuaagugacacgcaucauccccucugcauaucacauaggcucucagagagguaaacccacccaucucagauccaguguuuuuguuugguuugucuguuuguuuguuuugugagacgggaucucacucggucccccaggcuagaguguaguggcgugaacuuggcucacugcaaccacugccucuugggcucaagcaaucuuccaccucagccuccucaguaacuaauuuguguacuuuuuguagagaaacuccugaauucaagugacccuccugcuucagccucccaaguagcugggacuacaggugugugccacuacaccuggcuaauuuuuuuauuuuuuguagagacggaguuuuuccccgucagccaggcuggucucaaacuccuggacucaagugacccaccuggccucccacaguucugggauuacaagugugacccaccacaccuggccagauccaguguuucaaagcaccuaggugauuaaaggaugaggauagggggugcacaucugggcugagcugaauugcaacaucugaggagguuuacauuagcaaauauuuugagugucuguuacauucuguuguauguaaguaucuagggacccagcaaauaacaagaauuggccauaucugaaucacuuacgaucauacaggauuucccucagaugguuugaguaagcuuuaaugaagaugugacucaaaaguguggccgauuuagggaaccaauaaaggugacacacccagagaccagcaauggugguaagccucugacacgggagcgugggugauguggcaguauauucugucguaaucagcuuccugguggcacagagaaaggaagagaaggagugggauggggcacaaucagaauuaaccaccacaugauucccagaauucaguguucugugcacaugggccauguccugaagcuaggugggcuuucuaccguccuuaggucuuugcuggaguagaccgugugguauaguggaaagaaugaggcuuggggucagacacagauuugaauuugaaucccagcuccaacaacaccuugcaacugugaaucuuggacaagauacuucucccugggccucggauugcucuucuggaaagagcuaugucccaggauuaccgugagaauuaaaucaaaaagugugaaucacaccucgcacacacugccuagccccugguuggcacucagcagauguuaguuuucuuuugagaagaaagcauuguguuccugugggauuucucuuuuaaauugcaauaagauaaaaaaucuaugucauaggaaaccucaaguugccugguccucaguagagcauugucaguguuaggcuccauuuccaaguguguagauugucaguguuuauuugcaaguauaauuugcuuuuauuagauaauuuucaaauaaaauggccgaucagaccaagcccaagaaauuuguuaaauccuuguuacuucgaugagucuuugcuuccccuuuccaaaauucaguguucuuguggcuuauucauuaauuuuacgucucuaucccaaccagguucucucuaguuccuuuguugcuuuauguucagagauaaugcugcugaucauccauuguggagaccacuuuugaaauaaacuguagugaacaugucuuuucuguacuggauagaaaagauauucaguuaauugauuacuuuuuuucccuagaaaaguaacuuucgaaaaacagugguucuaccuggauaacgucauuggccauaguuauggaacugcauuugaagugaccaguggaggaagucuacagcccaagaagaagagggaagagccuacugcaggugcacauuuuggaugcgugaaauagaugcucuccaacugacuagucagaaacaucucagccuccaccuaauucccaagugcuaggccaugcuaucccaaaagaaaucuuaacucauaaucuaagaacugcagcucaguggagugaagcaaguacugccuuuggccaugagauaaccuggauucuggcuccagcccaccauuaaaugguucucuguucuugggccaggcauuuaauccuaugagucguugcugcgucauugcaagaacauaauguaaaguucuuucagugcccagaaguuauguaacagcugugaggugguuagcauaugguguagagguuaagaggucugguuuuggauccagcuaaguucaauuucuaccuucaucacuugccuuguaccguugggcaacuuauuugauuucugugagucuuauauccuuauauauguaaaauagggucauaaacacauuuaaugccuagguuguauugaguguucuaugauaugacucauaggaaguucugaauagugucuugcuuuuaguaagggcccauaauuuuagcuauuacuauuauuauuucuuaacaaccucuuguccaaaagcuguuauuguuaauuaaaauuauauuuauuaaaaugaacauugagaguaucuuauuaauuaaaacacaaguaauuauuugaaguuaaauacuguuaaaguuuugagucaaaccuguuauuuagauacauuuaaauuaauauccauauuuuuacuaagcaccaaauauaugccagguauaauuuggcgcugcaauuauagcaguucauaagauagacugucguauaaaaugugcuuaccaguuggaacaccaaaaauaaucaaguagacaagcaaacagcaugauuucugauggugaagugacacaugcuaugaagauaauaaagcaggggcguguacuaauuugguaaagcaagagaaugagcucagccucaagugauagaaaggauccagccacucagacaucugucguagaaccuuccaggcagaggaagcagcaggugccaaaagccugcugugggaccuugcuggguguguucaaggaacagaaagaaggccauuguggcugaagcuaaagugucaagagaucaggccaggaaugauaggcaggggccagaucauuuaugaccuugcaggucaucuuuggaguguauucuuauugcuaugggaagccacuguaugguuuuaagcaugggguagaugagucaaauugcauuuaaacaaagagcacucuggcauccagguggauaguaggggggcaagacugggagcaggaagaugacuuagaggcuuggaguaguuuuggcaggaaaggauagugugaugggggcagugcagcugggaggccagacuugaguggcugauggacuggauguggauaugaacucagaaaaagaaagugucaaauaauuucagaccauaaaugucaauagagcaauuucuuuccuuagagacuaaagaagcgggcacugauaaucgaaauauaguugaugaugggaaaucucagaaacuuacucaagaugacauaaaagcuuugaaggacaagggcauuaaaggagagguaauauucaaaggauuuuuaguuuuguuuuugucuguuuggcauuuaggaaacuguuggguuuuuaaagcagacuguaccuaagguaaaacaaaaaaauaacguuauagcuuugauagaaauagguugaaauguacauguuacucaacauuucaaagauuuuaugucuuauauacaggaauauaagugaaugacauuacuaaugucagugguagagaauguaauaacagugcauaucaggauuuaacuuuguucauuuucaguaauguuuucagccagugucuucagaaauuaguuuccuuuaccucucuucuccuuuuguuggauaucucuguucuuuuacguugguuuaaguggaguuauaaaguacuuguauuuuauuauaaauuccaaauagaguauagaaauauaaaguucaucuauuuggacuucuguggaaaagggauuggagaaucagaccauuggauccauucuuggguaagaagccuuuggaaauuacuuguuuugugaaaguaaaguuucagaaaaucuacuugcuccuuuucuuauaggaaauaguucagcaguuaauugaaaauaguacaacauuccgagacaagacagaauuugcccaagauaaauauauuaaaaagaagaaaaaaaaguaaguaguuuuuauuuuaaaaggcccacaauauuaaacuucuuauauguuuauaaaauauacauuuuauuacaaauaaaauauuuuaagucauuuuuuuaaaucagcguucuguuuuuucuucccccagauaugaagccaucauuacuguugugaagccauccacccguauucuuucaauuauguauuaugcaagagaaccuggaaaaauuaaguacgcuuuguuuccuuucaaaaguauaauugggggaaauaugucuuuaagaaagucaugauuuuaaguaaaaugaaaaagcuugcucaccugcauaaaguauccuccuaccucauaaauuguaaguccuuuuacugucaccuccaaagcaaucaauaaucuuaucaacacaauuuuaauaaagcaaacaaaacuugaaaaaugaugauuaaaauaauaggcuuuacuuagcuaaaaaugaacaaauuauuguuuuuacuuuagccacaugagauacgauacacuagcccagauguugacguugggaaauauccgugcuggcaacaaaaugauugugauggaaacgugugcaggcuuggugcugggugcaaugauggaacgaaugggagguaagauuuaauauuuccauuuucaacaaaaccccacccugaugugaguaaaggugguccaaaaauguaaacucauggaaagccaaauugaauuacuucaggguuaacaaagugacuugggugaaccugcacggcuccuagcauggggaccuucuuacacagucuccaucacccagccccccacccauggguacccccaaacccauggcaauuguccuuucuagcuucacugucagugggcaugaugcuggagccuguggcuggcuagggcuuucgggacagugauuuuaguaaacuccuggguagcuggugcucauuucauugggccuaaauugaagggauugagugggaagauuacuaagcauguauucucucuggaagaauacaacacagccugauuugucugguuuuuuucugaccccauagaagguaagaacuuguaacugcuccauuugaggaucggagugaggggaagcagaguccgucaccaaucaugugacauccaaauuugcagacacaggguuuuacaauaguaucaaguggggauaagcuucuuugagucuuccugcuaucugcuuuagaauuauauuaccuccauugguaauacucauagacuccaaacagacucccugaggagcugcaccauccuucagccucugaauaaaguacuaauagaaagaccuucagucucauuacuguggaggacucacugaggguuuacguagucuagagucacuccacgggcagauguuuguuucuuuuaucuguucagguuuuggcuccauuauucagcuauacccuggaggaggaccuguucgggcagcaacagcauguuuuggauuucccaaaucuuuucucaguggucuuuaugaauucccucucaacaaaguggacagucuucuacauggaacauuuucugccaagauguuaucuucagagccaaaagacagugcuuugguugaagaaaguaauggcacacuggaggaaaaacaggcuucugaacaagagaaugaagacagcauggcagaggccccagagagcaaccacccagaagaccaggaaacaauggaaacaauuucucaagauccagaacauaaggggccuaaagagagaggaagcaaaaaagauuauguaaggaugccaagaguccccaccacccccauaaucucagucccucaguuaacuucaguuaagucaugagauuuaguuuggcuuugguguauuagcucccaagaugauaacuaucaaaacagagaacgaguguguguacauguauacaaacgugugauucggucuucgggauggagcuuuaggauacagaagcguugcauagauagcuuaaucaugguuuuuauaguauauaggcuuucuuguguauuugcaacuuccuuauaaacaaccugcuucuauugguuuaguccaaguugauaaauauuguugaaauguuuugacaggccagagcauuuccauaaauuugacugaaagaccccaguacauugauuucuuauuuuucuuuuugaagauucaggaaaaacagaggagacaagaagagcagaggaaaagacauuuagaggcugccgcucugcugagugaaagaaacgcagaugggugcguugauggaagaaggcaggagacuccucagugcaugugggcucugcuucagacagauuggcauucucuuucuccuugucugcuuugacucuagugggacccgagaugaggauuuugucuuggggguuuuuuuaaagaaaggaggcugaggcuggcagggguggggaauugaugaugcugguuucaggguuucagaagaaauugaaucuucuccaucacugcaucaagaugggcccuguggucccacuggaugcaggggauggggcacucaaaugcugcgauacaggcuauaacagauauccacaaagcagcuuaugcaguguuggauuuguuuccaggugauuuuuuuuaaaaaaucaagaaugucauuaaaugcgacuuagaguugccaaguaccacaagagcuucuaaccuaguucgcguuuccuagaaagaaauagcucaugauuguauucuguuuuggauuucuagaauguuauauuuaaaucucuucucuuugugagucaugcaaauuaaauacaugaucauuuuaaaugcauuuuaaaaccugugcuccacuuugaggguguagagaaauaauuugucuggcauuuuccuuacaguuuaauuguagcuagucguuuccaccccacuccccugcugcugucuuugcuggacuuuguggccccuucaaggccguuuguggucuacugucaguacaaagagguaauacuggaauggaaugggcaggaauucuuaugucugaauguugauucuuaaacugcaucccaggaaguaguucuuaacagaauucuguuguugucugcagccucuguuggaaugcuacacaaaacugcgggagaggggaggggucaucaaccucaggcugucugaaaccuggcucagaaauuaucagguacguguucuuacagccagucccaagagcugcccucccgagacuugacuuuccuugcaguaguacuagaagucauuaaauagaguuaucucagccaggcacaguggcuuaugccuguaaucccagcacuuugggaggccaaggcaggcagaucgcuugagcccaggaguucaagaccagcuugggcaacauggugaaacccugucucuacaaaaaaaaauacauaaauuggcugggcaugacccuguaucuacaaaaaauauaaaaaucagucgagcaugguggcaggugccuguagucccagcuacucaggagcugagguggaaagauugcuugaacccuggaggucgaggcugcagugagccgagaucccaccacugcacuccagccugggugacagaguaagacccucucucaaaaacaaaacaaaauaaaaauagagaugucucuguuucuuucuacagggauggagauuucucauggcuguuacucagagaauaugccccugacuuuuugugacccuuuuuuucucuuguuaugucagaauauauuacucuguaacucugcccuaaaggcauuuaaaaugcaaaccauuaugguucuuauuuccccaaggccucaguaucacuguggaugauguaauugacaauagcaaaauucccagguggaugagaaacuggcccuuuccucucugccaggauguuuuugcagcaaguuuucaggauuuacuggugggcucugugucaguucaggucuucuggaagacauaugcuaagauggaaguugaaguguaagagauuuauugagggaaaugccuuagaaagauaaggggagagggagcaagauugguggugcagguugaugccugggcaaggagcggguagagaaaggaggaugguaggaagagccugcagugcugcucuggagaaagucuccaugaggcugauggcgagcccaaguggaaagaucgccauucaaggagcccuguguuaagcagaaaugcuccagcucugguacccaugcucaguuacugacuggaagcaacccauggccucccucgguaugaaugcugcaguggaucccaaaggagcggcagcuggagguguucuacugccugaaugccucucagcuguucccucaugaagggagaucugaggggagcaccuccaugcugccguaggccccgucucauugcuuggugucuuaccauacuguaguggggaugcuauugagccuuggguaacccugcccuuuguggagguugucugucuuggcuaagguuacaggagaaagaggagagaaguugccuuggcagaguuaacaggguagcggggaagggagguuuggaguguaguacauucaguagcaacuucuccauagacccaagcuccauuauuggccaugaagcuuccugaagccaggagaaagaaagcuauaugcacaguucuagaguacugccaagaccauuacccauucuccgccagaaacaugcuucaguuucuagauaaaccugggcugaacugaaaacugcuucaguucuuuuucuucucuuuuuuuuuuuuuuuucauuuuugagacagagucucgcucugucgcccagguggggugcaguggcgcgaucuuggcucacugcaaccucugccucccggguucaagcaauucuccugccucagccucccgaguagcuggcauuacagcugugugccaccacgccuggcuaauuuuuguauuuuuaguagagaugggguuucaccauguuagccaggcugaucucaaacuccugaccuugugauccaccugccucagcaucccaaagugcugggauuacaggcgugagccaccauucccggccaguuuuauuuuucaaaagaaaaucaauuaaaccaauuucuacacuuuucuuugcauuguaaugugaagaaauuaguccuuagaaguugguccauuuaaagccuggugccguggcucguaucuguaaucccagcacuuuggaaagccaaagugggagguucacuugaggccaggaguucgagguuacagugagccaaaaucucacuacugcacuccagccugaggaacagugagacccugccucuuaaaaagaaagagagagagagaaaggaaggaagggagggaggaaggaagggaaggaaggaaggaagggagagagggagggagggagggaaaagaaaagaaagaaaaaaaaauguccauuuaaaucaucaagagaaccuguguuguuuaaauucugauuuuugguauauguguuguuagcauggacuuuauugucuuaggaaagcaugaaugucuuuucugucuugauuagguuuugccagaucgaagucauccuaaacugcugaugaguggagguggggguuaucuucucuccggcuucaccguugccauggacaaccuuaaagcagacaccagccucaaaucuaaugcaagcacuuuagaaucacacgagacugaggagccugcagcuaaaaaacgaaaaugcccagagucugacucuuaacccuuuugagaauugcucugaauuuuguucucaggcauuauacaguuaguaauuaaacuuuaaaugccauuacuacuuguuuuuucauaucccaagaauaagaacaugucuauguacccguuucuaggaaggaggaguauaugccuuuugucuauuucugacacagaugcauuuggucugucaaaacugcaaccaugggguauguaguaugaccaacugcauuuaacaaaacuccucuaaguacuucuaaauauucugugcaaauaucuugagaacuucaacauccuaaaaauguguuucuacaagacuuuauauuuuaagcuaaguggaauaauacaacguaacuaaaacauggcggguaccgaaaggagggcaauucauggaagaaauuuccucuguucauuccguucucuucaaccuaagcaauauggaugugugagugugugauuuauuaugguaccaaaaauguccaccuucuuuccugcagcggaauaagcuuuuuugaaaugcugagguuuuauuuuaauaguugacaaccugggaaaguucugaguauuuauuuuacugcucuuuuuugugcauagaaagguuuaguaggguacuuuuuugcauuaauuugccaauacucuuauucuuuguucuaaauaaagugacuagaauuuuuguguacuauucaauuaaaggaaacaaaugucuuuucccccucuauggucuuauggauacacauuugcacacacacacauauguauauagauguugguauauauacacacauauauuuauauauacacagauauauacauacacaugcaaguggagacauagauuguaccaccuguaugaauauguauguacacauggggacagaaagagugugcagucuauuugaacuguaucaaagucuugugcaggacuuagaccaauucucauuguauuagugucauuccuugucaaaugucccuaaagugccuuucuugauuauuaaugcugaagaacucugucaugauuagaugguuacccuuucuaagcucugaaaaacucuaaucauuugaucaugugcuguagcaaagaaaguguuuagaaucagccaaggcucuuguucauuugagagauugagucuugcucacuggaacauggucaucguuugcguugcuccugucauagaauaggccuguaucauacagcaaggaacaucucagaaaaaaaauuuuuuuuccaaauagcaugugcuaugccaaugugauuacuaaguacaauuuugaguccuuuauccuaauugcuauuaaagaauaaaaaugucggccgggcacaguggcucaugccuguaaucccaacacuuugggaggcccaggcaggcggaucaccugaggucagggguucaagaucagccugacaaacauguugaaaccccaucucuacuaaaaauuagaaaauuagccaugcgugguggcuaacgccuguaaucccagcuacuugggaggcugaggcaggagaaccgcuugaacccgggaggcagagguugcagugagccgacaucacgccauugcacuccagccugggcgacgagugaaacugucucaaaaaauaaauaaaaaugaaaauguuuccuacugugauucuucuaacagugaug

SEQ ID NO: 13421 - RNA, 44667 nt, Homo sapiens
cucgucuugccgcuucuuugagcggaaguuggaucacugaagcgccaaaaaagaauuuaggggaagaccugauuuucgcuugaggcauuuuugcggcgcugugcgcuacagacaccuucuggaagcugcgguggggaaacugaguuucccgagccguugagacagaugggguucagcaccgcgcggggacgacaggaaagcugcggcugaagagaacugcggacuuggcaggagucgccugaggagcuaagaucccggagacucuuagccccguggugcuucucuacgggagggagggagggagaauccggccggacagaucugcgcguauccuggagccggcccaguugugaacuaggagagcuuugggaccucugucccaagcaaguaagaacuuuagccuuaggagauguaaauaaaguaguauuugaagaagcacagguacccaacuguuucuuuuuacucuuucuccaguccuacuucuuaacguuuuuuugaauuuguuacuguucucagcauauugucucguuugagaaggguauggcacgcagcguuguugaaggagcgccucagcuugggaggcugaaaguuuuaucucuguacugucgacaaacaacuuugaucuugaucgguuugcuuaauuucuuugagcaucaguuucauaauguguaaugccuaauuauuggagcccugucaugccguuaaaucgugaacuuucuaguuacuaucuuguuuuauuaacuaaaccccuuuuaaguaaggauuuggguagaguauuugauaaugaauugcacugcagcguacagguauaucuuuauuuacuuguauacuuaggauaugaaucauuuuuaaguagacguguauuuuauaagaacaguuuuggauuuacagaaaaacugcacaaaaaauggaugugacacugcaggauugacuguauguaagaagcuaugaugauguaucccuagugucucacaggccagaauuauguucauccuguccugcccuauaauaagaagucucaaauacugcaaauaaguuuucauagaguuaauuaccuguccuauuuucauuucuguaauggggacuuguaaacagguacaguaccuguccuuauuuuuaaccugugagcgucuaguauacguaaaccauauuuaauaguuauuaaacuauuaugguauaccuuaaaaagcgauagagauuagaaacuuaacugcagaauauuugggucuuguaucauagcuguacaacuuugcaagccuguuugcuacucuugaaccuagaauacauuaauuuuucccuuuuuauuaauacauuuuuaagagcacuauuuuccuuacaguuuuggugaagaccuuuuuaauaucuaucuuuuaggagagaugaauggagaguauagaggcagaggauuuggacgaggaagauuucaaagcuggaaaaggggaagagguggugggaacuucucaggaaaauggagagaaagagaacacagaccugaucugaguaaaaccacaggaaaacguacuucugguaggugaggucaaugauuguucaauuuuuuucacuuaaggaagcaauucacgucuaucauacaaggcgguuuaucucauacuucaguuugucuuuuauuucaugcuacuccuuaguaaguauuugaacauugaugucccagauuuuuacuaaaaccccuaauuuggauacucuauuaaugagagucucauuuggaaagagaagcauauuggaaaaauguucacucuguuucuacuaaccuaguauuuuauuuuuuucagaacaaaccccacaguuuuugcuuucaacaaagaccccacagucaaugcagucaacauuggaucgauucauaccauauaaaggcuggaagcuuuauuucucugaagguaggguuuaaaaaguacaaaaaagcaccauaaaucauauuuucuuaacuugucuuuggaugcuacaucuuguauuacuguaauucauuuacuaacauauaccugcuuuaaucuuaguucacccaaacaauuaaaugauguuuauguuucaaaagcauuuuagacuuuauaucagucaggaaagcagaaaccauacuagguauuucaaaaaggggacuuaauacaagaaauuggauacaaaaauggaagacugaaagagcagaaaggaaauauugagguaacuccccagaaaguaguaauucaggaagcagcaaccauccuuauggcuaagagacuaaaagaaguucugagguuaccagaaugugggaauucaaagguuggagaggucacagcauagcuguuauuuugacuuuugaggggcacccuacaaagcuaugcuuggacuucugaaggcuaccuuacagagcugugcuuagaccacuaaggcaaaugaagcugguugccacugguaacugagggggcaugacucaguggugcuuggaacuggaggcuagcacuaucguuaucuucugcagcugcagagaugcugaaaagaguuggaaacaagaauaaauuccuuucucuuccugccaccuucccgucucuaaagugccuucaauuggcagaauuuaaagagaaucugagacauguaggguacagaucugaauuauagcaucgcagagcaggaaguagaacagugggccugaaaucaagggacaauaacaaauacagcuuuguguagaaacacagguaaggaaucucccuuugauaauuaggaauaccaauuaaccuacaucagucuguauaggugcagggaacugucuuuuuugugcuguuaaaauacccauuuguuucuuaugucucaugaggggugugugugugugugugugugugugugugugugcauacuuuuuauuuuuuuuugagauggagucuugcucuguugcccaggcugaagugcaguggcgcgaucuuggcucacugcaagcucugccucccagguucacgccauucuccugccucagccucccgaguagcugggacuacaggcacccgccaccacgcccggcuaauuuuuucuguuuuuaguagagacgggguuucaccguguuagcuaggauggucuugaucuccugaccucguuauccgcccgccucggccucccaaagugcuaggauuccagacgugagccaccgcacccagccgcauacuuuuuuuuuuuaggaaaacuagacguuugagguccaggacccucccugccccauaccaggcaugcaguagucauuuugugaaugaauagaguacuuuacaaauguuuucuuuauuggaaaucuguucguuuuuuuccaucaauagaaucuguuucaugaaugaucuuuuguuccuuuaggauguauuagccaccagcacucccauugcuccccuagcagauagcucagaacacuauaagugaucuuuggacaguccuaaagauggaguucaagaggugccuuagccuucaccaucugugcuuccaaacuacuuuauuguacuguucuucugugagagacauauuugaaaauguagaacuuuagaguguuaaaaaaaaaaaggcuuuucaguuuugccaccagggucaaguguuggucugucuccugaucucaggaaagacugugauugugauugucuucagcucugucagaguaagagcuuaguuuaugugucuggcuuuggcuuuauuauaauuuuuaguuuaagcuuauugucuaaauuaucugaacuaacauguccuauuaggugucaaagaugcaaaacaaaguuucccagauaguggggcuuuuagagagagagaguuucugucugcauuucacauuaugcaaaccuaaauuuguuuuagaaucuuaaguuuacauucuauacuaguucuuauaugaauguaaucaaaauacaaagcaauuagaaaaaaaucaucuaccauguauauagugcugcuuuugucucaugaaaaaugugcauguaccugugugauuauuugugcuaaugccauauuuguuggauuaguuuacagcgauagcucuccuuugauugagaagauucaagcauuugaaaaauuuuucacaaggcauauugauuuguaugacaagguaagauuccucuacagcaaagcuaccagucaugugccaucuuaccaauguauucgagguacuugugauuaugaucguaggcacuggagucagacuuccuugguucagaccucaguucugccacuuaccugcaguauggacuuugauuaauuacuucucugugccucaguuuucuuucauuuggagauagagguauaaauaccuaccucaaaggauuguuaagaggcaguaauacauuaauauauuuaaaauaucagaaccaugcuuggcacaaagcuuauacuuaugucauacuuaccauuaucacauauaaacauuguaugcuuucucaaagucuauaauagaaugcucaguuaaugguaauugacuacagaaaagcaauuauuguuuucauacuuuuauauuuuauaggaugaaauagaaagaaagggaaguauuuugguagauuuuaaagaacugacagaagguggugaaguaacuaacuugauaccagauauagcaacugaacuaagagaugcaccugagaaaaccuuggcuugcauggguuuggcaauacaucagguaacuauuugucuuaugcauacuuuugucuaaacuuuuuuaauguuugcacacacaugcacaccuugucuaaguuuaaaggaagauuuuacagugacuguacuuucuauaagagauacuuagcuuuuacgaaaagauguuggcuagaacugagagguugcaguuccguucugaaagauaccauucauucuauauacaacagcuuaucuaaaugaaauauuuaccuccaacuuauuuggauuugcuuaaucuugcuaaagauugugcagaaauuaaacuuugcuuucaagaaguuauacaaucucauagggaagauaaaacaaggaaucaugguguuaucgguuaugaacuuagagcaaaaaagagcaaccuuagauuuagguucuguggcaugaagcaaaccacugagugucccuguauaucaaauguaaauaacaguuuguacugugcuugccugaguuuuuuuucagggucagguaauacaacauauaugaaaacauuuuuaacuuuuuaaauuuuuuaaauuuauuuuuuauuuauuuuuuugagauggaguuucacuuuguugccaggcuggagugcagugucaugaucuccgcucacugcaaccucugccucccggguucaagugauucucuugccucagccucccgaguggcugggugcaccaccaugcccagcuaaguuuuggaguuuuaguagagacgggguuucacgauguuggccaggauggucuugaucucuugaucuugugauccgccugccuuggcuuccuaaagugcuaggauuacaggcaugagccaccuugcccggccaaaaacauuuuuuaggcuagcaaacagauacaugcuucaagguaaugaauagcaaaucucaggacaggcauacacaaagugcuggggcauucagaggggcauucuucuaccucuugccugugcuguccauucaacauagaauccccuucccuucacauggacagauuauuugggccuagcucaguugucugucuguaaaaccuuucucaugaccacuuuucgaaacuugcaugguauuuugucuguacaucuuuaugguccuuaugacaauuacagcuguauauaugcaucuuauuuugccucuuagguugccagcaaacugcuguguacaagugguauuaaauguuuguuuguuguuuauuuauuuauuuauuuugaaauggaguuuugcucuuguugcccaggcuggagugcaauggugugaucuugccucauugcagccucagccucccaaguagcugggauuauaggcaugcacugccacacuuggcuaauuuuuguauuuuuaguagagaugggguuucaccauguuggucgggcuggucucaaacuccugaccucaggggauccacccacuuuggccucccaaagugcugggauaacaggugugagccacugcgcccagcguguuuauauuauuuaauguuaaaugccaagggagugaguauuagguauuuuaaaggucauuuuuauuuucugugucuugauuggucagugaauauagagaaauaggaaugcauuuuuuuuuuuuuaauuaguaucaagaggugaugguuuuggggacuaauguaagggcuuuuaauguuagguuuaguugggacagaaaguagcagacugggaugcuggaguuuuucagcacagggacagcaaaauccaauguaaaacauccacuauaaaguaaguagucauaauuaaauauuagauauuuaaagggcuguuaaaguuuucuguuuuuauucuguuucuguccauaaacuuuauauucucuauaaaaauagaguucuguauaaagaggauguuuuguuuuccaacuucagaguaaaugucuguccuguuuagguguuaacuaaggaccuugaaaggcaugcagcugaguuacaagcccaggaaggauugucuaaugauggagaaacaaugguaaaugugccacauauucaugcaaggugaggaauuugauguauuaaaguauuacuuagaaugggacauugaaggccauuuaagaaugaaaacgcucauuuuauaaaaaugaggaaaucaguaaaaaggacaugaguuccuugccaucucauugaucaucacacugaaauaaacucauugaaaauuauucaaagacaucaugacagauacuuccuaaauaaggaagaaaauguugauuuccuaaccugcagauuuuuguaaacauugguuuuggaugugaacuuaucaagacccugcuguguaaguuuaauaauccauguauggguugaguaucccuaaucugaaaaucugaaaucugaaaugcuccaaaauucaaaacuuugagcccugacacgacacugaaaggaaauguucauuggagcacuucagauuuuugaauuagagauacucaacuaguaauauugcaaauauuuggaaguccaaaaauuccaaaauacuucuggucccaggcauuuuggauaagggauauacucagucuguaauacacuaaguguucuuuguuaaauuauuagguuuuuguuagauacaagggaauaaugaaauuauuuuguuuuucuugaauucaucuuuaagauuuuaaauucauuagaagaauucauuauaagguaaucaucagcauuuuguuuuucuuuuccagaauuuauagaagaaaauuuccuagcaguucuuuaaaaagaacuuagaaacccaaagguuuuugaaucuguagauuuuccuuuuggcauuauuuuuuuccuuaaauuucuuuuuucuuuuuuccuugagaacagccugugagacaagaagaaaaaggaagauuuaguguuguuucuuguuaagaaugguuuggcugggcacgguggcucaugccuguaaucccagcacugggaguccgaggcaggcggaucacgaggucaagcgaucgagaccauccuggccaacauggugaaacccugucucuacuaaaaauacaaaaauuagcugggugugguggcacacaccuguagucccagcuacucgggagacugaggcaggagaaucacuugaacccgggaggcagugguugcagugagccaagauggcaccccugcacuccagccuggcaacagagcgagacuccaucucaagaaaacaaaacacaacaagaaugguuuaauucuugugauauuucugauauaucgaagggaugauuugauuugagaauuccauaguugcuccuaaaaggaacuugugaaaauauaaaaaacaucaauuuucuguucauuacuuccuguuuugucuuuaggguguacaacuaugagccuuugacacagcucaagaaugucagagcaaauuacuauggaaaauacauugcucuaagagggacagugguucgugucaguaauauaaagccucuuugcaccaagauggcuuuucuuugugcugcauguggagaaauucagagcuuuccucuuccagauggaaaauacagucuucccacaaagguaauacguucuuuaacugcuucuuuauuuaucuugguaaagaaggcaaaucagaauacagaaaacauuucccaguguuucugaacacagagcuuauuuuuauuuuuuauuuucaauuuucugcuuuuauauuaugaaauacuucaggguaagaaaaauacagaaauaaauaaaacauuccacuacucaucaccccgaauuuacauuuuucagcuccggacacauuuuuuaaugauauaaagcauuacuggcacaauuagugucuguuuuuuaccuauaccauucccagggaugaucauuauccugaaguuauuauaauaugcaucccuuccauucauauuucuguugacuucuagguauacacaccaaguuuuuuuuccccuuuauuucuucuacuauuuagaagugauggguuuuuuaaaucuuuauuagccuuuauuaaacuggauuuuaaaacuauagaaaagugcagagaauaauguaauuaacauuuaucuacucuaugauuuggcaaauauuaauauuauuuuagcuuaauuuguaacaaaaauaugguuauauaaaguugaagucuuucuguucucaguuuuauucccuuuauuugcucccuagaugcaaccacuaugcugaaauuggcauguauucuucaaguuuacauuuuuauucuugacuacauguguagaguuaguuuuuuguauuguguuuacguaaaugguauccugaauguaacacgcagcuguuuuuuuauuugguuauuuuguaguucuaccuauuuuaauacauaucaaauucuuucauuuuuacuauuguggaguguugcuuuaaauaaauagccacaauuuauccauuuuccuggagguagacaauugugcucuuuccaguuuuuuauaagaacaaaugauacugcagagaacauucuuguacaugucuccuuagcagaggaauacuaaguuguaggcuguacuuuuuuuuuuuuuuuuuuuuuuuuuugagacggagucucgcucuguugcccgggcuggagugcaguggcgcgaucuuggcucaccgcaaccuccgccuccuggguucaagcaguucuccugccucagccucucgaguagcugggacuacaggcacgcgccaccaugccuggcuaauuuuuguauuuuugguagagacaagguuucacuauguuggccaggcuguucucaaacuccugaccuggugauccgccugccucagccucccagagugcugggauuggccggcuguacuuauuuuuaacuguauuagauguuaccaaauuacuuuccagaguauuguucccaacuuaaaucuuugcugguaguguuaaguaguuaccauuucucugucuuuucauuaacacuugguauuguuagacuuguacauuuuugacaguuuguuagguauaaauaauacugcauuuauaaugugaauuuuucugauuucuguugugguugagcaucuuuucauaucuuuacuggccauucaguuucuuuaucgaauuuucuauuuauaucuaauguucauuuuccuguuuauugguuuauucuuuaauuuuguuuuuuagagauggggucucauucuguugcccaggcuggaguguagugacaugaucauagcucauuacaaccuugaacuccugggcucaggugaucuucccaucucagcuucccacguaguugggacuacaggugccagccacugugccugguucuauuaguuuauugauaggaguucuuuauacauucuagauacuaauuauuguugauuauauacauuagauauuuucucccagucuuugguuugucuuuuaacuuuguggguuuuuuuguuguacaguuuuacauuuugacaugaucaaauuguugucuuuuccucccuaauuuguauauuuuaugcccugcuuaagaagccguucuucggcugggcuugguggcucaugccuguaaucucagcacuuugggaggccgaggcgggcagaucaccugaggucaggaguugaagaccagccugaccaacagggagagaccccaucucuacuaaaaauucuaaauuagccagacgugguggcacaugccuguaauccaagcuacucgggaggcugaggccggagaaucgcuugaacccaagaggcagagguugcagugagccgagaucacgccauugcacuccagcuugggcaguaagagcgaaacuccgccucaaaaaauacauaaauaaauaagaagcccuuuucacucaagcauuauaaacauauuuccuacauugcuucuaagaauccuaaguuuuguuuuuuaucuuuagaucuuuuguccaucuggaauuuaagccauuggugaagggcauaaaacuagggauuuaagcugggcaugguggcauaugccuguagucccaacuacucaguagucugaggcaggaggaucgcuugagcccuggaguuugagacuagccugggcagcauagugagacccccaucucuuaaaaaaacaaacuagugaucuaauuuuuaggugaaaagcuauuuauccugacaccauuuauuaauuaagcccuuguuaccauggauguauaauguuuccucggugguacccagagucaucguuaucaccauugggcuuuacuaaauuuaacauuugcuaaauuuuugcucaugugaaggguugaauccuuagugagguaaauagucccuugaagaauuaaaaagggaaacauaagauguuuauguuugaaauuccuaaggcuucuuucucugacuggaagaagaggguaugugagauucagcuauugguucugaauaaucagugguguugauagauggguuucaucugguguuugucuuggcuuaagguucaagguauaaccuuuagcuuagaggccagaauuuaaauccugauuuaaaccagauauuuucuuccuuuuauuuugaagacggggucucacucugucacccaggcuggagugcaggggcaugaauacagcucacugcagccuugaccuccuuaaaucagauauuuucuagacaguauuuguucaggguauuuucaugcccccuaauaaauuagguaguagcauugacucaugugugaugucgugaagagguccuccauuugucugaacuguggggcuuugaagugacagaaagauggcuguuucaguugaucucuauucccgccacuauuguugcguaacacaucacuccaaaacucaguggccgaaaauaaagccaaucauuuuauuaguucucaugauaucuguggaucaggaguuuggaagaacuacucaacuggcuaguucuggcuccaggccucucauggaguuguagucagaugguggcuggaguacagcaagguggcugggggcuggccaggcaucuucuucuccauguggcugugugggcuaguuugggcuucuugcacacaguauagcagcucaggcacucagucugcuuauauggcugcugacagguucaggucaagaagugcaguugguaggcagaaauggccuugccuuuugugagcuagucucagaagucgugcaacaucacugugucacauucuguugguaacaaagugagucccaggccuucucaaauuccaggagaaggaauuagccuucauuucuuuuuuuuuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucucccgaccucaugauccacccgccucggccucccaaagugcugggauuacaggcgugagccaccgcgcccggccuucauuucuuaauggaggaguagcaagguucuaaaaagucuugaagauaaauauuguugcaaucauauuuggcaaauacagucugccacagucugaauuuauaaaugcuucuugagauccaaacaccaaacaagugccuguguggcauaauaaguauuacacucuacagaaagugcaaaaggagccuagaugagaaagcuggggauuaaagaaaacucuggaaagccuuuugaaaaggagaggauuggcauugggcaugugggacagaaugagaggguuguugaaggagcgagagguggcaugggcacagaggaagcaauaagugcuucaugugggaggcaagcaaagcaccuugcauacccauagcaggauacgaacaguaagugagaaggaucaauuggaaagugccucaaaagcugucgauauuaaauuguugcaggaggaaauagaaagucauuaaucucucaguggauuuuacuuuacuagcauccugagaccaacuuuuaaaacaauauuaaaugaaauguuuuaacugaauuuuccugaggugugauuauaguuuaucaaaaucugaaugugaauuacuuuuguuucauucaguguccugugccugugugucgaggcaggucauuuacugcucuccgcagcucuccucucacaguuacgauggacuggcagucaaucaaguaagcgaucagacuguuacauaaaaggcaggcuuuagaugucacacuguugagaaaauccauaauuuuacuguauuauauuguacguuuuaucuaaaugacaaaguguauaauaguguauaauagaugguuuauuugaugaagaguuuguauguuaaaauaauucuuuuuuuuuuuuuuuuuuuuugagacggagucuugcucugucacccaggcugcagugcaguggcgcgaucuuggcucacugcaagcucucccucuggguucaugccacucuccugccucagccuccugaguagcugggacuacaggcgcccaccacaaugccuggcuaauuuuuuuguauuuuuaguagagguuuaguuuagagguuucaccguguuagccaggauggucuugauuuccugaccucgugaucugcccgccucagccucccaaagugcugggauuacaggcgugagccaccgcuccuagccuaauugucuuuauuugaaauuuauucucugucagauuccagaaaggauucauuaugcaaauauuguguccuaaugagaaauaguugauuuuauaucucaauuaugugauuaauugaacuggauauaggccauaagcaaagcugugugcuucauuccauauugagcugugauagaaauaauauuguuuugaaguuuucaaauaaagacucccuuugaaauggcauguuucauuuuauguucucaauguugcaauggggcauuuuacuauaggguuuuuuaauagcuuuuuuuuuuuuuuuuugcaagucagaguuuucuuuguguauguguuuuucaucccauaauugauuacauuuuuucuagcuguagaucuauagcucaucccuaaauauaaaauaaugaaugguuuugaagucagugcucucuagcaaaccuggcugaaaugagaugguccuaagaacuaagaaccuagggaaaagauaagaugaucugcugcuaacugcuucacccccuucuucccugaaaaauuaagaccaacauauauaauaauuaauuguacuauagugagaucuuuacaaacaccccauuuuauaaaagaggaaaugguuaagacucuugaguaugaucguguggccuaugaguaugguagagccugauuuccaaccuagucugugggacuuuuaccacuuaagagggacaaaggguuagucuggagguaguaaguuauuucaguugauuauucacagucacuuacagaucaaacuucuuguucuacucuuuccucccuucucacuacugcacuugacucaucuuaaaaaaguggguguggggggugaauugauugugaaguggugagugaucuuggagcaagguuugaagucgugcagguuagguggaugccagcgccuggcccaugaccugaaaaacauugagagguagucuagauguaugaugaauguauuccaaaguuauuauuuuaauguucaaugauuguacuuacauuaauuaaguaaaaaaagcuuuaauaacaugugcauguuuuuaaaaauucaaucaguguggaaaggcacaguccccacaacuugcuguuacauuauacauaacuuuagauaccauucuugugucuuucauccuucgcuuuacugcagucauucuaugugagcugaggacauuagaaacauacuuguucuuuuaucuucuagacuuucuccguuccgacauuacuuuaaauugucaagguuuaccuuuugucuucuaauuauaauugucuuccagaguuuauuuauaggucaugucuaacaaaaacaauaaacaggcauuuacauuuuuauguuaauaaaaaugcccgauauggcauuccccgggauaaauaauaugagcuucugacuucucccuccaucuuuucuacuccuacuugcgucuucaguggucgaagccagugcuggaacuggcuggacaguuuauccccccuuagcaaaaaaccuagcacaugcacaagccucuguggaucugaccaucuucacguuccacugucucuuccauuuuaggggccauuaacuuuauuaccagaauaauuaacauaaaaccuccagcuuugucccaauaucaaacaccccuuuucgucugguaaguccuuauuauggcgguccuucuacuccuuucccuucccauuuuauuaacauaaaaauguaaauauagcucaacaaagaaccaaaugaaugaucaaaugccaagcaaaggagcuguaauuuaugucacuggguuuuguuuuguugguuuuuaccccuuaaaugaaaaugacucaagcaucaaauuaucuuuucuuauacucugcuaguuauuuggaauuaucccacauuuuagugugcaucauauuuggacuguaacuuugucauuuaguacuuuauuuuuccuaagguuucuaagugcugguuuuacuucuuagaguaugccuguaccauuucaccauaauuuuccauucucucuucaauauacuauggaauacauggaauccaccuuuuauucuuaaaaaacaaaaacaaaaaaacacaccuuccuucugcuugagucuggaucaguaguucuccagaccugcauuccugcuucauccugggaucuugcuucauugcauuuuuucuaaggaauauucccaaguaaauuuucagaaaguauacaggacagguaaaaaguucuaagcccuugcaugucugaaaaugucuuuauuuggaucuuagucuggcuaagaguuugcuagcuauugaagucuauuugguuuuaauuuucucugcuguuuaugagaggucuggugcucaucugauucucauuccuuugaggacuggacuuuuccuccucuuuguaaccauuuuaucuaucaugcugugaaacagugaaaguguaucuaguugucucuauccugcuugauuggcaggaucuuuugucuucaacucuagaauaucugacugauuucucagcuuccuaucagaugcauugcuuggauuauuuguuuuaaguuuuuccucauucuuucauuuucuuuguucuguuuucuagauuucuuuggcuuuuucuuauaucuucucuauaaaugcuugauuuuuauauacaugcuuuaaauuuucuugauuuuguacuuguuuccccauuguucccuuuuuguaguggcuuauuccuguuuuaucauggcaauauuuucucaaaacucuuaggcaguuuguuuuuaauacucccugaauuauugccauuuaauuuucaaaugucugaugaggaaugagaaaguauuugaaguagguaggauagguuuccuuugcaauuuuuuagguaguaguuuuuucucacaagacuuuaccucuaaauacaaagauagggguuugggcuaucagauuuugcuuuaugaauguguuuuugaauuggaauuggguuucucagaugguagaaugaagagucuuuauucugaagcucugauauucucacugcacaguuuagcucccuucacagaggggauggguuuguuuccuuagaacagugcucugguuuuugccagaugauaaaguacgcauucuuccccuacccaccuguccacucaccuucuccaaaaauucucaacagcuauuccaugacuugucuuucgguugauuacuguuuucuuccagccaucuacuccugcucucuauuccugccacauccaacuuggaagcuucucuggggcucugcuaagaacguugggucccacuuugcuuguacgcuuauagcuuuugcccauguguauucuggacuuuauuuuguuuuauccaucaauacuuuaccauuugcugguuucaaaaauuucauuaauaucucauuugcugaugauaccucuacauacccccaaauuuuuagugacucauuuugguggacauuuuggagggaggcuaggcaaauacauauguucauuuggcuaucuugaauuggaaacugcugaaguaauuuuagauauaccauuaaacuguuaauaagcaaaucugcuuuuaucuuccucagcaucaugugaacccugaauaguuaauaucuugcagaaaccauccaaaguaaguauucuaacugaaaacuauuuaaacuuuuuagaauccaggaauugaugucugaugaucagagagaagcaggucggauuccacgaacaauagaaugugagcuuguucaugaucuuguggauagcugugucccgggagacacagugacuauuacuggaauugucaaagucucaaaugcggaagaagguaggguacaacucuuuucauuauuugucucucaauaaugauucaucaacguucaucuuuucuaagaugcuccugaaccucaaauaauuugaggaauuucuuguugcuuacauaagaugaaacauucccuuuuaaaaaaacauguauuuguagcucccuaugacuuuguuuuauauucuaguugagucauuguagggaaaaugaaaauaccaacuauuguauuuaacacuuuuaauuuacagguucucgaaauaagaaugacaaguguauguuccuuuuguauauugaagcaaauucuauuaguaauagcaaaggacagaaaacaaagaguucugaggauggguguaagcauggaauguugauggaguucucacuuaaagaccuuuaugccauccaagagauucaagcugaagaaaaccuguuuaaacucauugucaaguauguaugcugucauuugaaauuuuauuacauaaaugcacguuggggguucucuuggcuacagguaacaaaaaacuagucaaaauggucggcaaacuacaguccauguaccaaauacaguacuccauccccuugaguauggccuaugaacuaagaaugguuuuuauauuuuuuaaugguugaaauaaauuaaaagaauauuucacaacacaugaacuuauaugaaauucagauuucaacuggauaugguggcucacgccuguaaucccagcacuuugggaggccgaggcaggcggaucacuugaggucgggaguucgagaccagccuggccaacauggugaaacccugucucuacuaaaaauacaaaaauuggccgggcuugguggcgggcgccuguaauccuagcuacucgggaggcugaagugaagaaucacuugaacccgggagauggagauugcagugagccaagaucgugccauugcacuccagccugggcaacaagagugaaacucugucuuuaaaaaaaaaaaaauucugauuucaguguccauaaauaaaguucuauuggaacauagccacacucauucauuuacauaagugugcugcuuuugugcuacaguggcagaguugaauaguugugacagagaacauauauauggcucacauauuuuugcuuuauccuuuuauagaaaaaauuugcugaucucuaguuuaaacaauacagaauauuuacuaucuuauacaagaaguuugucacucaacggaagagugagggaacagugaauuccaaagccauuucaauuaguucuguguaggguguugcucauagagauucaaaucgaauuaacauauauucaaaaaguauuugauaauuuuauuuccaugcuauugccaugccguggagaagcagcaaaguauaggcauuuuuugcuuuagugguuaagagcuuuucuuuggagacaaaccuaaguuagacuccugcuuugggcauuuacuuccagugugaucugggacauauuacuuaauuuccccuuuauuuguaucaccuuaaaauggaaauaauaagacuuaccucagaagguuguucuaaagauuaagugggauuuuauaauguacuuaacauaacuacugcaacauacuguuacuuuugauaauuuuuugacaacugugggguaauuuugaagaaauaggagaaaaugagagagacugaauaauagauauaucuaagagagguaaagaacugagaacguuuugaaaugcauuguauuauaaaaagugaucuuggccaggcacaguggcucaagcccguaaucccagcacuuugggaggccgaggcggguggaucaccugaggucaggaguucgagaccaaccggaccaauauggugaaacccugucucuacuaaaaauagaaaaauuagcugggcaugauggcaggugccuguaauccuagcuuccuggguggcugagacaggagaaucucuugaaccugggaggcggagguugcagugaucugaaaucgcgccacugcacuccagccugagcaacagagcaagacucugucucacaaaaaaaaaaaaaaaaagugauuuugucaugcuuuucuguucaguaggcucaggucuguaagaggauuugaugcuuuuucuuucuggcuuuaauauguuaauuagcugacugaguaaagaauagugcuccacagggguuuuuuguccuuaaauccuacuucccucugaauaaaagccauucagacccacccuggaagagaggcugcucuaacuuagcguugcugggguggucuuggagugaguccuuugagcagguggccaaggaagcaaccuggucgacaauccaaacaucuuugguuccucuuaacaguuguaaauuaaaacugaacauuuuuaguggucccucuucucccauacuuauagaagaguaaguauggaaaacuuuaguuuucuucccacaguuugcuuuuucccccuccauguuugugauuucagcaucaaaacuagaauuuuucaugguccucuauuaucagucuagcagagauuggcaaacuaggcaggcugccuguuuuuguaagucaaauuuuauuaaaacacagccccacccaguuuacuuacauuacuguucacaguugcuugcacacuacaaguugaauaguugugacugagacaguauagccugugaagcugaaaauacuuucuggcccuuuaagaaaaaguuugucaacccagccuaggugacaguagaaguuuauguuuuaguuuagguuccuucagaagcaaugauuuggaucaacauaguuuacuugggaggugauucuggaguuacugguagggaaaugauggcagccaguguaggugccuuaacgaacaggugacccacuagcaucugggacauaauccuccugggccaguggaaaacuccacuguggaaagccagcuucaguauuuuuccauuuaagggccuacauuugggacugcccccaggaguauuaaacaccucagcacuucuggccugcccauccugccugccaaugaugcuuguguggccauagaaaggucuuuggcagacaggugcagaugccaguaggaagccggaacauacugaacagugagugccaaggggauaugagcacaccaccaccuccuucuguguuuacauauauuaaaagggaauaaagacucauguuuuacuccugauuuucucucccacccuauuuuuguuuguuccuuguuuauaaaauugacaaauguaaauguacuguuuuauauucuuucucuuaauuuuuuuuagagacagggucuugcuguguugcccaggcuggauugccguggcacaaucagagcucacuguagcuucaaacuccuggccuuaaguuauucucccaccucagccucacaaguagcuaggacuaaagguguaugccaccauggcuggcuaauuuuuaauuuuuuuuuuuauagauaucggggucucacuuuguugcacaggcuaguuuugaacuuuugggcugaagcaguucuuccaccuuggccucccagagugcuugcugggauuacaggcaugaaccuguaaaccaaaaauaaaauuccaaggccccccacccauuuaaacagacuuccuucucagccagggcucuuaagauuuaaccugaaagacugauucaggccacaaagggaagugggggucagacaugccuuauuauaccucucuggcauuaacaucaacacagauuuuaagucuaauaagaaacauuuuacagccuguucucucugaaaccuguuagccaaagcuucaucugcaugauaaaacuuuggucucuacaaccucuugcaucccaaacauuccuuucuauugaucccaggucuuuagacaaacucaaccaauugucaaccagaaaauguuuagauuuaccuguaggcuggaagcccaugcuuugaguuaucccaccuuucuggacuuucugguucuacaaaucacugcaccuggccucauuuucuuauuuaauuugaccuuuugacuugaacugaaaaaaaugaaauuuuaucccaucuuagaguauuauauacugaguucacuucucagucuccuuucagugacuuggcugcacagucucaagaugucuguucacauaaaauacaauauaaucccguauccuaaaauggaagaccaugauugugacgcauuuuaaggcuaguuguguaagaagagcaacauuguauuuaguuacuuuaagaugcuuugcaaguauccucuguuccuuaugcagaguuuuuaaaaaauucuaaccuuuauagauuaaccaagaacuuugagaaauguacuguaagaauaaaauuucaguugaggggauguaaauuuuuuacauuugucuuuguugauauuaagcagguuaaacaaauuguagaggagaucuccuaauggaucaaugaaguauaaauuagaauuuauaaguuguguucuguuuuucagcucgcuuugcccugucauuuuuggucaugaaguaaguauuuuacuucaucuuuacucaaaaaguauauaagguuagcaaaaauaacauauaaaaacuuuacagaaaguagcaaauuucuauuggccaguuauuuauaucuuaauaugcuuuguaaauuaaugauaugggaggcaagcaaacuauagcuuuuuuuuuuuuaauuuuuuuaauuuuuugagacaggguuuugcucugucacccaggcuagagugugauggcacagucauggcucacugcaaccuccagcuuuggggcucaggucauccuccugaccucagccuccugaguagcuggaacuacaggcaugcaccaccaugugcagcuaauuuuuuuguauuuuuuguagagaugggguuuugccauguugcccacgcuggucuguaaguccuggccucaagugauccacccaauuuagccuccaaagugcugggauuauaggugucagccguauagcuccuuuuaagaaaaaacuuuuaccaacuagaguaaauaugaaugggcuuuuauuuuauuuauuuauuuuuuugagauggagucuugcucugucgcccaggcuagaguacaguggugcgaucucagcucacugcaaccuccaccucccaaguucaaacaguucucccaccucagccugccgaguagcugggacuacaggcaugcgccaccagacccagcuacuuuugguaagaaaugggcuuuuaaagugacuagacacugccaguauuaaagcaaaaacaaauauuucucguuuuuguggaauggauuuaugccuugcaagguagcucuuaguaauuucuaagauagcucugauuuuauauguuuucaaguuuuuacuuuuuaaucauuuacgugauagaaguuuguuuuuagacuuccuuuucuuagaaaaaaauuaucaugcuuuuaaaacaauccccaaacaaauuaauauuauagaaggaggaauacccccuuuacuagucaccuuuauguuuuccuuacuucuguuuuuuguucuuuuuucgcacuugagcuuguuaaagcagguuuggcauuagcacucuuuggaggaagccagaaauacgcagaugacaaaaacagaauuccaauucggggagacccccacauccuuguuguuggagauccaggccuaggaaaaagucaaaugcuacagguagacaaucagucauuuaguguuuguucuuuugcuuguaaaaugcguuaauaauucacaagugaauuuucucaaagcauguaguguguguguuccagaggacaugguuagguggcguaaaugaauuggaauuugugugaguaauauguaacuuauaucugaccauauuuuuaaauugagccagucuccuguuacagaggcuguacaaacaucuuggucuguugagacaucaacuauuaggaaauauuaaccauuucucuaaccauuguuuugcuagucuuuguuguuguuaguuguuaugugaccucaccuaugaacagaauaguucaggggaguuaaagcagggucaccuauucucccucauacaaguacauaaacacuguauugggcuuuaagaacagucugcuaaaggugugggaucugucuguauauaucuccacugcuugugaguccaaaucaaggcaaccuuuuuuuuugagacggagucacacucuguugcccaggcuggagugcaguggcaugaucugggcucacugcaaccucugccucccacuuuuaagcaaucccugugccucagccuccugaguagcugggauuauaggugcgcaccaccacgcccagcuaauuuuuguauuuuuaguagagacaggguuuugcuguguuggccaggcuggucuugaacucuuggccucaagugauccacccaccuuaaccucccaaagugcugggauuaccggugugagccaccacgcucuguccaaagcaaggcaacugcugugaucagucauuuguagauccccaagaaaauucugccucugccagucagagccuagugguuuuccuuuccuggguuuuaugauggcuuuagaaggugcugcuuauugguaugcuuguaguuuccuuaaagugacaaccgguaagccagccguaaugugcuuucuacuuuauuuuuuugagacaaggucuuccucuuuugcccagacugaaguacaguggcgcaacuuuggcuuacugcagcuuccaccuugggcucaggcaauucuuccaacucagccucucaaguagcugggacuauagacaugugccaccaugccuggcuaaugcuuuuuuuguagagaugggguuuugccauguugcccaggcuggucucgaacuccugggcucaagcagauccaccugccuuagccuuccaaagugcugggauuaaaggugugaaccacugugcuuggccacugugcuuucuaaaaaugccuguggcccccuucuucacucgauguggaaaauugaccagggcuucucuggcccuuuaguaaguuguaguaguauggcuccuaaaucuuuuuccaaggauugggauccuggcugcacaucuuaauuacuuuuggagcucuuugaaaauaccauagcccacugcaagccaauugaguuaagaguuucuaaguuaggguccuagugucuauauguguacaacaguccacagaugauucuaauaugcagccagccuugagaacugcuuugaucuugucauuacauuauaaacccacuguccuucauaucugagucauccuuuauugccugugguugaguguuaaaccagucauuuuaauuccuagauauuauuauaauuccauagauauuucaucuauguuugguuccuuuuggccaucuggggcuacuuuuuaaaaaauaaauucuguucugagaccucgcuacaauguagccugacaacagaggcucaggguaccccuuacaggugaaacaaagcucaucaugaacaggaaucugggugcaguggcuuacgccuguaauccuaacacuuugggaggccaagucggaaggauuacuugaggccuggaguucaagaccagccugugcaacaaagugagacccuaucucuacaaaaaagaaaacaauuagcugggcaugguggcgcacaccuguagucccugcuacuccggaggcugcagcaggaugauugcuugagccuagaaguuggagaaugcagggagccaucguuaugcaacuguaccccagccugggcaauagagcaagacccugucuuuaaaaaaaaaaaaaaagaaaacauuauguuuagaauauguaggaaaagaugcaaguggggaucugaauuguuacagcuuucuuuucugucuuuugugugguauaccuguucguguguguaacuuuggaauuagugaauuauaggugggagccuguuuuaaccccuagagugucuuaucuguacaaaucucauaauuuauacauacugcuugcaguauauaaaacuuccuuuuuuugcucuuuuuuuuuuuuuuuuugagucggagucucgcucugccgcccaggcuggagugcaguggcaugaucuuggcucacugcaagcuccgccucccggguucacgccauucuccugccucagcgucccaaguagcugggacuacaggcgcccaccaccacgcccggcuaauuuuuuguauuuuuaguagagacgggguuucaccauguuagcgaggagggucuccaucuccugaccuugugauccgcccgccucagccucccaaagugcugggauuacaggcaugagccaccacgccuggccuuuuuuuuuuuuuaauaaauguuucuuggcagauaguuguucuaaaauguguccagugguauugaaaguguuaauaccaagaaguuacauuggcaguuuuucuuguuuucagaccuggaauaaugccuuuggcucaauuuaaaaauagaaucuguaauguuaguggaaauuaaacauccugaauagaguauggcauguaagccacacuaagccaggguuuuuaaaaacgagacuaacaggcugggugcaguggcucaugccuguaaucccaacacuuuggcaggccaaggcaggaggaccaagcuggacaauauagugagaucccaucucuaaaaacaauuuuaaaaaaaauuaggugugguggcaugugccuauagucccagcuacucaggaggcugaagugggagaaucacuugagccuagaaguuuuagaccagccugggcaacauagugagaccuuguuucuuacagaaaauuaauuagccagucaugguggcaugcuccuauagucccagcuacuagggaagcugagguuguuguaaccaugcgaguuauagagaaacgccacacuuugagacaaauuaaagaguccuuuauuagccagcgacccagagacagcucacgcccaaaauucucucagccccgaggaaggggcuaguuuuguuuuuauaccauggucuaaauagggaggggggauuuuagcugaagcaauuuuuacagaagcagaacuggcagaaaguuaaaaaaauuaauugguuacaaaugcaguuacaaaaaaauaaacaguuccagguaccggggcuuaaacuaucacaaagagauaaauguagggguuuugggugccaugcacugcgcgugcccccaggagcugcuggugcaacucgccucagcaucucaucaacaggugcauuccuggacgugcuuugagucaguuuuacacuagcuaugccuggagggaggugaaaggguuuacaagugaagaagcuaaaauggagucuguccggcucucucucugcuaggagagagucacucggguuaaaacaagguaggauaucacaaggugggaugaucacuugagcccaggaguucaagguugcugugagcuaggauugugccacugcacuccagccuggacgacagagugagacccugccucaaaaauaauaaauauaacaaaacaaauuaaaaauuaggcuaacaccaacuguuaugaaccauuuacuuuauauuuuuguguuuucuucuuaccaccuaguaaaccaucauacucuguguguuauaagguuucucagaaagacuauauaaguaacaaaaauaaugauaauuacuauuuauugagccagcagcauaggauaacaguggguguuugagaugugaauacuguccccuagaauugggcagugcacugccauacacggcaguuuuacauugggcacuuaugugccagguaccaaauuaaaugccuuucauacaugauuucauuuauuguucagggcaaugcugugauaaaacauaaggaagcugaggcucagagaggucugagagccacacagcuggugcaugguggagccacgauuuaaacaggucugucugacuccagagagcuaugcuuuuaacucuugugcuguuuacuuuucuggccuguuauagcauguuugcucagaaggugagcauguauuaagucacuuuauuaccugauguuuaaagaagcauuggaaccuucaaaauuaaaauugguacucauguuuuugcuuuucgaacuugaaaaugaagcauaaauuggaauuguguugaguauuuauaugaccacagacuucagaaucugacugccuggguuugauugaauccugacuuuccaccuugauagcuguguaguuccucauucacucuuuguuggccuugguuuugacaucaguaaaucaggauauaauaauaccuuucucugcuggugauggugcaccuuguacacuaaagcucuuaaaagaauaccuagcauauaccuaacguuugugagcaacugcuguuagcuauuacuucccuuuuacuuuggaugauucucuuaaacuuuuuguuuccuuaggcagcgugcaauguugccccacguggcguguauguuugugguaacaccacgaccaccucuggucugacgguaacucuuucaaaagauaguuccucuggagauuuugcuuuggaagcuggugcccugguacuuggugaucaaggugagaggccaaagggaauaauuagugauucugggacuuuuugaaaagccuuuuccuuuucaguuaauuucuuuacauucuguuuaagagaaacauuuagauagcaaaguccuaaccaguaaguugacacugucagaaauaaucauuggaaaugcaguaucaucauuuuuauacuacagaauuggaacuguacuuaaugucauucauuuucagaaucuuauagccgauacaaguauauguaaaaaucaaauaaauauguguagcucccugaacuucccauuucauaccaccuaucauauuugugaucauuuuuuuuaaaagccuguuuugaagcuuuguaguaagcucccuguauggugggauuuggaugucuuguggacugccauguucccauugccuaguacauaggggcacaguaaauacuuauugaaugcguuacuaugauuuagcucuaaauaguuuggaaaccuuggcacugacaaaaagguggaugucauccuuugcucacagaggacuugcaauaggagauuacagguguuacuuucgauguuuuuuucuuuuuaugagacagagucuugcucugucacccaggcuggagugcaguggugcagucucagcuuucugcaaccucugccuuccagguucaagccauucucgugccuccugaguagcugggauuacaggugugcgugaccacauccagcuaauuuuuguauuuuuaguagagacgggguuuuaccauguuggccaggcuggucuugaacuccuggccucaagugauccacccaccacaccucccaaagugcugagauuacaggcuacaggcgugagccaccacaccuggccuacuucagaaugaauaguuuugccguauuguaacugaacucauugguuuuuuuucaggauuugagugacaggugguaagaaguccaggcauagggcccagcaagaagaaaccucuacauugggcuuugucaccuaaguuucucuuugugaugccuucaccuuauugggaaaacauguuuccaugcaugugucaggcaguguccagauuccaguccaguuaaggucguucauuccuucugguuugccagugacuuccauauucugaacccaggaccugguagccacauuugacacaguuaaucacucccuccuccuugagacccuugaaacucucauugguuuccaggccacuuuacuucauucuuuacuucuuucucagucguuuacugguucuucaucuccacaaccucuuaccuguuguuaacuaaggugcuuaguucuuggaccuuuugucuucugggucuguauuuaccuucuuggugaucuuguaucguuucauuggcuuuaccuaccuauccgugaaaaauucuaaauuuauaaucucguuucccuuaaauaucaggcacauacuucuuauugucuacacaguaucuccacaaauuucucaaacuuaacaugucuaaaauuaaaauccugauuuugccuuucaaaucuauuuucacagucuuccucaucucaguaaaugacaacucucauuauaauugcucaaaucagaaaacacggagccauccuugacuuuuucucauaccccacauuaaucugucagcaaaucuuguuggcuguaccaucaaaauauaucugcuaucuaaccacuucuucauuacccugguccauggcaccaucaugucucacauggauuauuacuguaaucuccuaauuggcaugccuguaaccacgcuugccccuuccuguuguuuuuaauacaguaaucucauuaaaaauuagauuguguuacucuugcucauaacccuccaguaacugcccgucucgcucagagugaaagccaaagucuugagaguggcccagggccauucauguucuggccuuucaccucuuuugccuccuuaucugcugcuucccaugucuccucuucucuagcuccauugguggcucugccuuggacaccaccagcacaccaggcacgucacauuuccucauaagggccuuuguacuuacuguucuguuugccuggaauguucuuaccccagauagagcugcaaaggcuuguuuucuuucccccuuaauguuuugcugaacuguccugaccccagugaggucuucccuaaauaccguauuuuaacuuauaaccuccccugccccugcugcaccuuagcagaccuuauuuuccuuacccuaaucuacuuuuuccuuccauagcacuuuuuaccuucuauauuguuuacuuuuuuauugccuggacccccuauuggcugaguagaacauaagcuuccaagagcagggaauuuugucuuuucagugccauacucggcauuccuagaacauaguacugguauauagaaggcauucaguuuauugaauuuauaaauuuauugcauuuauaucuaguaaauauuugcugaauaaauaaauaccaaaaacauguaucucguuauuauauagcucaucagaagugagaauaucuuugcuaaguuaccagguaaaauauaguaauaaaaagaugauacucaugaaaccaugcaacuucauuaacuagaaguagaaggugauuuggagguuuuuuaaaaaaauuuuaaugccagcacuuugggaggccgaggcaggcagagcacuugagaccaggaguuugagaccagccuggccaacauggcaaaacccugucucuacuaaaaauacaaaaauuaguugggugagguggcgcaugccuguaaucccugcugcucagguggcugaggcacaagaaucgcuugaaccaaggagauggagguuguagugagacaugauggugccacuguacuccagccuggguaacagaacgaaacucugucucucaaaaaaaaaaaaaaaaaaaguucaaaguuuauguuuuaugcuuuaaaacaaggggucauuaaacuuugguccauaggucaaaccagccaacaguguguuuuaguacaguccacaagcuaaaacuggcuuauauauuuuuaaaagauuguaaaggacaaacaaacaaacagaaaagcccaagaauauguaagguugugcauggccugugaaacuuaaaauauauacuucugcacauuugcagaaaaggcuuaccagcuccugcuuuauacuuugaaaagugacagccaaaguaggaaguagcuugacuuuguuccuaccccaucucugaggaauugcauuagcaaucuugauaauuuccaguaauaccaugaauccagagagguauaggcagacggagcaauaggcagcucagggaaagguggagauaaagccugugagucuaccacugcuaggaucuuagcacaggcagggaaggcucacuaugucccagagcuccacauugaacagcaggaacaggcuaaugcacugggauccccugccaugaauaugggacacauucccaacagaggggggugaacucucagaagagaucagcaagaaagguggcacaaaguucaacaaagccccccuugcuucccccuccuaaaucauuacguuaccaaaaagugcaaacuguagcuggaaaggaaaaaaugggucaaaauuacauugggaaaagcguauugacaagaauucauauauacugugucggaagaaauagguuuggacagagcagccguuauuauacaugagcaaggcaaagagacagcauagcagcugugaagaaauaacguaggaagaaagaaagacauuuaauaugcccaguaaaagaccucacuguagacaaaauuauaaucuaaggaacaaaugaaaauuucccaugaguguuucauguuugauaagaacauuaaugaaauagcucaaaacaaaaagauaaggcuaugagagacaaauugaugacuaacaauguuauuaaacuaauauauaaaauugacacugcugaaugagaaauuauaaagaggaaaggcuugagauaauugcagugaaugcaaaagaacaaagcuuaauacaauuagaggggaaguaacagagauagagaacaaaggaaauucaacauaauugguuccaugaaguagaaaacccaaacaugaaaccagaaauggauucaaggauagaagaaaaucuguugaaauaaacuaaaggcacuguaugugccaggaaugucaugucuauugcacaaguuauuggggacucucuaacauuaguuuacaauauuugucuucccugcuccccauaccaguuagguuagcagcuggggaucaaaaagacuaaucagcaguuauuuuccauauacuccucugugcuaguaaggcuuacuuagguauagaguagauacggagggguuuaaccacagcaaagcccuucagaugugacccccagauacuaaccuaacugguauggggagaaaggaagacaagcauuacgagguaauguuagagaaucuccaauaacuuaugcaauagacaugacauuccugguacauacagugccuuuaguuagugguggugcauuguauuauguuuaaagagauuaagugauuucccuauaagugcauacaaguguauagucaauaccugguauagguuuugaaauauacuuauuaaacauaauaaacuuacuauauguguauugagguauacuuauuaaauugugcauguguguuuguguguguauguaacaucacacccauuugaauuuaacuccuuaagcauuuugagaauuacucuuaccuccucuucguuuuuguaauccucacaacauagugcugugcguaugaaaaaugcuaaaggaagaacuauuacacaaaacuuaguuaaauaagacaaauguauuaacuugcugcagaacaaacaguaauucuccauuguaugacauuuuauaauuuuaacugcugaaacaaauggaaauaauuauugugaaacaauuucuauccuauaaaauuuggaacuugaccaaagaaaaaauguuuuuucugcuuuauucuacuucgauuguagguauuuguggaaucgaugaauuugauaagauggggaaucaacaucaagccuuguuggaagccauggagcagcaaaguauuagucuugcuaaggcuggugugguuuguagccuuccugcaagaacuuccauuauugcugcugcaaauccaguuggaggacauuacaauaaagccaaaacaguuucugagaauuuaaaguaagucucuucaaauauuuauaccuuuaauguauugaaucacuuuaauucaauaagaaaaagaaauaguucacagaacuacaggggaaaaacauggauauuucacagaaguuauaaauguccaauaaaugcacaaaaaugugcuuaaacacugcagaguaaaacaaugaaguacgaaugagauccaccagauuggcaaacauuuuaaauauuaaucauuuuuggcaaaguaguguggaaaugguuucucaguggcugggcggguggcuuaugccuguaaucccagcacuuugggaggcugaggcagguggaucaccugaagucaggaguuugagaacagccuggccaacauggcaaaaccccgucuuuaguaaaaauacaaaaauuagccaggcaugauggcagccgccuguaaucucagcuacuugggaggcugaggcaggagaauugcuugaaccugggagguggagguugcagugagccgagauugugccaccacacuccagccugggugacagagugagacgccaugucaaaaaaaaaagaaaaagaaauuguuucucacauacacaauuuauuauuuugugggaccccuugguguguugaucacaauucuaaaugcacauucuguuuguuauagccacucuacuuuuaggacuacuguucacagaaauagucauacaagugcacaacgauagguuuauagcauggguauugcagcauuauugcugccaaacauuggaaacaccuuaaaacuauaauaagacuguagugauuaugagaacgaaaguggcuuuauauguacuaaugggggaacaugucugugcuguacuauuaagugagaagagcacauuaacaaacuuaaauaugugguaugauccugcuuuuuucaaaaacaauguuuauaucuguauguaugcuuucucuucuaauucauucuguacagcuuggacaaaauguguggaaaaggaaaaauauauuuaagugauacaaaagugagaaaaagacaaaagaguaccuccugaaaaauuagagccuuaagccuaguggggguggaguuaauuucuuguuguuuaauaauguaucaauauagaaacagucuuugauacauagugaaauacacaauguguacuuggagauuuaggguauuuaccaccaccaccaaaaaaaucaaccuacuaguaguuuuucuuuaguaaaaugacaaagugcuauauuagaaaaaucagaaagaucuauugaacaaaaauccagcagacuuggauucuguuuuuuaaugguaucaugaacaaaauacugaacuagcuaaccucugauaugucauguagcaguauugccaauuagugauaauaggacaugaagaauucaguggguuugggggugugagaaagagccauguccucaaccuacccaggguagauacauguaauucuugugcccauguugcagugguuggauauaucgaauccaagaagcuauuugcuuauuucuuuaaccuaaaucuugguuuuucaaguucugcguggaacuugaguaguaaauaagugaguagacaguuuucuaguuuuuccuuuugauuccaaucauuguuucuucuuucuuucauccuucauagaauggggagugcacuacuauccagauuugauuuggucuuuauccuguuagauacuccaaaugagcaucaugaucacuuacucucugaacaugugauugcaauaagagcuggaaagcagagaaccauuagcagugccacaguagcucguaugaauagucaagauucaaauacuuccguacuugaaguaguuucugagaagccauuaucagaaagacuaaagguauaaauguuucuucuccuuauucaguuugguucuguuugaaugucaaaguucaguguguggcuuauuguagagcaguaggauacaaacuuuuuuuuuaccagaacuuuuuaauauuuccauacuagaguuuacguaaacuucaucugaaauaauccaagucggccuggcgugguggcuuaugccgguaaucccagcacuuugggaggccgaggcagguggaucaugaggucaagagaucgagaccauccuggccaacaugaugaaaccccaucucuacuaaaaauacaaaaauuagcugggcaugguggugcgugucuguaaucccagcuacuugggaggcugaggcaggagaauugcuugaaccugggaggcggagguugcagugagcugagaucucaccacugcacuccagccugagugacagagcgagacugucucaaaaaaaaaaaaaaaaaggaaucuaagucagcuaagaugagaccuacagauaaaguguuugguugauuuggagagucuuuuagaauuguauauuuaucuaaacaaguuauuuauuuauucugagacauagucucacucuuaucgcucaggcuggagugcaguggugugaucuuggcucacugcaaccucugucucccggguucaagugauucuccugccucagucucccaaguagcugggacuccaggcacgugccaccacgcccggcuaauuuuuguauuuuugguagagaugggguuuugcuguguuggccaggcuagucuugaacuccugaccucaggugauguguccuccuuggccucccaaagcgcagggauuacaggcgugagccacugcaccuggccuaaacaaguuauuuuagcagaaauauuuuauuugcuacuuauccuuguuaucuugggccuuuuaaucaugcuucaggugguuccuggagaaacaauagaucccauuccccaccagcuauugagaaaguacauuggcuaugcucggcaguauguguacccaaggcuauccacagaagcugcucgaguucuucaagauuuuuaccuugagcuccggaaacagagccagagguuaaauagcucaccaaucacuaccaggcagcuggaaucuuugauucgucugacagagguuuguuucuuuuuauggucaugcuuuuuuuggcuuaaaggggaagggugugccuugacuucucuuuugaaguauuuucugcauaauugacuccauuuuccuuucuauagagagauguuagaaauggauggaugaaaguuuuuuaaaagauuuugucaugucuauaacauauccaaguauagcuacuucuuucuagucacagaaucaauuacuuagcaugcaacuuuucuuuuguuuuucuuugacugacucuuaggagacuccuggaauaucugaaaagugguuagguuaacuaggaguaugagacccaaguugaguauaugggaacauggaaugugucagguaucuugaguauuuuauuuuuuuacaugacagguccacaaggauaguuccuguguuuuuaacagcaguaauaucuauucacaguuugaaauacuaagagaacucuggcaguaaaaauuagcuagcucagaguuugggcuuuuugcuccuaaaaucugauuaauucuucuuuguuguuuuaccauauugguuagguaugauuuccuaaaaguaaaaggcaagggaaaaccaaguguauuucaucaucaaaucuccugaaaugaucacucagaaauauacguuaacaaguaaaaaugagguuuauccuuauuuuaagugaguuguaauuuucauagucaagguuucacagauuuuuuuuguuuguuugcccugagucagggucucccucugucaccuaggcuggaguucaguggcaugaucaagccucauugcagccucuccucccaggcucaagggauccucccaccucagcuucccaaguagcugggacuacaggcauacaccaccgcacccagcuaauuugaaaauuuuuuuguagagacagguccucacuuuguugcucaggcuggucucgaacuccugggcucaagugauccucccaccucagccucccaaagugcuggguuuauaggcgugagccaccacccccagcccagagaauuacuuccauauuuugacuuuugauguuauaaccuuccucgccuaaaggucaguuuuuguguaaaacaaguaaaugaaguaaagcuuagacauacuaugguaaauauauucaucuuucgucaucugaaaaugguguuuucuuuuaaaggcacgagcaagguuggaauugagagaggaagcaaccaaagaagacgcugaggauauaguggaaauuaugaaauauagguaagauaaaaauuucaaauuguuuuaaaugaaauaccaguuaucuucccaucucaaauuagguaauaggccaaggcuacuuuuauuuagcccauugggucacuuauuuuccuccuaaacagaguaccguuucuuaguuuaaaauauuucucacuguguaaauaaucuuuacauuagaaauuuuuuugaaugaguaauacauuuacauagugcuaaaaucaguuccaaaaccuauuggagaagagcuauuuaccaccuacucgcccuucacccagacacccauugcuuuuccacagucugcuguuuauacucuucuguacugguuuugaauuuuaacaauauauccagagaucuuuuuuuauuagagacucuuuuuuuauagcuagaguauucuauuguguagauauacuauauaguauauuugaucaguccccuauugacacauaaauauuuuccauucuugugcuuuuaaauaaugcuacaaugaguaauguucuacguaagauacuucauauguggguaaguugugcaccuacgugauaaauucucagaagcgauauuucuggguucaacaguaaauacuauagguuuuugauaaauauugcuaaauuguauccuuugcauuuuacaucauuuaguagauaaugauuccuagaagguagaaaagaaaaauuaguugagcauauauguuuaccuuagacauagauuuuuaaaaaucaguaauauuauuuuggguaguuuuuuuuauuccagauaaaaaaauuuuuuuaauagguccauacuuucauaagcuucaaaauuccaaaguucaaaaaguauaggccagguaugguggcucacaccuguaaucccagcacuuugggaggccgaggcaaguggaucaccugaggucaggaguucgagaccagucugggcaacauggugaaaccccgucucuacuaaaaauacaaaaaauuagcugggcgugguggcuagugccuguaaucucaguuacuugggaggcugaggcgggagauuugcuugaaccugggagguggagguugcagugagcugagauugugccacuguacucuagccugggugacagagcaagacucugucucaaaaaaaaaaaaguauauaguggaaaaaguuuccuccuacucagcuuaauaguuaccccguucuuccugcuagccaguggcaauuauuagcaguuuuuugugugacuacauaucuauauauucuuuuuuccccuuuguagacaaaugguaacuauaacaacauaccauauacaugcuauaccuugcuuuuuucauuuaaaaugcauuuuuaauauccucugauagcaaugaaaauacauuaucuguuaggagucuacuuuuccaagaccaaaaaauauauugaagaugaaauuaucuaauuuuguuaaguaauuucuaauucuucuaagguagaugaauucuuuuguccuaguagcugcugauucugagguuugcguggugucagaaccaggugguuuugcccaggugguuuugcccagcuauuccccuuuggcugugaauaaaagugcagcauagcuggaagagcaagggcuuuggaguucaaccuggagcugccauggcagguuacacacugcuucucaguuuccucugguguaaaacacaccacaaaggauugugcucugaggugucaugcagugaugcucaauaaagugacgaauacgguucugauacauuagagaacacucaguaaacacuguuuacuaucaauagcgcaagucuuuuuuuuuuuuuuuugagacagucuggcucugucgcccgggcuggagugcaguggugugauauuggcucacugcagccugcgcccccuggguucaagcaauucuccugccugagccucccauguagcugggacuacaggugcaugccaccacaccugcuaauuuuuguauuuuuaguagagaugggguuucaccauguuggccaggauggucucaaagugcuggccuuaagugaucugccugccuuguccucccaaagugcugggauuacaggcaugagccaccacgccuggccugauaguguaaguuuuguugauacucagaugaggcugagcagauccccuuuucucugaguuauaccauaaaccaaaggccucaaaaacuggcagaucucacccuagauaagaaguuuccaaaaucacccuuuucaaagaauuuuuauggucuaguccucagugcucuccaucuaaauugugcaguaugucuuagcugcagauccuuuucuucuugucuuuuccucauagggagagacuuuaccuaguugucucuuuguccccagccugguacugccccaucccuggaggcugcugucuucucucugcugccucuagagguaugcagauggguagaagggcacccaugucaccuccugaagguacaagaaucugcagguuguuuccugcccuuagagggaguccauggaagaagaggaaccuuucuccuuaauucagucucagaguuuguaagcaaccgugagguucuacuggcugucuuugaaagcuuuaaagauucuagaauugacagcucuuaauuuuuuauugguggcaccaaaguaacugccucauaauaagaaaaauuaauaauuauugacucccaacccuuugagcuaauuucuaacaacuuaccuucugugucuaaguauccuauugguauggcaucacacagugcuuuuuuuuuuuucucuuuuauuuagacagagucucacucugucauccaggcuggagaguacaguggcgugaucucaguucacugcaaccucugccuccuggguucaagcgauucuccugccucagccuccugaauagcugggauuacaggcaccugccaccacgcccagcuaauuuuuuuguauuuuugguagagacgggguuuugccaaguuggccaggcuagucuugaacuccugaccucaggugaucugcccacguuggccucccaaagugcugggauuacaggugggagccaccgcgccugacaucacacaguccuugacccaucaauuuucucucuuuaugugauucaguacuaggguuugagggaucuuguagcugaaaauuuuaccaaccuggcuuuagucccucuccaguugaucucauuauguuggagacccucuaguugccauuuauaagcaaccagauagucuaggaauuuacuagacuuucucauacaacuugcugcuaggggcauggugugcuagcauaugaaguaaaagaauggccacaaaaucuaguugucugccugacuucuuguggguauggcuuucuaagagaccagacuagagacugaccuagcagagauauuuuuucccauuaggaaaguaagucacaacccaaccaaaauuucagaauuuuuuuuaauuuuaacuuuuuuuccuauaaaaaaaacaaagaccaaaaauaggcacuucuuauuuaaugaugagaaguugcuuguugacuuacagucuagaaugugugcaucuugcuuucucugcauccugcacuugaacacuccaccuuugggaguguggcugagauucccacuccugauuucuuuuuccuuuuaaugaucucuggcccucugggucuucuggugccuggcucuccugaaugucauguuucuacuuuguagacuguucaucugucgagcaaacuaagggguacacuacccugcuccuuuucucucuuaaccuguaacauucuccucuugaggcuuuaccauugcucaauuucugcaggccuuagaccauagacgucaccucaacuguuuacuguuuccccacaguaaauucacuggucuguggacacgguagauuaguucuccuaucugagcaucaugcuuaagcagaguaaauuaggcuauauuuaccuuuucaguaaaaaugcuauauugcccauuuaugguugguuauacuugguauaagauuucucugcaugucugaauacucauguuggacaguguuugcaugugcuuuccuguccaagaggaacucuuaaguguugucucauggaacucuguauuuguacugcuucccagaguugcuuuggugguaaauuugaacaaguuucagaucaguuuacaucugggccccugaaaaaaagaggucuuauuauuaaguguaaacaguacccacaugacauuaccagauuguuucccugaauugucucaguauguuuacuggcauucauaaaaauuuucaggaaaaagaaaauaguuugauuggaauuaccugacacuauguucaugguagagaucaagauccagugaaacacaaugaaauuagauuaugaauuaucuguuuguuaugcucaacaugcauucuuuccuuaguuuaugagagcagggaccuuaucugacucauuuaccaguauauucccagggcccagaaucaugccugucauaaaguaggccuucaguaaauguccugcacugauaguaaaguugaccuuaguaaugauucauucauucauuaaaucuuccauuucagaguuuucaucucuucagcuucguucagucuuugcccuuaaugugguuuuaaaccuuuuaagauuacauuuuaacugggaagcugacaguugaauaagaaaauucuuaaacugugacauagcuugucugaguuaccagagcacuuagcuguauuuuaaaaaacuaaaugcuuauauuuaguagacaguucacauaagcuuucuccuaaaauugaaaacauacuagguagcagaagagaacagagccaccuucaaaggugaaagaucauuguuuuuuucuauuucaggaaacuagcucaaauauuuuacauagcuuuuuaaaaucugaagcaguguagcagauucaaaucugagauaugccacuuacuaguuguguaacuucuggcaagucacuuuaaucuuagcauagguuggugcaaaaguaguugcaguuuuugccauaagaaaagcaauuucaaaaaccucuauuacucuugcaccaaccuaauaagaauguuuuuucauccguaaaaugggaauaagaauaguuccuaaaucacaggauugcugggaggauuaagugggauagccuauguuaaacaaauauaauuaagauaaauguuaccuauuauuauuaacugaaagcauuuuuaacaacuuucucaugagaaacaagcauaugggagguucaucuuaaaagagauuaugcuguauuucagaggaaaacacuuaccaucuuacuguuuuaucauuuuuaauaguuuuauuugaaugacucauuccuauuugcauaacguaggcuuuuaacuauucaaggaacaaaaggaagcuuuauuguuuauaacccauuaaaaucauuccugcagcucauuaagggaagggauuauaccuguuuuguucaccacuauaagccuguugcccagcaggugaccaguauguauuugacuaauuaauuaauuccugauuaaauaacaguuuugccaauuagucuggcugugaaauauagcuaucccauuguugaggcagggaaucagcaauagaguuggauuaaacaggaugguuaauuauguuucuaacuaguguuuucagacuuuagcuaaaauucacuaucaaguacguacuucuuuccuuggugauauugugaaaauuagagaaagcagaagaaaucuggcaguaauaggugcauccuuuaauaucuaaccaguaucacugcaacucaccauaaccuuucuaguucauuccuagaguauuuuaaauaccuuuuauuuaaaauacuggugcggccagaugcugcuccaggagaugggacacauuuuuauuuagugaagucuaaauuuauuauauuuagaauuucuuuucuucaugaaucaaaaagaaugucccagguauuuauauuguaguuuaucaauuuuguguuuuuaugcauuucucucuccaaauuuagaaguuucuuaaaagcaguaacuguguccaaaauauuuuuauuccuuaucaauccaucauagugaauuucagaguggccccucaauaaacacauguugaaauguuugcuaagugagccuuguggcuacuuccaaauuuuucuucuguaaccugaaagcccaggacaacaauuucuauggcagugcuacauuggguaauuuuuucuuccuuucuuuuuaagcaugcuaggaacuuacucugaugaauuugggaaccuagauuuugagcgaucccagcaugguucuggaaugagcaacaggucaacagcgaaaagauuuauuucugcucucaacaacguugcugaaagaacuuauaauaauauauuucaauuucaucaacuucggcagauugccaaagaacuaaacauucagguauguuaaacuaguuaaucucuuuuguaauaauuucaggagguccuuguuaauauauaguagaacagaaacaguuuuuacuuauuuaaaauucauaccugcuucuucucaaagguuuucagcaucuugauagucagagggaaacauuguaguaagacagucucuauguuuuucugacugucucuuguggauaugucauuuuaacaucuuuuaacguugcaucccucaucuguuaaauggacaugauuauaccaauuccuacuucaaaguucucgugaaaaucaauguaauagcacuucaaacaugggcuguuacacauuauggaaaauuaacuucuuaauuucaaaaguuagcuugauuuuuuucagcuaaccuaaaacaaauguaaaauauucucugcauauuggaauuuuuacuuuuuauuuauuuaggcauuauagaauccagaacucaaauauaggcaguuugcucuguaagaaauaaaaauaauuuuauuuggccaagaaacuuuacagguacauauuauuauuugagagauuuauuuuaaaaguaauauuuugacauguuacuuaaugggcuaaaccuuuugauguuuucuuccagguugcugauuuugaaaauuuuauuggaucacuaaaugaccaggguuaccucuugaaaaaaggcccaaaaguuuaccagcuucaaacuauguaaaaggacuucaccaaguuagggccuccuggguuuauugcagauuaaagccaucucagugaagauaugcgugcacgcacagacagacagacacacacacacacacacacacacacacacacacacacacacacagucaaauacuguucucugaaaaaugaugucccaaaaguauuauaauaggaaaaaagcauuaaauauaauaaacuaauuuaagaagugauaaagucuccagaugcaguagcucacacuguaaucacagugacucaggaggcugaggugagaggauuccuugaggccaggguucgagaccaaccuugggcaacauagcaagaccccauuucuuaaaaaaaaaaaaaaaaaauuuaaacuuagcuggguaugguggcacaugccuauagucucagcuacuugugaggcugaggcaggaggauucuuugagcccaggaguuugagguuacagugagccacaaucacaccaaucacugcacuccagccugggcaauaaaguaacucuugacucaaaaaaauaaaaaaaauuguagugguagccauguguuaauuguuaaauaaauucuccaaagggcuaaaaguaaauuacuuauaaauuuuuuauaguuguauuuuugaccugccuuuuauauguaugaauauuucauaguuuugcauaucagauguaggcauacagacaaauacauaaaccaaugaauauauuacauauucuguguuccaauaaaacuuuauuuauggacacuaaaauuugaauuucauaaaauuuucccaugucaagaauacaaaauacuugaguuuuguuuuuagcuauuuaauaauaggucucauuuauuccacaggcuguaguuuguagucuugcuugaaacaauagaaacagacugauuaagcaggagaaguuuuuug

SEQ ID NO: 13422 - RNA, 1148 nt, Homo sapiens
uacaaggcagugucugcuaacaauaaauacuaaucuuagaggagcucugacccauggcuggagagaauauuaauagguacaaucuuucuggcaagaaauguggcaauuaaccaaaacuucuuaaauacacauaaccuuuaaccaaguaauuccacucauacgaauuugucuuaaggaauuaauuaagcacaugcacaaagauuuagcacagccuuauacugggggggugaaauggagauaauucaaaaaaauaggcucaguggaaguaagauaaaucauuuguauccaaacaagacaaagcucacauugcauuagguauuauggaaauauauuuaucaccaguacacuggccaaggaacacuccuguaguguuauuuaaaaaaaaaaaaaaaaaaaaaaaaaaaaagcuauuuuguuuacccuucugccuuuugagacaggagaagggguauuuauuuuccucuccuuggaugaaaaccaggauagcuuucaugagacaucugggcucucuuagaucaugaaaagugcuccagacacugcuggucauuaaaaaaacagaaagaaaaaagaaaaaaaaucaguuugguaaugguuaguccaguucaauguaaucauuaaaauaucaaucuuuacucaaaguuaaaauuucuccuuccuucagcuguuguugccacagccugccugcagugcuaguuccuaaaggauggguaggaauucugcaagaggaaaggaagggggagagcaguccagauggaagaacgaacuguccaaacaaggaggaagacaacaaagggcacaccauccuuagugaugcugagggaaggggaugcccucacaauggcaacacaguuucagaagcugccagaaacucaaccuaucaaaacuaaauagaauuggaaauaggcaaaagagucuauguguguguaaagucuuguaagccauugagggcaaugguuuggaaguuaaauggggauaaauucaaauccuaacuuugccauuuaguaacuaggugaucuugggcaauuugcuuaaacucccuaagcuucaguuuccucaccuguaaggugaggaaauacuccuaguuuaugaggauuaaaugagauaauguaugcaaagaacuaggcacuguaccugggacauagagagug

SEQ ID NO: 13423 - RNA, 651 nt, Homo sapiens
ccgucuggcggcagccaucagguaagccaagaugggugcauacaaguacauccaggagcuauggagaaagaagcagucugaugucaugcgcuuucuucugaggguccgcugcuggcaguaccgccagcucucugcucuccacagggcuccccgccccacccggccugauaaagcgcgccgacugggcuacaaggccaagcaagguuacguuauauauaggauucguguucgccgugguggccgaaaacgcccaguuccuaagggugcaacuuacggcaagccuguccaucaugguguuaaccagcuaaaguuugcucgaagccuucaguccguugcagaggagcgaguuggacgccacuguggggcucugaggguccugaauucuuacuggguuggugaagauuccacauacaaauuuuuugagguuauccucauugauccauuccauaaagcuaucagaagaaauccugacacccaguggaucaccaaaccaguccacaagcacagggagaugcgugggcugacaucugcaggccgaaagagccguggccuuggaaagggccauaaguuccaccacacuauugguggcucucgccgggcagcuuggagaaggcgcaauacucuccagcuccaccguuaccgcuaauauaa

SEQ ID NO: 13424 - RNA, 784 nt, Homo sapiens
cagaaacgauaguacagaagcaagaguggaaacguccgcuggugccccggccaagcugccucuacagggacggcugcagucugcccacgguggagggcuuugcagggugacuccccgcccccacgcccugcuccaugccucaccuucaugguggaagcugcgcacaguguuggcucggcuggcugcccucuccaaccgguggucuggggcgggugagcccggcugaccugagugccugcgauacaggucuagcauguaggggggcaccacggcgucccugcugggggugggucucuguuucaggccgaacaugcugagcagccgcaacucgaacucgcucaggaccucgucagagggcugggaugaggggcggcccgacgacgccgccgcgaacuuccugcggcccagcuccggaacgaggccagccgcgccgcccaggaggaccuggggaagcagcaacgcuagaagacagcgggucccggccaccauggucgaccugcggacaggaccgacgugagucacccgaguuccccgcccaguccuccccccucgcgcccccgcggcccggucucccauuuggcuggcgugccuccuccaggaugcccuccuggcuuggcacacucacgagucuagguaagaccgaccgaagcucaaacguuugggauaaugaagggucccaaguuccugaaccagaugauuuaucgcucccauccaacgcuuagcucgucugacaucagauuugggauuugcccucccccccaaccaaaccagcgccaaugacugu

SEQ ID NO: 13425 - RNA, 2240 nt, Homo sapiens
gguuguguuaagaaauuuuuauucuuuccuuuggauuugugaugaaagcacauaaaauuacaaguggaagaaacaucaugccacaaaauugcauagaauuauuacaaaaaugugaauuaugcauuuuaaauaauuugagauagaagaaccaaaauauguacauuuuaagagcuucaaauacuuuguccuaucuuuuuuuucuucuuaaaaggcaagagucacaacguccaauccaucacaaacaauauuaacacagugcacaagcgcaacauuaaauucaaaguaaugcaagcaaauggcccuuuuuuugggaauuacuuaaugacagcuuaucuacuacaggaguauuaauuaauguauggugauacucaaauuuuaaaaugaaauauaaaaaaccaaaaacacauggcuaugucauuagaacuuugaaaauugguuuacauggccaaaaccaugcuauucucaguaguguaaagguaucagagagacacagucuaauuuaauacacagcucuacuuucuauuauaggaaaaaccacaguacggaauuucacacauucgacaaagaacaaggcaaauacauaaaggcacaaaacugcacaucauacagaccccuuuucuuuaucuuagucuauuucaaguaauauuaauauuauuaaaugauaguaucauuguaguaguuucaaugaugcaagauggacaguguuacacacuaccccacaacugcaaaaagugucauuguacagauauaaaaaugugauuacaguaaauggccaaauacaaacauauuguaaaaugacuaaauucacuaagauaaugaaauccaacuaccaaaacaguuuuguguaagucaagguuauucaacuuuauucuaucucuggacuaaaaugugauacaauguucugcaauaaucaucauuguguuugguuaugaaugcuauuauuaguucauucuucuucaauuucagacagucuguaauuuuguuuauaaaaaugcagcauucgauuuugaccauucuugcuucuuuaugauuaacgccuuucuuucaaagugcaaaaguagaaugauuuacaaaagauuucuuuuucauuggaaguuaaguuuuauuaagugucuaaugaacaccccaaacccuucagaucaaaauauaaucaucuccaaagaggaugugauuuuccccuuacgucuuacuagauguguuuuuuuuaaucaaacacuguuuccuuauguuugaacuaagccuucauuuugauuaaaauuuaauuguaaucucuaguuauugcuuaaaguuaaauaaaauaauuuucauaaaaauauuaaauucuugaaacaauuuucaggacacaauugguuuuugcguuuuaagauauuucacaaagcuacagucagacagguuuauuuuaaaguaaaauaaaacugugagcaucuggcuucuggguuuuaacuucaauguucauguguuacucucuaaguuacauuuuucuacauauuauuauuuuucuuuuuucagaacuuucaauuaugcuuuugaucaguuuuaccuugauauaauuuguuucucuuauuccaucuaaaauaggaacuuauaaagacagaguuaagugaauuaaauauacuuaguaaauauauaauggaaguuuuuuuauguuagaauaaaauagaaaugugucagacuuaaaaauuauggaagauacuaauaaauguccauauuauuucuguccuaauuuuuugaccauuaaaacaagcuuaaaaucugauacuuaacaucuaauuuuugaucuugcaaaauauaaaucaaauucauauaaguucuaaaucuacuucgguuugcaucaauggcuccaucaauuauuucuuagcgucuccauauaauuuaacauccauguaaucucgauguuugacccuuuucuucucuauccauuugucccugaauuugguuuuaagucuuguggaagagauuugggucauugucaauuaauaaacacaugucuacacucauguguguguauguguauaugcacuuacaugacuaaguggguacauauauacauggagauaauaccuaucauuuacaugugggucuuuguauucucuagauaaauauucaaucuuccucucuauauuaaaaauaaaugaaccauaaaaaaugucaaacggcaaaauaaccaccggaaccuguucauucugauugaauaucugcuuaacauauaucagcucaacuauuuuuauucaacagaucau

SEQ ID NO: 13426 - RNA, 226183 nt, Homo sapiens
uaaagugcuucagucuaacaguugacuuacaaugucuaacauauaaagacucucuaauaugguacaaauggaagaauuaaaggguaggauaucuauaagaccaaauaaguauuugauuaaaaguuuccuuuauuugcuguagcucuccacuuucuuccuugcugcuaaaauccuaaugccuuuugauuaauaagaugauaauccuguuggacuccuaugguugaauaacguuuaauguuacauguccugagagucccacgaaauuauugagcagcugucaccgacuucauuuucuucuucacacucucccuuuccuuuuccacagcgaucacgguuucccauucucucuccugagguacuucauaaugcaauauucagaccucaaucuuacuuuaagucacaaaacacugccugaggcuuaccuuaguugcuauuuuuacuuaucauuuauuucugccaaaaggaacuccucuaaaauuauuuucaucaagaauuuucauuucauguuuuaucaucuaaguuugaacgcuaauuuucuugaacuauagaggaagguuuuuuuucucuuuuuuucuauuuccaguguuuucugcuagggauuauuauaacuuuaggaaacauagagguauuuguaaauauauuuuaacgaauuugugauauauucaaaauaagagcauugauguuucacuaaggaauguaaucaaauuguauggcaaagcuaaaaaugauagaauuuaaaaaguggcuaucgugaaaaguagaagccccuaaucuauaagaucaauuggagagguucgcugugucaccccuucuuggaggaacuugaaaaaaugcaggauaagggcaaagagaaccaggacaauacccaacuccuaugugacacauuguaaacacaugugauaaagaacccuucuuuuagguuggggugaugauaaaaaugcaaaggcauggcaucaagaaugcuuuuuuccauuuaugugaccaaguuuucaguaaauaauuuauuacaaauaagcuuuuccuccugccuuuauuagauagcuauugcuguauaagaaaguacaucccaaauuugacuuaaaacaacauuuauuaucucacagauuuuguggguuaggaaccaaccugggaguagcuuagcuggcuuuuuugcaucagggucucucguguggcuccagugguagggcuauacucaacucaagguuccacuggggagaaccugcuuccaaauucacucuugugguuauugguacgauucaguuccuuuugagcuguuggcuagaagccucccucaacccuugcuaugugggccuccccagggggcaguucccaacaugacagcuggcuuccauugagagagaaggcaucaagagacaaacucaucuuuuuaccaccaaauaucagaagugauauccugucccuucugcuguauucuauucauuagaagcuagucauuaggucccaccuacacccagagagugaaccaccaggaagugagauuauugggaaccaucuuagaggcugccuaccacaugcaaaauacguccccccuacuccucagauccucaaaaguuucacuuuugcauuacaacaucagcucaaaguucagaaucucauaauuggaaucaagucagggugauaucauaacuggaaucaccccaggcuuccucaggagguaguucuuuaaguacaguuccuggaacacaguugcuuuccaucuguagacccaugaaacuagagaaaaguuaucugccuucuacucacagcauaaaauuauggauaaggcauaaccauaaccaucaccauaacauucuguccacaaagcugggaaaugggagacauaaaggagucacuaagucuagcccaugcucaaggggaggaaauuaugcaaggucugaaacuaggagguggggccaccuuagaggcugccuaccacacugcccuucuauuugauuguaauaauaaaaggaguaaaacuuuugauaaauauuuuaugagacuucagguggggcugauaccuaacauauauggauggcauugcugcuuguauugcuaguuuuuuccuuuggcucagaguaaaaauucuuuuugauuacaagaauaucagaggaaauuguuuaacaauucuauuucucuuuaucauggcuauagaucugaucauugacuauuagguugguuuguuucccaaaaauuuccaaaauauuuuccuaaaguuuaauacaacauuuguuauagcuccaugcuuauucauguggcugccuucuauauuucuucuucaauuuaucaauacaucuuauauuugcauaaaauucaaacuacaucccuuggugaaacauaaugucucuacuuugaacaugggagauuuucuacuuucuuuuucauacuauugacuagagaaauaacuuccccuucccuuuaugcugcuuucugaaguccugcuagaauacuccuuauuguccuuccuuuuucuaucagucuaugguucucaaccaacaacaguuuugcucuucgggggacauuuggcaaugucuggaaacauuuuugguugucacaacaggagggugcuacuggcaucuagugugcagaggccagggaugcugcucaguaagcuguaaugcacagggcagccuccguacaacaaagaauuauggggcucagaaugucaauaaugccaaaguugagaaaccccaguguaaaacaaaccaguccuucuucccacuuuaaaaaugaagacauuacaauguugcuuuagccuugguuacuauauaaaucuacuuuuuccccccaaaagcaaacauuuccccaaaauaacaaaaauguggaguugugauauaaacuacaaauugcaggcaaaccagguucuacucaauuaccuaaccacugaagaauauagcuugagauaaagggcauggagaaaagugaaauuuuacuaaaugugcaguuugaauacuucuuuugauugagcaauauauacugaauguuuugugacacuuugagaucuaguuuuauacuuuaagcauauguaauuacugcuaacuggaaaauaucuaaaauauguauauccaaacuagagcauggauuaggagucuuuuuuauuuguuugcucucaaaaugaugccaacauaacaaaaauuuagaacaauguacagcagccaguauagaaucccuaagauaacuauaauauuuuuaaauaaauaaugcuucauauuuuuauuguuucauggcauuuccauucacgaaucaccuuuuuuccuaaauaaguguaucuauaauuuuaugagucauuuguccaaauauguagaacagggcuuugggagaaaacaaauacacucacaauuuuucucaauugccaacagacuaguuuauuuguuucucuuguaauacgaacaugcuauucucuuaguuuuuaucuucaauaacauaugaaagauccaaaaucaaauuggcugucucuacagccaccuguaggccacuaagcuuugcagucaaacaguccaaggucagguugcuggcugagcccacagcuucauguggaaggcagcuuuguggcacaaauggacgacgugugcuucuuaagaaagaccaguugaguucuuccuggcuauuguauaauccacagccacacugugaaagcaaaucuggccaguuagcaacacagggagaaucugccugaacugaccaaagguguccauacuucaugucagugagaauuucaccuccaucauguucuaaagagccaacaacagauucuagggcacugcaaaaugcuucagcaauuaauugaaguucuguuugaguacauucaucaucuuugagaaugcuuucugggucguugugagucuaaagaguaauaaaaacauugaaaacacauacaaagcaauuaauauaaaauguuucagaaaaauaagauacugaaaucaaaaucuuauuccuaaaguaauuacuuacuuucauuuaauuuggggucuggcacaaugcuaacgggcuuguaugggucagccggccggguugcaaacccuuaacuagguugguuauaguaaaaauguauuaaaaauguauauacuaccagucauguuaccagaaugagugaaucagaauaaccccaccaucagcuuauucugaaugaggcuugguagugccuccuuaauacaugaaggacuaggcauaauacauguauuacagguuuuucugcacacaggaggaaguuccugaagacugaugucccaaauggaguacuuauuuaucucugcaaaauguuugagauuugcuuaaaaugggaaugcacauauuuuuauuuggaaaucaugauguaaauuuucauaucaauguuuuaaaaaugaauauucuucucuuuaaauuaaugaaaagguaauaagaccuuaaacagucuucugguuccacuauuuaaaaauguuuauccuagaaauuccaugauaaaaagaaaaauuaauauauagccaugcaccacauaccaacacuucagucaaugauagacugcauauacaacaguggucccauaagauuauaaggccauauuuuuacuaaccuuuucuguguguugauauguuuagauacauaaauaccauuguguuacaauuaccuacaguauucaguacaguaauaugcuguaaggguuuguagccuaggagcaauaggcuauaccacauagcuuaggagugugguaggcucuaccauguagguuugugcaaguacacucuauauuguuugcacaacaauauugucuaaugaugcauuucucagaauauaucuuuguuaagcaacaugucuguauuagcaaacuaauaacugaaugauggguuaaaaaauccauaucuuaacugcuuaaaaacagugacuacuuuccuacucaagacaccuccuuccucuaaaaaacuuucucuaguuuaucaauuccauuucagaauacauuauuguccauucagcaccaauagauuggcacaaauuuuguuuuccauaauguauauucugauaacuuuucaugaaugugcuuuaucuucaaagagauucuaaguuauuuggggaaggacagggcauguuuacccaaugaaucgauugcuaauaucuggaaaacaccuauaccuuuuucuauccauuuucaaauaaaguaggccaguacuuaugaaauaaucagaacaacaaugcacuaaacuuaucugagagcugucaggaaauggaguuuccuagaccaaucaaaaaauucuauuuaguauaauuaauaaauaacauacauaaauaccaauuuuaaaauuauaauagaaucuaauaugugaauugcuuaaauaaaugaaacuuuucuugaugcucuagaagauacugaaguauucuguagaaacuuggcccuuuuguuugugaacaucaauuauuacuguauugcagcaguugagaucucuaagagaacucccaauaacagaaugcuagcuucaacaugcagaacauguagacaauacucaaagaacgugaucgcuugcuuaaauauuuuuauaauaaucauuguaauaaggauauuaccuuauauuuaccuuguuauuucccucaaguguuuuugauuaucuacuuuauuuagacuacugaaaaauucaguguuaaaggcuacaaguuuaccuguauaacaaaccuauacaugcaccccugaaccuaaaaguuaaaacuaacaaaaagacuauaggauauuaugauuuuggcuuauuaucucagaaaacaaaaguugcugagaauucagguaauccgaagaggauuaucuuacauaccuugugucugauauaugcagccaaaugaguuucaguacagccaccucccaacaaagcccaugguuccuugaguguuaacugcaggacaugcagugccgucugacacgugagcuaagaaaaaacccaaaucaucagaaucagacguucacaucauauuaacacacaaaaaaucaugcucucaaagcaucauagugaauacagagagugugauuuuaauuacaaaagaacaaaacuuguguggugccaagguugucaugugauuaauacauucugaauaguaagguuuagagauuaagggaagauacuucagucagaaguuuguuuucacggagccagauuaguauuuucuuucauauacacuuagcucuucaaacugagacgaauauauggccucaaaauaucugggucaacaagguuugcugacacuuccacuaaaaaaaucauuucagucuaaauaauaaauuuauuuugaauggauuuggaaauaauacaguuacaucccagcaauaauaaauaaaaaaucacacagaccuuuaacauuuacuaaggauauauccuugagcauacaugaaucuuuaaaacuugugaccaaucccauagauuaucauuucccuuguauaaaaguugcauguauuauugcuggcagagaacaggaaacucugcuaagaaguggaugauggguauugacuggggaacucauuuuuccaagugaauuauucauacacauuaccaucaaagacuacacaauucaagcuaauuucuuagaaaaguucgcaugucaagggccuuuuagguuucuaguaaauaguagaaauaauaaauggcaacacaugccaaauuuauuauaaugccacaggcauuuaaauuagcuuacuugugacuuugcaucaaucauuuuaauuuuugcuuucuauacuaccuagggaagcuacgaaaaaaaaaucauaauaacuauugagugacuaauuccucccucagccucugcauauggaauucaaaguucauuaccuaccuucagcucaucccaggcagugucauuucuguugcagagaagcaagcugcagauuguugcuucauuaggaauaagaugaaaaaaauguuuggagccaaauuuugcagugcacacaucuuucacacuuccauaacuauuaggacauauugagccuagggauccaauaggcuguguuccuauuuuuuaaagauuagaaaauacaaguuguauaagcaaaaguggagcaaacaaccauuuaaaaguauauuuauuccuagccaacauaaaagccccacaagcauauaauuuaaaauaugaaauacaggauaaauaagaugaauauuccuaaacugcuaaguuauauucugcuauuaaaaugauauacaaauaaaguaaaguagaaguuauuuuuguuuacagaucucuuugaaaaucuuuuagaagucauuuuguacugucuucccagaaaagggcacauacaauuuugcauacauuuucaaggaauucagaaaacccucaaagcccauucaggguuuagagaccccaaauuaagaacuucacuaauuuggauuacgggugaugugacaggcuauuuuuuuuuaaaggcauuauuauuuucaauuuaaaauaaaugcugcuauccaaauaguuguguaguugaauuccuucgggacgcuacauagugaauauguaagaauuauuuuuuugucuggcaacuauuuauaaaauagcuaacugaauuaugccaaaauaaagugacaugcuuauuucacugcuauuauuugauauauuaaguauuuuguccuccuaccugcacauguaaaauagugaaguuuuauaaaccacaaguaaaaauaugaauaaagaaguuagcgugacuugaauuuuccaaaucuccaaacguaauggaaguuauguaagaaaagaaaccuacaucaaacuccuacaagaaacaauacuaaagucuaaagcuauaauucugagccauucaccccuuucagcuaguuuccuuuucuuucagacucaccuuuaaaagaugguuucuuucaaacuaaugggguuuaguuugaaagucuaaaaugucggccggguguaguggcucaugccuguaaucccagcauuuuaggaggcugaggcgggcauugccuaaggucaggaguucgagaccagccuggccaacauggugaaaccccgucucuacuaaaaauacaaaaacuagccgggcgugguggcaggugcuuguaaucccagcugcuugggaggcugaggcaggagaaucgcuugaaccuggggggcagagguugcagugagcagugagcugagauugcgccacugcacucuagccugggcaacagagcgagacuuugucucaaaaaaaaaaaaaaaaaaaaaaaaaaaagcuaaaaugccuaaaaacacuuccaucucaaaaaauuuauagaauauaaucacuaaacaauuucacuuauuugaauauuguuuacuucugaaauauucaagaauaaugaauacuuuaaaaaagugaucuaaguaaaaaacccaaaaucuuauaguauaauuucuuucacauggugggaacaacagauucugcaugagaaggccggcucuacugcuuaucagccacuggaugcugucacucaugucauuuaacuuuucugccucccucacaugagaggcaaguggggauaauaaugcauacuucacaaauaaaucaaaccaagucaaauguuaaaaaugcuccaggccgggcgugguggcucaugccuguaaucccaguacuuugggagguugagauggguggaucaccugagcucaggaguucaggaccagccugaccaauauggugaaaccugucucuacuaaaaauacaaaaaacuagccaggcgugguggcgugugccuguaguuccagcuacuagggaggcugagacagaauugcuugaacccaggaggcagagguugcagugagccgagauugcgccacugcacuccagccugggcgauagagugagacuccaccuuaaaacaaacaaaaaccucuguaagcugcaauaugcuucacauguggcacccauccacaguaacacccacuacacaaccuauaucauuaauaaacaggaauuuuguuugaaggccugaaaugagguaauguuaacuuagauuaccaggggagauagguaaggccaaaaacauacuucaucuaccuaaaaguuuaccugcgcuaugugccugguaguuuucccccuuuucuuuuuuucucaaaagcucucugcucccaagauccaggacuaaagcuauggcuauuaaugccauguuuagguauauauuaugggcuaguguggaaacccagcccccaguuacaauaugguuucuacgggaaaauguuugguuuuuuuuuuuuugauagggaaucuugcugucaccaggcuggagugcaguggcgcaaucucgguucacugcaaccuccaccuccuggguucaagcaauucuccugucucagccucccaaguagcugggauuacaagugcggccaccaugcccagcuaauuuuuuuguauuuuuaguagagaugggguuucaccauguuggccaggauggucucgaucuccugaccuugugauccgcucaccuuggccucccaaagugcugggauuacaggcaugagccaccgcccagcccuuucuguuuuuuuagauguaguccugcuuuguugcccaggcuggacuugaacuccuuggcucaaguaauccuccugccucaacuucccagguagcugggacuacaggcauguaccacacccagcuaaagugucccauauuuuaaaaaugagucuggaagacccaguauucacaaacuggaaauugccagauucaugcaaagcuaguagauauuuaaggcuaucagucugacuuaccauaccaacaacgaguuccaaggaauuauuuccauuauuaagaaacucuacuuuugacagucauuugagucuuaccaagguagggcaauaacccagagauauuauguauucaacacuuggcauacauauggcuccuuuuugauaauuuauacuaagacuuuuauuaaauaaacuuuaacaaugguuuaagucuaguaacuuaaaaauuggaaacaaugcagacuaaaugaucaucuuucugauagauugucaaagcaguuaaaggauacugaaaaguagcucacaucaggaacucuucagcuugucauuuuucuuuggcucuaacaguacuuauaucugcuuuuaauuugcugaguuuguaaaauacagugaauuuuuugccuauuuuaguucuguauauuaccaaauauauuucggucaauucaacaaacacuuuagaacacccacagugggccaggccuguaauaggugcugaaaguaaaagaugaucuugguucucaaggucaggugggaacaguuuugauauagguaaaacauaggugcauguacaucccccucccauuagaaacaacuacuuaaggagaaguacagaaguuugcuggaauuaugacaaagugaagaaaaagggucauucuaguuacaaaauuacuuucuaaauauaacaugauuuaaaaguuuugucaauugaggcugaagaauuuuguguaaaguaugaaagaccuuaggauuauggggauguuagacuucucaauaaccuguaaaauauuuggggguuagaugauauaguacauuagggggcugaaaauacauagaaaauggcuauaaucacugcauuuuuaguaugugaacaauacaggaucuuuuccagaaaccuuugcugccagaaaugauacugacacaugcugggucaauuuuucaagauguuaacagugacacaaaccaaaaauaucucugcucaaaaaagugugauuuauuaacuguaagaggcaaaagcaaagagugauuuuuaccugucauuuuagucagggguuccaucagagucacuccaauucugucuauggcaauaauacgaugcauauugagaaacugcuucaaagauggauguauaacuuuuuggcacaggacaagaucuacguggucacugauuagcugccuuccuagguuaagcagcugguccaagacugcauuuucaagagaaaccccauaacugaccaccacaguuccuucuccagugucagaagugucuccggauaaaguuguacaaaagagugccaccuugagggcaguugauuuuuugauagguaauagccucauuaauugaacuucugacauuucaaugaguaucccagguaauacaguggaaucuauaacucuuugaccuuuuaaagguacaauuaaacucuuuccuaaaaugauguggccuucagcauuuucuggaauuguaagcaaaaaggcucucaggaucaaagcacugacaugcucuguuuccuuucuggugagcauacaggcagguuuacuuguuaauauacuacgcaccaaacaaaggaggaucugaguacuacuaaaguccacugggauucgacaaccacaggucucagacuugagauaacugaugcaaagacucaaaagauguuuauuuaaucuaaugacaguggugggugucaagccuaaucucugaacauuuucaaucagguugcagcaaagaauagcugugaauaagccacaaucacugaagcuugacacaugauucuguauggaggcugucaggaucuuuaaaaugggaugugugaccaaaaggugacugagcagagcugaggacugugagguuguacacacguaaccuccaaagccauugugcagcugcuucagccuaccugaggggccauagcaugauguuacaauucuuuucaagacagaaagugugguccugacucucucaguugucagugguucacucuuacacaaugauggcuucuuagcuuccaaacgagacaucuuacuucaggugguaacuagugaagaccguuuuuauuuuguaaaccacauuuuucuauuuauugcauuaucacguuuuaacauuaaaaauuauucuuuaggaauuaaaguaugaauaugcagcauuguggcuauaaaaucaaaaaguucaauguuuaugaagcuaaucagcauagaaugauuuaaugacaaauuaguaauuccaaauauuuauuuuacuucacucuucaauacucuuuuguuugcuuugagacugaaauuuuacagacugcuuugcagaccucugcaaaaaguauguuccaagauggacaccuaugaaagauaucccagcuacaagaagccaguucuuucuaauccaacugguauuuuucaucucuucuuucgauaugaagcucagauucaaagcugcuucuuuaccuaauaaauaauaaaaaaaacauuuuagagaaauacuucccaagcaguuuguagacugcaguuuaauaauuuauucuaaugcucugcugccuuuuuagaaaaaggaacuacuaacuggcacaaacguccagaaaaugagaaagguagaccaacuuugacuuaaaauuccuuuauucuucaauaaauccccucuacaagaaaaagugcuuguauuucagugauucuguaaggcacaacaacauggcuagaaagcuuacagcacaguuauuugaauauggcaugcuucuaggagagaaaugcuacgauauaaaacagagaauuaggucucugagucuuuuuuuuuuuuuuuuugagauggaguuucgcucuuguugcccaggcuggagugcaauggcgugaucuuggcucaccacaaccucagccuccuggguucaagcaauucuccugccucacccuccucaguggcagggauuacaggcaugcgccaccaugcccagcuaauuuuguacuuuuaguagagaugggguuucuccauguuugccagguuggucucgaacuccugaccucaggugaucugcccaucucugccucccaaagugcugggauuacaagcgugagccacugugcccggcaagucucugagucuuaaaagaagucccaaauaucuuuauucuccaacaugaagauuuaauauuauguuuuuaucuauaauugugguuugcuuggaaacuuuagguuugaacagaagugcauuuauaucaagucauguuuguaaauaauuauaaaaacaagauagcuguuggcaugucuacugcaggaacucacuaauguauagucuauauuuagcugaauaauucugcacaacacauuguaccaaaaaacaaaccauguuuuaaacaccuggcuaaagucagagcuaauuuucuaucauuuuacguuaucaaucaaugauuuucaguuuuggaaauccuagucaacgaauccuccccaaagcacugguuaaugacaguacaugcaaaaaccaagggauaugcuggauaacaacaacaauaaaaauaggaucugaguugcaauucaauuucaaagucuaaauaccauaaaauguuauauaucaaaaggacauguagaaauacaauucuaguuuccuuaacaagguaguguccuugcuaaaaaaaagugugccuugaggcauaaauuccugacacauuaauaauaaugugugaaaagaauaaaaacguuagaucauagaucuuaucuguugaggccggguguuuuaaagguauauuauucguuaguauuuccaggaauaugcugaguaugguaguguccaggagagcauuuagcauaaaugaaacaaaucuauuuagccuaaaguacuuccuaaaaguaggcuacagcauaguauggugaucagaccaaaaccuugauuugaagaugugcaaagaggugggcagaacaagggaauguuaugcaaauguuauuuugguuaccauucccaauuuagcuaaagggcuguaaccauggcaacugggcccaaauaaagggcaaugauggucagcuuucuuccuguggugauaaagcuauugucaacuuuuguauggcaugaggagggaaagaaaaaucuguuuauugaugccaggaacagccaagguacuuaaauauuucaauggcuauuacagauucagcaaaaucugagaaauacauuuaaaugaaaccucacaaagugacuucuauauguuaauuugcacguuaaaacuuacauacacaccccacaauaaaaacuaugauuaagaaaaucguuuuucuaguuagaacauuuucaauacuuaauagugucauguaacuuuucaaaaacagaaugccauguuggcaccucugucagucuuacaguagugagaccaguacacauaucuuuuggcuaguauuucauuaaaaugacaaagaaaucacugaaagugguagugacucccaaaucauuuuaaagaugccaaaacuuguugaccuguggucacaggucuagaccugaacaaaagaagguacaagaaagagaaaagagaaaaaaaaaccaaaccacuggggcugguuuauagaacauguuuggaaguaucaguucagcucuauuaaaacucuuucuuccuaaacaaggugcuccauaauuccaagaguuaccauuagacgaaugguccugacuauucuuggaugcacgggcuuggcagauggguuuuuguuguuguugcagugauggauaacuuaauuaaaauaacaguaaaacuugcaugacuucuucuaaauuaagaggugcacuauaaaauaugauuuaaagaaaauacaaacaggugaaaguuuuuccuaaaagcaaauggaguucuuuggcaaaaagaaugauuauagguaugagguaagaaauacacaagguaagcugggguccuuuucugcccaaaaguaaggauguuauuaaagacuacgugggucauaucacaaggacaaaggaaaaacaacaacaggagucaacuuggagaggauccaaaaugggacaacuuuagcauuaaaaaaaaacaugacgacagcaacagauuaauauaacugaaauaaaugcaaacccacagguucauacuaacaccaaaaacaaaaacccuaaguggcuugagcacucauuauuauaaaaaccaauaaagggaauuacagggauaaaacauuaaucuugcuuuccuuguauaaaugcauuuugggguaacugaauaguugacgauggaaaguuguuccagcuaauaaauggagaaggaaugauagaauuugagcagcaucauuuggcaaccccuaaugaaauagugcauuagacccauauauggugguugguaaauuaagccuauggaccauauccagacugcugccuguuuuuguaaaugaaguuuuauuggaaagcagccaugcucauuaauuuguguacuguguaugagugcuuuuacacuacaacagaaagcugaaggguugguauagacacuauaugaucugcaaagccuaaaauauuuacuaucugaucuuuuauagaaaaaaaguuugccaauuucuagguuacagcaaugauaaugaauagucgcuaauaauuauuaaguaaaagaucaccuggccaacauggugaaacccugucucuacuaaaaaaauacaaaaaacuagucaggugugguggugggugccuguaaucccaguuacucgggagguugaagcaggagaaucacuucaacccagaaggcagagguugcagugagccgacaucacccaacugcagccugggugacagagugagacuccaucuuaaaaaaaaaaaaaaaaaaaaucaaaggggaacuuuauaauggaaagaaacacugcuaacuugccuguuaaucuuagcaacacuggcuagacgcaguggcucuugccuguaaucccaucacuuugggaggccaaggcaggaggauugcuugaggccagaaauuugagaccagccugggcaacacagcaagacccugguucuaaaaauauuuuagaacuuagccaggugugguggcggaugccuauagucccagcuacuugggaugcugaggcuggaggauggccugugcccaagaguuugaggcugcagugagcuaugauauguuacugcacuguagccugggugacaaaucaaggccugugcccaagaguuugaggcugcagugagcuaugauaugcuacugcuacugcacuguagccuucucuguaaaaaaaaaaaaucaacaucaucaucaaaaguggaucagacauuauauaugaaacaacaugauuaccuaggaucuauuccacaguaccauccaugaaguauucuuguucaaaaaguaaauuaaaaaaacaaaugaaaguagccucuugauauaauuacgagauuacaggaaauaggggagagaaagaggaaauuguuaaaugacaagaugaggaagcaaucagccaaacugagaaugugggaaauuuuuuaaaaggcagauuuaggaggggaauugaaaagagauauuaucuaucaaaugcaauacguagaccuuguuuggauccugauuccaacaaaccaccugaaaagauuuuuuauagacaaauucagaaauauaaacauggccuuggguaucaaauuguagguaaagagucacuguuaaguuuuucuaggugauaaugcaaauguguuuguguauguguguuuauucuuacuguuaaagacacauacaaaaggacuacauaguggagcuuaagauuugauuuaaaauauucuagcaguucaaaaaacagaggaaaagauggauaaaagaagacuggcaaaacgcuguuaacuauuaaagcugguuguggcgaaaugcccuuaacuauuaaagcugguuguggcaaaaggccauuaacuauuaaagccaguugauggauacuugagggcucaauauacuauccucucuuuaucuugaggcauguauguaauuuuccauaaugaaaauaagaauagaaaauaagagacaaauaaaugcauucuuuugauguacuucaacuauucggaauuuguguuuaacuuacucuaaauccggcucuaacuuuugcuuacuaaaagccuguuuaaauaucugcuucugcuugcuugacuggaaauguuagccucuaaaacuuuuaacuauugcugcacuggcaucuaaaaucucuuacuacauucaccuaacauuuuagaggagauucuuuucucagcucuauuuuuccuccaagaguauuucuuuuugcaugagaagaaacuacuugauuuucuuccuccaaaguuuggccauaccuggccuccaaacuguuaagacaucuuuuuguucuuuacuucuugucauaaguacaauauacauacauaauauaauggucuuacuagucugaaagacuauauauauaaaaauccagcaccuaauaaauucucuaacucccugcuuauauauauuaaaacucuuccuauaaauacaaauuuuauauagaauguccuaaaguuacucuuuuaaguuguuaagcuucuauguuacuaccuggcuuuuauauuuaauaauugucuaauauauuaagcuaugcucuuccacuucugcuuaugaacauuuaaaaguaaaaucuugauuuaaaauauuguugaaaccaguaauuauaccaaaagucaaaaucucagaccaaggcuuauaaauaaggaaaaucuuacugagguucuucuuccauaaagagcagaaccuuacacucaucuaucuuauaacaaaacuuagagcauauuauucaccucaagguuaaaaaguaaauuauaauagaaaaugcuuuacaauuacagggucacaguucuuuaucugaaacuccuugggccagaugaguuucauaauucagaauuucuuagauuuuauaaauacaauauaguguauauaacauacauaaucaauauaaucauaauauaguauaacgcuauauuauaguaaaucaaacgugacaaaugccaauaaaauuucugcagugaaacucaauuuucauauuaaguggaauaaaaacagugaccucccccauuuaucuaugagggauauguuccaagaccacccaguggaugccugaaacuacauauagcacuaaacccuauauauacuauguuuucuucuuguacauacauaccuaugauaaaguucaauuuauaaauuaggcacaauacuccugugcuuuggguacauugugaaguaaaguaacaguuaccugaacauaagcgcggagauaccaccacaguugaucuaacccagagugcugcuaagugacuaacgagcagguagacagacaagggaaugacucacauccugcguggaugaaguagaauaucccaggauuucaucaugcuacucagaaaggugcauaauuuaaaauuuaugaauuguuuauuucuggaauuuucuauuuaauauuuucagacuaggguugacugcagguaacugaaacugcagaaagccaaacugcggauaaagggagacaacugcacugcaaauugccucaugucaguuaagaucaaguuuugcugucaaaggagugaggauaaaauguuuugguuuugagaacuuuuugaauuuuggaauuauggauaagggacuauagaccuaaauuauauaacuucauccucuuuauuucagugacucucaaaaguaacaaauuauggucaagcuaaaauaguugauguuaagaaaugaauacaauuaguuuuguauuguuaaaaaaaaaagaacacuaauagaagaaaauaaucuuguauaaauuuggacuuuugugauauguaaugguaaggagucaggggcuccuuugcacacauucaugauccuggugaugcugcuagcaaaacugcucuuucccuuugcauucaauugacugccaggcaagugucaaaugucucugcacaacgaacuuuucuagaaacaacugcagaauaguauuuugccagugggucacaauaaaaacaacagguaacuuaccaauuuaggcuuuuccuugccagagaucuaaaagauugaguuucccauuguuggaaugugccauaugauuaaccaaccagauuaaauggaacuuaccugaagauugcaagccugcuacuuccccuggauuuggcucuucugaagauuugaaagucccagacuaucuugcucaggaaugucgucguuuuuagguauuuggaaaacagggcugcuuuugauucuguaccaccccaaauguaugagcccaacuaaagggaccauaacaaccaaaacuuuguagucucuccacaaguuccgaaggcucauaguacuucagcaucaguguaccuaagaaaagguuacaguuagaggaaaaaaaccacuaaaacccauaaccucccuuuaauuacauuucuaaaucacuacaaguagcaugcuguacucuaacaaaugcugacuguuaaacauuuuaaauuauaauacauugcaauguuaauaaacaaaaagagacaugucauugacccaaagggagcaggcagucagccuugggaaacuuacagagcaauacugacuuuuuggcaacaauugcaaaggagcaacauuaccugcuggaaaagcuauaugaaucuuugaaaacacacaugcauggaguguucuuuaaauauauuaauguucucugagccacaauagaguaagagccuuuuuuuaaauuauauuuuuuaaaaauuauaauuacaggcugagggugguggcucacgccuguauucccagcacuuugggaggcugaggcaggcagauugccugaggucaggaguucgagaccagccuagccaacacagugaaacaucguuucuacuaaaaguauuagucggauaugguggcgcaugccuguaauccuagcuacucuggaggcugagucaggagacuugcuugaacuugggagguggagguugcagugagccaagaucaugccacugcacuaggcaacagaaugagacuccaucacaaaaaaaaaaaaaaaaaaauuacauuuagucacaauuuuaacagaagaaucaaacgguaauccacaaauaugcaguaagaauuuagguucuauauucugacaggauguagugauaguguuucaacugcgauugcaacagcugaacauggauuccaauugcaguaaaagauuucuggcuugaacgcuacaaaucagaaugaauguaaugccauuuccacauuuaugugcaaaacuacugcauuuuagaguguuugcccugaaucacuagaaaacccuaacuuacaggguuaucgaccuaguuuagacaaagaaacuggggcuagacaguugccuggaguuacaaaguuaguuagcuuuuaaaauauauauauauauauuuuaaauuuggaaaggauggaaguagggcccagaaagaugcuauguuugaugaucuguuggguuugggaacuugaaucuggacaaccucuaaagacuccuuauacucuuaauaaggacugcuccaccaucuaugagacaugcuaugaacuuggcucaauugcaucucugaguuuuaguaccaugaaaucuccuaaauuacuuuauuuuugucuaaaugccauuagaaaaaggucugaaaagaauuucuuauucccccuuuuaagaccaaaacacaauaguacugaguuaaauagucugaaccaucuguguucuguguauacauacuaaaaauaauaaaagauguuaucuuauagcuaugaacauguuauucuuagcauuauaaaucauuucucccaaaggucucaauucauauuuuauaaggacuuuguggcaaaauuuuaauuacuagauagaggaaacacgaccugcuuuguaaaugaaaguauuuuauggccuuuuccuuuucuaacguacugugguauacuauauacuuuuuguaaccuuuagagaauacaccuuuuauugacaugcuuauguuccauuuuuagagggaaucaauuacaaauaacuguaucauaauuaaauuucauugugaaguccaaaggcaaaagccuuugggaauuuaaggguacaauaaaauaacugggggaggaauuuagaguaaggagggaagaauucuauuaagggcuacuuacuuauaggagggacagaggcugcaccaaaggucagcuggccuguguugauugacauauggcauucuuguuugcaaacaccuuaacuaaaggccuagaagauacuguuauuuauauccagucucaauacuuaaggugacuuuggcaccucuauuccccucaacaugagguuaucaaguuauauuaucuuuuuuuuuuuuuugugagacagagucuugcucugucacccaagcuguagugcaguggugcgaucucagcucacugcaagcuccgccucccagguucacgccauucuccugccucagccucccgaguagcugggacuacaggugcccgccaccacaccuggcuaauuuuuuguauuuuuaguagagacaggguuucaccguguuagccaggauggucucgaucuccugaccuugcgauccgcucgccucggccucccaaagugcugggauuacaggugugagccacugcgcccggcccuucaagucacauuacuuuuaagagccauuucugccauucaccauuuacuucuccaugaucauuaacauaauucaacauuugucagcuuuuuucugaacuauaaacucaaggaaaaaaaacccuagcuuauaaaaagagauuagggccaggugcaguggcucacaaaaguguaauccuaacacuucgggagccugaggugggcggaucacuugagccuaggcaacguggcaaaacccguuucuacaaaaaauacaaaaauuagcugggcaugguggcgcacgccuguaguucuagcugcguggggggugcugagguaggaggaucgcuuggaccuugggaggcugaggcugcggugagcugagauaacaccauugcacuccaggacaggugaugaaaugcgaucguuucaaaaaaacaaaccaaaagcaaaaaagagacuggauaggauaaaaggauguaauaauaaaauugagauuuguaacucaagaacuaaaauuaggaacaaauuaaaugacaaucuguaacacuaauguuuggggaaguguuguacuauucucuccagcaaagugguuaacagcauguaaugacauaguaugaacccucuuugagaagagugaaaauuauauaggguuagcucccuauaauacuuagugaaucuuuaggucaucucccaguuaaagauaaaagaaaugcucaauuuuauguauauugugcuuaacagucuauuacucuuuccauuaggauaacuuaaggaucgaugaaucuuuuucuagauuuagguuuaguuaaaccuggaaaucaguaucuauuuuaacugaaaacucuauuugcuaaacaucacugagacucaguacaguauuuccugguuaguaaaugauguagacugauuuaaugauuaauugcuuuaauguuuacugaacaucuacauguccccacuuccucaaauucuccauaucucauauauugauuuggcuaaugggggugagagagcaaguaacuauuuucugacagauaauucuguuguccuuugagaggcuugggaaaugauuaggaucaguauggaagggcuuuucacguuacaaacuauuuuuagaguuuucauuuaauucacauaaaaacaauaaguaucacacuguacauauaauagucccuuuucacugagcaagauggaauuagcacuuuaaaaugacauuggcauauaaugagaccucaucucuauuuuaaaagaaaaaaauauauauuaaauaaaaaggaaaaaaaaaggccaggcacaguggcucacaccuguuaccccagcacucuaggaggcucaggcagggggacugcuugagcccaugaguucgagacugccugggcaauacagugagacuucaucucuauuuuaaaagaaaaaacauauauuuuuaaaaaaugacauuggcauauaacuuuaaacuacuucauuucuuucacuuaauagugaaaaaucuccaguacauuggauguauucuauugccugcauaaccucuucucagggcaagacacauuagaccuuacuauaccuuacuagcaaagcucauugcuaguuuuacaaaaaaaaaaauaguuuucaaauuuuauauuugauaugguaguuagcgagguaauguguuauuuauuuuguuuauaaacucuugcagagcuuuuacuuacaaucaaacauauuuuggggauacaauuuaaauuuagcacuuuuuuucuucuuaguuccucugugguuuuuuacaaaaugaaaauuagagcagggcacgguggcucaugccuguaaucccagcacuuugggaggccgaggcagguggaucaccugaggucaggaguuugagaccagucuggccaacauggugaaacccugucucuacuaaaaauacaaaaaauuaggcuggugugguggcaggcgccuguaaucccagcuacucgggaggcugaggcagaagaaucacuugaaccugggaggcggagguugcagugagccaagaucaugccauugcacucccaccuaggcaacaagagcuaaacuccgucucaaaaaaaaaaaaagaaagaaagaaaauuagcauuacuguucuuuucuaauaaauauaguauaguauaaccuuacuuuuuaaaguuagcaaauauagaaacaaggaaaagagagcuaaaaucuuuuggguguaacaaaaaugugaucaugauacacaugcuguuuuguaaucccucuugcaaagaauauaaaucuccauuaucauuuuuaagagcuauacagcauuugauuauaauggcgauauccuaauuugaccaaucugugauugagagaaauuugagauuuuucaaugcuuuauugcaaaauaugcuauggcaauaaauauuuguguaaauacuccagaguccaugcucaaagccucuaugugcugcuuuucagaauuaacaaauuucuuaaaaauuaacucauuuuucaaaugaacuugacaagaaaguuuuuaaaaccuugacuuuuagaaagguucaugauacugagaagcagacagacugggagauccaauuugugaaacaaacuuaagcuauuuacaguuugccuugagaugguccuucccucaaaacacuuggcaaguuguuccaagaggcauggacugucuuguagagauucugagucuaaaacaaagauuucucaagaauaagcucaaaaugaucagauuugaugagcaguaacugguuaaucccuaaaauaaguuaguguuugaugcucauuuauugaacuuuucaaguuuggagcaaagcaacaagagaaaugagauuuuuucccuuccuuacccucuaauguacuugccacugcccuuucuuucuuuccugaaucuucuuuaaacauauuucuaaaaaaagacuccuuuagaaggauagagaaaucaagagacaugaaaugagauuaguaaauuuuagaucaaguaaaauagaguugauauuuauaguuucauuuacuaaaaugucuuuuguuaaguuuagaaaaaguuuagaggcaaucuuaauguggauuaugcuuuucauauucuucucucaaaaguauggucuuaaauuauucaaaaguuucauauuuuucauuuuguuuugcuuucauagcaacuuuaugagaucauuuuauaaaugaagaaacauuaaaugauugauucuaagauuacugucaguuaacuguggcauucaauuuagaugugaagucuuuaaagucuugccuaguacucuacuaagcaauucuucaagucaagaauuagugccccagcuugggcaguacugucuaucaggauuuccagugugugaucacggaugaggggaacauuuggagggcgugaggcacacccuugaggaucacugaggucaacuagcuuggggcaucaugccuggcauguuguucuuuuuucuuuuuuugggacagucucacucuguugcccaagggggagcguaguggugugaucucggcucaccuccgcaugccagauuuaagggauucucguaccucagccucccagguagcugagauuacaggcccacgccaccaugcccgacuaauuuuuguauuuuaguagagacgggguuucaccauguugcccaggcuggucucaacuccuggccucaagugauauguccgccucagccucccaaagugcugggauuacaggcaugagccaugcacgccccguggcauguccuuggcugauuuucaugucagguauauaaaagguuaacagcugucauuucacuuguccaaaauuagagggcaucuuacaguucuggagguaagaaaaacaaaaaaauuagagggcaaaagagucuauauccuccaaaaacacauccgugaccuacuaaugguugagauuagcuggguuaguucaguuuucuuuaauuuaguucucaguauagaaugacagcaagagauuaaugaacagaagagggagaacuugcuaugcuucuaccucauuauaaauacuguaaucuuuuagaguagcuuaaaggccaagaaaagaaaacacugacacacacacacacacacacacacacacacacacacacacacacacacacaaaguaagguuaagggcaaaaaggcaagcaagcuuccuagaacuucccaaacagcuggaucuagccaucagauuauucuaucuagcauaguauuaguuaaagccaucaaguuuuuuuaauugcuuccugcaaaauuaggccuaaaauaacuuggaugcagggaauguuacaucaaauguucucauuuugccuauugggcuugcugggcgccaucugcuggccuuuuggacacaguguaaaacggauucuuuuuggucuuaauugcuguugugauuugaaaaaauuguaauuuuuaaaaacuuccacugaauguaauuuaaucaugagaagaacauuagauagaauauuaaaaaccaauuaacccagcucuugugauaaugaaacuuuaugaaguuuacuggaauuguacuaugccuuuucuuuuacaaugacaauguuggcuuuagguauuugugaauucuucauuucugaauucucaucaucaacauucaaaaguuauuuuuuauccucaauuuuuaauacagcaguuugaauuguggcauuuuuucuguguacacaauagaaaagacugcacguggucuucaacugugcuaugaaaugaacugacaugguaaacagaacaaucguuuuccuuuuucuuuuccaacuauaucaccuaaaauaacacucauuuugcuggacuucuccagucuuguaaaaacacacaccccaaaaacaauacuguaauucuuaaugaacccauggaucauaauugaguucuaaaguuuccauucugcaaauccuaccaccuuccccaccaaaccauucaaggucagcuugaccuauauccaagagcugggcugcuaacagcguaacugagucaggaguggaucugcagucagaaggccgaaacagguaugcguaaguaucuuaugucuuuugcuauuccucccugcucauugcugugaauuuaauguauuuguaaauaaaaaauauacugaaagcaucauaagucuuauauggggguuucacuaauuguaggcagucucaaauauuaagcaagugauuaacaacuaaugagaagugaaaacuagcuuaccagcaagcugugguuuaucacaaugguuguagugguuuauagaguugucugagaauccuguccccuuucacuguuuuuacacccuggcugccauuugaugcuggugauugguggaggagaggggaguagguaucaugcagauagccagauuguuccagaucagauaccuagaugaaugggccuuuagugcuacagcaaacacuuuauguuccugguauguucugaaucccuaaagagcccauuucuacccuucaucauuuucaagauuuuaauuguaugcuccaccuucauuucugcagauaaccuauuggccagaggacauuauagcucuuuagguaugaacaccucuaacuuguuguccccuuaugugcaccuuagcucucaacuaaaucuucuuucagcugggcgcgguggcucacgccucuaauuccagcacucggggaggcugaggaagguggaucacuugaggucaggauuuugagaccaguuuggccaagauggugaaaccccauuucuaccaaaaauaugaaaaauuagcuggauguggugggugcaccuguaaucccaguuaccugggaggcugaaacaggagaaucgcuugaauccaggaggcagagguuacauuacagugagucgagaucgcgccauugcacuccagccuaggugacagagcaagacuccgucucaauaaauaaauaaauaaauaaaacuccuugccugcugucagaagaacugguauuccuauuaccuguguuccagucccacuuucuacugugucuuugggguucuaacuucauuauccccucucaucuaccuccaaccuuccacucuuaagggccuuucucuuuugcauaacuaugacuauuuuucuccacugaaaagagucaaaaacaaauucccuaaggcaacugcccuuuaccaucuuccuucccaguacuacacaaucucuuuccuuucaaauaaugcaucuuuuccuagucacuucccauuccaucuucaaacccaagcaaucugcuuuuguuucauucuccauggaaaguguucugaccauaaagaucaccaauccuuccccuuacauaaucucccuguagccuuuugauguguucuugagacuccuaaguacucaggacucuauacuguuccuucuuagucuccuuuaauagccugcugguuuccauccaccuauucauccuuaucaaagaucugucuuugguaguguuuguuuccugggcggucucauucaauccccaaacuucuaugaucaugcauccacucuggcucucacacguucaucuccagcuuagacccacauaauaaacugcuacuguacaccuuugaacuaaccguccccacaaauagucucaauucaucucauauaaaaauaaguccucuuucccucccaaacugcuguuccaccuggauuuccuguuucguuaacaaaaagcaucaucuacuaagccauucaauucagaaaucuggauauacuggacucugcccuuuuccucaugcuccucaucaacucacucagcacauccugccauuugacauaaguguuucuuuacauaaucccuccucccuagggucacaguccagacccucgcgcccucacaugaccuccuugcuucaauuccaguaguucucaaacugugguccucucaacagugccauuagcaacacuugggaauuuacuagaaaugcaaauuaucaagcugccccuccugaccuacugagucagaaacucuagggugggguccaguaaucuguguuuuaauuaauucuuuagguaauucugaagcuaaaguuugagacccacuguucuagucuacauccacuaauccauucucuacacuuuuaauauagccaucuugcaaaacaaaaaacaaaaaaacaaaaacaaaaacaaaucugguuguauuccugcuuugcuuaaaagccuuuagugacauuuuugacuagagugaaaucuaaauuucuuaguacagcagaaagaaaaauccacuaggaucuagauccugccuaccaguuuucagaaagucaagcacuuuaaaucauuuuuguaagaaugcauugucauguagugauuaagggaugagcuguggacucauaccaccuggcuuugaaucuucacuuaccacuuuacaacuggcuguguggccuuggauuagucacuuaaucucauugugcuucaguuccauuguguguacaaugugaauaauaacauccauaucauaagcuugcugugcaguuaucacaauacuuggcacuuugucugggcucaguaauuguuagcuauuauuauuuugauuaugucaaaaagaaaaaaaacauuacuggaauuaaccuguaguauagcaagaacuggagaggauuagaauuaaugcccaaacuaagggaagugguccccauaaaggaaggcccacuucucugggcaguuucaguuaguuagcuaagaauaaaaauacccagucucaacagagagguucagaggucuuugggguuugacuaggguagugaaucugguaauuagauucuaggauauuauaggacagauaacugucaagcuucuaaagugagagccaggaaagcugugaaggaagucagaaaacugauacagagcaaagaagcaaagacggugaaaaauuucauguauguuucucuaauaacaguuaauagagcagccaagugaucaaaugugagaauccuacaaugacugaaacuuggucgacauuuucagacacgcuguuggucugaaacaacguuuuacauaagagcaaaagcauugaguaauggcgagaaucaaagucuaaccuccaccacaaauuaguuauggucuuggacaaauuacuucucuccugccucaaugucaugaucugaaauagggggccacauuaugaagagaacuauauacauucauagcuuaguacagugccuagcaugugggaagugcucaauacacggcagccauuacuuuuauugggaguauauuaucuuauacgaaucauauauaaaaauaggcaccccuggagguuccugcuugaucaaagcaauuauauauuaucaucgaauauuuugacuaaaauuggguuccaacuuauaaggugaggaaauacuguaaagacaaauccaaacacagucauguaucccacauucacaauauuuagggauuagcaauuuucacuucaaauauguacaagauuaauucuauccaaaugcucacuuagugucuauuaggugcuagcaagacuacuagccucaggggggaacuaccaagaagaguaaggcaugauucuuguccucaaggagaauacagguuugagaagauaaugggacaaucuuaauaaaacauaacucaaugcuguauagggucaaaaaaccaaaccaaaccaaaccaaaccaaaccaaaccaaaccaaacccgcacaaaaaacugcauaaagucuuuaccaaguugacucauuuuucaaaaucauaguucucauuuuuuccucuauccuccucugaauuagucucaauccauuuuuacuuacuccaucuuuaguuacggcagggagucaagaucuagaaaaacuagucacugccacccacgauaacagaagguagcagccacuugucuucucugcuauauuccuagugcguagcagaaaaguagagaaucuuguccccuuugguccacagaggauggcuuauucuucugcuucagcucuuaguucagaugucaccuacucagagagccuuucucucagcacucaaccuaaaguguuuucccucucccuccccauuauucucuagcacgugauuccuucaaagcccuaccuuugugaugaaugcugugaugugccacccugaccccccuaaggaaugaaaggcuuauuuccccagcuccuggaagagcugagacagaccucggcugccagccuccguccaugauugacuuggcugaagagaguugaaguuaggcccuuuccagggaaacagacaucuaacgacagaucaaucaagggguauaaaagccuggcccuucucuucaacuuugaagggccaacccagcacuagaguuccugugggacugguggagaacauccuugagacuucacugcagcuuaacuuuuucuauugcccaauccugcuuccuuucuuccuugguaaucauccaaaaagucuucucuaguaaauguccugccucuaaaucuccucagagucugauucucaggaaacccaaccuaggacaaucuagaaacaucuugcucaauaucaaugugcaaucaccccucaguauuugggggauugcauccaggacccaugauggauacccaaauccagaugcucaggucccugauuuaaaaauuguguaguaggccagacgccgugggucaugccuguaaucccagcacuuugggaugccgaggcggguggaucaccugaggucaggaguucaagaccagccuggccaacauggcgaaacaccaucucuacuaaaaaauacaaaaauuagccaggugcaguggcgggugccuguaaucccaaacuucuccggaggcuaaggcagggagaauugcuugaacccgggaggcggagguugcacagugagcagagauccagcuucagccugcgcgacagagcgagacucuuugucaaaaaaaaaaaaaaaaaaaaaaaaaaucguguaguuuuguacacaacuugccaccuccuuccauguaccuuaaauaaucucuaggcuacuuauaauaccuaauacaacguuaaaugcuauguaaguaguuguuacacugcaguguuuagggaaugacaagaaaaaaggucugcacguguucaguacagauguaaccaucuuuuuucccccagaauguuuuuauuuauuuauuuucuuaaauagagucucugucgcccaaccuggagugcaguggcgugaucuccgcucaccgcaaccuccgccuccagggcucaagcgauucuccugccucaaccucccaaguagcugggauuacaggcgugcgccacugcgcccggcucauuuuuuuguacuuuuagcagagaccggguuucgccacguuggccuggcuggccccaaacuccugacucaagugauccgcccgccucgggcuccuaaagugcgggguuacaggggugagccaccaaaccccgccgccccaaaauauuuucuauccgcaguugguugaauucacacaugcggaacucauggauagggagcguauuguuucucccccaucacuagaacauggagucaggaccgugcaagucccucuuggucacugccguaucuacuaacucggcagugcuguagacacguguauaucuguuuauggauaaacugaagauguuaaugaaugaaugaaaccgucauauugagucucugaaacggcaacaggauuuggguauggucuuaucggggaggaagacgagcaugaccuuagagggucaucccuacaagguccacagcccugcaagccccgcggcugcuuucacguagcuggcagggccacgcugcacaacgucucuaacgccgucggagggcggcccccaccucccgacagccugggguacaccgugcacccuccagacagucaggggcacacggggccccucccagcgagggaggggacggggagucacagguucggcguagaaggcggcagcgcaggugggagcguggugaggcgccacuccuccagcucuccccaccggcgggaagaccuccucgccgcccgcauccgugccgaccgcaacauuuaccaucggcagcuauuucagaggucggucuuucgccuccuacagagagccagccuccuccuuguccccgcccucaaauauccuucagugaggacaccggugaccuuuggggguggagagggaggcgccuacaagccccuuccccucucuucggccggacacaaagcgggcuuuuccaccuagagucccagcgcucucaccugcgcaccagccgucgcgccgccccaggccgccaccgccagaggccccagaaacagaucucaagcagccgcugcugccgcggaucccgacaaccuucgcgucgcgcgagggcacggagcacgcgcagcucugcggucgacgccgggccgcccccacuccgcuucuccggguuuuccgugaagcuccagccaacagcggccgucaccggaaaaaacggggagcgaaguuuauucagcguauauuccagcaaauuguugaaacugaaauuuuaaaagaacgcauaaaauuuaaauaacauaucaaaauggcacagcuucugccuuuuggugagcgcuugacaaugauuuauugaaugaaagaaagaaauaguccacugcgcucugcucucuguccugacaugaccaauuacaaagcgcuuggauuugucgcucagcgccaguaucccgccucucugugcgguugucuggaaaaucaggauuuuuacucucccguaacucccgggaucggguuuggaaaacggacaugcgccgugagagcuaguugccuucuacuaaagcauccgcccucaguccuuccugagggcuuacagggaagugcggaguuucgcagcucguacucuucacagauuagauaauucacccggcauuuccccauccugcuucuggguuccaggacaaaacuuuuauucucuuuuaacauuaaaaaacauauaggaaguuauguucaaacauggcuauuuuuauuaaaauuuauccggcacugugaaagcuaccuuuccuuucucacaaucuuucgcaccgaauauauguuccauucuugagcuagucauuuuccaauguuaagaaaacacaccacagaaaagcguuuuuuuuucucucggucaguucaacugccuagcaccgugaguuaccaugauacguuauuugcuaaugagagucauuggggucccagccuuuaaaaauagccugcguccggcgccauuuuuguuuugggcccacuuugaaagccgcgauauucugaacagaggccauuuuucuuuugggcagauuccacgggccaucgaaguguuucgcugccaucuuaaauccuggcuguggccucaauccugcagcgaagcugcccagaucauuuuguguuugggcggcggcugaguucccaaacgcgcgcggagacccugggaaggaggaaguaagcgcgaaagugcuucccuuaagcuucugaagguuggcugcaguuccggcuaccuguguaguccgaguuuccacagccagguacuacuccgccagugacccuggacaguaacaaaacauauaaagcccgagcccaaaccccgccaccaucauagguaagcacauggaccucugacaaccucagauguuccuucaagugaacugaacuguuugcccaucuccucccuccugguuuuuggcuuugauuuuuugagacuuuuccgaauccuucucccuguacuuccaccuuucuucauuguuuucaaaaagccaaaaaguugcuaaacaucaggaugccaugagcaugggcauuacgguggagauauuauucaggaaaguuaacugucuuugcacaaagggaaugcaguagaugggccagguauuuguaucaaaucauggcuaccugcauccagcaguacaaauaccucccccuucccagacauuuuuggagaugugagguaaauacagauugcguuuguauauacuucccauucauucauuuauucauugcauuucuugaguaccuaauuugugcuaggccauaaggauucaggaguuagcuaaaaaaaauccauuaacucauggagccuacauuuuaucaccuugacaucuacuagguugagacaaauaacaguauuuuaugguucuuagcacugcuagacuguauaaacaaguauuugcuuucuccuuccccugaacuauuuuuuuuuauuuuuaguuuuuaauuuuuuuggccggguguaggaauuaaugguauugacacuuacuucuuggauccuagacauaacgauauuuguaagccaguuggcuagcguuaaaacuaauauuccaguuacuuagggccuuguugcuccaaguucauuucaccuaccaccagcaucagcaucccugggagcuuguuagaauuacacuucaugacucucaccccagagcugcugaaucagaaucuuccucaagaaguguaccuuaaaguucaaggaacauugauucagggcaugggcuaaagauacagcccuuucuuucuuucuuuuuuuuuuuagauggagucucgcucuguugcccagguuggagugcaguggcgcgaucuuggcucacugccaucuccgccccccggguucaagcaauucuccugccucagcguucccaguagcugggauuacaggcgcgcgccaccacccccggcuaauuuuuguauuuuuaguagagacaggguucgccauguuggccggguuguucucgaacuccugaccucaggugauccacccgccuuggccuccaaaguccugggaucacaggccugagacaucacgcccggccuggcccauucuuuguucaacccgugcuucuuaacuagauucacaguguauuaucaauuuauugcauguucuaaaugcaauggauauuugacagguuuuuuucugugcuuuuaguucauugacuugauguuagggcgucaauuuagcuuuccaaaaaguugaaaagagauuuugucaucccaauauacuuauauguaauuucuguuauaacaucugaaauguaggguuuucucuguaagucuuagcauccaauuuaccacugguuugcguuuuuuuuuuaaaaguuguuuacugugcuucuugcuuucucauaucuuguaugcauauuuguacuuuuaauuuguuaaaaguugaacucaaaaguuugcauguggacagcaguucaauacugacuuggaaaaccuugggccuugguuuaccaaagcuuuuuguggcaccuugcuuucuucugucuucccauuuuauuuuacuucuuuuauuuuuauuuuuugagacaggguauaacccuguugcccaggcugaagugcaguggugggaucauagcucacuguaaccuccaacucuugggcucaagcgauccuucugccuuggucugucaaagugcaggaaagcaggcaugagcgacugcacccagcugccuucugucuuucuuuaaugagaagacuaaaucaagaguucucagccuuggcugcacguaacaaucaccugggagcuuuaaaaacagacuccagcccuguaucugcagagauugagacccucuggaugaaauuaaagagccaguaaggaguaugagaaaacagaaacaacuuuuacguuuuauguugcuauguuagauuuucucucccuuaugguguuacuuaaaauaaucgggauuuugaaaaccaugaaaagaucuggauuaagaauguaaggaaccagcuucccaguaacuggucaacuugccaauuauuugcucuguguccuaagaaaguuguccagccuuucugcuucuccucccuccaucuauuaauugggaaaagaaaauaaagccacuguuguuuuuuauuuaguuucaugugguguugccaauuguagugaauguuuauauucugugagugugagaaagaaaaguauuuuacaaguacaauauucauugcuucuaguauuaacauaccucauauuguguguggcaguagaacaugauggguuaggaaauuaacucuagagcuagacucccuggguucaaauucuagcuccucuacuaaucagcuuugugaccuugaucagauaacuuaucccuucacuaccucaguuuccucaucuguaagauaggguugaugugaacguuagauaaauucauacaagaaaaaugcuugucauagugcccggcacauagucacagccauguaaauauuaauuaacuauuguuaaauuuuaugauaauuaaauuucugggcuuuaagguuuuguuuaugcaugcaaaucaccaggggaaagguauuacaguucugugacuuuucgggauaugaacuuguuuagaaaagagggugauauaaacacaauauaccaggccuggaagaggccuuuuuuuuuuuuucuguaaguacuuuuaaacagcuuuauugagguauaacuguuauacaguuaaugcacauauuaaaguguacaauuugguauguuuaugccagugaaaccaucaccucaucaagauaaugaagguauccaucaccccuaaaaguuuccucuugccgcauugucaucccuccagccacuccucuuccaggaaaccucugaucuaucgcuguagauaaguuugcauugcauuuccuagguguguguguuuuuuuuuuuuuuuuuuuuuuugagaugaagucucccucugucaccuggacuagagagcaauggugcgaucuuggcucacugcaaccuccgccuccugaguucaagcaauucuccugccucagccuuccaaguagcugggauuacaggcuuccuucaccaugcccagcuaauuuuucuuuguauuuuuaguagagauggaguuucaccauguugaucaggcuaccugaucaaaugaucugccuaccuuggcaucccaaagugcugggauuacaggagugagccaccaugcccggccacauuuccuagguuuuuaucuaacugcagucuuggaguaugugcuuuuugggggguacggguuagucuggcuucuuucaucaucaucauaaucauuuuuuuuuuuuaauuuuuauuuuguuuuagagaggaucuugcuguguuauacaggcugcucuugaauuccuggucucaagcaauccugccucagccucccaaagcacugguauuauaggcaugagccacacacgccuggccaucauaauuauuuugagaaccgucuuuguuguugggaguuuugauaguuuauuccuuuuuaauuacucagcgguauuccauuguguagauauauaauaauuuguuuacauauucaccaauugauggacauuugguuuguucuuauuuuuacaaucucauucucacauugcuuuguucuucucuagcuuauuuuaauuaaaaacguuuuuuucuuuuuucauuuuuuugagacugggucccacucucaggcuggagugcagugguaugaucucagcucgcugcagccuccaccuccuggguucaggugauucucgugccucagccucccgaguagcugggacuacaggugcgcaccacugugccuggcuaauuuuuuguaucuuuaguagaguuggguuuuuaccauguuacccagaccugucucaaacuccuggacucaggcaguccucccaccuuggccucucaaagugcugggauuacaagugugagccacgggggcuggccuaacaauuuuuuuagaaguuuaauuauuugguaaugaagccuucuguauacagugaaaccaagaggugauagucauaaagcauguuuguauuaaaacuucaccuuugcuguuauguaguuuaugaauuaauguuuugugaaugaaacauggcuuuuuaaaaaugcaaaaugugugcauugacuuuuaaguggauuguuaguucuugacauguacaugucuaaucacuuuaagcuguauuaaaccucaagucuacuuuuuagagauugaggacaauaauucaugcacaugaagaaaccuauuuauuagguagcaaaguagagaucuauaaagccaacccuauaauuucauaaaacuccccuuugucagggagauggggaguaccacuuauauuuugaguugauguaaguauauuucuaaagucuuuuugcuucuauuauguaaaagcgguuacuuguguuuauuuuaguauugacguuuugugcuugaauaaaucagaggugguuuaaaauuggauuugacucauauuaauuaugggauaauauauagaauauggcuauuacaauaucguggacauagaaauucauuugugucacuuuugauuuaucuucuaguuagaaaagauugcauuuuuuuuuuauuuuuugcauuuaaaaauuauuccagacccaguacgguggcucacgccuguuauuccaacacuuugggaggccgaggcuggcggaucacuugagaucaggaguuugagaccagccuugccaacauggugaaacccugucucuacuaaaaauacaaaaauuagcugggcaugguggugcacaccuguaauccuagcuacuugggaggcugaggugggagaguugcuugaacccacgaggcagagguugcagugagccaagauagugcaacugcgcuuuagccugggugacacagugagacucugucucaaaaaaaaccuagaaacuaaaaaauaaauaaauaaauauuauuuuuaauuuauguaaaauaaaauuauucuuggguauguaguuuucagaguuuuaaucagugcauugaguguuuuguaaccacuaucgaaaucagcacauggaacaguuccaucagcuccuuccuccccaacuucccuucugccaccccuuuguaguacuccuuaccccuucaccuuuggcaaccagugaucuguucuccaucauaacaguuuuugcuuugaaaugauuagauuuuaaaacuauuuuauuaaugauuaucagaacuuuuuuuuucuauguaaaggugacuggaaaacauuaguuaucagaguucuuggguuacaaaguggauugaucaugugcuguuugcuugugcucuuguuguuggaaugauuccguuuaagacacugagcauccacuguguaucaggcacuaggccccauaauuacauaucugaucucauguaauccuuacaggagccaugaaauagaaacuguuguuauuaucccauuucagagguaagaaaaccagagacuuaaaggaguugaauagccugucucaggucauacgaagagucagaauuugaagggauguguuuuacaagaaccuaaggacaugcaucaggugugggugccuaugucuguuucugacuagguauuaaauaaaaacuagauucaggccggacaugguggggucacaccuguaaucccagcacuuugagagucugaggcgaguggagugcuugagcucaggacuuagaaaacagccugggcaauauggcgaaaccucaucucuacaaaaaauacaaaaauuagcugggcaugguggcuuacaccuguagucccagcuacucggaaggcugaggcaggaggaucacuugaaccuggggagguugagguuucagugagccgugaucacgccacugcacugcagcccgggcaacagaccgagacccugucucuaaacaacaacaacaacgaaaaccuacuaaauuuugccuauuaguaaagcaucccaugcaguggcugguggggauuuucugugggcacagcaggaaggggaggcucagaucaugggucaacugacuagguugagaguauagaguaacuaaaagguagcacuguuccauggaauuauucuugguagaguaucaauguuugacuuacauuuagugacaaaggauuuuuaaaaguucuaauuuuuuuguuacuugcauuauccucuuuccaguguugaaucugacguguuuguuuuuguuuuuuuuuuuauaaguaaacuuuggcauucagaauuaccaucugaauaauagcaaaaacuaauucuuuuuuacacugaaguugccuuucagccuuuaucugaguggucaccagugaggccuuugcucauuugucauuuuuccuuggucuuuuguuaaguuugugauucauuccuugauauugguuguuuuggugguaagauuggugcauguguugggagaggacaacagugaaaugauuucucauucuugaauuauagcuguaacuucagaaguucuagggcuuugccuuugcuguuuucuguuucuguucccauaacuaaugaaaguuuuuuaagaugauagaaagaagcauaauaauuuccuagauaaaauuugaaaucuggagauuagaaaccuaaaguuaauuucuggucuauuuaaugagagcauuugcuugugacacaggccagcaacacuagaaagaagacaaaugugaauuucagagugccuuagauuuucccacagaauaaucuagagggucauugacuuucuuuauuagaguuuaucucugcuuuguauuuaaaugacaggacaaccaugugauauuguuuaaucuacuuccauucccuucccaaauuaauuuuuuaaagcucuuaggaucuuucucacuccacuaaaaacacacauguaaucauauuuuugguaggucauacccuaucaaagucuccucuuuguuaaagaaugcuuguuuucaggccugagagaguggacucaagaaugcacaauagaagaugaggcaucauuuguaaguuauaauauacucuaacuuagcauacuuauguaaauuauauacuuucagauauuuggaaaauugaucuuuuuggguuguccuacacuucuuaaaaacaggcaacaaaauaaaaaugccacugaauuuagacuugaauugccagcucugguagcaaaggcuuuuuaacauuuauucuguaaaccuggucacugagcuuguugcauccugcugaaagcaacuuugagggccuaggaaaauaaucauugaagaugcauuguugcuuuuugugugcgugugugcacacuugcuuuuuaaugaucaguaaaaaaaauuuagaaaagccucaggauguuccuugauuuaaaacuuaauuaagauagaagcuaauaauaucuuuuccauuuaaaugaauguuaaaaugccaguauuuuaaagacaaagaaauuuaugcaccaaaaacaucaucuuugugguauaaacuucaaccacaccucuaaucuguugcccauuauuuucaauaugaaacacuaggaucuucuggguauguguuuauaugaauuacaacucucagcuuuggcuguaugauuauauauaacugaaguauuauuuauuuggugaaauagguccagagugcuugaccucuuuuuuggaaggcuuacuguggaauuuggaauuuagggacaguaaagauacguuggauaaauagguauaaaucuaaaaaaaaacaaaaacaaaaacaaaaaaccacauucugauuuaguaacaucaauggacccaagucagcaaacuuuuaaugcauaacagugccacaccccaaauauuaaagaggagaugaauggacccugucccugggaaucuuauagucagggagaggaccagaguuaguuauaauucagugggcuaagcgugagaguagaggugguucaggugugucccagagaaggagcaauucacuugguucauagaaggcuccaagaaacagguggcaucugaguugggucucagaggauaacucaacucgcuuuaggagaggacauuccacagugcggcaugcaugggugaaggcagggagagcuggagcugcauguucaaggacaugugccaggaguugguuaugugguggcauuacaggugugaaguugccugugccauaagauggagguuugggcaggggcacugauauuguucggauuuguguuccugagcaaaucucauguugaauuguaacccccaguguuggaggaggggccugguugaaggugauuguucaugggggcagauuucccacuugcuguucucaggauagugaguucucucaagcucugguuguuuaaaaguguauaguaccucucucuucucucucuuccuccugcuccagucauguaggaugugccugccuccuuuugccuuccaccaugauuguaagucuccugaggccuccccagccaugcuuccuguagagccuggagaacugcgagccaguuaaaccacuuuucuuuauaaauuacccagucucagguaguucuuuauagcauugcaagaacagacuaauacaagcauugacaaaagggcuucugaugcugugggaaaucccagugaagaguuuugaauaggggacuuaugcucagauaccucuaauguuggguuuggggauggggaaguacaaggauagagauuagagguacuuuaagaggcuguaguuguaggggucuggagcugcuggcaucaccauguguuuuagucugccugugcugccauaacaaaauaccuuagacugaguaauuuauaaacaauaggaauuuauugcucacaguucuggagaaugggacguuuaagaucaaggcaccagcagauucacugucuggugagggguuucuuucuuucuuuuuuuuugagcuggagucucgcucugucacccaggcuggauugcaguggcacaaucucagcucacugcaaccucugccucccggguucaagugauucuccugccucagccuccugaguagcugggauuacaggugugugccaccaugcucagcuaauuuuuguauuuuuaguagaggugggguuucaccauguuguucacgcuggucucgaacuccugaccucgugauccgcccgccucagccucccaaagugcugggauuacagacaugagccaccgcgccuggccuggacuugcuuucugcuucgaagaugauaccuucuugcuguacccucacauaagguagagaggcuggggagcuuguuugagccuuuuuuaaaauaagggcacuggucccauucaugaggauggagcccucauuauuuaucacuuuccaaaguccccaccguuaauacuauuacacugggcauuagguuccaacauauaaauuuggggggauaccaacauguagaccauagcaccauguugugauuuuuccuucucgugggaggcggaugggcccauccaugacugucaucuguuccaucccagauaacaggcugugugcauguaguaagggaagagaacauguguuccccacagauucuccgucaauucuucuguguuuagauaucacaacuaauuggguuuuguaaaagaauagugagggacaugccccucagcucccagaggauauacaagucucaugguuggauguugcacagugguugucaaggccuaaauaacagaagggaugagaagcucuccuuccacccccuacugccuugccagaccugcagagacuuuguugggaggcaggggcaccuuacucuggggaccaccucuccccauuuuucuguuggauugcuuuuucuuuuuucuuucuuuuuuuuuuuuuuuuuuuuugagauggaguuuugcucuuguugcccaggcuggagugcaauggcgcgaucuuggcucacugcaaacuccaccuccuagguucaagcaauucuccugccucagccucccuaguagcugggauuacaggugugcaccaagacgccuggcuaauuuuuuuaauuuuuaguagagauggaguuucaccauguuggccaugcuggucuugaacuccugaccucaugauccgcccgccucagccucccaaagugcugggauuacagaugugagccaccaugcccagccgaugagauugcccuuuuuuuuuuuuuuugagauggagucucacucugucacucaggcuggagugcaguggcgugaucucggcucacugcaaccuccgccuccugaguucaagcgauucucccgccucggccuccugaguagcugggacuacaggcacaugccacuaagcccggcuaauuuuuuguauuuuuaguagaaacaggguuucaccauguuagccaggcuggucuugaacuccugaccucaggugaucugcccuacuuggccucugaaacugcugggauuacagccaugagccacugugccuggcugagauugcuuuuuuuuuuuuuuuuuuuuuuuuaacucagccuauuuccuuaaaauccauccaaguugcauguaucaauaguuuauucccucugccugaguaauaugccaggguauaaagguacugcaguuuguuuaaccauucacacguugaaggaugucuggguuguuuccaguuuguggcuguuaagaauaaaguuacuaugauggccggaugcgguggcucauaccuguaaucccagcacuuugggaggcugagguggguggaucacaaggucaggaguucaagcccagccuggccaugauggugaaaccccgucucuauuaaaaacauaaaaauuagccaggugugguggcaggcaccuguaaucccagcuacuugggaggcugaggcaagagaaucacuugaacucggagggcagagguugcagugagccgaaauugggccacugcacuacagccugggcaacagagugcgacucugucucaaaaaaaaaaaaaaaaaaaaaguuacuaugaacauuuuugaacaaguuuuuacgugagccuaaguucucauuucucugggauaaauucugaggagagcaauuuuuggguuguuuagauugauaagaaacuuccagucacuuuuccugaguggcuguaccacuuuuacagucccaccagugauauaugagagaucuauuuucucugcacccucaccagcauuugguguuauuguuuuuuauuugucuuucugguagauauguagugauaucucauugugguuuuauuuuacauuuucccauggcuaaugauguugaauaucuuuucauaugcuuuuuuaccaucuguauauccuucuuggugagauaucuguuugucauuugcccauuuucugauuggacuguugcuuuuuacuauugaauuuugagacuauguauucuagauagaaauccuuuguuagauauggauugcaaauauuuuucucccaguuuucuuagaaaaguuuuaauuucaauauggccaaagcugucauucuuuuucuuuaugguuuacauuuucucugucuaguuaaaaaacuccuuuaugauuuugaguucauaaaaauauccucugaaagguuuuaguuucacaccuuugaguuuuuaacccaucuguaauugauuuuugagucuuguaugagaucgaguccaauuuaauuuuuucucaaauagauaugagcaguuguuugaccacaguuuauugaaugagucaucucuucauuucacacuaauuucacagugcugcucccagcaugcaucaguuucauaaaugcaugcauugguuucugguguguggagucugcccccucugccuguuugucugcccguuugccaguacguuaguuuuuuuaccuugcauuguagcaguuuugcaagccccaucuuuuguuuuuuucuuccuuuucuagaagugucuugaucuuuuuuagucuuucucaguuucccuguucaaguuuguguuuggaguugcauuaaauuaguagaucagucagaggaugucucguauauauuuuuuucauuuuauuccuagauacuuuuuauuugugggaugcuaguuuaaaugauauuuuaaguucuacauuuucuacuuguugcaaagaaguuguuucuacugguucaucauuaagcauuuuguuacauuuuuguagaugcuuuuuuuagauuaagaaauuccuuuguauucauagauuucuaauguuaccuuuuuauuuuuuucugcuucuacugaaauguuuaugugccuuuuuucuucuuuaguuuuuguuuuuguguuuugagacagggucucugucacccaggcuggagugcaguggcauaaacauggcucacugcagccuugaacuccugggcucaagugauccuccugccucaguuucccauguagcugggaccacaggugggggcuccacaccuggcugauuuuuuuuuuuuuuuuuuuuuagagauagggucucacuuuguugccuaggcuggucucgaacuccugggcucaagcaguccuccugccucagccucccaaaguccugagauuacaggugugagccacugaacccggccucuacuucaguuuuuuaaugugaugauuucuguaguguuuagcuaaccuugcacuccucagauaccucacuugauucugauguuuguuuguuuuuaaguagguuugcuagauuaaaauugcuuuuagauuauugcuucuauguucacucauagaauugacugauuuuucauucuuuuacugccuuugucugguuuugcuaucaguacuccauaaaaugagcggugggaugauuuccuucuuacucuuuucucuggaagaauuuguauacuggcauuauuugaacccugaacuacuguugauuuuuggauucuagagguuuagaaauggaauagacuauaguggucaaccuuuccaacuccacuguuuuuuugaggugggaagaauuaaaugcugaggcuuaaauccaagggacacuuugcacuguaccaugacccggugauuucaucauuauagaaacccuaauccugaaguagagguaauagucauuuuauuauguaaaacagauggcucaaagccuucgcacacugaaguccaugcaaauccauguaagaguggcuuggaaaacaucacauuagccuuagucucuuaguuuucuaggcccaucugauuaagauuaagaauggaguuaagaaagggacucaggcacucugacagcucugggaucaccugcgagagcaggcagacgaccccgcuggccuacuguugagcagcuuugaguaggagcuagcagcucacaggggcagugauguguuuauugcucagugugaugauaacuuuaauugggaauaucagauaaauauucaauauaugguauuuuuaugaacauuaauaaagauucaguauauuuuuggaaaauuucccuaaaaacagaaaaaaaauaaaaagguuauaugcauaagugacucagcaccaauuaucuggaacauuuuuuucacccagcaggcuuuucuugaguacccucuaguguuaggcauugcucugagggcugcucacauaugaguguguacuccuuccaccauggauaaguaugauuuuaccauauuuggaacuuagcagauuggcucaguucauuucagauuucaauucaccguuuaauucauccccagcacaugccuagugcugucauaaaccaaagaaaagaugguuucuuuaucugaaaugacuuuagcaaauaugcaagcucaaggucuaugcaaccgacuuuccagauguguuaugggcuuuaucuugguagaauucauuuauuuauauuuugucuaugaagggugccauauuauguagcauagugauaaauuaauucaaacuucauuuucauuaacuauagaguuucuuucuuucuuugauuaacaggagaggaccacuacacauguagcuucauuugaggucauacucuguguugggaacuuggaccuuggcgugaggcagagggaagaaggucacaccuacccugacagcccaauuagucacugacuuuggcaauucuacaggugacagauggugcuaguuugcccucaguggaccugacaagacucuaucuagcgcuugguuaggccaucagcugugagaugcuggccuggucccauaaguucucauuaggggaauagauggcaaggcugggaguagagggucuguaagaucuauuuuagcccuaaaauugugacuuuuugaauuuccaaacauuguggaaacaagugaaaaaguuacauaacuugaggcagaguguguuaugauauuaaaaacagacuaaaauauucagaauauagauuucauucuucccagguagccuauuuuacauugucagaccauauuauuuuauauaaaaaauacaugcuuuucaguuccagaucccuagagaucauuuuuuugauauuggacuuugaugauacucuuugaaaaauucagaaucuacaucguaaauguagcuguucuuguuuuauugauaaaaguaaaaaaaaaaacccacaaaaacaaaaccuuauugugaguugaaaaugugaaaauguaacuguauuaguaauauuagccaucacaguaaccucacuguaauauggcucauuuaugaucuauccaaggcagauaugaugugaaagccuugccuuggccuuccacguggucuaucuguccuucaggaaaaaaaguacauaugggaaaacugguguguaauuaaaaaauaauuggaucacacauuuuuuuuaccugugaugguuacuuauugacaaaacuguccccuuuuuccugguuccaugucuagcugaugcacuugaguauucuuuuuaaguacccucauuuagggacuuccuuaauucuuagcaagauuauucaagccugauuuaauguauuuaaggugacugauuuuauguuuauuagacaaaaauaauguaauuuuaaaaaauucauauaaaguuuucaggacaaccuuuauauacauuguuuuuaaacaugugccugauuucccaggaacuuacuuuuuuuccacuuacacuugcgucuaaaugggcuugcuaagauaaacuucauuaaauauuuuucuaagucaugugcauuauguuauuuagagaauggaaaugaauacuuaacaugacuuaggguuuggauaaagauauuuuuguccauuuaaaaaauuaggaucucaucacauaggaggcaaacauuaaaacauuaaaaauuaaaaccaaaggguaccaauuucuaaaaaaucacuguugacugaguaauaauaauuaucaauacucaucgaaggccuagugguuuuuuuguuuguuuugagacggagucucgcucugucgcccaggcuggaggacaauggugcgaucucggcucacugcaagcuccgccucccggguucacgccauucuccugccucagccuccugaguagcugggacuacaggcgcccgccacuacgcccggguaauuuuuuuggguuuuuaguagagacgggguuucaccguguuagccaggauggucucgaucuccugaccucuugauccgccugccucggccucccaaagugcugggauuacaggcgugagccaccgugcccggcaggccuaguguuuuuguaugucauuuuauuuaguccuuucaauaauuuugaguuagguauuauuacucuuauuuuagaaauaaaauauucaggauacagaaauaagugcccuucuuauuuauuuuuuugagacagaguaucacucugucacccaggcuggagugcaguagcguaaucucggcucacugcaauuugcgccugccagguucaggcgauucuccugccucagccuugcgaguagcugggauuacaggcgcccaccaccaugccugccuaacuuuuguauuuuuaguagagaugggguuucaccauguuggccaggcuggucucgaacuuugaccccaagugauccacgugcguuggccucccaaaguguugggauuacaggugugaaccaccgcgccuggccguguuuuucuuguuuaaaaaaaggcucucaaacugcgcuguccauaaugguggcuaccuacaagugucuauugagcaccugacacaugaccaguccaaauugagauguccuagaaauauaaccaauuucaaagucuugguuaaaacaacaagcauguaaacauuuuuauauagcucacauguugaaaugcuaacauguuggcuauaucagguuaaauaaaauagauuggccaggcacggugacucaugacuguaaucccagcacuuugggaggccgaggcgggugaaucaugaggucaggaguucgagaacagcuuggccaauauggugaaaccccgucucuacuaaaaauacaaaaaauuaguugggcauagugacgggcgccuguaaucccagcuacuugggaggcugaggcaggggaaucgcuugaauccaggagguggaaguugcagugagccaagaucgugccacuacacuccagcccuggugacagagugagacaccgucucaaaaacauaaaauaaaauaaaauagauuauucaaauuaacuuuaucuguuucuguuuacuuuuuuaaaaaugcaacuacuagaaaacuuaaaauuacauuuguggcuugcauuauauuucuuuuggaagaccuguucuaaaaauuucaacgggcaaauaguuccaugcucaaggcuugugaauuaugguguccuccucaaccccuuuccuccauccuugugagcucucuucaucuuguucuucaguuuggggcagaguuuaguacuuaagaauuggauccaggcagggcgugguggcucccacguauaaucccagcacuuugggaggcugaggcugguggauugcuugagcucaggagaugaagaccagcgugggcaagauggugaagcuccaucucuauaaaaaauauaaaaauaggcugggcgcaguggcucaugccuguaaucccagcacuuugggaggccgaggugggcggaucaccugaggucaggaauucaagaccagccugaccgauaugaugaaacucugucucuacuaaaaauacauaaauuagcugggcgugguggcaugcaccuguaaucccggcuacucgggaagcugagacaggagaaucgcuugaacccaggagacagagguugcagugagcugagaucacgcuauugcacuccagccugggcaacaagagcgaaacugucucaaaaaaaaaaaaaaaaauauauauauauauauguaaauuagcugggcuugguggcaugaaccuauaaucugagcuacuuaggaggcugaggcaggaggaucgcuucaguccaggaaguggagguugcugugagccuagauugagccacugcacuuuagucugguugacaaagugagacucugucucagaaaauaaauaaauaaauaaauaacguaaaaaauuuuauuaaaaaaaaagaauuggaucccgaucacuaaauuaccgucuguauuuuugcuuuacuauagcuauugugguuguuauuguuuuuacuggucugcuuuguuucugaaacauuccaucaccauuagagaucuuuugcucuguuuaaccucuaugcccucaccauauuuauacacacacauucccuauuuuucuaauaucaucguaagcauaauauuguuuaggucaggauucaauguuugcuauuauaacuauaaaugcuagucauaacugaacuguguauuaagcacucuuuuuauuuacugcaguuuuuguuuaucauggaaucagucauugccuuguuauucuucugcuguuuagcuuuccauguaccuguccuaauucaaucucauauucuccacgaguugucuaaaacucauccguguguguguguguguguguguguguagaucuuccuggacgugccucuccccugcggccugcucuggucugcaccugcgcuucuccuguggucuacccacagcucucauggaggccuccuuucaccagauccucagcuuugcucugccuuucuccugucucacccuuccuguuuccucuuucuugcuuaguuuccucauuuuggugaagcacaucuuuaguagcuuccugagaaaaaauacaugaaacaguuuuauaagagcuugcauaagaauuuuuuuucuucccugaaguuuaaauccaguuugagguuggaaacaauuuucuucagaauuuugaagauauuucuccauuucuuugggcgguuuggaaccaauucugacuccugauccuuuguguucuccaccuccuacuaccccccaacgcacuuaaaaaaaauuuuuuuuuuauccccaaugccuaaaauuucacugggauagaugcuguaauaugggucagucuccauacuaauuuucauguguuugaccuccuauauuggucuuuuaauuuuaauuuauugucucuuuucauuuuuuuaauuuuugcugaaguuucugagagauuucaucagcuuuaucuuucaaccauucuauuaaguuuuuaaaauucaacuaucauuguuuuaguuuguugucuucugauaguucucuuuuuuuguugcugucauuuuuugcuuuauggcuguaguaucugcaaucucccuaaugauaauucuuaaaaaauguuuucuucucccuccauacuuuguuucagccaaauagguuuuuuucuguauuugguuuucuuucauaauuuaaucuugccuuaggugguaggugauuccugcuuguuuacuuguauuugagagugggacauuaaaagaugacuagaaucucugcauauggguguggggcuuauggauguggacuucacuuaagagccaucuguuuaggcuguuccccaaggaaccccuaugucaguauuuuuagacagugucuuuuagguuaguccaauucucugaauagggagguuucagucugcagucuggagaguaugggcaggguagagaggcaugcaggcagaggaaggucucuguauuuguauucccuaaugucucuuuguucagaagacuccaccuucuacugugccugguguuuuccagacuagagauccucugucuuacccucuucagaaaauacuccagguuucugccagggugagaaaaagcaguugccuggcugagcacaguaaaggggaauauuuaccuuuuuauugccaaauaauauucuauuguaugauauaucacauuuuauuuaucuguucauuaguugauggacauuuggguuguuuccauuuuuugacuauuauuaguagugcuucugugagcauuccuguauaauuuuuuuguauggaguuauuauuuuuuuucuuggauauauccuuaggaauggaaaugcugggucauguggcaacucuuuaaauuuugaaaugcuaucaaacuauugugcaaaguggcuacauuuuacaugccuaccaucaauguaugagaguuccaguuuauucacauccuugccaacaucuguuauuauuugucauuuugauuuuagcuauuuaucuuaauggguauaaaguaauaucucauugugguuuugauuugcauuugauggcuaaugauguuaagcaucuuuucaugugcuuauuggucauuuguauaucuucuuugaaggaaugucuauucaaauucuuugcuuauuuuuaaauuauuuguccucuuauugaguugaguucuuuauauauucuggacaugaguccuucaucagauguaugauuugcagauuuuuuuucuauucuguguauuaucuuuuuacuuucuugguuugaaguauaaaaguuuuuaauuuugauaaaaucuaauuuacuaauuguguuugucacuucuguuuugguaucauaucuaagaaacuguugccuaaugaaaggucacaaaaauuuaugccuuuguuuuuuccuaagauuuuuauaguuuuagcucuuauauuuaggucuaugauccauuuugauuuaacuuuuuguauauagugugauguagcagucuaacuuuauuauuuggcauauggauacucaguuguucuagaaccauuuguugaaaaaacuauuuucccaucaaguuaucuuaguacccuuguugaaaaucaauugaacauaaauuuaaggaucuauuucuaucaauuuuauuccaauugaccuguaugucuuuuauuuauuuauuuauuuauuuauuuauuuauuuauuuauuuauuuugagacagagucucacucugucccccaggcuagagugcaguggcgcaaucuugccacacugcaaccucugccuccugguuucaaaugauucucgugcuucagccuucccaguaguugggauuacaggugcacaccaccacacccagcuaauuuuuuguauuuuuaguagagacaggguuucgccauguuggccaggguugucucgaacuccuggccucaagugauuugcuagccucggccucccaaagugcugggauuacaggugugagccaccgugccuggccuauaugucuguucuuaugcuaguauagguugagcaucccuaauaugaaaauccaaaauacgaaauccuccaaagucugaaacuuucugaaugccaacauaaugccacaaguacaaaauuccacaccugacuucacaugacaaucuguagucaaaaugaagucaaaacuuuguuucaugcacaaaaucauaaaaauauguaaaauucaggcuaucuguauaagguauauaugaaacauaagugaauuuuguguuuagauuuggaucucauccccaggauaucucaucauguaugugcaaauauuccaaaaucugaaaaaauccuacaucugaagcacuucugguccuaagcauuucugauaagggauacucagccuguaccauacuguuuugauuguugugauguuguaguaagcuuuuauuuauuuauuuauuuuauuugauaguuuuucagacggagucuugcucugucacccaggguggagugcaguggcaugauuuuggcucacugcaaccucugccucucagguucaagcgauucuccugccucagccuccugaguagcugggauuacaggugcaugccaccaugcccagcuaauuuuuguauuuuuaauagagacgggguuucaccauguuggccaggcuggucucgaacuccugaccucgugaucuacccgccucggccucccaaagugcugagauuaacaggcgugagccacugcguccagcuguaauaagcuuuuaaauugagaaggcugaguucuccaauuugauucuucuuuuucaguauuguuuuuguuacuccagaucucuugcauuuucauauacguuuuaggauaaacuuguuaauuucuauaaagaagucagcugggauuuugauagggauuauguugaaucugagaacaauuugggaauauugcuauauuaaccgcuuuaagucuuacaauccaugaacacggguuaucuuuccacuuaagucuuuaauuucuuucaauuauauuuuaugacuuuugguguacaaaucuuguacuuuugcuaugcuuauuccuaaguauucuuuuucauguuauuaugaauagaauuuuucuuuaaauuuuauuuuaggacuauucauuguugauauguagcaauacaguagauuuuaaaauauuuaucauauauccuacaaccuugcugaacuuauuaauucuaguaguuuuuugaugauuuguuaggguuuucuauauaugagaacauauuguuuaugaauagacaguuuauuucuuucuuccugaucuggaugcuuuuuauuucuuuuucuugccuaauugccuuaguuagaaccuuuaguacaaugaugaaaagaaguggcaagagcagacguuucauguaaagacaugucucucaucuuaagggagaaaacauuuagucuucaucauuaaguaugauuuuagcacuugguuuuuccuaaaugucuuuuaucagguugagauaguuccuucuauuccuauuguguuggcuuuuuuuuguuuuuaauuaaaaaagcauuuuggguuuuuuuuuuuuguauuaugauuaugugcauuuuuucuguuauucuauuaauagaguguauuauauugauuaauuuucagaucuuaaacuauccuugcauucuugggcuacauccaacuugaucgugguguauaaucuuuuuuacauguugcuauguuugauuuucuaguauuuuguugagaauuuuugugucuucauaagggacauugaugugugguuuucuugugaugucucucucugguauugguaucaggaugauacuggcuucagaauuauuugagaaauuuuucuuaugcuucuguuuuuuuaaagaguuuaugagggauugguuuaaauuauucuguacacauuugauagaauguagcagggaagccaucugagccugugcuuuucucucuuuuuuuuuuuucuuucuguagagaugaggucuugcuguguugccuaguuuggucucgaacuccugagcucaagugagucucccacuuuggccucccaaagugcugggauuauaggugugagccaccaugccuggccagggccuguccuuuuauuugcaagcagugcuuaaauuacuaauuuaauauaguauuuugguuaagggcaauuauaagugaacauucaucucauaaauaccuauugauauuuuacuauucagcccaucuuuuuccuguauaauauccaaauaaaaagaaauuuuaauauaccuaauuguaacuuuuuuuuuucuuaaaggucuguaguuacuguggaaucaauaagccauggcaucuaagaaauuugcuguuaaaguaaguaauguuuaauagcuuuuuaaaaagaggcuaaucacuuucuaauauaacugagcucuguguuaauugaaaaucgagguuccuaacuuucugcuuuuuacacuugggacucugcaaaauuuuuuuuuuuccuucaacuuuuaaguucuggggcaugugugcaggaugcgcagguuuguuacauagguaaacaugugccacagugguuuguugcacagaucaucccaugacuuagguauuaagcccaguguccauuagcuauucuuccugauguucucccucccccuucccccacaacaggucccagugugugcuguuuccccccaugugucuauguguucucauucagcucccacuuauaaguuagacuaugcaguauuugguuuucuguucuugcauuaguuuguugaggauaaugccuuccagcuccauccacgucccugcaaaggacaugauuuuguuccuuuuuauggcugcuuaguauuccaugguguauauguaccacauuuucuuuauccguuuuuucacugaugggcauuuagguugauuccaugucuuugcuauugugacuagugcugcaaugaacauacgcaugcauguuucuuuauaauagaaugauuuauaucuugggagguauauacccgguaaugggauugcugggucaaauggcauaucugccucuagaucuuuagggaaucgccacacugucuuccauaauaguugaacuaauuuacacucccaccaacaguguaaaaauauuccuuuuucuccgcaaucucaccagcaucuguuguuuccugacuuuuuaauaaucgccauucucacuggcgugagaugguauugcauuguuuuggauuugcauuucuuuaaugaucagugauguugagcuuuuuuucauauauuugcuggcuacacgaauguccuuuuuucagaagagucuauuuacguccuuugccuacuuuuuaauggcgucauuuguuuuuuuucuuguaaguuuguuuaaguuccuuguagacucuggauauuagaccuuugucaaauggauagcuugcaaauauuuucucccauucuguagguugucuguucacugugaugauaguuucuuuugcugugcagaagcucuuuaguuuaguuugaucccauuugucaauuuuugcuuuuguugcaauugcuuuugguguuuuggggacuugacaauuuuaaguaggcauauggaaaauuuauauuuugagaaugagacggcggagaaaauguucauaugguuaugaggcguuccuugcuucaucuuuuaaagaugcuuuuuggucaucacuuggucuuuacuguuaaaaacuaucauucauauuccauguccauggcuugauuucucauuaugucaaagcagauaaaagguugaagcaaaagaaguaaucagcaaauucucuaccuggguaaaugccaggagaguucucuugccugguugcccucuuucauuuuccucuuauaaaugucccuuguuuguuccuugauggcugggguugagaccuucucagguguggauagaugggaggcuccugugugagggauagugggaagggagaagagaagaacugaugaugagugcaagaucuuggagaugcuuucauauauguugguguuucuuuaggacauuuucuguaugcuagucuuaccauaagugcaaguucaaaacaucaaaauauaaauuacaauagcuaguuggccagauuagauacuauguaauauuauagcucugucuuauuuuuaaccaagucagugcuuauuuagauuuacuaacauauuuauaaauuucauugcuuucaguuguuuuuuguauccauauauauauucuuuaguauuucuuucugugaaggcauguaagugaugaacuuucacuauuugugugucuaaaaauguauuuggucucacccuagaaagauauuugguugguuuuagaauucuagguugagcauuauuuuccaacaacaguuuaaagauaauuuuuaauuuucuucuggcaucuuuuauuacuacugagaaauguuuucauuauguauugaugcuuaaauccaccuuaaaacuuaguggcuugaaacacgaaccauuuuauaaucucuccugauucuguagguugccuagcaucaauugaguaauuuuuccuuuugauguugguuggggcugcaguucuacuuagggacucaacuuagguggaaaaugaaagauggcauacucagugcaguugaugcuggcuuugguuggaaucauugcuggaucuguuaauuguuguccuuuaguucucauccacgugccuguucugcauggcuugggcaucuaccccgguggcugaguuuugagggguagcaucuuaagacuugcacaaugaaagaaguauaauuugucaguccucugaaggccuagaugcagacaucucagaugccacuucuguggacuuccauugaucagagcauucacagggucagccuagagucaggggaagcugcacucuugacuugagaagcaguauuuucucacagggauugggagaauuguuggggugcgucuauggagacuacucaccucagaaguucacuguuggccugaucugauuccuucuugguuaucugucuuucuucucugauugcucuuaagauuuauuuuugucuuugcucuucuauaguuucacuaugaaaucucuaguuauagucuuguuuuuauucuggcuugggauaaaauguaugucuucaauuugauggcucaagucaucaguuuuggaaaauucuugaccauuuucucugccucuccuaauucucucuguucucuucuuauagagaacuuuuauuugaaguuuguuggauagucucauaugacuuuauuauaugcuagaggagugagauuaauuuuuccaagacugagcccugguagucugucugcucagaaaagggcugggcuucuugcaaaacucuguugaaacuggcuauggccaaguagggcagaccauccuggucaaccaugaaacuuggacgugaggccccuaauuaugcaagagaugggucuguuccauacccauggaaauggcauauucugcuaccauauuaucccaucuuauagugaugccugcaaggcuuggaacaaagcuuccagaucauggcaggcagaggaguugccucaaccgugaguaucaggcuagcauaauagggauagggacaggguucugacacaucguauugaaggcucugcacaucacuuugugguuguauuucugccucugacaggcuagggaccagugguucucuaaucauguaccuuacuuagaagcuccgugacucaagcauggggaucccuuuuuaaauaucugacaugaaguuuugccagguuucugugcucugcuccaggguaucaugagcagcaggagaccugcacaccugcuacugauguugucagacaugcuuucuucccagggaacacugcuccugaagucuugugugagugcuguguggccaguggccaauugccuuucccuguuuuucuuuuccuuauuacuuugagagugcuuuuuuccucucugaaacaggaucucacucagucgcccaggcuggagugcaguggugugaauauggcucacuucagccuugaccuccugggcuuaagcaguccuccugccuuagccuccugaguagcugggaccacaggcaugcaccaccacucucggcuaauuuuuuuuauuuuuaaauuuuuguagagauggagucucagagcgaaaaaggaagguauuacauauaaccacaaaacaagguuaggauguuacgaacuagggaaauucccaagaacaagaaagagcucuuauaaauuaaaaacauaauauaaaugaaaauaugauaaaguauggggcaaacaccaaggaacacugcccagaaaguagaacaaaaagauaauagauuaaaaaauugaggagaaaaccacaagaaaauuagaguuucagucuugauaugaaaaauuggaguucuagaaagaaaaacaaaugguugagaaaauauuaugaaagaaauaaugcaauacaauuuacuggaaguggaggauacaaacuuccuguuugaaagagcugugagugaauacacaauaaagucaaugaaaaagaguugugcuaagguauaucauccuaaaauuucagaacacugggaauuuagagaagaacuuaaaaagcaaacagauuacagacagagaaucaagaaucagaacacccuucucaacagcaauaacuaggagacaguagaacaauaccuuuaauauuuuaggaaaaaugguuuccaaccaagaauucccuuuacagcccaacuuucagucacaugguagaauagagacauuuauuuuuaggaugcagaauguagaaaacacuucccuucugaugcacacuguuuuagaaaggauguggucuuccaaaauaggggaauaaacagagaaagaaucagauaugggauccaggaaauagggaaccagucagaugagggccuaaccaaauuccuugaugauuacuguguauuuugccuagaaaguguaaggguggaaaggguaugauccuuucuuccccaucauggagggucacagucagcacuccuguaacaaaagaauaaguuaacuaaggaaagcauaacaaauuuauuaugugcacacaagugcaugggagucauacaaaauaugaacacucaaaagcuggaugugauggcauaugccuguagucccagccauuuggggaggcugaggcagaagauuugcuugagcccaggaguuugaguucagccugggcaacauagagagacccugucucuaaaaacaacaacaacaagaaaagaaaacccaaagagccagacgguugacccuuaauacccucuucguuggggagagggaacugggagauauagggguaacugauuuuuaggggaaaugaauggacucgagagacagaaauuaacuuguaaaugauucucuuuagaauuugaaugagccgagaagcagauaauaccuaguugaaaugccuguccacugugugguugcauucuuuagucuucucugcuauagauaauuucagggaauauggaaggcaauuguguuccucuuuggguauccaguuucugggcagauaauagagcuucagcggagagccucaucuugugcuuugggagagauaacggauugagaggaggaggggaggaggucagagagaccuugcugcugcuuuuuuaguuuagcaugucaaaguguuauauuucuggguauugguuucugaacugcaaccaaaguaaccaguccuauuggaagaagacagaggguuccaugaaagauuucuucaacaaaaaaugaaaugaauaaaauacaucauguauuuaaaugcauugagaagagauuuuuuuaggccugucagguagcaugggaaugauuuagucauaggaauauagaaaacuaaacaaaagaaaaaugaugcaacccucaguucucaguaaacaaaagauugugcaagauaggaaauuaagcauaguauacuacguggcucaacuuuuuguucuucuuguuauagagauggggucuugcccuguugcucaggcuggaaugcaguggcacagucauaacucacugcggccuugaacuccuaggcucaagugauccuccugcaugguucagcuuugaacagagguuacauuucauaauauugugaacuccaaguuuuggaaggcuggggaaggaaacaugugggagggcagguauaaggauuaagucuucauuuuccacauaaaguauauaaaacugaaauaauaagacauucguaggauaaacauaguguuuagaaauauguuggcaaauuaccagaucaaaaagcuaaguuucagugugguugcccauggugagugagaguuggagugagagagggggcuggaugaggcagaagaggccauuuuguuuuuuuguuuguuuguuuguuugaaagauggggucuccuuaugcugcccagucugaucuugaacuacugggcucaaacaauccuccugccucagccuccugaguagcugggacuacagaugugcaccacuacacccagcuugagaccucacuuugauaugucguuuuaauaugugucuaugcauuaauauaaaaauuaagugcauaaauaaaauguaggcugcguacagugguucacaucuguaaucccugcauuuuggaaggcccaggagggaggaucacuugaggccaggaguuagagaccagcagccugaguaacauagugagaccccaucucuaaauuaaaaacaauaauaauaaauaacauuuaaaaggaauuaauuaacuuaugcaaauuuuucacauagaugcagccacuuuugacuggguugaaaaguacuugguuagagcaggguuucaaaguaacagaaaaauugaugaacaccaaauaguuugacacuucaucuggguuguuuauucuaagacugcccuuggaauggcauuaauuauucaugcaaacgacuuacccaucugaccuuccugcauaugaauacuuuuuuuuuguuuuuaagggcugugguucuggccuugaauucuuuuuuuuaaucacuauuuuuuagagacaggaucucguuauguugcacaggcugaacaugaacuccugggcucaaacuguccucccgacuuggccuccuacguagcugggacuacaggcggcacugccaccgcacagcuggcucuugaacucuuucaagaguugaagacucuucugaggccagacuuccaggaaauggcaguagugcaugagauguaggaauccuuggaaguauaacuuucagggucuauagacuucugggcuacugcagcuucuagcagggagguauguccuguacuucagugagugacucuuauuuuaacugaaagaagugguagcagcaggcgcaucuccccaaggcuucauagcaaucuuaaacccaagcuuugcacccaccccaguguuuuaaaauuuccaaaauaauaaacucuuuaggguagggaaaagaucuagaccagagaucugcaaauuacagcccacaugccagcugcuuguuuuuguaaauaauguuuuaccggaauccagccacucccacuuguuuacauaucaucccuggcugcuuuuaugcuacaaugaaguggaggguugaguaguugaaacaaagaccuuauugcuugcaaagucugaaauaaacacacucacacacacugauuuauguauagaauauguauacaaauauaucuuuuauuuaucuauuuuuuugagauugagucucgcuuguugcucugucgcccagguuggagugcgguggcaagaucuuggcucacugcaaccucugccucccagguucaagugauucucuugucucagccucccaaguagcugggauuacaggcacaugccgccaugcccagcuaauuuuuguauuuuuaguagagaugagguuuugccauguuggccaggcuggucucaaacuccugacuuuuagugauccgccugccucugcauuccaaagugaugggauuauaggcgugagccacugugcccggccuacaaauauaucuuuuacagcacaucucaauuccuauuagcugcauuucaaauguucaguaggcaccacuggcuaguaucggcuguauuggccaacacagaucuaaauugcuguauccuugguacuccuaccuccugguaccuuaucagaauaagcauucaaugaaguuaccuuggguuaaacuggcugcaggugugggguaaguuagcaaggccaagguaaagccauuuccuuugcaagaaauagacauggacacauaauguaauagucaugaauguuuauccauuaaaacaaaacuuuaguaaaauaaaaaagaaauccaaauaucaaauuauuguuaaaagugucaagugauacacauggugucuaccucaggaaaguuuauguguccacccgcugccuuagaggcauuugaaaaaguauagaauguugccagggucgcucucaauaauaauucuaacuuaugauuuugaauuuaaauuuugggucccagcggagcagugcugugaaaguuuccuaccucauugugugucucuguagauaauuuccucugcuuccugcaucuguuuucuuggauuaguuagguauuauacuaaagucuagaauucuuuuggcugcagagcuuucucugcugcuucccuucccccccaaccuacuuuauugugggugggaaaauuuuuguugggagggcuugauuaauuagaagggauuccuggcuucccuagcgguggcagccugggaagauuacagagccuggcuuagugacaggccagucuguauuuaaggaaaaacucggacccgccagauuucucuggaaugugcaucuggcuuugucuucuacagggaauguguaaugauccccuccucuuucuucccacccauuccaggaggcuaaacgcuuuuacuuuugcucuugaugggguugucuacuuuuuauuuugggagaggggagggcuggaauuuaggggugggaagcuugagucguuuucugaaucuaaaguaaaagauuuaagguuuuauuaauauuuaggaggaaaggagagauuuuauuaaaaaaaaaagaacucccugcaucuuuacuaucaauguuuuucuuuccacucuuucagagcaauuauaguuuuauauucuucucugaauuucaguuaaccuuagucuucacauuccuuagaacaccacaaaaagagaaauaagccuaagaauugacaaugauuuccccuuuauaguaaaaguauagagcagcucuuuaaacuuucagagaaagagacaguugaaugguaaauggguaaucacuaggcuuuugucuugcuaguuugccucaaggaaucacuuaaauccuguguccuagguuuuuucgucuacuuaaaugggaacgugguacugacuauuaucagugcucauuugaaaauggcugcguugauuuuguguaucacauugaaaagauuuaugcaauuauuuucauaucaauugaguucuagguacugauuuuucuacacauuuuaagaaagaauaaaacugaagugccuaaacagaauaaaucacaaacauuuuaaaugguuauauuccuuacuggaaauaacuuuggagugugcaaccuuugucccgaagaaugauuuuacagagauuugucccugugaaacuuuuaaagugaaagaaguaccucuauauuucuucuccugauacuuaaagucugcaucuuccaauuccuccuuaauuucauguauuccuuguaagagcuuuauguuuuaaagacauacagggucaaugcgaguuugcagagugguugaugcuaugcccaaacuaacauaggaugcuguuuucccauucaguaucauuguucuauugcuuugcucaugcuggaagcuguauuuaaguaaguaugugcugauuucgugaaagaauugaaauaaaauuaguaaaaguuuucacaccagcagucacccaaugaguuuuaucucaggcuuagagcuuuuagauaccuucucacucuguaaggcaucugcucugaguguugaugacuuugaaacaaaguucuuggacuugaaauuaauuuuuuuuuucuaagaguucucucugccuuucuggccagacacccaguuuucuaggcuucauuuucccaguccuuuccucaugugauaauagauaaacuagucuguucuuuuuuuggaugacuaaaaauguguaaauacagcucuggcuucuuauccuccuuuuuagucucaacuuuccaccugccuccaagaaguuucugccuacauugaucccuaaaacuucaaacaaagaacugaguuuaucauggcuuucaucuaagcugauuuuugcuuugaaagucucugaugcugccuccacacacccugggcuugccaaaugaugucucguccuucauucuuuagucacuuacuaaacgcauuccugcucugcagagcaucuugaauuuacuccucuuagaaauucaagccuuuauuguccuuguuuuuauguccauguuaaucucugaggaccucugugccucucuucucuuaccauuccaguucaucuagacaagugccaggguaauguuuucuuaacaucauauucaucauguuacuuccuugcuuaggugaucaggguaauuccuuuuguuuaaauggaucuaaucugaacucuccagcuagacguaaggcauucugauaauuacucuccccuuccuuuuuaacuuggacccauguuuguuuucaucuuggaacuggggaacguggcccacuuauuccugugaaacuaaugcauuugcauuuccugcagucaucuggcuuuucugugguuuucccucuguuugcuaucucucaccuuuucuuccuugguccacacccuucagcuuuuuccaagcuugaccagugaaugacuugcuuuuucuuuguuacacaucuaaaccuuucccauauugauuucucucuugcuauguguuuuuuugacuguuaugugcaguuuauguuauguuuuauauauauuuccaauuuguuuucuuuccuaagaacaucaucuugaggugauauacaucugcuuuuauauacauuaugccuagccacauucccugggaagaaggagcuguccuaugcuucuuucauaucugcacagaccuugaauaaucuaaagcagggguguccaaucuuuuggcuucccugggccacacuggaagaagaauugucuugggccacacauaaaauacacuuauacuaacaauagcuuuaaaaaaaaaucgcaaaaaaaaucucauaauguuuuaagaaaguuuacacauuuguguugggcugcauucaaagccauccugggcagcgaguuggacaaguguggucuaaagcauuucugaagugcccaguaccccccacuuuccuugucccaaagaugacaaguuucuucgucuuggcucauagagaacagggaagucacuccagcuuuggauuauuucuuacuggucuuuuuuucaguuccagucagggaauguuguaaucuucaauuugugguauauuuguuuuuuuaaaaaaaaaaucaucucaaccuauuucuccuuuuaggaguccacaguuccacuuugaaaauauuuuuaauaauucuuuugaaaauaaucucuauuaauaaucaagaugacaauccauagaauuugcuucuauaugcuucagaaaaguaaaauguuucaguauaaugguuuugauugucuagacauuauauuuuauuuuaauaauuucuuaguguuagaccuugauacuuuuaauuuuuuccaacauauguacaaagcauguguuuuuauuacuuauucuaguguaaaaauuaauucuuaccagaaaaguaaacucaggaucucuuaccaaauagaugaacucaguaagcaccuuggauucucucugagggcuguagggggcaucauuguuccaauguuuuauaaaguaucuucccgcugugaucuaaagaagcacagcaacuaaagugcuuuuacagucguuggcucgugcccacguuacuaugacauccuaaaugccuguuuguuugccuggugguuguaugugcacacuugcaucccuagccuuuuaugaauguguauauuuagauugcuucugucauagaguccuccucacuaggauguaccaccaccaaacaccgagggaagacagucccaacgacgaaaacuauccaaaguggccccagggaaagcauucucagagugacacaagacugccucuucaguacuuccuuuccagauucaggaaccuggagaugauggucggagaguaaggauccucuuuguccuuugaaagcuuugggaccccaguuccgcccuggucccagcaguaagggcuggagggggccagucgagucuggaaagaaauccuugaagucauaguuuuauuaccauuacugcucauccgacucaccuuuccuuuuuguuauuauuacucuuaguuugggggaugcuugguugagaaagugagggaugggguagcgauugagaguguccuugcaauuuacagucccagagaauuccauggaaaugacauuccauugaaauggcaaaaacguacagcagcguagccgucauuagccaaauaauguaacgaugcauaguguuugcuaauugugcuuugagauacuucucuaguaguaggcucuuggaauauccaugauuaaguaauacaggaagcuaggccucuauaugugucacuuugucccaugugagugucaugugacaaaaacacugauuuucagacuguuggaaauaaucagguuauuaauaguuaccuuaaacacucacauacacacaugcacacacuugugcuauauuuugcgaguuuaauaugaggugaaaaaagaaugucaugcuguuuguuccacaguggaauagcauuauauagauucugguaagguauguaccaggucuagcauccggauccuuauuaccugaaaaauucaccauauguuacugauuaguauugagaucaugucugguucuaaauuuuugugguucucuaaaucuauucauuuuacucuagguucuuugauagcacuucuugaaauuuagaucaucaagucuuugaggaaaggauucuagaaaauuaaaauaucagacuuuuaaucaggauuccugaaugcauguugugguuucacuuuugaaaacuggaugacuuugggugaauuuuauuaccccuuugagcaucuuauuucuucagcuauaagguaggauuaacagcagugucuguuuuacaggguuucuuuuggauaucaaauuaauauaaaagacauaaugcugugaaagugggaaaauaacauuuuaugcaugucuuaggcugucaguaauuauuuuauuaucuuacagugacaugcuguaugguauuugagggacuuggccuugacuuauuuguuccuggucucauaauucuugggagugaggaguagucuaauucuuuucauaugugagggcucaauuagcaaaucuuuauuuauccucaucaugcaaggcccuggguuaggcacuauagacacagaugaggcugaugauugcccaucccuaaccucagguaguuugcagugagaaauuaaugugucaaacuaauaucauuaaauaaagguuagugaaaaagagauaccagagcacccagcauagcuggguuaugaccagaugagcccaguaauuuuuuucagacauguuucugaaugggauguuguggaaaagccauagggcagccagucuguugggugcacuauuuguuaaucaguuuauacuuugggcuacaguggcagguggucaggauuagaaguuaggguuguuagauuuuaguccuugcuauugauuccuaucuaggggcaagucagcuagccucuuuuguuuccguuaucuguaucugugugacaaagaagccccacuauucucauauuucaaugggucagaaaauccagcugggcaguuuuucugcuuuauuugucuuuggcuggggucaaucacucagaugcauuugguuacugaccaggcuacaaagcucuagaagacuucacucacauguuuaguucuucucaaugauacccucucucuucacaaggugucucaucacucaguaaucuggcuugagcucccuuacaacauggcaucuagcuuccccagagcacaugaaaguggaagcugccagcuuccuaagggcuaccucuggaacuggcacacuauuauuuccacuguauucuauugggcagcaaaucacaaggucaagaggagaggaaauaacugccucuugauggaaggagcagcguaccuccagaggagggaagggauuguugguggccaucuuuggaaauuguuuaguguaguuuucuuauuuguuuauuauaguuuucuuaucuauuaaaugagauguugaauuagggaguuucuaagggccugucaaacucuacauuuccguaauacuauacuuuuuuuuuuuuuugagauggagucuggcucugucgcccaggcucgagugcaguggcacgaucucggcuuacugcaaccugugccucccagguucacgcuauucuccugccuuagccucccgaguagcugggacuacagucgccugccaccacgcccggcuaauuuuuuguauuuuuaguagagacagaguuucacaguguuagccaggauggucuugaucuccugaccucgugaucugcgugccuuggacucccaaagugcugggauuacagacgugaaccaccaugcccggccugguaauacuauacauuuuuauuuaagggauuuuugugugcaugguauaauggaaauaauuuggccuuuggaggcagaaaggccuggguuugaaccagggccuuaagauugaccagcaccuugggaagugacuugagucuuucugagcuuuuguacacaucuguuaaauaauaggguuaauuaaauaggauuaauguuaacucacuucuauaauaauuguccaucuuagcacagagucacgacccagaagguguuagcacccaucccuuuucccuucuuuguuaccugauacaggccuuuuaaagccaacaauaguuaaagauauucauugagguuuuuuuguuuuguuuuguuucauucaaguauaaaaauguuuagguguuuaauuguguuuugcagaugcuggcuuauuuuucuaagaccaggaguucaaacaaaacuguuaaguuuguuuaucuguuuuguuguuauaaauuguccuuagaacauuguugcuauuaagaaagcaggcuuaaaaauaacuuaauuugaaaaaugcauuuuggucugugaacagcugaguuauuuggcauucuaguaacuuuugucuggaagaaaaaaauagcuguggggcauggccagcauucggucuggcuguuauacgcuguggugguacuuagcuugugaaccaggccugauaggugagacugggcaugcacuucuacucacaggcuaaaugguugaaaccacuggggucagaaagcucagcaacuaagggcaguaggagaaaagaaaaucucuguugucucuaaagcacugguucucaguguauucccuggaccagcagcauuaguaucucccacagucauugcagugauuuuauuguacugguuauugagaggguuaaauaaaaggauucguauaaaguguuuagcacaguaccaaguaaccauuuuaguaaguguuaggcauuauuaguaauauucaucuucauugucauaaauauugauaaucauugugguuaauauuuuucugccagagugugucuugaagcagcuuauucugcaauucuucuuaaaacugccagaguucuguuucuuuuuuuuuuuuuugagacagagucucacugugucacccaggcuggaaugcagugguguaaucacggcucacugcaaccuucaccucccagguucaagcaauucuccugccucagccucccaaguagcugggauuacaggcgccugccaccacgccuggcuaauuuuuaaaaaauguuuaguagagacgggguuucaccauguuggcccggcugguuggucuucuuuuuuuuuuugaaaggagucuugcucugucgcccaggcuagagugugguggcgugaucuuggcucacugcaaccuccgccucauggguucaggcgauucuccugcuucagccuuccaaguagcugggauuacagacacacgccaccaugccuggcuaauuuuuguauuuuuaguagagaugggauuucaccauguuggccagacuggucucaaacuccugaccucagaugacccaccugccucagcauuccaaagugcugggauuacaggcgugagccacggugcucggccucaggcuggucuugaacuccugaccugaggugauccauccuccuuggccucccaaagugcuggguuuacaggcaugagccaccauuccuggccaaagcugccugaguucugauuaguucuuuuuaaaagcuuaugaauggugugcuggucuaacaauauuucaaguugucaaguaagaaggagcuucuuacaaaagcccaucguucugaacaagauauucuucaguccaaaauaauauugagagaucacauaacacagcuaugcagauauauucuaagcccuaacuucgugggagucauuaaugccauuuaaugaggccccauacaaugucugaacucuggaguuugcuuuuaagagccauucuuuccuagacccccuucccuucuuuacuuuagguauugauguccuccauuuacaucucuguggaguuuuuuccuuuuucuuuuuucccccgcucccauuuguggucaaauaaggaucaugguuaaccccagaaggaaggccagaugggccuugggggccugggcuggggcuggagccucuccacuuccgccggccgccuuguucacuuccuuuuuuucccucccuuaccacuauguugcagccaaacuuccgaagugaaaagcaguuuauuccaucuaaucggggcugcugaaucagagguguuggggguguucccugggaugaugcugcccuuuggccacugaucucuguaucauagcuuaccucggccucccucuggcgccaccauccaggacuggaagcauuugcuuuuccucagggagccguggguucaggccauggguggugagagagucucaucuucuccagcuuccugguccucagacuugaguaacacuccuuauccucugucuguugccuucuuugggcaagcacguggagccgcucaaguaaagcugcucuucauugggaauauuaucugccaaggcuaagccaggaucccuagagagcauccaagucagggcuuucagcagaguucccuggaagcacugcauucuguggagggccagagccagaucccugucucugcuccagccgacagcucggccaccaucaguuugguguauugaggucaugcauagaauuuaacauugaaaaacauccuuguucagcuccuucagugaugagaugagaaucccuggggaguggaaagugaggaucucagaaguugcccaagggaacuuagugucuuauuuagagucauaauaacuagcuuagacuagcguaacugcuagucaaggcucuuuggaaggaaguaacacccacgcaaacuacuagaacuugaaaugggcaguuuaugauaagggagugugacugucucagcauacuggcaucagugugcuauugagcuggugagggccuggagguagcuucagguugcccauggcccugaggcagcuucacugugggccucucuuugagaagugggauucuggucuuugcaucuuccuuguuauucucccucugcuggccucucucugcuccuuuguucauguugcagaagauaguggcuccucaccucccaagugacauauccuacaaaacugcugcacuuucugccccaauagcaaacuucuggaggugaauuugggcagauguccacuuuugcuucaucgauuguggcacggggcagugucacaugguaaauacauggcugcccaugcccacccuugagcaugacagcugucagaaagaggggcauagauucccccagaaguuacaugauaguacuuuacaauuuagagacuuugcuggaaaguuucuuuuuggcagucucauagacaggccuuuuuacagaacauaguaaugagcacuuacaguuuguagagaggccucgggggcauccaagagguagcuggaauaaucugacccuugagaagcuucucuugguuccuggggaugacgauggucauaauuaacugcuuuacuuacaacuuggcaauguguuuuauuaucggugugcauuuugaaguguuuuaagguuuuucacaucccucacuguguguguguguguauauauauaucuguuaugauaauuaaaccaaauauuguaaaagucaagaaaagugucaaagaggaugucauucuacuaaacuuuuuugaauggcuacucuuugaugaucuugugaguugggagaggacccaaccuucaguagcaugaaucuggucuuaaaucuuaaauuuugaagcacugaaugcauugcaaagugucccauagucaucuaugagugugcauauuugcuuuugacucagcauuccauuuguacuuccuccacaacaaaaaaugcauuguagcuuuaguauuuuuaauugucaccaaguaguacugcuagccauugugcaaagucuaccaacagcugauaaaaugauuacauuuuuaaagguugcuggauggaaucagauguugcuguaucaguuccuaugccgcgugugucuguuucacuucccauaaugacugauucuccaccugccaugacagugcauucuugaucugcugcgcccuccuuggguuggggacuggaauauuuauuuuuaggaaaaguuaaaauuauccagagaagggugcuuucuguaaaauuuacaugaaucagccucuuauugcagagaucaugggagauguguguguguguagauaaaaaaaacucaauggaaaaauguaaaacuguuaaagggaaggaauauaaugaacauuguuuuacccaucacuaucuuuaacauugugggcacuuuuaaauuaacuaguauucaaacuaaauguguguuuaauaaaagugaaugguacuacauaacauuaaugcuuuugcaguuaagcuagauuuuccaaauuucagcaaaaccaagagucuuagcuccuuccuucagucuucaguuuaaauucuaagaaauauuauucgaaguuuaagaggucuuauuagggcauuaauguggguuuucccguaucaagagcagacacagguuuuuggugucuuagguucuaaagauaccaguguuccuuagauuucugaccugacugugaagggaauucucuuuuuuuuuugagacggaguuucgcucuuuuaguggcaugauuucggcucacugcaaccuccgccuccuggguucaagugauucuucugccucagccuccugaguagcuggguuacagguaugcaccaccacgccuggcuaauuuuuguauuuuuaguagagacgggauuucaccauguuggucaggcuggucucaaacucuugaccucaugaucugcucacguuggccucccaaagugcuaggauuacaggcaugagcugauuuuuuguguuuuuaguagaaaugggguuuaaccauguuagccaggcuggucuugaacuccugaccucaggugauccgcuugccucugccucccaaagugcugggauuacaggcgugagccaccgugcccggccgaagggaauucuuguuaggcuauugcacaguugucagauggaccugacugcuucucaucucuaggaucuugguuccuucucuccaauauggggauaauaagugucaaucuucaugggguuguuacauaaaagguuucuaacacaaugccuggcaacugguaagcauuuaccaaauaaauaagccuuagcuuaauuaguaaucaaagauaccagcugggaaacauaucuauuuuaagauuauauaggcuccuucucauccucuuugggcauuuuauuucagcugcuuaagaugugaaaucuguguguugugguguuccuuguuacaaucucccuuuuuuuuuuuuuuuuugaaacggagucuugcucuaucgcccaugcuggagugggaguggcgugaucuuggcucacugcaaccuccgcuucccagguucaagcaauucuccugccucagccuccagaguagcugggacuacaggugcacucugccacgccuggcuaauuuuuuguauuuuaguagagaugggguuucaccguguugcccaggcuggucuugaacuccugagcucaggcauuccacccgccucagccucccaaagugcucggauuacaggugugagccaccgcgcccggccaagcucucuuuuaaaagcuuuuuuugugacagcaaaagaaagggagcuaagauugacuaccuaauaaaguagguguuuuucacauuuucauguguuuccuauuuaguucaguagguguuuuuccuguuuaguucucacaacacugugaaguacauguuacuguugacaugucacagaugugacaggcagugagauugaguaauuugcucaguugggagguagagaaugugaaaagcagguuucaagccuggggucucugacucaaaggcauaugcuuugaugaagaucgaaacucuagcuacaagcuugugaagauauuaauuuagaaucauccuuguccaguaauaacacaacuacuuauagugguuuguaauuuuaaacauuuuauuaauauuaacuauauuacauuuacuaaccauguuaaaauauguucucuugggagguaggcagcacagguaacauuguuaaagaaggggcccuggagccucugauucuuguucuuuauuguccuugccccucaguaaaaaauccuuuaggaaaacagaugcguugaugacugugcuggucaaaggucaauuuuggaccccagacuccuuuguaaaagcuuaaugaaucugaccaacucuucuaagcucuucuagagguagcugccacucccaagggagagauucuugagcuccuuuggcuuaccaagugggauggggugagaugguaugcaaagagggaaggugaaagaaagaagggggucagucuuggagaaaaaggcguauuaccucuauucagguagaagcaagagaaaacugccuaaaaccugggauuccagggaugagcuugccaauccucccccuacucaggccucugcccagauucgggacuggcauuggagaaggaguuagggagaccuugagaagugguuaggacgguggacuccaccuagaggcaaguagugacucugauuccuucccauaugacaaaccagccuucugggaaaggugaggacagucuggguaagucaucugcggaugcaaaaugaaaaucuguauuguauaacuucuagggucuuaguauacuucuuuuuuuguuugguaaauuaaaaacugaaaugcauaaagaagaaaaauuuccauauucucaucgcucaaauuccauauuucuuuuuuuuuuuuuuuuuugagauggagucucacucugucacccaggcuggaguacaguggcacaaucucagcucacugcaaccuccgccuccuggguucaagcaauucuucugccucagccuccugaguagcugagacuacaggcgugcaccaccacgcucagcuaauuuuuuguauuuuuaguagacgggauuucaccauguuggccaggcuggucuugaacuccugaccuugugauccgccugccuuggcucccaaaguccugggauuacaggcgugagccacgucccggcucgaauugcauauuucuauuacuguuaacauguuacaguauuaucauccaggcucuuauuuaaaaacaggcaaacagaggccgggugugguggcucacgccuguaaucccagcacuuuggaaggcugaggcagguggauuacaaggucaggagauugagaccauccuggccaauguggugaaaccccgccucuacuaaaaacacaaaaauuagcugggcgugguggugggugccuguaaucccagccacucgggaggcugaggcaggagaaucccuugaaccagggcgucagagguugcagugagccaagauggcgccauugcacuccagccuggcgacagagugagacuccaucuagaacaaacaaacaaacaaagcagguaaacagaugaacaaaacuuguuuuauaaaaaaugaccuauuuauuuuuauuaugaauaauucaaagaagaaaaaguagucacucgguugggugcgguggcucacgccuguaaucccagcauuuggggggcugaggugggcagaacgcuugaacccaggagucugagaccagccugggcaacacggugaaauccugucucuacaaaaaaauacaaaauauuaaccaggcaugguggcaugcaccuguggucccagcuacugggggauuggggccgagaugggaggaucaccugagccugggagguugaggcugcagugaguugugauugagcuacuacacucuagccuagaguuuuggaaacagcaggacccuguuuccaaaaaaaaaaaaggaaaaucaguccaaauaacuugauaguguuaaaagaacaucauuccggauguguacuguagauuauaucauauguacagauggaaugauuacaauuaaagguagaaauacuuuuguuaaauauggcauauuauagcuauuguuuuaacuaaaaauauaaaacgugauuuuacuuuaacaauagauaaaagaagaauugaaauauaaggaauugcugaaccucaaauuucuuuuucucauguagauuuuccuauaagauuucuuugaaauuaaaauagccuagaaauaaauagguugaacugauuuuuaaaaaauuaaauuucaguuuuagauacuagugauugauuucuacauuguaaguauuucauuuccggaauuguuucaugcuugagaacguguccucuuugccuuuauauuugaaugaugcuuuagcuggguguaguagucuuggcucuuacuuucuuucucucagagcuuuguaacaacauuuucaccacuauuaucugauauugaauauugcucuggggaaaugcaaagccaacuuaauaucucccuauuauauaggugacuuguuuuuuguuuuggauaucuagaagacuuuguauuuguccuugaaguauaaaagcuuaacuauaacaucucucaguguggaauauucuuacaacuuuuuuuuuuuuuaaauuuugauauguguacuuguuuugguauguucauucuucagagacauucuuuuuuaaaaaagguuuguauaaauuuaggggguucaagugcaguuuuguuaccuggauauauuguauaguggugaugucuaaguuuuacuguuaaaggaaaagaaaucacucuauugaaaagauggcugcacuuguauguuuauagcaucacuauucacagcaggaaagauauggagucaucuuaaguguccagagagauucuuacauugucucauaucuuggaauccauugucuguuccauuucuuaaguugucuucuucagggaucuguucuccuauuagauuauuuuuaucugccuuucauuuuuauuagcuuuucucuaauugcuucaauuuccuuguuuauuuuauuauuuuaaaauuugaauuugccaugauuaugcaaacuuucucacugucaguaaauuaguuuucagggaugucagcaucuuguuugucuuguuuucccuuauauauuaaugcuauaguaacgcugacuuugauucucaauuuauuuccuuauuuucccuauguugguuaccuauuucuggucaccaaauuaccccagaauuuagcagcuuauauugacucacaauuuuuauggcuuagacauacaggcauagcuuagcugagagccccuugcucagggucucucacaagccuucaaccggaaugucagccagggcagcauuguucuuaacgcucagucgcggggaggaucuauuucuaaguucacucuugggugcuccccagcuguuggcuggagacaucuguuucucaacaagugguccucuccauaaggcaacucacaacaugcggcuggcuuuccucagagcaagcaagagagggugcccaagauggaagccacagucuuuuugaaaucuaaucccaaagugauaucccauaaucaucucugucacauucuauuugcuagaagcaaaacacucaagaggagcagauuauauaagggugugaaaaccaggaggcagggaucagugggggccacuuagaagcugucuuccaagcucccuuuuucauuuuacuuuggucauaaaacuuuggguucucgauugauugauuuuuuccugcuuuuccuacggcucuaagugccuuaagcaauugguuucucauauuauguuuccuuuuggguuggacaugugccuuuuugcauugugcuuuugguagaaucacagugaaagccaugccauuuaauuuaaucguggucuuaugcggcucuuucaugcauucuauuuguuuugauaucaugugagugacuuuauagucuucccucuuuaucugaggccaguuugauuuuucuucaagcuaaguuugaggacuggguauuuuuggcuugaucacuuuccugagccuguaaagaauggucccuggaggaagcaagcacaguugaggugaggugguuauacacuagaugccuggauccuacucucuucugagguuguacuagagguacugugucaggguuuacuccuuguuggggagagugggguagggugagauccucugccaugggaacauccucccuguuguuaacucugccucccaaauagccauucccuauacuucauagaaggaaagcguauuugcagaagugggcaaaugggcuaagagaccuuuuagaaguguucuaaaacuagauuauggugacaauugcacaacuguauaaauuuacuaaaacucaucagacuggaaacuuaaaacaggugaauuuuacgacauaaaauuguaccuuaauaaaccuauuuuuagaagccauaucuguuuagugugcauuuuucccgaguuagaggcauuaauaagaauuuucagaauggugaugaugcaccagucccagccauucacuguucauguuuauucauuuauuagagcauacacuguucauguuuauucauuuauuaucuauagugauacguuaucuauguauuaucuauauaucaccacagauaaaauuaacaacagaaagauaaguuuuuuguuuguucguuuguuuguuuugagacagucucgcucuguugcccaggcuagaguaaagugacgugaucucagcuaacugcaaccccagcccccuggguucaaacaauucucgugccucagccucaugaguaggugggauuacaggagagugccaccaugccugacuaguucuuuaguauuuuuaguagaugcgggguuucacuauguuggccaugcugguuuugaacgccuggccucaaguaauccacccaccuaggccucccaaagugcugggauuacaugcaugagccacugcgcuuguccaagaaagguaauuuuguaauuaguaugggaugaguuaguuuguucucuuuaguuuuacuagcaaacaaaaugauuaucaagaaaguucuauaguauugauuggguaauacauaaaugaagaauuccucaugaauguugcaaaaaugcaaauuaauuuuaauuacauauuacaauuuaauuuuaaauuuuuaaauguuuaauuacauauuaaaauccugacuauaaaaaaacuaguagcaaaaaggaaaccauuuuaagauaaugcuuucccaaaaggagucuaugauaaugauggaguucaggccaugcgaccccaaaguauggcacaugugaaaacagcagaagcauuaguucauuuuccccuccccccacccuucucuucuaaaggaggucauaaaaccuaggaaggaguuucugaccuuccucugaagcaaaucguaagaccuuauuugagaagugcccucucuauacccagaggaaaggaacauccuuaucucugaauacaaagggucacagagaaaagucugaacaaacauacuuugcuauguuuccuccaguuuauuaccauuagaucauacuuuuaaaucuaaucuuacuuauccacaacuauccacuuauucaucaaaccuagcauaaaaauauacacauuuacuccuauauucagaucuucauuuccuuaggaaggcucccaugucacacuuauauuaaguaaauuuaugugcuuuucucucguuaauuugucuuuuguuuuaggggccucagucaugaaccuaagauaaguaagggaaagauauuuuuccuccccuacaaugagauagccuuuuauuuauucauucugauagcaaaauauagcaucuaguagagucagaucuugauggucuuuagguuauagauagauacauugucagugaaggaauuaguguauagugucacugaagaaauagccuucacuuccuccuuuagcuaggaguuucauucacuuaucuaagaaguaucuugaggggagcucauugcuuugguaucuauuaguaguaugccaaaaagaaauauggccagcuucucaauggucagcuuuuuaguaaauagaugggugaagacuucucucugcuugucacugugugaggcacacagugauaccaaaauugugaggucauugagggaaaggcuaugucugaugaauucguuucacaucuccaguuuuuaauauaggugcuccauaaauauuuaaugccuaagugaaugaaagaauaaguaagacauaguccucacccuuaagaaaagauaugcuuuuauuauccucaagaaaaguauaugcuaguuagacaacuaagucauacacauaugaaaaagauagcuaguaacacagggccucauauaaucccaaguauucaaauuguccauauagugccugaagaagaugacaguggcuuggacugcucagaaaagccuguggaguuggugguacccauguggguacaccugaauuccugacaaagaacagagaaugcacacagggagagugcacucagaaaugaagguagaaaugaagauggcuugaaugggggaccucgaagagacagggcucacugaagccaaggggagaccugggaaacagaguuggauggaaagagugacugaagauuguagaggggcuuuaaagcccaacauacgagauuagccuuauauuuuuaggcauuagggaaucaauggguucuugagucaagaaaugauuacauuaaaauuuacaagcuuguugggguuauugauugaccacauggauaauugggcuguuuuuuguaucucuuaugugcaagaugcuuauacaguugacccuugaauaacauggggguuagggcuacugacucucucuaugcaguugaaaauccacauacaacuuuugguugggcauggugguucaugccuguaaacccagcacuuugggaggcugaggcuggcagaucauuugaggccaggaguucaagaccagcuggccaacacggugaaacccuuucucuacuacacugucucuacuaaaaaaacaaaacauuagccgggcaugguagugcacaccuguaaucccagcuacucagaagacugaggcaggagaaucgcuugaacccaggagguggaguuugcauugagcccgagaucgcaccacuacacuucauucagccugggugacaaaggagacucugucaaaaaaaaaaaaaaaucacugauaacuuuugacucccccaaaacuuaacuacuaauagccuaguguugaccaggagccuuacugauaacauaaauaguccauuaacacauauuuuuauguuauauguacuauauacuguaugcuuauuauauaguaaacuagagaacauauacuguaugcuuauuauuuaguaaacuagagaaaaaagguuaagaagaucauaaggaagagauaauauaguuacuguuuguuaaauggaaguagaucgucauaaagaucuucauccuuguuaucuucauauugagucgguggaagaagaggagggguuggucuugcugucucaggggugguggaggcagaagaaguggaggagguaggauaggcaggagaggcaggcacccucgguauaacauuauuggaaaaaucuagguacaaauggacccaugcauuucaaacucauguuguucaaggguuaacuguauauucaagaggguuuguuuauuuaguucuuaguuuucuuuuuguuuggcaucuuaacuaaaauaauuaucaacuccuugcuuaaauuuuuuuuuuuuuuuuuuacuagguaggcauccuaacacagucuugcaaaaaauuguuuuauuugaaacauucaggcugaaauuaauugagggcauguuauaugcaggacaucacauaacauguugugaaggaguucagagaugaagacauuaccaugcacagagugguuagacuauuagaacgguagugaugaaaugcugcuggaguugacaggaagagaaggagcucuuuguaccugaagaaucaagaacugaaagagauggaacuggugugccaggcucuuuccuauauacuuuccuuaaacccucacaacacccugguaaaauuuuuaauuccuacauacauacagaggagaaaugagguuuagggggcuaaauacgcaugugaacaugcguauuuaaaucauagguugggacaaauuugcaaauagaggaaauauagacaggaaaggccaucaguucauauaaaauagcuuguuauuguuuauaucuucucugggauaaaugaucaugcagaguauauagccaggauagcccaaugucccuguuuacaaaauuuuaaauucuaagauaguuaauagcccuucaaauauuacuugaaaucaacuuacauuaaacguucaacccuagcaaagauuucuuagaacauuuaaaaauuguucuuuugaaaggauucuagccugaaagaaaauucuguuagaagaaaguaaugccugaaucucuacauucaaacuugcucuguuuuuuuuuuugaauaaucucuugaggguacaguuaaguguugauuguucauuugaucaauugauucugauucacuucaguuuuuugggcguucacaucucacucaguaaacagagguuuggauuagagccgccugcacgcuuuucuaacucugaaugccucuguucucuguagaaaacuauuccuuaaagcaguagcucuuuaagaguuaaaaacaaaaacaacaacaacaaaaucaacauccagucuaguccugcucagcucuuauuuauucacuuuuggaacugugauacuuguuagaucuugugcaguaaaacauaacucccaguuuuccaaggccagcuguagaucaggauucuaaaggccuuaauggaaaagggugggucauguguuugucaagaggccacuuagagaaaucauuuccauguaauuuuuaauacaguucuuuggauagacuuuuuaugacucaguauuacagaugucauuaauuuguaauggaaaauagugagacaauaugacaauuaucuucagacucaggcauacuuaggcagcagggugagugaugauugaacuguucuaacaguuagguugcugcaaagugccacugccgggaugaagcucucagccgaagcacugauguugcaacccagccauggaccugggugucuugauuagucagccacuugauauguaacuugggcagcagaaggagacugagaccuguugggaaucugagggccuugagguuucuucucgcacacauguuucuuuuccaggcaugcugagaugcucgagagggcggucuugggcaaaaugggagaguagauuuaaguuguuuuucuuccagucauauuucuugcauguucgcugaacaguagguauuuuagacaugagggcaggcauauugcagaaauauuucaggcauuuuugugagggaggaaguuaggauacauuggugaacauuagugaccaaauggaaugaugauuuccuuuuccuggcauuugaauguuucauuguccuuugugagauaucaguuuuuugugggcggaagucauuucugacuuuguaaguaggaccuaucagcugugguagcagagaaaucuuaugaauaagaaaggccacugucaugcauugggagaccuggguucucuccccaggucccaacagaguucugcucauaguccuuauuauggguugaaauaucccuucccaaaaauguauguugacauucuaacccuucaggaccucagaaugugaccuuauuuggaaacagagucuguaaagagguaaaugaggucacuagggugaacccuaaaccaauaugacugauguuccuauagaaaggggacauuuggacacagagacagcacacacagagggaagaugaugugaagacacaaggauaaugccaucaacaagccaaggaacaccugaggcuaccaggagcuaggagaagaggcauggaacaaauuuucccucauauccauacucagaaggaaccaacccugcugacaccuuaauuucagcuucuggccucuagaacugugagagaguacauuucucuugguuuaagccaagagaaucugucuuuugguacuuuauaucauagccucaggaagcaaauacagcccugauuccuucaaaguuguaaaaugcugagcaagccucucagucuccucgucuucugcuuccuuauuuguaaaauaacaguauugggguagaugaugucaggaccuuccugcucugacaucugaugauuaacacuucaaagagugcauuucauuuccagagaaguaauuguuauauuucuuaauauagcuaaaauaagcaaagaauauguuuuuuucaguucccaauuuuuuuucuuuucauucaagagucauuggugauagacacuucccuugagcugaaauauugggcaaggcuguccauuucaaguugacacacugaacaaaugacagcaugucuagucuguacaugauuauaauauauaaccaaagaacauaccacuuaaaagcauauagcuguuuucugcugguuugggguuagcauaguuuggaugucauuucaugaauuuuccuucccuagauuuguagaaugauuucuuuuagacguccacaggcuuguucuaguuuucacaagggaaccugcccauagaaacaagccacucagguauuugcuagaugccuuaccuccauaaacaguagugcagcagcagccuggaaucgugaaguguaguucaugccaaacguucacauaagucgaggaguucuguauggggucauucuucuuacuugacuugucauuagguuauaguucgguccacuaauguagacaaaucaagacauuguacuuggugcugucccagaggaaagcagugaggaaaccaccaccccccucuucaccaguuaucuuucccuacaaaaugggcagcugaaacccacaagauacauuuuaaauaauaccaccuaaggccuucucuuuagauuuuauuuuucucuugcuuuuccuuuaguuccuaaguuauaguggauaauuuuuuuuaaugggccuuaaacuugccauuugacucaaaguauagagaggaaaucuuuaaaacaagauguaugaaauguuugauaccauuugcccuucugucuaaggcucucuuccuaauuuccccagaacccuuuuauaccuucuugcucuguaaaaauauucccucuccucaacgugcuagcacaagaguaaggggucagguuaggcuuagggauagaauuuagaaggggagugggauuacccauggugacaugugucuggaugggccucaauggcuucuauuuccuuuguacuccucagugagagggaaagggaaaugguuaacaugaggacaguuucucugaauucagcuaaguuaagauagugguauuauucacacauuuaaugaagcuuacuugguucuuuaagaauuaccgaguuaucuucugaagguguuuuaacacaugcaaauguuuaaaucuggucucugauuuaaauuuucuucugcacuuaacucuaccccacccauacaucuuucauagguaaaaacagggaagggccaaaaaaguucuuaguguuaauaucuaauucuaaggaggccaugaugaaucaccuguauggauuaugaaugacacaccuuggaaaaacucuaucaccaugaaaggccuuaaaaaagaaucccuaucaugcaaaccuaaagaacauguuucaaaaggagauauuuuuaguauuuaaaguaguggaaauuucuuuuuuuuuuagacuaaaacuaacuuuggauaaguccauguauaaaauucuuuaugaguauuuauaauaucauuuuguuuaugaauaaaauauaauaauuaaaauauuccauuuccgggucugucccagaauccuccuucaugcugguucugucuccucaguggcuuagagcagugguaacaaagauguucagcuuaauuuggguccgugugucuuccuguaacaucuuucuauagugugaaauguggguuaaaaauaagucauccccucccacccccugcuuuagauuaagauucacagucucauagaaccuucugaccucacauugagacuggucacucaguuaguuugugaauuuuccugacucuacuuccugcucuuuuuuuggguaaccuauuguuuuggcauuuuauuucuuugugccuuuuccagaggauccagaaagaauggagagacuugaaacccaacccaucuguguugcuguuaguuaauagagguugaaaagauuugguaggucugcaguuugaaauuauuggccauauagugacuuacaguguuuuuuucaccauuguuuugugguuuauuugagagucucuguccauucuccuucucccugugaacauggcuucugguggugagagccaguuugcauucauucuuugaugugaaugcucugauucaguagcucucaacuuguuuucugcuacaacacagauggcuuucacaugccucacacccucacagggggguauccaggguuaugcaaaauugaagcaagcuacuuguaauuccaccccucucuuccccauucaggauaguccaggagaaagcaaacaagagagugguuuugucacguugcugucaguaggcuccacuuuaaaaaaaaacacagguuguuacacacuuugguacuugccucuugucuugcuuugucacuugcagauguaauucuuuaaaauaauuuguguuuuaaauacuuaauaaaauggcuaaucgcauaaggaacacccuuguacuuauuucgcaguuuaaacauuucaucacauuuugccaaacauaauacccaucaacucuucuuaaaggaaaugaagaaauuaaugccuuuauauuuucuccuauuucucccucaacuccccuguuuuuuucucauauucuuacuuugugcagccaaguaaucauauucaugauucucagcucuaacguucuucagagcuuucggaccuugcuccuuugucuucuccaugaaccaguguggagaagcauuaaagucaucucagguuucccccauuucaacucaauuuugcugucugcacaacuagagaauguucaaguuccagaaccuaaccaucuuuuuagcaauuaugcuuaucacuuuuccccaaagcauggugcaucuuuuacaucugaagauuacuuucuuuuuuaauuccaaaagugauucucuuauuaaaucuuuaaacuuauguguuauguaauaauuugauacauauugaauaauauuuaucauguuuauggaaacuaugaggcauaauuauuucaaaagaauucaagaacucauuguucaacguaauaguaucuacugguaucauuggguuaaaaaauuguaaauauauuuuaauacccguguaugucuccucaaccuauaaacuccucacuuaccccagaaguaacaguuuuccugaauuugguauguuuuauuucuauauacauuuuccugccuuuucuacaagcaaaugugcucauaaacaacauuugguauugauuugcacauuuucaaaguuaguauaaaugguacaugcugugcauaguauuaggcagucugcuuuuacuacucauuguuauguuggcuguggauacauguagcuuuagugaaggaucugcuacauaguuuuccuuuuuauaacucuaugccauuuauuuacccguuucugcugaauguuuaaguuuucccuaauuuugugcuauucccaacaguuugugaugaauguucuugggugugugaauagggagaaggugcacagaaauacuggcugcuguaggggauguguccuggagugggauugcagaacuacagaacaugacucaggcucagccucagccucacuggacaguguaaauuacucuccacaguaguugcgucaguuuccccucccaccagccauaugagaauuuccuuuucuucauaucuuugggaauucuugguauugcuagaauuuuuacuuuuuccaaucuuaugggugugaagugauaucuuacuguuuauuuuuauuucuuuuguugauaccugguucauaucuuuuacucauuuuucugcaggacuguuuguuguuaucuuuugacauaacugcuaucuauauagugaucuuuugucauuuauauuuguuauaaauacuaaucugugacuugucuuuuuacuuugucuccagugucuuuguugaaaagaaguuuuaaauucuaauauggacugauauaucagucuuuuaugguuuguacuuuuuaggucugcuugaaaguaucuuuccaaccaaaauguaucuaauauauucuucaaaaauuuuagguuuuugaaaauauuuaguucuuuaauucaucugguauaguuuuuacuucccaauggauaauuaguuaucucagaacagcuuauccuuuccccguugaaguguaauguuccucugucauauaguaugauucuaaauagacauauuuuuuauguacacauuaucauuugucucuuucuaugcuaauaccaacuguuuugauuacuguaacauuaucacaagucuuuuuuuuuuaagagauggggucuugcuauguuggccaggcuggucucaaacuccuggccucaagcaguccuccugccuuggccucccacagugcugugauugcaagugugagccacugccccuggugguaugucuuuucaucuagcagaacaaaucuuucuacuuuuuucuuuuucaacauugccuuggcuacucugugaccuuugaucuuccuuaaacauuugggauuuugauuuaaguaauauugaguucguagauuaauuggggagcauugcagucuuaugauucugagucuugucuuugaacuagguccauagaggccuuaaauaagauuuuuuauuaggucuguuuccaggcauuuuuuucguuguugcuacuauaaauuggauauuuuauucuauuacauuuuauaauagauuaucacaggauuuaggacaauuauucauuuuuuagauugauguugaaaccaccaaccauaucgaacucccauauuuuaauaguuuuuccaagauucuuuugaauauuuuauguauagucaacaucuacagauaagguaacuuuugucucuuucauuaaguucuuuuuuuucagcccuuuuaaaugcaugaacauucaauucuuauauauccauuuucuauuucuugaauuauugcauugccuaggaccaaugcaaugugaauagaagauguagugguuauuccugucuugugccugacuuuaauggaaauaauuuuaaagccuuacuauuaagagcaaugucugcgucaggcuuugauacauaacacauuuuagaugaaaaauguuuccuacuggucuacuuugcaacuauguugucuugaaaaugaguguuaaacuuuacugaaguguuuuuuuuauaguugccuuuuuuuuuuuuuuuuuuuuuugagucagggucuuacuguguuacccagacuggucucaaaccuuuggccucaagugauccuccugcuuuggccucccaaaguucugggauuacaggaaugagccaccacaccuggacuugaagacuuuuuaagagcauuuauugagaugaucguauuuuauccuuuaauaucucaauacggcauuuaguagauguguugaucuuacaauuccugggauaaacucugcuuugcuuugacaguauaauuuagcauuauugaaacuuuuuaugaaugagcuuucuuuuuuuguuguuguugacuuuguuacuaaucucguuaaaugauggaucaccccuuuaaaaguauucuguaauaguuuguaauuauccauuuuuugaagacuucauaaaacucucucgugaaacugccugggccugugguucuagggcggaggauggaaauaaagcuuuuugauuauuuaagauuauuauuauuuauauuacuguuauaauaucauuauuauauuuauauuauuauaaguuucuuuaaugcuuauugguuuguauacaauauaaugcuuuugagucuguuauuaauauuuuucuagaaaaaguuauuucaucuguuuuuagauauauugacauagaauugaguuauaguuuucucuuuuaauuaaauaaaacucuguauuuaacauuauccuccuuuuuauccaauauuguuuauuugugcuagacguuugccugcuuaguuuuucuggugagccagaauuugguuuuguuaauauuugcuguuuuucuuauuuucugcuuaauuucuacuuucuuccuuuuacccucuugcuuuuucccuucuuccuccuaucucccccuggcccuacucccacuuugucuuucugucuccuccucuuucuuuaguuuacucuauuuuaggcugaauugauuuugauuccuucuucugucuuagaaaguacauauaauagaguuuguggagugauggagagauggccaucaagggguacaaaguuucaguuaggagaaauaaguucuugauguguuguaccucauggugacuauaguuauuaauaauguauauuucaaaauugugaagacuaaauuucaaaugucucaccacaaaaaaagacaagugagaugauagauauguuaauuagcuuguuuaaucauuccacauuuuucccauuuaucaaaacaucacauuguacugaauaaauacauacaauuuuuauucaucgauuaaaaauaaugaaaauacguauaugacuguaaaauauaucuaagagucacuuuaacugcauguuacagguuuugagauauaguacucucaacauuauuaauuucuaaguauuuugugauugucauugucauuuucuccuuacugucugauuuuuuuaagauugcauauuaaauuucucaaauaccuuuugagaauauuuucuauugucaguuucuaauuuaacugcccacauuauggcuagaggauguggucugugugauaaccauuguuggaaauuuguugagacuuccuuucugaucugguacauggucgggguuuuguaaauguuuaaaguauaauuaaaaagaauucguaguccagauuuauuaaauguaagauucuauuaaauaaucagauaaguuaauuucacuauuuauuaauguuuuugcuuaaauauuuugccugguuuuucagcuucucacuauaguaauagauucgucacauuuuccuuauaucuugucaguuuuugcuuuauguauguugaagcugcacugcuaaguauaaacaaguucaugauuauucuaucauccucauagauuuuucuauguauauuguuagguauccaucuuuaguaauucugaugguuuuccuuuaagauucuguuuugucugcuauuaauauuucaguauuaacauuucuucaccuguuuuucuuuugguuaaaauuuguaaaacauuuacuuuucaagcccuuucugugcauucucucugauaaguggcaaauagcuggguuuuuuuuuguuguuguuauuauuugguugauuuuuaauuuuguuucauuuuugguuaaauuuuuaaagacauuugcuuuuucagcccuuuuugugcaucuucucugguaaguagcaaauagcuggguuguuucuuguuguuguuugguugauuuuuuuuuucugcaccuauucauugguuccauuuauugcaaauauuaauguauuuggacuuauuucuacuacauuauauuuuuugcuugccauucuuuuucuuuuuaaauuauuuuauuuuuguaauugauacacagugcuuaugcaugugucugggauacaugugauauuuauuacgugcauagaauguguaaugaucaagucaggguauccaucacccgagcauugaucauuucuacguguuggcaacauuucaggucuccuagcuagcccuuuauuuugugucuucuuuuuccuauuccugucuucugcuuaauucaucauacacaguaauucucuucuuuuagaguuugcucauaauucuuuuuacuacuaaaguuauacucaaugcaaguagcagaaaacccaauuagagagucacaaacaaauaggaguuauuuuucuugcacgaaacaaaaccuagagguggaccuaccaucagggacccagguuuuucuaucuuuugcuuuaucaucccauaacuugggggcuuuuccucauucuuauagcuuuauggcugcaggcuggcagcugcacuuccucacauccauguacuacuaggcaggagggaauugggaaaggccaaauggacaaaaaaaaaaggcgugcucacugaggaguuuucuuuuugucagaaaagcaaagacuucugggaguagcacccaaggggcuuuuguuguuggcuagaacugugccagguagccuucuauagcuggaaggaagccaggaagaaauuaagaauggggcuuggggucauaucaucuacaguaucucucauggauuucauucuaacauuuuucagcaaauucuaaagucauucaguauuucuauccuuuuuccauaugugaccuagacuuagcacauuuuguuuaaacauugaacaacuuucacaguguuuucuuaauauaaaaugaauugguuauuaauauuuuuucaaucagaaguuaaguguauguaucuauguguguguguuucuuuucuuuuuuguuuuuaaucaguaucuggcgucacuauuguuucagguaucccaugcauuuucucccagugauaaacauuuaauaguucuuuuaaugagggacugugggagucugucccucauugauugauugauacuuaguuuuucaaugucagaaauuacuuugcauugaaucuuggauggcaguuuauuuuacaugaguaugaaauuuuaggucaacagauauuuucugugaauauuuugaaggcacucuuccauuuucuguagaugagacaucugccauuagauuuugugauaacuuuuaaauuuuacaacuuuaaaaaaaucccugauacuuuaugcuuucacuauagugucuagauguggauuuaucuuuuuugcuuuguacucaaagguguuuucaucugaggaaucauuuccucaauuuuggcagucucuaguauacccucuucaaauaugguuuucuacuauucucuuugcuuucuuuuuucggaaacuuuauuucugcccuauuacuuguguuuaucauuuuuucauaucgguuuccuaucagcauuaucucuuucuguauuauaauuucuuacucauuuuaaugaaaugauguuuuuauuucuuuaaacuucuuaaauguacuuguuuagaauucaaauagacuguuccagaaauuauuuuucugguuauugacuuuguuggucacuuuucuuaauauuagaauucuucauauacuuuggaauuuugguuuggaggcucauuuugaguaggcugcugcuucuuccuuuaaaaaaauuuuuuuugguguuaauuuuuccucuguugcccuuuguaugcaauccuuccaccaaucuugcuuuuucuaaaaaauggccucuucucacugagaaccagcuuucucuucucucuacuccuucaccauggagucuagagccaagucauagagcauauuaucaguuccaugacucacuuuuuuucauguuuuaaaaucuuucagauugggauacaucuauaauucauggauauaucauuuuaacuggcaauauuuuuucuuagugguacauagcaauauucuuccuuaacaauuauuggcauccuagauuugaugacauagguaauauaauuucagaucaucugucuugcagugaauuagauauuguuaaucuauuagcugagccagugggcagcucuguucaguuccugaggcuguguuuguguuuuccugccucccuguguuuacagcuuccuaucaugccagugcccuaggucaaucuguuagcagaaguuuuccucuggcgaguccuucuccaucccacccaguguggccucagggguuaucucucccauuacucugcagaauggaacuucccacugccccugccaggucugugguaucuacccugccuccugugccccugccaguucugugguaucuacccugccuccugcuuauuucagguccauuucugucucaugaaaugguuaucucaguuuugaagugucuuaacacuguaauauuuuguggaugguuuuaaggaaauugaucauugccauagggaugcuucaaaauaagcacuuaacuguaucaucuugaugggagguucuuuggugcuuguagcaauuucuuuuuucuuuucuuuucuuuuuuuuuuuuuguggugacggaguuuacaacuggugauuauaccugacacucuauuguaauugagucuauugucccuuauucucaagauucagauuuuuaauauccauauuaaaauucuuuuugaaaauccucuaauuuuuaaaaauuuccugcuuuagacaaauuuacuuuguuaucauaucauucuacccuguauaggguuagaacaauagcgauucuuauuggccucuucuagguaggaaaaauaacauaaagcauuuggacaauaaauuaucacugaggaugaucacaacuaaaauauguauauuuacauaugcuuuggauguuaaaauaucucuacucccuacuuuguaucuuuacagcaaucauuauuaucuuaacuauaugugugaacaaauuuuuauuuauuuuaaauuuagugaucuuauuaacuucuuuaaugacaaaaauuaugggucuaauacagauuuucaacuuuaauucuuuauguuauauauggcuuggacuuuuauagcuuacucucuuuaguuaaaugacagacacuugucuaucuuugaacuuuacuuacaauaagaaauacauuuuacaugauuugaagaaccccaacauacauacacaauaugcauaugcacacaacaugcacgcacacaugcauuuacacaaauaauugaaaccaaaguaucacaaaauaauauguagcuuuguaacauguaauauaccuuguuuuauucaauucuagacaauucauugcauucaguuaaacauauugguuguaaaucaguaagcugauuucaggauccaguaauggguuauugcuugaaaaacagugucuguuguaugaaugauaauuuucaugaaaaucaaugugcuucaucuucccauuuguauuccuggcacaggaaauauuuaaauauauuaguaguauuaccuacagacaagacaaauuuuuugauguccgugaaaaugcugaaagguaugacuauacaugagaacaaggucauuauuuacccuccuuucacagaggauagcauaguauccauuugauuggagauaaaagauauuuuuaaaauguaguccuuuaaaagucaaaaugauaaaaguuaaauauucuaggucuguuauaaucuauaaccuggguuuaacuggaucuagaagaguaaaucuauguauagcuaaucaugauaaugacugcugucaaaaauacaaauaaacccaauaacugaauucaaggaaaugguacaugucaaaguuggaaaaagaaaagcugugguuaaaacaugguuauuguacaauuauuagaugacuuauuuaagaaacaccucuuuugucaggagaccagaagauuauguagaacccugucccuuuauuagacauuguggucugagcucuggguuuagauagauggggaagacuuugaauuuaugauguuaugugucaaaauucuuuuuuuuuuuuuuuuuuuuuugagacugagucucacucuguugcccaggcuggagugcaauggugcaaucucagcucacugcaaccucugaauuguucaagcaauucucuugccucagccuccugaguugcgauuacaggugcccgccaccacacccggcuaauuuuuuguauuuuuaguagagacgagguuucaccauguuugccaggcuaguuuuggacuccugaccucaagugacccacccaccuuggccuccgaaagugcuuggauuacaggcaugagccacugauguguuaaaguucuaugugugguucucuucauguguggaaaaagauggggccaggcaugguggcucauaccuauaguucuagcacuuugggaggcugaggcagguggauccuuugaguccaggaaauuaagaccagccugggcaacauagcaaaauccugucucugcaaaaaaauuaaaaaauuaaccaugcgugguggugcacaccuguagucccagcuacuaggaaagccgaggugggaggauuccuugagcccaggaggucgaggcugcaugagcuaugacugcaccucugcacucuagccuggaugacagagcgagacccugucucaaaaaauaaauaaaauaaguaaauaaaaauaugaacauuuguaagggucuaccauugcaugcuuugccccucaugaugucucagguacucauuucaggauucuaauuugcaaccaguuuuguuuuauggauaauguucuuguuggaaaugcuuccaaacucaggcugaaugcagaguguguuacauaagcacagauuaaggccaugucugcagggagauaaugcauuagaauccuguagaaccaguguuuucauguguucauuugguguaggcuuccuuccccacugccauggugauauuugaugaaacuaguugguggcuuaguuacaggaauuacaccugaaaauaaaucgcgaaaguucccauaugaagcacaaguuuagccauauguacuuacaaugaugauggcaaaaauaggugaaaaacauuguaguuauauaauauuaccauauuuagaaaugcuagugaugguggagggaguaauaaugacauuauauaauaauguauguauaaucagugcagaaaaauuuccgcuauacuccaaaagaaacuaaugcuuuaauuuacauuugguucuuauuuguucuccccuccccccacagucuauccuuucaaaaaaagaugcuaaugaguaguaaaggaaccagagcuaaaaaaggagcuguccucaucuguaaauucaccuuccccaaagagcugcaaguugacuguuugcaguugccaaaaagcuggggcccagcaauaaagugcucagcccccacagcaaucuccuuccuucagaggcggaacugcucaugauaaauacuucugccuccacagaagccuccuuguuuuaccuccucuccgcuguugccaccccacuugguucucgagggcagcaggcagaguugcccaagacuuauuguguggccacaaagagauggcagucaugccagauggcagguuuuccuugcuucuacuuacccagacaaacagacuuaaagcagucugguggugaaacaagaauuguuguggccaugaagaaaaguucgugucaaaauguauucauuuccuuucauuuucuuccgagacgcagacaacuuuuuaaaaaaaaucuaguauuuuguuauaagacuuuuaagcaaauguacuacuuuuauaugcauguuuugaaugccuauguaaaaauguaaugggcacauugcuuacaguacucugaugagagcacaccguuugucuuuaaauaaaccuagaugugaucuuugguuugcauuuaguuucaauaagccaauuauuggcagauuuuucacuggguggggccgaaacggcggcuuauucauuuuuucuuaagcauagauacucaaggggguuaaguaacugcacaccacuggcaaagauuuguaauccucagugcuaguaaaggugaggcacuuaccccuuuaagugaggagagauggcuuccauuuaauuauugcucuguggcauuucuguguaggaagugggaggcacugcagaugcucggaggaguugggaggcccauguguuucugcacuaccuggucucugugcccucgccucccuucagccugcccucuacauagcagcagaggauccugugaaacaccagucagaucccaucacuccucggcuccaaugcugggguauugauccaggccaucuuauguagaggcaaagcccaugcccucaggccuuccgaucugacucuucucugugcaugugcaugcacacucacauguccccgcucacaaacccacucacuuucaaccucacaggacuucuucgaagaugccagccuccuuuucacagccuuuguguuuacuacuccugcugccuacaaugcucuucccccagauauuugcagcguguacucccucucuuugggcaucauuuucucuuugaggcuuuccuugaccaccccauuuacucuguuaacugcccccuccccaaaauuuucugucuuguucucugccuuauucuuuuucaucauacucaagucaucaucuaaugggcuaaauaguuuccuuuuuuuuuuucuuuuuggucugucucuauucuaaugcaagcuucaugaagacagggauuuuuaccugguuuauucacugcuauccuccaugccuaaaauaaugucuggcacauaauaggugcucaguaaauauuuagagaauuugccaguaguauguucuaguagcccuucacaaugggcaucuggcucuuuagaccugauggcucauguuaucuuucuugcuauuugaccuugauauuggugacugugagucugguuccuccucuaguuguagugccuugugcugccuuagacacaccuccagcauugauacaacuguuggccaccucacuauggccuacccugccaucuguccucccacauucccuuauaucagcaggguucacucuggguaugaaugggacucuucuguaugccaagguuaagguaggacccaaggguguauaugaugcaguccuucugagucuucaggccugcuguccgccagaggucuacaggguuaaacuagccacugagucucccuaacagcuggcgggugacugacuggcagaguuuaguauagguggccuagagguguggcuggguuggauggaccauugaagcaaccuagaaagugugagccagacauugccaggcacccuuaagaaguagccaaaugugcuguuuucuguggaccugcucuuuggaccagccugcugccaccuugccaugggaggauuugaugugugugcccuaugcuuuugcaagcagcuuugcuuuccucugaaaggcaucaucucuguucacaaaugacaugacuucguuucuuagcucaaggcaaaauuugcucuuugaguuuguuuccuagggcuguuguaacaaacaaccacaaacuggguggcuuuaaacaauagauauuuauugucucaugggucuggaugccagaagucugauaucaagguguuggcagggccaugcuuucucucugagggcucuaggggagauccuuccuugccucuucuaguuuugguguuuguuggcaacccuaggccuucuuggguuuguaaaugcauugcaaucuuugccucugucauuacacagcucuucucucugugucucugucuucuucucuuagaagaacaacagucauauuggauuaaagaucuacccuaaugagcucaucuuaaccugauuacaacugcaaagacuauuuccaaauaaagucacauucacagguauugggaguuaggacuuauccuaauaucuuuuggaucuuaugauauccaguucagcccacaauuaaacccacaaugcucuucgugagaaagaagcagcagccaugaagaaagccuagauauuuuuaaggguggagagcgcucuugaccuuuccuuugacagccuugagcuucccuaaauacuguuguccucacugacuggcuugucuuaggaguaggguuuuugaucuucaaaccuuggagugcaguucaguaaagugagacaagcauaccuucugucucugagguccaggagcacuggaagaguggacagauuaauugugaauagagaaugcccugaaaauacaggaagaaccacccuccugcagauguagcucuggucccuugugggagccccuggaccuucggugaggcagaucuggaaggcuacagcaggggauguaaagagccccuuccuagacccgcuuccuggcccauuauucugcccuuccaaauguauuccaagggcuccucauuuugaucauugcucaguggcauuguuguagaggaaguaggagggugcuugguggaguuugggaggcccaugaauuucugcacuuggagaaauguuaauguugagcuuauauuucucuccuugcagcacagaagaccauuacuaggucuguguguagaagcccaagcaguuagagggggccucugcgaggcuugugggauuuuucuggccagaagaugggccaugguggaggaaggccauguuaaauggcugugauccacugccuauagggaagaguacgcaacacacacccaggagggcuuagguagccggaacuguggcggcuccauacccccaaagugaauuuuaaacuugacuuauuuaugccguucucauagcaacaggaaaacuguuccgaccuauagccacggaagacucuguaaaagaaacuguaggaggaaaaaaagauaaugccaggaaaaaaaaaaauuuaaugaaguaccauucuuucacuuauucagucaacugagaauaacaguuugugcauuuggcaaucaaaugggaaguggcauuucguguugcaacaugaaccugcucacauuaagugauuuauuuuuuuguuuagacacacuguacugagaacuuucuucaaguagaaagcuauuaaaaaugugagaacaagcaguccucacuaaccugaagcauuuggggacuuagaggaaugauaaaugcaaacagcccagaauccagaaacugucuugaacauuuaaacucuagacucugggaaugugugcaugucuucaguuagucagauguagauaauuuuucuuucugugaggucucuuuucacuuauaucuugucuggacaggguggagccccugcuuaaauucuauuucuagcuugaagaaagacuaaauuauuguagaccaaagccagugcuacucggaaaauggaaaagacauaggagacagggcaugucuucuuuagcccgacugugaacuuagggccccuccucuggugagugcuccugggagguugcacaaggcuuauguucagcuacugggccaagcugaaggaacgccucucaucucucucauguuuguacugaagauccguguuugguaaccauuucauagaucuuuucuaccacuugauccugggcuuguaguuaaugcugugcucagcauauuucugugugaucuugauaagaaaucuauuggccaaagaccuugugagcuauuucuguccucugucucucucaucuucuauuuaauauguuugucuguauuauauacguauaaauauaaccgaguuguauuacauuaauucuuuuuuuuuucaaaaauauauuaaaauuauuccccuuuucuaaccugcccauuuaugagcucuugcacgguaacaucuugauucccauuuuggcugagaaacuacauaaacuaguuuauugcaugcugcuccauuuuguauucaugguuaugauauugaaacuucaggaccacacacagauagcauagucucuggccacuuaagcauguaaacagucuggcuuuuuauaaaguggaaaaauauuucuugugcacuauuuuaacaugaucagcauguugaaacuuggugugcaacugugucaacauuucuuuggcucugaggagcaaacccggagaaccucaugguaacauauaaaaugcaaagcugguuuguuuacuacugggauuuaggcagcaauuagagucuguaguugacuuccaaacuugggguacagaauaagugaaauaauuauuuuugcaucgcgauuaugcuagcuaaaauaaugauuccuuuucagauggcuaagauucuuucagggaagcaaaggaaaauggguggcuggauuacaaugcaguuucuuuauugaaaaacccacauuggacccagcuugacaguguuuucuuuuguuucauaaauuuacugaacaccucaaaugugucaaauccuuuucuacaugcuaggcaugugaauuuaacaagacagacaggccuuauguuguuugcucaaacucucuggcucucuugaagagaaacaaacacuaaauaaguaaucagguaaacaagaagauguuuaugauugcuaugaaauucaacaugagauguuuaccaagggcacuguugagacccuuaggaugugucagugaacaaaacaaaugcacauuuucuucucuuaggggucucacauucuaguacaggaaacagaccauaaacaauaacuggaauaaagacauaaauuguagagcauguucauaagcagucaguacuauccaacaggaaaaagcagaaccaggugaaagguaucaggaggagugaggcagcagggggugugggaacggacaggcugcaauuuuauuuuuauuuguuuauuuucccgacuuuauugggauaugauugacaaauaaaaauugcauauauuuaagguguacaaugugaugauuugaugaacuuacacauugugaaaugauuacugcaaucuggcuaauuaacaccuucaucaccucacauuuugugugugguggggcggugagaacacuuaaauucuacucucugggcaaaucucaagugaagcugcaauuuuaaaucagguggcuggggaaggccugcuugagaagacuugaagagaugagggaguuagcucagaugugucucagggacaguguucuaagccuaugggaggccagugccuuugacaagcaaggaggcaagugccuuuuaaugaggauaugcgauuugaacuaaaacccggaagaugugaagaacccgucauguguagaguuaggugggagugccccaggcagaggaacagcagggccaaagaccaagacaggagaggaagaggccacuaugacugccccuuuaaaguggggagaugaggugggaaaggugggaagagauugcucagguaagguuguauaguccacggcagggguuuggguuuuacuuugugugaaaugaguuguggaagaggagacacccucuucugauugcccaucucauaagaguucagagaggagaggaagaaugaacccagcauaaacuuacccugaggaccaaaaaccucaugaggguugggauuugaucugcugguuuaccacugcauccuagcagugcaacaaauacuaggcccaggaaagcagucaguauuugcagggauagacacauggaugcaugauuuagugacauaccuccugggacagaagccuauuaucuuuuauuuuuugagauauuuggaaaaugcaaagaaaaaagaagucucaagaauaauauaacagcacuuuaugccaaccacccagaauuuacagcaguuaacauuuuggcauguuugcuuccagccuuuuuuauuauuucucugugaauacuuaaaaggcauacaaggagcagagggauacagucuccuuuauauauauauauauacauauauguauauuugagauauauauacacauauguguauauuugauauauauauacacacauuuguguguguacguaaacauuaaacuucuaauuaccauucuuaguugcuuuccccaugcuagaggcgaucaugccuaauaauuuauuagcagauccuguuucugguuugcaucugggggaaggggagguagagaagagagccagccuuauaugagaggacacuuggcagguuguggcccagugcucaccuggccggagucagccagugugugugcccacagcccugcccuuggagcaucagccuacuuggcgagcaccuaguuugggcuuaacacagugcuaggcacaaugccaaugcgggcagagccuaagagagcccagcccugaaaauccuucucuuuauagcauuccuguagcaugauuuguccugggucaguuuguccuugccccugugauaucuucagcaaaugagcugcucaacaggggugacccuuccagauaacugaggcuuauuccuuuauuauaugaaacgcuuuugauagaaaugauccugaaguaucucacagauuuacauuucccugucuucuuaaaugaggucuauuagccuuugauguggguugaucaggauuguucuuuucaacaacaguugcuauauccauucaugcucccgggggcugcuggcaacuugcuccuacaguacauggcccagacugcuuugcagaguauguugcuuuagaaacucuucugccugcuuuugcuaacuuuacugguucuccuucuccgugggcuggcagcuaucccuucuugcuguugucagugagccugcuucuaacucugcuucaguugcauuucucacucuuuauuuaugaguuccauccgcuggggccugggaaaggagauagucaaauuaaguaaauucuggguacagccaaagacgacucccagugaguggcucuccacugaggguucccugcagacccuggggccuaacuuggggugucuguuagacaucccagccugacauuuugauacuggcuggcagacacauuuggauuuauggccuucccaagagaaucaugcugaggucagugcugcuaugugaggcucuguaagcauuccuuaguagcucugugauggguuaaucucccuccucccacuccgagucagggugucacucccuuuccccugugauucuacccacaacgucugaccuagugccaggggcacggagucucuuuuaacugccaugguaguuggcaucagguuguaauucagcauuaggguacucugacugugaaauuguuguucccgggucuuucaauuauuucuguuauucaauuauaaagauaguggggaacauggagauaaucucauuccagcuuauaguuuugcaguugaagaaacuaaagcccugaauggaaaaugacugagaucaccgaguugauagucaccagcagagcaccguccccacuguggaacagugaccaccaugggugaaauugcucugauuuugggcuguaauuuaucugaaccaguaaguuggacagccuuggcaacacuauaaaguagagggucgcucuccuguaccucauuucccaagugugguaggauaucgccuugauacagaccagauucucuuccuguuaaagaaaaguaguuugcagcugauucacuauguggacgaagauccauccagaaagauguucauugcagcauuguuuacaguggugaaaaaauggggacaguuggucccgcauugggaugaugaauacauuuuuuuuuuuuuuuuaagccacagagucucacuuucuugcccaggcuggaaugcaguggugcgaucauagcucacuacaaagcccuggcucaagcaguccuccccuucggcuuucccaguaucugggacuacagguguguaccaccaugccuaacuauuuuuuaauuuuaaaaauuucuuuagaggcagggccuugcuuugcugcccaggcuggccucaaacuucugccucggccucccaaauugcugggauuacaggugugagccacugcaccagccugaugaauaaauuuugacacagcaauauaauagaauauuaugcagcuauuaacauucuguguacagaauuuuaaauaacaaggucauugaaaaagucacuggucauuuuugagccuaauguuauaauauuaagucaaacaggcagaauuaaaaggaagaauaacaauauaauuuuaaauuuuuaaaauuuccuuuuuaaaagaagaaaauggucaaagcauuuacuagucacucuucuugauuggugaagggaaagaggcugugugccguccaugcacuggauacuacaucugucaugucugugacacugccaugugguuuuuacccuugauuuguauucagacugaacaaaugauccccaagcccuuagggugcuaaagagugcaugagccauacuccuuguggccacacacaccuuucauccuggauaaugggcagcuggggccacaggcccauugugcagucaaguaucuugcuuccugcuaguaucagcggggagcacggagcccugcugguggagccuguccagcucuacuaaagauagagcaagcugcagugaaagagagccuggccauggccuuaggugccuugcaaauuauuguuguuauuauuauuauuauuauuauuuuuauuauuuuuuuuuuuuuugagaugcagucucgcucugucaccagacuggacugcaguggcgcaaucucggcucacugcaaccuccaccucccggguucaagugauugucccgccucagccucccaaguagcugggacuacaggcgcccaccaccaugcaugucuaacuuuuuguauuuuuaguagagacaggguuucaccauguucgccaggauggucucgaucucucgaccucaugauccaccuaccuuggccucccaaagugcugggauuacaggcgugagccaucgcacccggcggugccuggcaaauuauuaaugggcccagggugaauggacgcagcaugaauugggcacacuguaccuuugaaggacccugccagccaaaaccacugggccuguuguuggagacagggccgcuucccgggugacuuuaucagagaaccuggcuuuggugccguguucuugucccuccauuuaccuuuuuggcaaaauggaaccaaguuguguccuuauucuguucugaguugauggugguccuuuaaaacuuaaaaaguuugcaauauguuguucucauaaucugcugacaccuauuuacucucugguguauccuacauauuuccccguucuuaagauggggcugauggugugcguucccaaagcuuucuucaucauagucucagauaaaaacacauggcacuggcagucuuagucagauccucacucuccugcaaucccuucugaauccuccaugccauggggcucacacugcccuagggauacugucagggauguugaacuccaugagacugucuguucaccugacucccaggcagacaguaaggcgaucaggcuuuuccuuaaguugagcugaaagcugaaaucugccuccuugaaaccuaccuccagcuguuuuaauuuugccagcagaguauguccagcucuucaccaguaacagcaagcacaaaugacuaauuuaagaaaagcaguacagcagcuggacguguuccaucuucuuugaugcucaccaccucccugugaggaaaguacucuuacuaccccagcuucgcagaugacacuuggaaaacguaaggacccacaguuagguggccagacugagagcagagugcugagucaccacacggugcugacucacccucuucacgugacagcccuuccuguguguggagaccacagugguuuucuucuucucuaguaaauaguugaguuccuuugaccauuccauguguaauaauguucauuaaguaugaaacuaaaauuuauugaaauuuaacaugaaauuguugcauaguaaaaacucaugccuaucauaagagaaguaauuugguauuuuuuucuugucagauaauagcauacaaaugugagauuaugggauuggaaagcaaugucucugaguuacuugagucuagaacagggguuggcaaaauuuuucuguaaauagccaaauaauacauccuuuagacuuugugagugauagaguuucuguugcauuaacucaucucugccauuauugcacaaaagcagacauaggcaauauguaaacaagugagcauggcuguguucuaguaaaauguuauuugcaaaaacaggcaacagcuggguuuugaccuuggcuuauaauuuucacuuaaugggguuuuucuugauaaugagaaagaauuuacaagugggugcuaaguaggagaauccuagauguuuuguuauaauuauuaauagcaccccuuuuuaguuucaaaaaugucuuggucaauaaauuaacguauugucauccugguauuaugucacuuuaaguauuuuuuuuuaaagagauggguuuugcucugucaaccaggcuggaguucagugguacaaucauaccucuucugggcucaaaugaucuccugccucagccuuccaaguagcuaggacuacagcugugccccaccaucccugucuaauuuuauauauauauagguguguguauauauacauuauauauauauaaaauauauauaguauuauauauuauauauaguauauauaguauuuuuuauauauaguauauauauuguguauauauauuuuauauauaguauauauaguguauauauauuuuauauauaguauauguauuguguauauauauuuuauguauauauauacacacacacacucuauauauauauauauauauauauauauauauauauauauauauaguuguuguuguuauugccuaggcuggucuugaacuccuggcuucaagcacuucucccuccugccuuagcuucccaaagugguagaauuucaggugugagucaccacacccagccacuuuaaauuucuuaaugagacuaaggugaaauagaaacuuugguuuauguccuuaccauggucagucauuuuuuguuacaacagaacuuuucugcaucaggugacuuuuccauagauuucuauccuguccuaguccaggaagagguccuggcagugaaggaaaacucaaggagggaaaacgaagaccuccuagaggagcaucccuagcuuacuuuuugggaguagugccugugugcuggacacuguaccaaaggcuuuauauauggccuaucuuaggaaacagcugcuaaccccaggaguuaaguaugauuauuauuucaguuuuacugacgaggaaacugaagcacagaagcuuaggaaauuugccuagggucacagagcuggaaauuugguuuggauucaggccuacacugucuggcuccagaacccaagcugggagauugaacaggugugaaauaauuaaaucuaauaaaucagucaaaucaaagcaggagaagauugggaugagguuaagagguggaagacauaccucucauccuauccaucuuagguacaaacaucauggaagucggggguauuagcugcaccuuuucauuacaaaauccuuaggccugcugguuaagagaaaucucagggcacuggagagacuugagggcagaagaugccaggugggcaagggcauccuuggauuuaggaagaguaggaggcugccuuuugcauuagagcugccucuggcauucccaggguuuugucuggcugggcccaagggcuagaaggacuggaggaguccuagcugugccuaucacuggccauugccccucugcagcagaguagucaguaugcagcacagcaucugccuggcacuuaagaugugcaucucugugggacaccuguggcuucuagcgaggacaguggagggagaguggcccacacuagucucuggacucuuauacuuuaggcccccuacuucuagcucagugauuuaaggagaacaccaaguuguacauaauuuucaaagggaggggaguugccuucuuuagauaaaccuaugccaaaaggaaaucuuuaaaaauaauucccaucagcucuuauuauuucugggugguauuuuuuuguacauuuuccaaagcagugacccuaaccacaaugaggacagucauuuggagcuuuugcaagcuacucauucaaagaaaagugcaaagaagggugccucuagguuugguuacaaaacucuaccggggagugggaggugagagugggaaaccggugaauaugccuccuggccccaacuuuuuaaaauguauccuuugagguguauucuauuuggugcauuuucccagauuuugaauguugccccaggacaacugucuuaaguucguuuuggcaucaggacaaaugagaggauguuuccuguuugccugacucuugccccaacuucuuucucuguucuguuaagcucuuggcuaaauucuuuccucuuguauuccacauuuuaacugacauuagggcaccaagugcaaaaaucugcaaacaguuagcuuuccuguuugagcauucuggucagauuaugcugaaguuaaaguucuuguagcacggaaggaucacccucuguacaaugcauuaaguauuuaauaacuguacuaauaauuacaaacacuuuuaaugggccacuugggagccuuaaugugguuaaaaaauguauuucuucucugucaaguuaacuugugucaaauugagagaaauucuucuaagcagcuuugaaagguuugagcuucauaagccuaggagcaaguagcauauugugaaaguaguuuuuauguaagaagagacaacagaaauagggugaguauuaauguagugcuuuguacauuuccuuuauaguuuuguauuuuuuagguggagaagugucccaccacccuguugcauccgcuguaugucagguuaagcaauuuuuaguaggauuggcagcaaaaccaacuuuggaacacaggacucucuggcuucaagaucucuucuuugggaauguggacaauuuggauuuggccauuuuugaaguauuuuagaaaauaggacacucuugaggggcagaauugaaggucgaugcgucuuuuguuaaauucacauuuauuuguaaguugaagcuuuuuuuuuuuuuuuuuuuuuugagacggagucuuacucuugucacccaggcuugaaugcaguggugcaaucucgacucacugcagccuccaccucuugaguucaaccuguucuccugccucagccucccaagucgcugggauuacaggcagcugccaccaugcccagcuaauuuuuauauuuuuaguagcgacgggguuucaccauguuggccaggcuguucucgaacuccugaucucagaugaucugccaacuucagccucccaaagugcugggauuacaggcaugagccaccgugccagaccuagcugaagcauguuuuugagaaauuauuuucuggugaaacaggugugccuuugaagugauauaguugcuuuccaaagcucagaaagaaaguauuaaaacaaggauaaaguccuauaauguaauuaccaguuuuacuuuguuuuggcuuauuuaaaaguguuggcuccuuacuccaaaugagauccagucaaaacacuuacaauuauagugugcauacauuaaggacuuaagaaacuguuauuucucagguauuuggaaggaaaugaugucuucuggaugaaauucauggcauaagcauagcucauuuaguucacuagccugaauauucuaucugaaugguaacuuuuuuaaauuuaaaaacuuugcuuuuagguguauuuguaugguugguaucagaugauuauuucuuucugaaagcugauauuuuaagagagauaaagucuuuacaccugauuuugcugugugagaacagcucucucacauguuacuugagguuuuuuuguuguugugguuguuguuuugagacuuggucuugcucuguuaccuggguuggaguacacuggcgugaucauagcucacuguagccucugccuccagggcucaagugauccucccaccucagccucucgagaagcugagaauacaggcaugugcuaccacaccuggcuaauuuuuguguuuuuguagagacgggguuucaccaugcugucuggacugguuucuaauuucugagcucaagggagcugccuaccucggccucccaaaaugcugggacuacaggugugagccuccaugccuggccucgugaggcuauuuuuaucugcaccuuaguaucugggauaguggugccuuccuaggcauggguagguacacacauacacaaaaugucaaugcuagcaaguuuuuauucuuugaggaaagguuuaguuuuuuuagcucagagaaaguaaguuuaguuuuucaacucagagaaaaucaccuuauuaaucuucaacagauuaauguugauuaauguuauugagcaaagcugagguaugauucuaagguaaugagguuugucuucuacugaggcuuauaaacugaaucuuaggcuguuacagaaaagaaauugcuguggguuggcagcacugaggaaugagcauucugccuucuaagacguaugcuuguuuguaagugucuguucugagauguuuuguaacaaaucagauucauugcuuuauagcccuucuucauuaagaugggucuaacacggaaaaccucagaagcucaccccaucaaagacagcugugauagaaauaucaaguaauaauaaguuugcugcugugauuuuuuucagaaggaauuugcuggcaucagcaaagaaaauuucaaaguggguuagguugucuccauuggcuuuuauucaucuuucccuuucacagaaugaaaaaaugucugggcuguuauagcuuuguucuaaaguggcccauaauuuugucuauguuuuacaucccaguggauuccuaaguccaaauaugguauugcuucucagagaggucuccuuuucuuucccuucaaucuauacaauauuuaguagauuuauuuugagaucaagauuaucuuuuaggucaaccugcaacuuaaaaccugcuggacuaauguauuugaaugagcaugggaggaacuauguaugaacauucugaucauuuuacauugucaagcccuugcauauaagaaagcauuccuaagaauuuaagaaauuguucuaaacugaucauuucucugaaccccaucucuuacugguucuuuguuuccauagguaccauaccagaaagacugucaucaaacccucacagggucaaugucaauaucacacuuguuuuauaacacugucagaaaccagggguacugcucugccccucagucuggcuugacaaggugaaaauucagggacagaugagaggagggaccagauugaagacaaagaauggacauaggccagaacgugauguaggguggggauaaacagaguguucuaacagaagugaugugucagaaucuucccacuuauuagaaacgaaaaaugucaacauuuauuaaaagaaaugaaaaucugaagcauugguuuuagggagacggacauauguuaugaguuagaaggucaggcucuggagacaaaugagcagcccaaguugcacuccuagcuccuuguccguaggccgcuugcuaacaucucaguagcuacauuucucaucaguaaauuggaacaggggcuaauuguccugcugcauaggguugaugugaggaauaagugaggagagcaucuuggguauuuaggaagcccuccaucugugcugaugauggggccacccucccuggagguguggagaagcgaccugggcuggugcucagcagcuuugucagcuuaucaucccugcauuccccagcaagucuucuaacuucucuaggccuucauuaguuucagccuuugucaaauaagggauuugcuauauacaaguuccuuccagaaggaaaauuuuauguuuuuaaggugaaauuuuauuucucccaaaaagcaaaccgagaauaaauaguaguuuacaaauuaagaguucuguuuauaauacacacuggggccuacugggaguggggaggggcagggggagggagagccucagguagaauagcuaauggaggcugggccuaacaccuagguguuggguugaucuaugcagcaaaccaccguggcacacgcuuaccuacguaacaaaccugcacauccugcacauguaccccagaacuuaaaaguugaaggaaaaaaagaguucuguuuagaaaaguuaauguucuguuaggaagauauacuugcuaacuuuaagaacacauugauuaaacggacauuguugcuuuccugcuggaaacugagucuugacgcucuggaugaccauucuccacccagcacuagagaccagucuuuucuuucuuucucucuuucuuucuuucucucucucuuucuuuccuucuuccuuucuuucuuucuuuccuuccuuccuuccuucccucccucccuccuucuuccuuccuuccuuccuuccuuccuuuccuuucuuuuccuuuccuuuccuuuuccuuccuuccuuccuuccuuccuuccuuccuuccuuccuuccuuccuuccuuccuuccuuuccuucuuucuuucuuuucuuucuuucuuuuuuucuuuuuuuagacagggucucacucuaucacccaggcugcugcagcgcugcgaucucagcucacugcgaccuccagggcucaagugauccugccaccucagccuccuguguagcugggaccaugggugggagucaccacaucuggcuaauauuuuuguauuuuuuguagagacgggguuuggcuauguaacucaggcuagucucgaacuccugaguucaagugauacacccacuuuggccucccaaagugcugggauuacaggugugagcuaccauuccugaccuaggggcuuuucuaaggaaggcagaaaauguuugccuaacacaggugaguaaugcuggccacagaaagguagucaugaguuugauauucuuuccugccugguguucugaaaguaacauuguuauaaauuaauuguaaaauuauugcauuggagaugcuuuaugaaaaaugugcuuuauugaggugugauuuacauauaauaaaauacacccauguaaauguacaguugaauguuuuucuuuucacugucauagucuuugcaaaaguuggauacguuuugacaaauauuuacaucuguguaaucauugccuuaucgacuuuuaaaaacagcuuuauggaggcauaauucauauaccauaagauuccuccauguuaaguauauaauucaguaguuuuuaguaucuucacagaguugugcagccauuacugugaucuaauuuuauaccauuucaucacccccccaaaaagaaaccccauacucgucagcagucauucuccucaucucugugcccacuccuaccccuuggcaacuguuuauuuacuuuuugucuuuauaaaaaauugcuuguuauggacauaucauauaaauggaguuauacaacacgugguguuuugugacuggcuucuuucacuuagcaaaauguuuucaagguucaaccauguuguaguaugugucaguacuuuauuucuuucuaugauugaauaauauuccauuguguggauacaucaccuuuugcuuauccauuuaucaguugagggacauuuggauuguuucuacuuuuggacuguuaugacuaauguugcuaugcauguuuguguaaaaguuuuuguauauucuuacaugcuuucauuuaucuuggguauauaccuggaaguggaauugcuaagucguauggugacucuguguuuaacuuuuuggggaacugccaaacuguuuucaaagugacuauaccauuuuacauuccuaccagccacguaugaugguuccacauccuggccaacacuugcuaucgucugucuucuuguuuacagcuauccuagugguaugaaguugugucucaguugugguuuuaauuugcauuuccuugauggcuaaugauauugagcaucuuuucaugugcuuauugacuauuuauuuucuagagaaaugucuauugaaaucuugugcccauuuuucuuuuuucuuuucuuuuuuuuauuuuugagauagagucucaccguuggccaggcuggagugcaguggugcaucucagcucacugcuaccuccgccucuuggguucaagcgauucuccugccucagccuccugaguagcugggacuacaggcgcccgccaccaugcccggcuaauuuuuuguauuuuuaguagagaugggguuucaccguguuagccaggauggucuugaucuccugaccucgugauccgcccgccucagccucccaaaguacugggauuucaggcgugagccacugcgcccggcccuugugcccauuuuucaauuggguuauuuaucuuuuuauuguugaauuguaaguguucauuauauauucugaucagguauaugauuugaaagcauuuucucccauucugugaauugucucuuuacuuucuugcuggugugcuuugaagcacaaguguuuuuaauuugauaagcccaauuuaucuaguuuuuuucuuuuugucacuuguuuuuguaucauaucuaggaaaucauugccuuaccaagauuaugaaaguucacacuuauguuuucuucuaagaguuuuagaguuuucauucuuaaauuuaggucugugauucauuuugaguuaauuucuguguaugguuugaagaaugagcccagcuuuaauucuuuugcaugugguuauucaguugucccaacaccaucuguaugaacauauguuuucuuuucuuuccccuuaaaauucuuucucccuuuaauuguuggaaucacauuauagacuuugaaacaaaaauaauaguucccucuuccacuccucucuauccucuguucccacuccccagaagugagcacucuauagacucuuuuggcuguuucuucugguuuucaccuucauacuuauaaauagcauccuuauauggcaguucuggaggauuauuuaaaacaguauauuuaauuuugacacauuuuuauagaaauuccuauuguguuuucauuauuaugaugauauauuauuaugacaguauuuacugcagagccaggcaguguacucugauuaccuuucguuucucuuuaauucccacaccucuuuuguuuucauuugcuugcucucuucagcagccuugcugaucugucuuacucucccgcagcucuuaaaagugccugccaguccacuucucuccauggcagaucaucuuucucuucugucuuuucucauugugugucuguguuuuuguucugugagucauccuuccuggacuccucucucuuguuccauucauucuaggcuggucgcucuccaugacugcugucuuccugaggcuucauauugcucuucuuuuaggagcucccaucaccucucuucucucuacguggguuccugugccuccuagcuuaguguggauuuuucuguaggagauccuuuacauacagucaaggaaccugaugcccaggcuagugaggucccuuagcuaauauccuugagcuaauuaguauuuucuuuuccugcucaaggcuacugaaaaugaauuaaauucaauuaaaaugcugagucaaaagcagcugucuuacucugaguggcaauauuauucaugaggacuaaaaugcuaggaaccaagucaccaggaaaccaagaaggccagaaguggugcuacauccccaaauaugcccauggaggccccagcuccuuccucaccacaucucucuuccuucagaggcugcuucucuuuuacauacaauucuaaagugcuuggcuuuuuggcuuucuaaggcacaacggauaaucugaaaguguuuaaauuuaggagcagagggagugcagagaugggcacacugugagccauaagaagugccaguuagcuaaggggacagguggggaaaugacuuuuaaaaaaucaauccauaauuaguagagaucugaaguaugugucauuuaauuugauuacagaaggcccuacauuagucagcaucacauagagacaucacuuuauuauggcacucuaaagugacuggccucucuuccucacucccuuucaccccccuucaagagauuugaagagauuugcauguguugugacaugcaagcauuagagauaauuauuaguaagauauaacuggaaaaugucuguuuugaucuucugcucucaauagaaaaugcacguuguguugcaguuaaugcaaugacauuauuaguuuucucuuaauguugccuuuuuuggggggaucuuagcucuuuuuguaaagacuuauuaaagcccuccuaacacucucagugacagaaaucaguguuuucaauccucuuccccucugccuuuuuaaagcuaugcaacguuuucuuaaaguacaaugauacgcggaaaaaguauacaaacccguaggguggaggugcucuguuggugagagcuggcugacccuuuuuccuuccugccaagcagcccagcagggagcaaagagaagcauuuaggagggaaggagacacauggcucccggucuccugggccugcggguaccagugacagugcaugcaacuaaaaccuggauuuuguugaccuguugcauucuuagccaagugccuuacccucauuaaaaugcccuuccgucacucaguccuggggagggaggucaucucaugcgcuuacauaucagcccagcuggcugcuacugguccuguuucucacagagaacccuccuuguucuuccccgccauugaaucuguucauccaucgaugccacaagagcccagcugcagaaaccauagagaccaucucuccuaccccauggcacagccuguugcugaggaagggggucccaccacaggguugcuugggccuucugugaauaagaauuugguaggacagaaagcauaucacauccaccucacugggugcacaacccucuucccuacuguguuaaguucucucuaagcccugaucauccugcaguuucuccuugccauuuagccucuaagucucccggcccacuauucuucccugccuuugcuugaccugccugcaugcauaugugaauccuaagugcaaacagagaucaaauuguuccucuguagcagaccucuuggcaugggaugggccaguggguaaguuuauagagcagguggggacuaucucucuggccagaaggaucucaagcugguuuccaccugaaagggaugcuauaccacgagauacugugacagucagagagacaggcuuauagcuuucuccuccugguggaaguuuauaugaaauuuguuucuaaugauaaaaggacacauaagccaguuugcaggggggaggaggaguugaauucauccaaaucacacuuaacugguuuucaugauaauuauuaaauugccuaaauugucuuccuucuuucaauugaccucuguauauagacauagucaaacgccuuuguguuuauuucuucauaucuacagacauaugauuauauggaagaagauuaauuauaagauaaaguaacagauccuucaccuuuguaaauguugcauuaaacacuaaugacuuucuaaaaugagacuguaagcaccauagaagacagggaccaggacugcuuauucacaccauccuccacggggccuggcacggugcccggcaccaaacacccagugcugauuuaaugaaugaaugaauaauuuauugcaggagaugauacgucagaacugucugcuggaggagguauuaggugagaagcucauauuaagcuuuaaaauuaugagcagacuaaaaaaucuuuuuuuaagaguugucucacuauauaaacaaaaagucacauuaucacuuagcugcaaccaaauucuuauuugagucuauuaaauucauuuuuuuaaggaugugagacaguaggugaaguaucauuuuuaaaaaaugaauugguaggaggaggcagugauguuuggccauuuuguuguuguuccugucugacagggaccugcaagggcagggcuggcuggucgaacguaagagccuuccuggcuggcugggggaccagcgggcucaugacccuaagacucugcacugggaggcguagagaauguggaaaggccuggugacggcagcaggccugggccagccccagugcuuugugauggaagagagcugcaggccucaugggguuuguaaaguggacuggcuguguccguuugggauugauuacacaguuacagggauggcucgcaaaacuccaggaaaggaggacccuuggcagcguuccucucagcugcugcucuuugggaaucagcuggacucuucucaggcucuguuuuuguuccacagugcccagguuuacacauaacaggcauagccaugcagggagacacucuugaccacccgcccugccuuaguuccacguugccgagaaacaugaaaugauuguuccgucagcuauggccaggccugggaugaagucagaaacacacagggcucccaggagcccacucagcagugaugagaaaauagucauaaagaagagguuuaauuggaaauucaguuugcuauauucguaaaaaugucuuugauguuuaaaauaauuaauauuuuugugaguugcuuucaaguuuuuauuugaccuguggggauacaggaugguaguggagcuacaaaaguauuagcugaguguuguauguacagaagucagcacagugucaagaaggaggacugggcucugccaguuaccugccauuugaucuuaucuuuucaaagccucaguugacaggucucgaaaaugagguaaugauucaugcuugcucacaucugaagcucaguacauccagaauucugaucuccugcucagucauacuugcuuguuccucggacauuucuccucgucauuucuacugccauugucuugguucagguugucaucuccuguugcuaagguuacguaacagccacuuaacuaguaucauugucuucagcuucuccccucugcaccuauccuccccuuuggagccagugguccuguaugugcuuauccuguuugauagagaaaaaaguuccuagcacauuauuaaaaauagaaagauagaaauaaaauaaaaucuuuacaaucugauccagcuuaucuuuuucuuuuauuuuaaaugugguuucuuuauaauuaguauuuucaucauuuuuauguguauaucauuuaaaacaugaaauagcaguaccacaaggauuuuaagaaaaaguagcagaccccugccuucaguucuuccuauuuccaaauccuguacuccagaagacaccucuuuuuaccuguuuauacaguaauuugauuugccaauuuugauguuauauauugaccuuucucuacacggaaauuuagcacucauaccucuugcuuuccaucugcucacauagaagcuuccccucuuucccuuccauaguuguauuacaauguugaguuaaaucuguauuuaauguuuauauuauuauaauuauauaaguauuuuuaccgcuuagccgaacuauauaccaugaauacauuuucucauuguuauaaugguuuguuuuuccuggaauuuagaguugccucuuuuuuggcggauuaggggguguuaaugguuuucuuuguuucuaucacuauuuuccuccagaauuauucaaaugaauuauaaaguccuuccaagaaauauuuucccacaaucaaacccaucagguaauggaccagcacauuucuucgugucuuccuggagaugucauucuguugcuuucuggaccaacugcauucaaggcucagcgcacagacgucauuuucuguuuaccuucaccucucuucuguguuagauucuccuuuucucacaccuuccacugucuugacuuauuccuuuuucgguggaacacaauucuaguaacuuucugagaaggaauguggauaugggguaaggacuugggggucuccugauaaaugccuugcugccggcauucuuggagcugagcagcagaagggccccacuucuccauggaguccucucccugcucaucacuggccugucagcugaucucuuuguucuagccugcauuuccggucucaccuucccccaucauacccuccuuccuucaugcgcacaucacauugcacuuucacgccucugcauuuguucacacucuucccauagacuucaggguucuuccccaauauucuacuugguaaaagccuagucaucaaucuagaugucuauugaggugauaaaauuauaguugagaaagagaaugguucccacucuggaaaucaugcucuuucucaauuauaauuuagcucuugcucaacuuugguuuaucaaagcaugaaaagucaguuuuuaggcagguguaugagaaucauuggguuuggguuugucagcugucaugauccuuuuugggaugagcuagaauauaauucauuaacaaguaaaauuuaguaguguuucugacacgugcugguauuugucugaaauauguccucaagauugccacucagguguuuucuccaucaaauuguuuuugaacugcuguguuuuuaguaggcuucuguauuuguuuccuauggaugacauaacaaauugccacaaaccaagugguuuaaaacaacagaaaucuauucucuccccucucucucucucuuuaagagacagggucucaggcugggcacgguggcucaugccuguaaucccagcacuuugggaggcugagguggguggaucacuugaacucaggaauuugagaccagccugggcaauaugguaaaaucuugucucuaccaaaaauacaaaaaauuagcuggguuuuguggcaugugucuguggucccaucuacuugggaggcugagaugggaggacugcuugaggcugggaggcagagguugcagugagccaagaucgcaccacugcauuccagccugagugacagagaccccaucccaaaaaagagagagacaggaucuccuucuguuacccagaugggaaugcauuggcuauucacaggugcaaccaaagcaagguacccauugagauauguguuguauguugauaaucaaaagauauaucaucuucuggcuguaaugaucacauaccaucaguauuuugcugguucauuuguucacuuaacagauaaacaugccauaaacuaggcccuaugcuaggcgcuggcucuauaaaagcuauaaaaacaaaauacugccccucaaagagcucacaguucugccagaaaagccagcucgcccaugaggguccuaacuuauuauuuaaauacauccuugaauagccauagaaauaaggaguuaaaaauacgaagaacaacucuggcaggaagguuagacacauguggaaggugcagaggggacuagucagaaggcauguuucaugauuuaccaacuagagguguuucaagcaggcuuuuggaugcaaaguggcuuuaugauacaaagauuaaacucucuacagaauccucucaguguauucaauaugagccccuuuacuucuuucuguaaaaauuuacuccauccuguccccaaggaagauguuuuuauaagguauaagggaaauggaagguagucuucagccuuuagagauguuuuauugcuuucauuuguuucaggguacuugacuacacucaaaauuauuucucugggguauucuuacaaagcucucuuggauucaucuaauaaggaagaauaauuuggaauccaaaauuaucaucucuguuagagguucuaauccaugguuucuucacagugcaguauguuuuggauaaauugugauugcuaauauaguaccuaaguuugucagugauuucuuuccaaaaaaagauugacgcacauuuaagauuauucauuaauauaauuacuccuuuucauuugcauuccauccugcuuuuucauuugggaaagaaaugugcagagggacagcuggugccucuguaauuacacauaacccccagccugucuuaucugugcacuccugggagcgggucacaaaugucauccucugucuugcguguuucaauuuuuuaaaaaaauguugacaggccuggugguuccaccuuuccuaaguaauugaucauuauggcuguuguguaaccauuugucagguaagaguaguuuguuuuauuuuuaacuuuugcaguuaauuaaaaaaugguuuuaagcuccuagaauuuaauucaaaaguuuucuaacuuugcgcuauucuugcaacuuuucugaaauuugaaauuauaugaaaacaagaaagcaucaaagcaauaggaaaaaacaaugcuuaaauggaccuucuguggguccauuuaucaaacauuaguuugauaaauaucaucauuuuugaaauguaauuaauuuuccugguaaggcugaaucauucaaaugggauuugcaccuuucacagucuuucauccuccugcccauuuucccuuuccuuuaucugauacucaugaguaauaacaaaagcaacaacuaacacuuaugaagaagaaaauaauuuuacuuaggaguaaaaaggcuuguggaaguuaagcuucacuggccuugccauauucuuggaauuuucuuuucuuuucuuuuuaaaaaaaauuccuaggaauguguugucauuauaucagacuagcucuuuggaguaaaccccagaccugucuccuuauguaccaggccaacagaggagggccuagacuugucagccccagccugaagacucagaagagaaaaucuuugauacccaugugaagauccacacccaaccagaguggcuggccaguguuugccccacuggucauauuucccugggcucaacauaccuguguugucacauuagauguuuuuguaauucgggauuuuucuucugaacauagaugcagacauuucagauacccacaaacuauguaaccaaacacagccuagcucaaaguugauauucccugagcuuuccuuuaugcacgugacuuaaacacaugacaauauuugucuauuauuuuaaucuguacaaggaaagaaagguagugauacgucagugaauuguucagauggguuucuguuucuguuugcuuuccauauucucuauuuuuuauaauaauaaauuuaggaugaugucuaaagacuaaaaaguagauucagauuuugcuuacugcuuuaacuuauuuaaaaguccuguuuuuaggaggaguaaguagauugauuuuccugucaugcuaacaugagacauuuaauuuuuauaauguaaucuuacguucauuagccuuguggcuaaugauaaaacaagauaaaauaaauggcauuuuaaaagugauucuggaccaggcgcgguggcucaccccuguaauccuagcacuuugggaggccgaggcggguggaucacuugaggucaggagucugaaauuagccuggccaacagggugaaaccgcaucucuacuaaaaauacaaaaaaauuagcugggcaugguggcaggugccuguaaucucagcuacuuggaaggcugaggcaggagaauugcuugaacccaggagguagagguugcagugagccgauauuguaccacugcacuccagucugggugaccgugugagacuccaucucaaaaaaaaaaaaaaaaaaaaaaaaugauucugauuacucacauucuucuucuucuuuuuuuuuaaauccuacuuuuguuagaauuccauaucucuaagaaaggaggaacaccaaaaucauugaagguucaaggacccucucccauaauugcuaucauagaaaauguucaauucuaguccaccugaauauaaaccaccucaagccaaaaugaacagaguucucagugccaggagaauuucaugaguuugggaagcauuuugaaucucugcccucaguuuggaaauaguuucauuucucugcuaaugaagaaguccaagaccauaugcagucuacagagguuccaucuauggagcaaaaguugggagcagaccagcaggguuggcagcgugaagauucuaguucucucuguugaagucucaacugccgagccagcacucagacacagagaauggugguucccaaaaguuuugggaauccauauugugaacaggcugacacucugccuaccuacuguuuaagggaauuuagacuguuuugggaaacaaucguguaagaaggcuugccugugcugccugccccagaguaaggcggugcagucucagacguacugguuggagauuugaagcacaguaauacacuggcugguccuuucauuuguugguuauucuuuguguuucugguaugaguuuguacguuuagauaauccagugaaucuuugagcuuuuucuuugugaggucuguuuacacauuuggaaauaucagugaauauaguuccauugguguuuugcggcuuucagcuuuugaguucccucugaagcuacugccaugacguuaaccuuugaugaaguuaagagcaucagaggguagaagaaaaugauuaccagugguuaacgaugucccgauuuguuaggaguuugggaaaagugcacauuuccauggagucugcgugcucacuuggugagaagcucccugaccacacguaaauugagaaauagauugcaaaaucaguuuugauuaaaaugggaauuugagccugccacugagaagcaaccaucuugcuauaaauuauuuauggcaugagcauaggcuuuaguauagaggcuguaagccuuuuuccaucuugcuuuaaaaauugauuugauuauaaaaagaaaauuaauuuugcuauugaaacaaaucuuuaaaaagggauuuuaaagugacucuaagguagaaaaaaaaaauuaccaagacucuuccaaaaaaccaacuucguagcuggauucuacaaaaaaagcauaaaugcugaacccugauuaacacacuuuaucauauuauauacaugagauauuucuuacagagaguaccacagugguguaaggagcauauuuuugugaaguccucagcuuuacaaacauauuuagauuuauuccugugcuaacuagguuauaucauaucucccaguuuagacugcacauggauaguccacugagcaaugugacaugaagauggaugggccuaguagacagauaccaggccgcugccaggcuugcagcauugacuccucuucugggaucaucacaugcccacuucuccccacccaucucagcuguuaagucuugcugugggaucagacccucaccccaccuccuaccugccgugacuugacagggaaguucauuugggagauuaaaaauguagauggacagauacaguuucaugaaugauuggaaacaugguauauucucugcuuucauugcauaggguuugagguauaucuuguggaccaacauuaucuauuauauguccucuauggucuuauuugucuuugccuccuugaucugacauggccugaaagaagugagcucagucuucuaugacucuuguguuucucuuugcuguuuuuaaaaauuguaccuguucaauaaauguuuauuccuuauuucccaugugccaggaaugguucucagcuguggggacccaauuuugaauaagaccgacaaaguccuuggucucauggagauggcauuucagucagggguuagacagacacugcacaaagaaagaaacaagacaauuucagauaccgagacgugugacaaagaaaauaaaagaugguaacuugguggcuagugacuggaggugguuccugcuuaaauaggauggucagagagacuugaacuuucaaggugaacucugagugaaaagagagagacaccuccuagcgucuggaggaagugguucuagcagagagaacagcagguaccaagccuuugagacagaagcaaacaugguguaucagaggagcaaguuuuacagucuuuucccugcacauguaugcuguuggauucucaggauaguuuucauuucuuuauagcuuuuauucuccaucacuacacaugcccugcuucaucuccuauaacuccagcguaaguuucugacaucacaucccugacauugguuugcaacugccagcaggaauuugccuuuuucacugugggccucaucugagucaucagcuaucucgucauugacuggaguggucuccauaguuguguacaugugccaagaugggggcagagguuaaaugauccacggugguaugggaaaauauaagaacuuucaucuguauuuaauuuauugaauucaaaagaacuaaucaaaagauugaugucaccaccaagaaaucauaaguaugggaggggauggauauguucauuggcuuggaaucauuccacaguguauacauacaacaucacauugugccccauaaauauacacaauuauuugucaauuaaaagaaauuaguauccgcacccucacuagguuggugcaucaaagggcccucugucugggaaggugacaugaaggagggaaagaucccuccugaugggaaggaccugauuguaguacccuuuccuguuggcuuacccuugauugggacauagugcagccacaugcagcaggguguugucauguggacgauuucauaaaaacacaacccaucucuaguccucacuucaccugaggcccccuggugacauauuguagugaaaauaaccagugucuuaaauagggguucguauucuuuuagugccccucuccaagaugggugcauauccccaagcugaaauuuggacuaugagauuuuaauucauacugaauagaaaagcugaagaaaaaaauggacuuuuauaagccacaagcaauuuuuuuuuuuuuuugaaauagagucucacucugucacccgggcuggagugcaguagcgugaucucggcucacuguaaccucugccucccggguucaagcaauucuccugccucagccucccaaguaacugagauuacagaugucugccacuaugcccagcuaauuauuuuuauuuuuaguacagaugggguuucaccauguuggcuaagcuggucucaaacuccugaccucgugauuugccugccuuggccucccgaagugcugggauugcaggggugagccaccacgccuggcccacaagcaauauuuuugugucaagaaggagaaacuucaguauuucaaaaccucuugggaaaacucucauaugaaugagccuuguauuugugcaaauaaaacagagauccacuuugaaaugaaaagaaguuuaagguaaaucacucuggugggaagaagguuguucagugcaugaaaauuugcaacucaugucuucucgauggucugaucaucuuauaugaaacaucucuuuuuuguuguuguucuugaaacagagucuugcucugucgcccaggcugcagugcaguggcaugaucuuggcucacuguaaccuccaccuccucgggcucaagugauucuccugcaucagccucucaaguagcugggauuacaggcaugugccaccacaccuuuauguacaaaaauacauaauuuuugaauuuuuaguagaggcgggguuuuaccauguuggugaggcuggucucaaacuccugaccgcaggugauccgccugccucagccucccaaagugcugggauuacaggugugagccaccauucuuggccuuuuuuuuuuuuuuuuuuuugaggcagggucuggcucugucacccaggcugaaaugcaauggcaugauuuuagcucacugcaagcuccaccucccgagcucaagccauccucccaccucagccuccagaguagcugggacuauaggcacaugccacacugccugacuaauuuuuguauuuuugguagagauggggcuuugucauguuacccaggcuggucuugaacuccuggcuucaagugguccuccugccucagccucccaaagugcuaggauuauagguaugagccacugcaccuagccaucucuuauuuuuaaaaaauuuucaccauuaauuuuguguugucugauuuucacauugcccucccuuuuuccuuugguuaugaguucccagaucuuccuccagccuuuugcugggagggagagucugcauguggagcacagaguuuugucucagccgaggcagggugaggguggugggucacuucugccagagcccccuugaaccaacuuugugccuuguggguagggguaaacagggcagaagccaagguuaugagaggauuuguaaggcccugggcaccauuagaacugcacugggacccaggaaggaguguuggcccugagucggggagugagcauguauucccugccuccuuccuuucuuucugcaauauacuuauugagcaccuucugugggcuaggcauugguaagcauuagggugucaaucaucaauaacuaaauugcagaccuuauugucucuuggaggaagcuggcagucagaucaaucacacagaagcaggaaaaauugcaaucuugaaucauuguuucaaaaagagguacaugaugcugccugcaagauaaagggugaguugcccuggucuggagccuuagaagguuuccguaaagaaggagccucgagucaagccugagccuaggggaaggugggguagaagaaggaauggggagcuccuuccagcagagccaagguccuuucugcuuuguccugcuccguguucagcuccuggcgcagggcuggcgucugggguaugcucaauaaauuaaaaacgagugcaugaacagaggccagcagggcuggagcagagcacaggggacaguggguuggcauggugcuggagaagcuggcaggggccagaccucacagaggcuuguagguuaucauguacuuguaggagaccacauagguuaccaugaaaggagaccacauagguuguuaugaaaaucaagauaauuuuuagagcagaagggggagcuauuaauaauuacgccuggauagaaaggcguaaaaugcaacugacuuggguguaccgggauauggucaaccucuuaccagcuuccuaggauuuuagucuuuauucugagaggaguggaaggccccuccaaagguuuuuagcugggaugagguuugggguguggaggcagggcauggcaugaucgcucuggcaacagacugguaauagauugaaagugaguuguugcaggagagagaccagggaagacgguugcagaaggccaggcuggagcaggugauggcuuggccuggaggcauggaagggguuagaagugaugaauugcaaauggcugcugaggaagggaaguguugaggucucagaauuggauaaguccuagugccacuggcugagucaaaacaggaggagggagcagguuuggaaagaacgugcagguuuuguuuguuuuuuugaggcagagucuugcucuguugcccaagcuggaguguaguggugugauuuuggcucacugaaaccuccgccuccuggguucaagcaguucuccugccucagccuuccaaguagcugggauuacaggugcgugccaccaugcccagcuaauuuuuguauuuuuaguagagaugggguuucgccguguuggccaggcugaucucgaacuccugagcucaggugauccaccuccucggccucccaaaguacugggauuacaggcaugagcuacugcgcccggcccaagaacauguaguuuugucuaggguaagagucaagguaugaacuuaagagguuucauccuuagucucaugaauucccaaaccaggagagaauaauggaacuaccuguguugcaugcacauucaugcuccauccucaccccuucacccagguguucacuacucacauaugccugaauuuuauuaacuaaaaacaaguucuuuccuucacuagagaugaauguguuuaaaaagcaaauauugaguaaauuugcauagcagaucaaaugcuuucaaagggguaaggauuuuggagaaugcuuuguuuugagaaagccugaagacccugagcuagagacacacuguuuagaaagaugagccuggaaacacuagugagggagaaaagcagaaaugagcgccggagacuccaccaagggaguccgaaaagucagggcacugugggugaacuugaaccugaauguagaauggcucuuacgguaucuauaauuugcaaacuucuuauauacuauuuacauaauaguucuccacuuagagaucuuuaacacaccuucuuguuuuuuggaaugugacaaguuuuauagcuaguauggacaggagagaggauaacuuuaaaauguggugaauagggcugggcgcugauggccuaugccuguaauggcagcauuuugggaggcugaggcaggaggaucgcuugagcccaggaauuugaggacagccugaacaacacagcaagaccuugucucuuuaaaaaaaaaaaaaaggauuaaauaaauauggugaguugguugcagugagcagugcuucuguaucaucaauuagaaauauugcaacgguuugaucucucagucgccuguuaguucauccaaggaaaaggaaaggcagagagccuuguuucuuugcaugugugacacucagaagccagcaguucugcaggcaguuuccuaaggucuggcucccuuggcaaacguuaccuuggcugcagguaacuuuauucuuugugaauaaugccagccuggccaccguugcccucuucugguaaggggcuaaugcuacaaacguacugaguuuuacaaggaaggaaaacucaagcucgauuuucacuuuggucaacugugcuaugccagcuggcauaaaucccuacaaugaaaugaauguuugguuuaaaauguuguaauguauacucagaccauggaaccaugugagggucuaaucuuauuuacaguuuuggcuuugaggacuaccuuggguauccauaucauuucccacaguugggccacuuucuguuuggcaaaaaagauuucuuucagccuuuucucugccugugaaacccugucuggcugcuucauuagcuaacacaugugugaauuugcaucauugauaauggcagcaaaugcaaggaauaugguuuuaaucaaauuuuaguaucuaauaucucugaagcuuagggcauagaacauuagaggccugggauaaacaauucauauucaauagcagcauuuuagcauuucuuggugacauauuuacacaauuuauaauuuagagaugaguuuauguuacaugguaaaacuugagaauaugcugaaauaacgcacuguguugggagggggcaaugaaaauauggggcuacuauggcaguuuaugcaggaacuacuuuaagggcaguccuuguugcccuacccagugcuuaauuuuuugugaccaaucuuugguuggcaccucucuuucccuccccaacugggaagaagguaaauacuccagucaacuaagugggcuuuguguuuaauggaacccguaaugaauacuuacaaaggaaacacuguuucgugaggcauguacuuccuuacuauaacucuuuuuaaaauuuagauucuuaaguaauccauuagguugcaguuuggcccgaagaguaucacagauaaaagcuagcuaccauacucguuuggauuauuaggaucuaaagacaugauguugaucuuuuuaugcuggaucaguuugauauuuacaguucaguugauucauguaauuuuucuaggaauugaauagcaacaagaaauacaucuaauaucaugaucuccuuaugacauuaauaauacaugagaagaaucuuuaaguuuuacccuuaugcaaaugccccaugcaaauuacccaaaauaaaaaugguuagguaacaaggucucucaagagaaaggacaacaugaucauuuagauuuugacaaaaguaaugagauagccuauuuuuuagauguugucuguucacaauuccugaauuuauuuuuuaauuccuuucucccugccuccaucccuucuuucauugauuuaggcccuguuaaaagcuaacagugauauaagaaugcuuuauagagcugggguaguuugucagcuggccaggugaugaaucauggaauagaauucuuucugugaccaaauuaaacccuaaucccaugaagaaagcagucauugacaacuucuggcaagguaaagacuaagaggacccuuucuuuguuguuccgggcagcugggaggaugagcagcauccacacucuuuggcugagcauuuuguaguaccucuuugacccagggccauuuguaccucuuuuucuuccuccucuuggccuuugaucccuacaaauucuccagggcuaagucagcuggcuccaugcagaagguuuuagacaagguuucucuacuuuggcacuaaugacauuauagaccagaugaugccuugcggugggagcuggccugugcaguauaggguguucagcaguauuccuggagucuacccauuagaugccagcugugacaguccuaaauguuuccagacauuguacacagggaggaagggagcaaaaucaccucuugauuaagaaucuaaaauuacaguucuagauucuuauugauaaagcccuucaucuuuuuuuuuuuuuugagacagagucucacucugucgcccaggcuggagugcaguggugccaucuuggcucacugcaaccucugccuccuggguucaagcgauucuccugccucaggcuccugaguagcugggacuacaugugcaugucaccaugcccugcuaauuuuuuguauuuuuaauagagaugugguuucaucauguuggccaggcuggucucgaacuccugaccucaagugauccaccugccauggccucccaaagugcuggaauuacaggugugagccaccgcaccagaccuucuuuggcuguauuauuuugagguaaacuguauugucacauuucaccaauaggugcugauucauggcacacaguggauugcagccugaagguuucuuaauuuaaggaauuaaggguggggaauaaguuuccuguugaggacuaaugcccaaggcagaguuaaucaagaggcacauaccaaaaauaauuuagugucuuuuuaucucaccaaauaaaaauacucaguucccuuguuuguuaaauuaggaacaggcaccauaaaacuuuauuucauaagaauaacuaauuguaaaguuuacacuugucacauuaaggcagaggugaugaaggaaggguacaggcaggcagaugauagaugaaggaaaaguagaaucugauuuagaaagaaaaaaaggcauucaaggaggauagaaaagagacugaaggaagaaacauuagaagaauuugaguguuuuggaaauauuaccugcuccucaaauaguuguaggauugucaugaaaauguaucacuuuuuaccuaccauauuuuaaagggauuagaagauuuaucaguguucacaaagcgugaguugcucuaauuaguaaaucuguagggaauccugucuaaauagcagaauuggaguggagggugacauuugcaggugcaaagaagcucauuauauuuugguuuguuaaaaaaaaaaaagaagaaagugaccaucaccaguaagggcagguggaaucaagcagacaccaggaucugccucccuaucucuaauguguaaggaaaaacaagguaguuuucugcuucucuuuuucauuuuaugagugugaaaguuauggaauuuacuuaaaacaaggaauaauuauuaaacuguucagaguauauguagucuccaaauuuaaauaguugaagguaaucaucucagcagugggucucaacccagccagcacauuagaaucggguagggagcuuuuaaaauauacugauacccaggccccaccccgagagucugauuugauuucauuggcguagaauuuggacauaguuauuauuuuaaaagcuccccaagugauucugaggugcugccaggguugcaaaccacucuucuaggccagugaaucucaaaguguggucucuagaccagcagcaucagcaucaccugggagucuguuaguaacgcacauucucagccucaccccagguuuaagucucaccauggggcugagcuuuagcaauuuguguuucuuuuuguuuucuuucuuuucuuucuuuucucuccuuccuuccuuuccuuccuuccuuccuuccuuccuuccuuccuuccuuccuuccuucuuuccuuccuuccuucucuccuuccuuccuuccuucccucccucccucucuuucuuucuuucucuuucuuucuucuuuuuguuuuuuuaauaccuagccgagcacaaagcuaaucaauguguguuuuuaacaagccguccuggugaaucugaugcucgcccaaguuugagaaacacugugucaggcaauggguagugguguuuugaagacaucgaauccugagaaucaaggguguguaauaguggaugcuggcaguauuacucugaagucaaugcuauggucuucaguguucauuuggcucaggaggcucuucacuuauccgaggaggauaccugggaaauguaacuuuccacugagagccuuuauaaggcuuaauugcuaauguguagguagcagcugauacagacuugucccucccacucuuuucagccaagcuuucaaccucacucuaaauauucuuaauuaaugaucuucggcuucugaagccauuucaucaguggucuccugucccagcacguuuccccuuugagcauuccuugaagaggguguuauucccagcagucaacuagaaaaggaaaguagagguggcucuacacaaguccugugaccaauuaacgaccucccuuuauuccucuuuguaguucucuaaaaaugggucagaggaagaaaaacucggcucucaccagcagaccucgccuguguuugucuaacauauucugucccauuucaauuuccugccuuaggcaugaauugguugaagauucccuuugaacucuuacucauucuguagaaauucucugugaugaaagcagucaugggauuguuuccugaguucugaagcagagcagaauagugagggaaauucagugcuaaaguuuaagguucauucucagcaaaacuaagggauuauuuugcauugaaugaauuuugaauuuuguuuucucauuugauaaagcugagugagggugaaagguaaagggaaacaaacuucuuaauccuuuacuugucaguaacaguuuuuauugcuucauuuucuauuuacaaggaaaacaccuuuaaaauaaaacaauucuauuggaucagcaccuucuuugguaaaguucaaagaaauuucccagguuagucccuaucauucccucacaugugguccuuaggagccuucuggaauucccugcaggaugggauuccccuugcaucacugggcacuuccuauuaugagguucccaauguugcuugcccuuugugguuuuagucucucacuaaaauaauagaaccaggauuucugaaccaggagucacuuuaaggaagugucuaggcuguccaauguggcagugacuaguuuauauguagcuguuuaaguuaauaaauuaacugcuuauuaaccaauuuaauuagaaauaaaauuuaaaauucacaccagccucauuucagauauucaguagccacauguggcuugaggcuaagguauuagacauuguagauauagaacaugugcaucaucacagaauguuauuggacagcaguggucaauuuugucacccuuguuaaauaagauacugagacugagaaugauguuuguuaacuacucucaauuaguuaauuccuguuuguggacacugcagucuguuuucuuuuugaauuuaaucauaacaucucugggagggcagggauuauugucccauuguacagauaaagggauuaagauucagagaggcugagaaacuuggcccuggcucuguggccaguaaagggggcagccaguguuugcauacauauguaucuguaugacucuaaagcccaugcuuugcauguuaaagucacuaaaaggucaaguacucagauuuuuggggucuauaagcccacauuuuuagguguaaacuaaacaaacaaacaaaaaaccaggaagccaauggugcauuggaugguugaaguaacuaaaucaguccaaugcaacaagccagcagucaauccuuuccuguguaguuuucaucacuccucacagggagaccaguggccuaugauaacagugcaauauuuauucaguugcccauuuuaaugggcuuugugucaauagaguuuucuccccuggguugaguggccagugcacacccccugcggcagaucacuuccuguuugaaaaguccugcuggucugaucgucuuccuuagguggagccaguaccugucuccuuaugguuucucugcuucaucugguucucuaucccuuaaggcccuagagaacuaaggauuauucuuccaccuuugaaagcccuguuaauauuauauuauccuggcuauucuuuuuuagauuaaucauuuuacuuucuucagcugaugcucaugacaugauuuuaaguguugcuguuauccugaucacucuuauuuggguacgugauaguuugucucaauuucaauauugagaguaauugagcacuaaaugcauaaagccucauccugucacuuuucccggccacugcuguuaaggcagccuaacaugaaauuaacaucauuuacagcgauggcacucugcugccugcucacagcacuuacucuugacuaagaaugccuccacuugggcuguuaguuuuuuggagccaaauguuauaugacccuuacauauauccuaguuuaauucucucuaguuagauucccucugaaucacagagguccaguuuuagaguuuuguuuuguuucccagauccaguuuuugcuaccccagauaugcacuguccccuucuuugcagugacauccaccuauuuuguggguauguccccuauauauucauccauuccagugcuggaaaugcagaccaagaccagggucgaggaaaaaguuguucaccauccccauccagguugcuguuuggccauuaauggguccugugguuauggcuguuuaacugguuaugaacccaccugucauuucauccacuucuauuuuucuguuguuuuauucacuaggacucauuuguucauagauucauuucauuaauauuuauugagcuccuaccaugugccaggcccuuuugaagguagaacuguuaggguuuguuaauagauuggauguguaauaugggagaaacagaggcaucaaaaaugacuccaacguuuuugaccugaacuggaagaauggaguuacaauuaguuaccauguuugaggguaaacauuaauaguuugguuuugaaccuguuaaguuguagaugucuauuugacucccaaguggagaugcacaguaggcaauuggauauaugccucuggaggcgagagggaggucuaggcuacagcaaaaagacuaggagcucucagcauguaaacugcccagugucugaaaccuugagacugaugaaagugcagauggaggcaaggagaggucuaaggacugagcccuggacucucuaguguuuagaggccaaagugaugggacaagccagcaaaggagacugagaaaguguguccagugaggagggaggagaacgagcaaagcugacuucuggugucccaagaaaucaaggaaagcaggaagugaaagaaccacuuuguuagauggugcugagguaaaguaguaugaggaucaugaacugaccauugggcuuggugacaugcagaucauugguaaccgugacagaagcuguuuuaguggaguaaugugaauaaaaggaugucaugaggaacuucauuugauuccuggcugagguucacgugugcuuugucaacugccuucaccagucauggcagcuaagaauauugucaaagaagaaaaugagguuaguuuuucauaauugggguuuucuucaggcucucccuuaguagucuguuauggaugaaauguauagcuguaaaauccaucuuucucuccuuuuugaaaagugcagcaucauuucugucucucuagguccuccagguaacucuugugcuccuccucaucccaguggucgagccaggcucuggugcccugggauggauuccucugagcccagucaucuaacucauuaaaggauuuacaugcaguuauaucuguuccuuaacuguuuggaguuuacagcccccuuucuuuucauuucuggccuuuccuuucuguuucuuccuaaggcucucccuucauccagcagguagaucucuuuuucccuuuggauuuucaucaucuuuaucauccuaauucagaggugaauuuugaagaugcucagcaaggcacuguuuuaucuguagcucucacccuggcuacacaucacauucaccucuggagaauguuuguuuguuugugacaggguguccacuccaguugccaaggcuggagugcaguggcacaaucuuggcucacugcagccucgacuucccaggcucagaugauucucccaccucagccuccugaguagcugggacuacaggcgugcaccaccauuccuggcuaauuuuuuguauuuuuaguagagaugggguucuggcauguugccuaggcuagacucgaacuccuggacucaagcaaucuguccgccuuggccuuccaaggugcugggauuacaggcgugagccaccaugcucagccuuuuuuuuucuuuuuaaagaaaaucauaauuuacacuaaaggaauuauuuucuuguauuuaugauaaaauggugauuuuuuuacuugugaguuuuacaguugaaauauauucuggugaauauauuuccuguuguauuacauggugaaacuucaucagguauuuuuuucuuccuuucuauuguaaccucaaaaaaaguuccuguauucuacagagaaugcuaugaguauucuuccaggauacaagggggccuguagcaggggcucuuaaacuucagcauaugccagaaucaccuggagggcuuguuaaaacaccggauccugggccccucucuguaauugcugauugaguaggucugaguaggauccaagaauuugcacaucaaaucagcuucaggagaugcuguggcugcugguacucugggaaccggcugcugguacucugagaaccgguagucuaggcuugaggcucuaguggguaaauaucccuaaggucguacacacagagagcuuuccugaacuagcagagccaggaugguaaguguggccaaggguacaaacaggccuagcacuugacuuuguuggggcucuccaagguucugguaacccugagcccugaaauaguagaaacuccucauucugagguuguguuuuaguuugcagccacauacuucaaugcuguuuugucuccuguaaaggucacacuuagcccuaucuuuggccugucaaaguugacacccgcuuuaaaagaguaaauguguagcccccuugauacacaguacucauucugugacacagcuguacauuaaaaaacaaaaaacaaagcaguacucauacaaugcuaauaccccagaaaaaauuaaaugacagcuggauugagcagagaguaccugucauagcuuuaucuggcaaguccuuuguuguauuagaaaguaaaugagaagauuccagggaaaaauuaccacugugggggggauuccuuaaauuauuuuaccuauaaacaaauaaacugaauuccucuaagucauccagaauccccaaaguauuuaucaaagacacuuugguuccacccacagagguaggaaaauuaugcuaccugucuuuccucuuccuuccugcuucaagaaaucucccuccaaaacuggccacccuuuagaacaaucugccaaccuagauguugauuacuaggggaauauuuacagggguuuucuuugacucauauguaguuugucauaaauuccucuaacucauaaacugaaaagcuuuucuuucaugucaggauucuucacaaauauuaaagaauauuuucuaacauguuaauucuuaguuuaaaaucaaagccacauuccaaugccucaugaucacacauguuagaucaaguaguggacaaaauuugugggugcugauauuccuguuguuucccauacuccuguuucagauuauagaugccauaauugauccagaacaugcuccugaccagcauaaaugucacuaaauaugagugaugcuuguuucccagccacuuugcacccucucaagucaggggccuuacggacgaguacauugcaguuucugucagguugucuuuucauuucaugugcucucuugcagaaauauguaagaggagaguucauaguuuuacuuguaauguggugugauuacaagccaucugcucuuuuucguagaagcaguguguggccggaguaaaaccgugcagaagaauuaugaggcauuuauuggcucuuaauaggaauagguggaaaccucugcccuaccuaucuguaaaucuuauggaacuaacaguucagaauucauuugaaagucuuuggaauuuaagacaaauucuaccuuuggagaaaaaaaagagaaaagcagccaauauuucuuccuugagcccuuuguauggcuggcauggugcagaagccucaugcccacauugucucaugucauccucaaaauaaaaccaugauguaguuuucauugcuaucuccauuuuauguuggaggaacuuaaccugugucucagagccacugaggcucagggcuaggauuugaagucaggucugugcugaaccaggccacuguuuuacucauugccacaccugcugugucuaugccacugaccagucgacugagggaagguaccugcagguuuauacuugaaauaaucauguccugaaaaccauuagggagggucuaaagaaaugaaaucaguucucaucuuucgaagggacccccagagagccuauucccaaauguauucuucaugcagugauggcuuugagaguuugugauucagccuggaauucuaccccagggucccaggggcauauguuaaauuuaaguagcccuucauaauaacaugguugaccauugcuuuauuccacgcaguacuuugccucccaucucaaaucuuacccagggagacugugagccacccuacagcacucugggucaaaacucaaaacucuuucucaguaggauaccagagaugauuuacugaaggacaucacagccucuuauuugauuuucuccuccuuuuagaagcugcugucaaagucauuuguucugcuuuucccucaucuuucuuucucuuuccuuuguguuuuuaucuuuguagaauccuuccccaaccauaguaauaaaucuguuguggaaaacaagugacugggaaguuacacauccuugaccuguagucagaggucccacaacagacacugaacaggagacaggagcucccuccccuccugaguccuuuucaccucagacaagucacacucucccaagcaucccuuuaacccgaaaaacucaagcuuaaagaacuagucauccauuugcaaccaaggaaguuuccuuuaauuggucuggauucacauugucaaccagggcuuuguacuugcaucuuguucugccugauugacuggaaaguggggaaauagccauuccaauucacgagugacaguauucugugcauaccuggggcaaccuuaguuguaaaccauuagcuugauucugcaguguuuuuuuuccugcguucagggugcaggugagagggagguaaucccuccuagagagagaauaagccagccacuuaauuuucaucacugauauauguuuucacuuaacaaacacucuucacgaccaucugugugccagacccaguacuagacauugacaacccaaagguaacagaaggcagcuccuccacaaaggccaccugguggauggcccauaguggacugacagaggacaguaugaggugcuagucucagugugacacuuuuauaaccuccacaggaggacagacacuaugugugcagguagaauccaaguaaaugguugcaaaccaaaaugaccaggagaugagaucuuaaagggaaggcaccuugaaggcaauuuaguucaguccacucauuuuguauauagggaaacugacaguagagaaaggaggugguucaacgccuccuaaacuggggcauuauuagaagagauucauggucuuuggacuuccugcaccaggacauucuccuauuagucaucaaagggcuuucuccagggcuucuuuuuuuuuucugaaacggagucucgcucugucgcccaggcuggagugcaguggcaugaucucggcucacugcaagcuccgccucccggguucaugccauucuccugccucagccucccgaguagcugggacuacaggcgcccgccaccacgcccggcuaauuuuuuuguauuuuuaguagagacgggguuucaccauguuagccaggauggucucaaucuccugaccuugugauccucccgccuuggccucacagagugcugggauuacaggugugagccaccacacccggccucuccaggccuucuuuguguguuaugaucucauauucaggcugugucuaauucuguuacugagauuauggaguguuccuuguaccccaccugacaaguauugccagguuggcaaggcaccgcaccaaacaaaacccagucaugaucaccagcgaucuccuaaaagagaaagagugcuuuuaaauuucucaguguuuccagaacgccaagggguaauaguuucugcuuugugaguugucacgagaauuaaaugcaauaauguacagaaagggcuugacaccaagucuggcacacaagcgcuccaugaaucuuauuguuauugccagcuuguucaccauuaguagauuuuugcaauuggacuaaauauauagcauauuccaacagaaugacucuuuauucucccaucuccugaccugucugcuaguuuacugaguaugccauccaaaagguaugcugguucccuuucuuauauguaaacuacaagcuuggauuuccugggccaguguuucacgugaguaacuggccaagggaauucaauugacaacacacuugcauugacuuuucuucagcuuuuaacucucuggauagggauucuuaauguuaggagacuucucuucuacccucacagcucuaccccaccucuugcaggguuuauugcugucauccucugcugcauucuuuucuuuccccucuucaccuuuucuuuucccuaaccaccccucccaccucguucuuucuacagugaggcuuucacugccucacugcacuuguguuucagcauggggcccuacaguggcauggggcccuacagugagcucuccguaucuguguuggaauggaaucagacauggaaucaggcugcccagggaaaggagcugugggacccuguugagaaucccuggugcagucaccaggcacuaaggcguaggcuguuuuagggcacacuuggcugccauugcucaccuagaggggauaggggccagcucccaaauaaaggggaguggguuccaggcuagacagccuaaacgugcucccacaugaggcuggaaguguguccugaguagccuuccacagggguuaaauuuccucagaguaaugucuggcaauguggagucucucagaucuggauuugauuccugggucuggcacucacugccuguguaaucuuggacuagaccuucccgaauucagcuuccuuaucuacgaaaugcaaauaaucauugugcuccuucaccagaguggcaaggauuuaauugaaugcucugaguaaaacuuagcacagugccuggaacauaggugcucuguaaauggcaaucaauauuuuaaacugugauuguuuaaucacaucacuauaaaauuuugcauuguaagauauaugcaguuugugguaauaugaaaauauuuaauauguuuucuagaacuuuuuuguaaaauucacacuccaggaagaaaauuuccaugucuucugaggaagccuuuaggagaaacucuuucuagcuguaguaucagaaaugauucaguuauccucagcaugaauuccuucucaucuucuugacucugauuggugcuguauuuuucacauuuguaccuaggaaucucagagccagauguugcagagacuugggacuauggugggaauuucgugcaggccuaucaucgguuucaucuuauguuuuuacccuuguuugcuuuuacuuauucuccccauuuuuaaucuuugccucguuacuugaagcugccuuauacccucaaugccagguagguguaaaaugccaaugacgauuuguguggcuucucagcgacagacccauguauguaagcugccucuggaaacccagugggcgugguagaaacggaccacaugccuugggccucacccuuguccuuccucucccucacacccaaccacauccucuuacuucugucuucugagugucccucaaaugugccccuuccccuucaccucgagaucaccuugcuugaucucuuauuuggguuccugcaguggcuuugaaccugucugccuggcuccagugauuuccccuugcccgcccaugcuccacacuccuacccaagagagcccuccagcccaccagccuccucagccuguccagggccccucuguggccugagccuuccugcccuauuggccccaucugccagcaaugcccuguguuucugcauugagacucuuuuccgucuccaaagcacgcgagcucuuucucugcauggggcguuauucauuuuuccuucugcacuccuuucccuguuccucaguacuugacugcgacaccaccuccccuucccucaccuuccucaggcagagcugucacuccgcucccucugguacuuggguaugugccguggucacacaugccacagugcccagcugcugccccucccucucucagggccuggcuagugccccugugaaacucagcagguguuucagaugaucaaugagugcaugagagaauguggggaccuuucuacaucucuuaagaguucugagucugcuccagagauggcuuugugggugagaaauguuaauauuuucaccuuuauucuuauauuuaauguaaacacagaagacaagaccucccaccuccgaggacuuggaaauagugugaguugcaccucuggaauucuuaggaaagagauaggaaaaauaaccaacacguucaguuggcagugaguuuccagugaaguaauccuaagauucuuguauucccauuucacgaaauaugaaaaaugacugcuuguuguugcugauggcagaguugucgcuacuccagaauagggagagaggaaguuguucuaugauguaucagugcacugggccgaauaguaacggcuuggucccuggaaagggcuuagagcucucccuuugcagacaaggcugugauuugcccaauucuuggggcuaacuuguucugucauuuguuuuuuucauuugucuuccuuucauuaaauauuaaguauucacugagggcugguaguguguuggucacuggggaugcaagauuggcagagguauagaccugucuccauggcuuauagccuaggaugggggcccuacauggaccagucacuuaauguagaaauaaauaaucacaugaagaaugggcugguccagagcagggaaagagaaacuguucagaauagcuucacagaguugaccacacuccugcuaggguucgaggaugcauaggaucucaacaagcauggaagcagcgaggcaaguuguaauguaagccaaggaugaaaacgucaggugcaggagacaaagacaugggccucauuagagcuugugaguugcugcucugagcugcagcaggaguggacugauccgauuuauagguuagagauuucccagauaugcauugaggguucauccaggacaccaacagaagugacuguaaucuuccaagugggagaagauaggagcagcagagcaagagagaagugugugugagaacgcucuaaaaaauuaaaauggacaagaugcgugacugauucuggaggguuaggggaagggaggaguugggggugacaccccuguuguuggcugaauccucuggguggaggggauagaagccagaccagacccuggcugggggacucgcagcccagugcaugcaaugugaagcuauuccuagcagccugaugguugcucaagagguggcuuggccucugcagagugaccaguucugggcugagaaagaagugaugguuaccauguugcuucucucagaagaaagcuggagaguugaucuucugagacuagaaauaaccuucuccuaauuaggaggaggagaaagggaggcugugcugcuggcaguguaagaagcuuucuuuucuuuuuuuuuucuuuuuuuuuuucacuucuguuuucucaugagugacaagaagcaaagcuuugagagcagggaacuuuggaaaggcagaauaccucugccuagugugggagggaguugagagagcucagaacugcaggcugcagagggagagcccccugcgggggaggggacugccugccaaacaguggaggcuuccagaaaccccaggaaagucugcucaccacaguaagauuugacaauuuauuuuucuaaaaagagacauucuacucaaucuguuuauuuucaaacuuagacuagguuauuugugaucaaagucacaaaauggugagaaaaauaccaaauuggaccuuacuauuagguuaauucuucagcaagcugcuguuacaguaucaauucaaguugcuuaagcuuaagauuccccuccccccacccccuuuuuuuuuuuaaagaauuaguuuugcggugguaggaggguuacaagaaaaaaaaacaauuaguuuugcuaaugaaaagguagcagugaacuugguuuagauuaaaaaaucaggaaagagcaccuguaggaaccugcaauaaaauguguugagacauguuuuaccgcuuuggaagggcuuuuauuccagaauccuuggaacuucaaugggccugugauugaauucagaggccagugaacuugcaugggaaaaaguuacgucuuuauugugaucaaguucuaguaaauuuaguuuuccuuuuuauuaugaacgugggauucauaaucaaaauaugaauaauauuagcaguauuugucaccauuagaaauuauagcucuuuucauauuacauuaagguuguugcagauaaugaagauaucauuuaugcuuaucgccacuucagauuuguaguaguacuagauccaucacuaugugacaagacccaaugccuuaauaaacaaggacauacauuccuaugucucaaauuuuucuuucguuaagauaacuguacuucaguguaauugguuuucuuguuaauccuauguguuguguuucaugcauuuaaaaauauuauucugagcaacuuucaucagcuucacaguuggcuaaauaaguccauggcacaggaaagguuaauauuccguggcuaagauccuguaguuguggcaugcgaccuccaccugguggcagcauacuccuuaaagguuaaauucuguaaccaacaguugagaaggacuuuaacaguauacuugagugguuuucaaacauuuuuuauuacaacccacaauaagaaauaggcuuuccaucauaacugaguacacacuuacuuacauuucacaaaacaauucuugaucuaaccauaugacacauugauauuuuguauugcauucuaauauuaucuucaguucucuuucauuaaaauaaaaugcugguugcaacacacuaaacuguaacacacuaaagugcacucuuuuacaucguaggaaaccaucuuucaacaugcuucacaguuuauuaccugguaaacuucauuugggucucccacacauuuucagggacguaauaccuacauuuuaaauaacugccaacaaguaugagugcauuuuacacaguguuuaaaaauuguuuauuauugauguauaauuuaaauauagugaaaggaacugauugcaguguauacauaacauaccccaucaagauacagaauagucuuaucacauacaaaguuccuuugugacaguucucacccaguuuuuuaccccccugggaaauuacuguuuugauuccuuucaucacacguugauuuugcuguuuuagaauuauauauagauggaaccauacaguauauguuauuuuggucugguuucuuuugcucaaccuaauguuuuugagaugaauacauguugagucuaucgguaguguggugaguaguguucccuugcaugaauauggcacaauuuguucucuuguuguagacuuuuggguugucuucacguuggguuauuauaaauaaaacuuccaugaauauuugcauacaagucuuugugugcacauauacuucaucucucuugaguaaacaccugggaaggaaucauuggcucaguugauaaguaaauguacguuuagcuacaggaaacugacaaacccauuugccagagugguuagaccaucuuacauuuccacugggaaaguaugagagucuggguuguuccauauccuuaccaacauuucauguuaugucagucuuuuuaacuguagucauucugguggguauuguaguuguaucucuuggugguuuuaauuuuaauuugccugaugacuaaugauauugaacacuuuuuucauuuucuuauuagccauucauuuauccuauuugugaagugucuauucaaacucagguuuuuuguuuugcuuuuuuuaaaaauaucaguuuguaggaguucuuuacauauuuuggguaccaguccuuuuugccagauacauguauuuuugaauacauaaauacauuucucccagucuguaacauaccuauuuauuuuauuaguggugcuuuuuucguuaacagaaauuuuuaauuuugaaaauuuaacaauuuuacaacuauuuuucucaauauuuggugcuuucuggauccuaagaaaucuuuuccuauuccaaagaucaggaagauaguuuuggcuuuuuugucuaggugugugauccaucucaaauuaaauuuuguauauagcgugagguaggugucaaguuucacuuuauauuuacaucugauggucuaaccauuuguugaaacuacuuuccuuucacuguugauauauaggacagaauuuaaaaaaaaaaaaacaaaacuguccagccaaggaagugaaaaaacugaaccucugagucucauaaaccgaaucucugggucucucagaccauccccaaccuuggugucccauuccuuaccaaauuaguuuguucacaguuaucuugugauucucagaaauuacuucacucauaugugaggauuuauaaggcaacaacuuuucacagggucuguaacugugcuauccaguauggaaccacuagcuacauguagcuacuuaaauuuaauuuaaauuuuauuaaaaauguagcuuaucaguuacaauagccacauuuuaagugcucagcagccacauauggccacauacggccacauauggcuaucuuauugaacagcauauauauagaauauuuccauuauuuucuaaagugcuggacagcgcuagccuauagaauaagaacagagucaggcuuuguacaguuuuguagcauacuuuaaugaauuuuguuuuguuuuguuaacuagcauucaguauguaucuuuaucuucuugcuuauuucucauucuuccauguuccuauuucaauuccaaaguguaccguccuagccaauccuuuuguccgucuaaaaaugcaguaucuuauaucuguuauuugcugcuuagaagaaagaauuccccuggcugugcauggaaucauucuuuuguggagccuaccuaguacugaccuauuuaacuucucucgaugcuucacgucuuccaacugcugccgggaugcuuggacauccccuuucaaggugcagcccagagacagauauuuugucuuuccugucuugauuaacauugcaucucuccuuagcauuuccacuguaaauguuaaacuuagggaaaguaguagauuaugaccuguaaccauguucuuuauuaaaaguucugucuaguagugaacuuuguugccauuucaucaugagcaaccacauaggaauuugugagauuuucucucauuguuugcugggcaugagccgcacagacacugacucugccauuaaugucuuucagugugggaauuuugcuguccucguggaucuucauaucuugccacaagguucaaacaaagauacaagcugguuuucugaacagaagaaagagguacaacaaaacuuucuacuauuuaauugcaaguagcugcugcugcuauaagaaauaucagcucuuuccagcuuucauuucuguuagugggaaaaaaauguugcguauuuaauccuugaaaaacaauuguauucccaaugacagacacauaugcacccacuuuuuuuuuccuucagaaacugacacauucauaaacuucauaugauacuguauuauuuaaaccagacauuuuauaccucuuuguuuugggggaaggauuucuauauauucaaaaagaggagaagaagaagaagaaguuaaagugacuauuucaguaaucagggauuuuaaccugacugguugugaaggauggccugagcaccugaagcagguguggcaguuaacacaaggcugaaccuucacacccaucuuaaagccucagcuuuuauuuucuaucauccuuguauuaucaugagccuuugacaagucaggaaauacuugacgguguuccuucucacaauggucagucaggaaagccaguagccgggggcuuagcagagcaugaugcuggacuucacugagccucagccuccucaucugaaagugaagagguuugccuagaugccaaauucacuccugguucuaaguuucaacaaucccacccaagugcugcuugugguggaggcuuacaagcugcacugagcucucaccauugcuuugccuccuucucugaucccugcucaccagagagcaggaguaaccagcuuguggcuuuuacacaccuuuaaaaauaucauuauccgugauguccauuuaccacaguugcuuuuuagacugagaaauaaaaaucagauuuguuaaaauauaguauauggcgaagaaacuauugacaguggugaaaaaacaaaaagccacccuuuucugugauaauugcuuuuaauuagcuuuuggagcucacuagaaaaaagauccccaccccccaaaaaagauuuuauaggauaauacauuuucauucaaaggauaauauuaucaagacuuugcugucauuauuuugcaaagaauaccuggugaccuaaagcugagaaaaggaaggcacaagguucuguauggugggauuuaucauucagguaaauaacuguggacucuucucuucaggacuuuuaaauauuuagcaagucaaucaacaucuccuacugccacuuaccuucauauaauuccacuccuagcuuacuaacgcauguugcugugauucaaaacuguucacucguuuccccaaagugaccaauagucacccaaggggaccucaccccaaaaucuucugacuugacuuaaauuaacaauguuauggaauccaccauuccaggccuguucuccauucccuuucggcuuugccaccuuagaccuuuaucggccuuagaccuuucuuguuaauauugaguccguuuugcccaagauucaguuaauuuggaaugcuuuagaauaaagcccugggugugugaaucaccucauagccaaagcgugaggcuagguuuuuguuuuuuuaggagccacaugcagcugcguggaugcucauaguaccuacuugagggcagcagggcaugacuuagcaaagcugugcagugcaugacaggaccugcagagcagugcugcacuggcagcugcaaggggcaggucgcuguagcaggcugagcuugccucucaaaaccaaauggucgguuugcugcugcuucuuuaauuugcccuuuuaaaauguauauuggccaggugcagugacacacaccuguaaucccagcacuuugggagcccaaggcaggcggauugccugagucuaggaguucaagaccagccugggcaacauggugaacccccaucucuauaaaaaguauaaaaauuagccagaugugguggcuugugucuggaaucccagcuacucuggaggcugagguggggggaucacuugagcccaggagguuaaggcugcagugagaguugugaucaugccacugaacuccaccauggguggcagagugagacccugucucaaaaaaaaaaaaaaaaaaaaacaauucgcugauguuaaaauuccucugggaucauuugugugugcguaagaaaggagaaaagcuaguugaagaaaggcuaugacuuuagcuuagguucaguguccccaggcuuucaucuucuuuauccuuagauccucucaugauugggauuuuaugagcaaccaauuugauuccauuuuaacagucauuuuauacagugaaagccuaagaauauccaguuccuuuuuagaaaaaagaacuaauuacauguauuaacauauguuuauuuugagugcagcacgaguagucuuuguacccaaacaguugaagucaaacuguuccaugugucaacucgaggaagcgagcacagcccguuagccuagagaugcccucugcaucucugucuugagcacugauuuuaacuuguucuucuuaucugccccucaaagguagcugagaaguuuucuuuucuugcauuguugugguucugaagagaaagcuucaugacgugugguguggucgguuacuggugucuaucacacugcacuuggucuaccuugcauucgucaaacugacucacagaaggaaagccccacagcuagagggagaaaguuuguguguaugagccuuugcuuuauuuuugucaugcuauuuuuaguuuuagccuuauagggcauuuauagccaaauuuuagcaauccuuguuuccauguaugucuuucacauauuuucuagcccagucauaguugaacucugcaugugaagcaaaauucuuuaauuguuuuuuaaaaaaaaaaaaaccuaugaggcggcaaggcugccuuuuuguugugugaacaaugccgaaacacucaacuguaaagggauaucucuguauuccaugaggcacugcaucuuuaggcugcaacaugaaaagcaggagagaggaaaccaguguuuguacuuuaucuagaaacucacacucaugaguuaaaucaaggguuuucuauauuguuugaggaguacaaguguuuuuaauaaaggaaaaguuuugcuaucauugcucuuuagaacagcuaaaaauuuuguuguuuuaauuugugaagauucuaagagaucaaccugagaugacauugcaagaaaccagcaaaacagguuugaggugaccugggcaacucugaguuuucugcagucuuugggaauuaaacaggaaucaucaguucuuauacaucaguucuuaaucuaaauuaagaaauuuagauuuguguaugauuuuacucucuuuuucuacauuaggucacaauuuccuguuagugcaggaaacaacugcaaagaguaucuucccauuguguugggcuuaaauuuuuguuuaccuuuauuauaaauaacaccaaaacaauaaaacaauugaccuauccugaaacuuacuagugauaaggaauacugaaauugaauuaaaaccauguguuucugucgccuaauaaauguuaaucuacuuuagagaaauuauauuauuuucacuguuaguacaugaguguaguacguuuuuacaaaaacaaaggcauauacaguaucaucaacaagagcguagaagaaaauaggauuagugauuuccaguucucugcuuaacucacugcucaacaguuuccuucuugaguagauuuguaaacccaagaccagaaacuaaugaaugaugguguuuagauuuuuaaaaauuuuuagaccaaguuugaaaaaugggauaguuuauauaaaaauuacuguuucugacuccuuuugaacaaagaucuagcaacacugugccuauaaacaugaaacaguccccuaaaaccauggggggcugcuugcuguugacugggcugugguguggguuccccaugccguugcaccagcaguggaugaauaugcccuuacuccuggccccaucccugucuacaguccccuggccacacuggguguuucccuggggcccuugaugccagccaguguuggcucuucuugacuuauuucuucuauuugucacaguacaacugauugauacuuauaugaaagcauucuuuaccauacuuauuaccuccuugcccugauguuuacacugaaauauuuuuaucuuucuuuuagaaauaugaaacugaggcagaaagaaaugaaaugacuuucccagaucacacagugagccaacaucaugguuucgagcaaacuucaguagcaaauuuaaauuugcgguguuauucaugagcacauaugacauuccuuucaacauucacagcuaaauuaaaaagcaaaaugaaaugaaauguucauuguuaacuuuuuaauauauauguuaauuuuuuugcauuaaauuugaagguuauaucuaauuuuuuauuugcuuuaggaagucuguuuacuguuaaaagaaaccauugauucaagaguucaggaguacuuggaaguucgcaaacagcacaggccaucaaaugcagaauucacaagauccaaucccuuguccuuaaaagguaggcacagagcacuuugauuuuggacaaaaaauaaauagaauuucugcuccguagagauggcaauuauguuugacucugacugucauguuaguauagugauacauuuuaaaaauauguccuaaugaagauacuuuguuuggguaaagaaaauuaacugaagagcccucaggacuuuuaaugguaggcaaaauguauaaaaauagcaaauaaaacauuccuaaggaaacuguaaauuguuuaaaggauuguuuuuuauuuuuaagguuuuuuuauuuuuaguagacuuaauaauuguacacauucauaggauacagagugauauuuugauacguguauacaauguguaauuuucaaauuagaguaauuagcauaucuaucaccugagcauuuaucauuucuuuguguugugagcauuuaaaauccucacuuauguuuuuuuaaaaaauauacaauaaauuaauguuaaccauauuuacccuauagugcuauagaacacuagaacuuacucuagugguagucuuauauccauuagcuaaccucuuccuauccuucccuuccccauccuuccuagucuucuaauacucacaacucugauuguaugagcucaauuuuuuuaauaaauagcuucuacauaugagugagaacaugugauauuuuauuuucuuauuuucugauuacaucaucaaauuuuaauaugucuauauaucuauuuuucuuuuuucuuuuuuuuuuuuugguuauaguaguaaguucuuaaguggugauuugugagauuuuggugcacccaucacccaagcaguauacacuaaaccugauuuguagucuuuuaucccucacucccuuccccaccuuucucucugaguccccaaagucuauugugccauucuuaaugccuuugcaucgucauaguuuagcucccacuuacaaguuuggcuuuccauuccugaguuacuucacuuagaauaauagucucaagucccauccagguugcugagaaugccauuaauucauuccuuuuuauggcugaguaguauuccaucguguaugugugccggacuuacuucacuuaauuuccuuugggcucauccguguugcuauugaaacaggaaaagauaccuuaucccugaaacagggcgugggauggggaugugucaucggugcccugcggcucaacccuuaggggaacauacagacgggcaguucauaggaagcaugggcuccaauccugcagcagcgucuaggguugaguguuuacagauccucaagccccagugggcguguguuacaaugugcuuuuucaguuuagccgucugcaggcggguugcguuaaucuacucgauuaggcccucugccuuaucucaaggacagagggcuuucuguaucccggguucuugccuugguguaccggaaauacuggaucacacgugggcuuggagaaugggugcaagguuuuacugaguggagguggcucuccgcgaggugaauggagaggccagaagggggaucuagugggaagguggucuuccccuggaguugggccgcccagcugccggacucuccgacugccccuggcagaauuucacguuaucccgcuguccauggccugccggaaucugcuggugccugucagaacaacuucuuccguuccucugcuccucuuguuguccagccgccugugugugugcccgcuagggucucgggggguuuuauaggcacaagauggggggcgugguaggccaugguguucuuggaaaauacaacauuugggcgugaaaacaggagugccuguccucaccuaggucugugggcacaggcccaaggguggagcccucaccagggacccugcccuucucuacccagcacuuccuugccccucucccauaucaccaugaaugacagauuuuauuuuauuuauuuauuuuuuuguauauauugcugaauaguauuccauuguguauacauacagcacguuuucuuuauccauucaucuggugaugaacauuuagauugauuccguuaucuuagcuauugugaguagcacugcaguaagcaaggggguacagaucucuucaauauacugauuuucuucuuuuguuaaaauaccuaguagggagauuggugggucauaugguaauucuauuuguagauuuuugaggaaccuccaaauuguucuccauaaugguuguacuaauuuaaauucccgugaaucauguauaugaguuccuuuuucuucacauccuugccagcacuuguuaguuuuugucuuuuugauaauagccauccuaacugcggugagauaucuaauugugguuuugauuugcauuucccugaugauuaauaacguuaagcaauguuucauauacuuguuggccauggguaugucuuccuuugagaaauauucaaauccuuugcacauuuuaaaaucagauucgcuuauuugcuauugaguuauuugaguucuuuguauauuauggacauuagucccuugucagauuaauaguuugcaaauacugucuuccauucuacagguugucucuucaugcuguugauuguuuccuuugcuguauagaagauuuuuaguuugauauagucccauuuuucuauuuuuguuuuuauugcuugugcuuuugaagucugauucauaaaauccuugccuagaccaaugucuugaagaguuuccucuggguuuucuucuaguaguuuuuuaguuuuugggucuuaaauucaagucuuuaauucauuuugaguugauuuuuguauccagugagagauaggggcccaguuucauucuucugcauauggauauccgguuuucccagcagcauuuauuaaagaaaguguccuuuccccuaauaugguucuuggcaccuuuguuaaaaaucaguuggcucuaaauaagugaacuuauuucuggguucucuauucuguuccauugcucuaugugucuguuuuuauaaccauaccaugcuguugugguuacuauagcuuuguaguauauuuugaaaucagguaguaugauguuuccagcuuuguucuuuugcucacaguugcuuuggcuauuugggucuuuugugguuccauacaaauuauaguguuacuuucuucuauuucugugaagaaugucauugguauuuugguagggauugguuaauaaaugcuuagacucuugcuaaacugucaauuucuaaaagguaugagcauuguggacccagcucgaccacaggauugauuuucacugaugacagagguucauuuuguucuaggcuguguagaucuagacaccugcagggacaagagggacacgccaugguauaccaccgucuuauauuguuuauuaacagcaucacuaaaaacagaaauugauucaugcuuuuacuuugucaucagugccaaaaacaucucucuauacauuuaucuaacugccuguuuucagcugauccuauagucuuuuaagccuguuucaaaaccaaguucaaaaccacuaaccaaaaagccaugccuauuuccuccucagucuucaguucuaugucucauguucccugaaaauagaguuguuguuucuguguagguaguuuggaugaauguggauuguuuaugcuuuuguguaaauuggauaucuucucucauuugcaugaguuccuuaccuuuuguuacauuuccagauccauauauuggaauaugccucaacuuggguauauauacuuaauauacaacccuggauaagcugaagucucuaggcuggugacuuugcucauugcuauaauaauauuaauauuuuuuaugcuuugagauuucuuuauaaacaauuugcauaaaugacuuggaggcuguuuuuccaauuauaugauauaaaggaguaugaaaauuacucacaaacuuggucaaagaacagcauaguacagacauugccaauagccucauuguuuuuaagaguuacugaaaauuuauuucaguaucaguaaaaauuaaugguauaaggcuuuuuaaagacuugacugucaauucccaucaauucugccucacuaauguuuuuuccucuuaaccuugccaauauuggguauuaccaguguuuuuaauuuuugccagacugacaguccaaaaaucaaaaaaggagauauugugcuuuuugauuuuuauuuaucuguguguuuuuauguguuuacugacagaacugcauauuuauaguuuagguuugugguuuuugccuuuucccuccuaauuuuuuuuuuccuuuugucacucccuuggucgaggcccgucuugaucagcucuuaaauuaaugccacagccugugauuuuccucuuaauucauccacaccucugcugccagaguggccuuuugaaggcaaaaaugugauagcucccagcuugaaacccucuguggucaggaaccuuaguugccugacauucuuuauuucacuuuuucucugcuugagacuagccagagugggucuggcucuuaagcagagaagaaguugauuaaagauauuagauagcucauaggaucucggggagugcuggagagcccuguugugaagcuacgcaaaacagccucagccaugagucggggacagcuuugagacaugcucccugugaugcuuaggaccacguaucagaagcuuugccgagccucauccucugccccacccugcagagacugacugcccggccuguggccacagccuugugcuguuuuuucccuuuugaguccaccacaaggcaaaacuagauuucaugguugucuccuaguuacaagugagucaggggaggcaaaauguuuggcuuuuaccuugggaaagugacacuuauaaaauguggaaagucaucaaaacauaggaugauggucaacaauuuugaguggguggacacaaguuacaaauauccacuaauaacuuuccucuuggcuuccuucuuccaugagcuucuaaucaguaacaacaagcuauugccuaacagccugacuuucccaacuacaaaggaaaugugcucaccacauauccuucaaaagagaugacccagagucucaagucccagcuccaaguccaggacuucuaagugauguuuacuccccuucuaguucauucccagcccauauuuguuaacuuuucaacuaaauaaugaagugaacuacugccaacaaaccuuaaauaaaauaguagggaaacagccaaaaaaguaacugauguauaaauaaauacaugaugcagcaaaggacagugagguagguagaugcuaccauucuaauuucuguaacugugaaauaaguaguugauguuuguaucuucccuccucuauuuauuuuguauucccuguguucuucgccuguaacucaucugauuagcauucuuuaccuucauucccccaggauuugagcugccagugguccugccuugaugagauugccauuguuuuaguuaacuuuuagcacuggguauguuucaccagguagaacugauuacauuuuuuuuuuuuuuuuuuuuuuuuuuuugucuauauaccucucucccuccauucaucucaucaugagccagcauuucaacuccccuuuggccuguuuguauauugccauaaagagccugaaacagucacaugguacuuugaacuuucagcccgauucauuguuaucaucuguguuauaaucauccuuugaguacuaaggaagcagagucauggggauggaacguaaacguuugcugagguggucaccucgcuuuuccaguccuucguuccaggaaccauguaucuggccaagguagcacauguucugcuggucggagccuauauugcaucccuuaggaccuuacuccaguucuacaagguccugccucauaauuugcaucacaacugaguuuucaauagaccuuuccaccauugaguaaggccagcugcaguugagcugugcuugauuguuuguaagaccauugaauuuuacaagccuacugucuuauuuuguuuccuguaaaaugagcugcuuugucagaaucgcagugguggugauggcaagugaggccuuccugaagucuguggaugauguggcuggcagaaacauggcagacauacagggcacauccaaauccagaagaaagcuccauuuuagugaagauaaggcauuggcuccucugugaugaaagaggucaaaugucaucuacccaccaucacuggccuaucucccuaugaaaugagaguugguggcaaggcucagauuaauugcuauugcuggcaaauugggcauuuggcagagcucagucuuggguagguuaagucuguguugagcccuagcagaacauucauccaugccuccauggccacauugcuuaugagcccuuugagcagguacuuuggcagcuagggaaagaggccagccagcauccaugggguaugucaccuugucuuacucauuauaagaaccucuccugaauggggcuugcuguggugugaaguaucccccaaaauucacacauuggaaaugguccccaaugcaauaguguuagaagguggggaaaguauuugcauaugaaggcagagccuucauaaauaguuuaauguuguuuuaaaagggcuugauggaggccuuuuugcccuuccuccuucugccgugugaggauacagcauuccuucccucuggaggacucaguguucaaggcaccaucuuggaaacagagaucagacucucgccagaccugcuggugccuggugccuugaucuuggacuucucauccuccacaacugugaggacguaaauuucuauucuuuauucuaguuugugguauuuuguuuuagcaacacaauagacuaagacagggcucuuuggagaacuuucacaaaauguauaaauauucucacacucuauauaacuuuuccccaaauauuuaugucaccaguucuugaugacccucucuucaaacuauuaaccacugccagugaaucaguauauauuuguuucucaggccaucucuccuuauaggccacauagacccaaaauauaccacucaacagucugcucacuggacagauuuuucuuuuccacccugagugagguuauaucaucacauucauucacuucuggcuaguaccaucccauugggcagugccacugauuaggcacaaauuuuuaucuguucauaacuggcgagugaagcuauugccuuuucaggucucucauaguggucagagaaacacacagacauacucauugauguuugugccuauuucuuaguaguaagggguacaagguguaaaaaacuugacuuuccuuuuagaugagcuuuuuccugugcaccaggccauuguacauucagaaacuguauuuugaaaggcuuuaucugucaccaucugacaugccugugucuuagcaugacagcuagaauacacgccaccuugugcuguguaaguccuaucauaaugccuuuggugugguagaccagaacaauguccugcaagauagugagauaaugaaguucccuguagauucaguagugucacugaagcagaaugucaacagagcaaugaggcaaaacagugaagcugcgugacuuucucugccaguagauagaaaccugcuucuguguucgcuguucacugagauagaaaaaaacagauuuugcugccucuguaguacugaugcuaggugcuguaguucuccagcugagagaucgccucuggaagaaucucuggcuaauuaaacuuauauuaaccuuccaucauucuguaagacucaucuguguucugcuuuaccaaagaggaaagugagauaagaccauaugaaagaugcucauggauguuucagguuucucauggcggcagaucucuuugaucuccuagggauuaauacugauuuuaguuuacaauuuuggugggaugggagaaguuccagaaacuuucaccuagcccauaauuacuguaauaguucucacucccugaaacaugaauuccaacuguggauucugucaguugcagaauaaaccuaucccaaggauacacucagcaacugggaagacaacugcagauuuuuacagucaugcugugcccuucgugagaugaauuuaagccacauuucuagaugucacccucugguggaucacagcaauaaucaggaacccaagaauuaucucagagccaaugccuaauccuccucaaaaguucgaauauuucucuuuuucccuugugcaaauaccuuaguaaucucuguugaucccacguggaagauuuaaaggaugcacuuguaacguuauugaaggguccuuacuugaggacugccuggcucuccuuucgaggagaaaauaaguccguguacugacccaaaucuggagacuggccagguggcaagucaggucccugugcaccagaucuagauuuuuuuuuuuuuuuuuuuuuuaauuugagacugaguuucacucuugucgcccaggcuggagugcaauggcacgaucucagcucacugcaaccucugccucccagguucaagcgauucuccugccucagccucccaaguagcugggauuacaggugcgugccaccacacccagcuaauuuuuauauuuuuaguagagaugggguuucaccauguuggccaggcuggugauccacccccuucggccucccaaagugccgggauuacaggcaugagccacugugcccgacccagaucuagauuuuuuuuuuccuguuauacaguguauugguuugcuagggcugccauaacauaccacaggccgaguggcuuaacuaacagaaauuuauuuguucucaaagucuaaagacuagaaguguaagaucaagguuaguuucuucugaggccucucuccuuugcuuguugauggcugucuccucccucgucuucacaugaguuuuccucuguaaaugccugugucuccucuuaucuagaagucugagauuaaaguauuggcaaguuagucucuucugaggccucucuccuuggcuugucgauggccguccucucccuuugucuucacauaauuuuccgcuauaaaugucuuugucucuucuuaugaggaugccaguuacauuggauuaggccccauccugaugaccucauuuuaauuuaauuaccuccuuaaagaccuaaucuccaaauauagucacauccugagguacugggaguuaggacuucaacauaugaauuugcagggagaggugcacagcucaccccauaacauacaguuuaaguagagucuaaguauguucuccgucuuauuuggagguauggacauaaucaauuaacugguaagccagagacagcucuggggugcaccacucugaaaggguucugaccaaggucaccacuggaucauggcccuccaguagaccaagugacuuguccagccaugugcuuaaauugacuacaaauuucuacucacccaguuaccaacugccccaccuuuacucuugagcuuugguacugugcagacaucauaucuguuccagcuguuaacucucucagcagcuaacucuuacucccugggggacaucccucacccacaagguggcuauccacucaggaguggccuugguagcaugucuuucucauguugagccacauaccauuuugcagauaguucuggggaaugcagggggaucaccgggcacaggcugguauugucacacagaucggcaugcagacagaucauguacucugggcaucguguaccaaggugugcuccuauguaucacacacauacacucuuuuuuuuuuuucuuuuuuuugaggcggagucuugcuucuuugcccaggcuggagugcagugguacgaucucagcucauugcaaccuccgccucccagguucaagugauucuccugccucagccuccuaaguagcugggauuacaggcgccugccaccacgcugagcuaauuuuuguauuuuuaguagagacagguuuucgccauguuggucaggcuggucuggaacuccugaccucaagugacccacccgccuuggccuuccaaagugcugggauuacaggcgugagccaccacgcccagccacaugcacacuuguuuuuugagacagggucuugcucuguugcccaggccagagugcaguggaacagucguggcucauggcagccucaaccaccuggguucaagugauucucccaccucagccucccgaguagcugggaccacagguguguaucaccauaucuggcuauuuuuuuaaaaaaauuuugcagagauggagucucacgauguuggccagacuggucuagaacuccugggcuuaagugauccuccugccucagccuccgaaaguguugggauuacagacgugagccuccaugccuggccugcaucacccuuuuuuauugggcagcauaaaagugaccuuguggaguuggggguggcaaacauuugagucccagguucgggcaccgagcagucuggcugcuuaggaguaugcuggacaagccaguugcccaggaccuggaggcuuuugcagucuuccagcuagaccugcagucggcugaguucaggaggauccucucuccccagggacuaggagucauuauucccagauggccuuggccagcaaacccagagagugcccauggucauugaucagcuugucacucuccccuaacuccauccccagagugugcugcugucucacccugggcuucugcacacacugcuucugcuccccugugugugcccuccucauccuccagccugugcucagguaucaccuccuccaaggagccuuaucugauucuguguagcuucucucucaagagcacuucccuuccucucucccugcucacccucugguguagcagcacucauuguuccaguugcuucccugccucacagauaggcuucaguuucauugaggacaggagucuuguccuguucagcacccacugcagagccugucagagcacaaguguugggagaaauaaaugaauuguuacggcucacaggucccauuuucuuugcugagacuuuacagcauguuuccauugcaacaucucuugccccuuacacaaaacacagagaugaaaguggccugugaauuacaaauuauugaauagcuuuucucaucugguuuucagaaagucaaaaccacaacuuaccccaguguaagauuaggcugcaacaucuucugacuccagggacaggaaauaccuucccuucagccccaccccaccccaggucuuuguuaguauuacuauccugcccagguaccuuaccgagcguccaccccucggaugcuggcucuggguuagaucuuccaccuacccauggcagaucccugagacaguccuuucuagccaggcuucuuagcccuucuuuuaaccauuccuaagcuuuagaacccuuucucuacagaugagagccagauuugugguucaaguaacuugcccaaagaucagauacuagcuaggaagugucagaggccacaugaaaacuccacugucugacaccggguuuguccucauugcuuugguaucccuauuaaggagaguauuguauguuuaugugguuuuuuuaaauacaauuuuccucuaaucauaaaaacacaucugucuuuaaauuaacuaggagcaguauucugcuugaauuaccauguggguaucuugguuuaaaguucauauucucuauucucugaucaugagauggaaagggagaaauagacccccaaacagagcucaucuuccagcuguaagcacuugccucaaugcauuuugucuaaauaggguucaggacauuuuucuguuuguggaacaguaacaguaaauuuuuuuuacugccuauuauucuauucuguauaaccuuuucuuguaguuaacaucuaagaaacccaguccuuuggaaaaugccauaaaauaaauuaaauuuuccuggguacugugguuucugucugcaguggccugcuuuuuggcauuucuucuaagcugaaugcuucucuaaaaucuuagcuuauaucuguagccaaaguaccuagcccucugcucacccuucuguggcauccgagguaucuuuggugaacauucaaggacgaauuaccaagguguucucucucuucgucaacacucaccucccaagcagcguucugugguggggcacauuaccaccauguuggggaaucaguguguguucacacgacaagaggcgaaaaagaaaaagacaagaauugccaaaacaagcaaauuuuuccuauucuuuccucugucugagaaauguuccucaacuuuccccaacacccgaugcaugauaccugccaaaaaaagcuuucuccuugcucuucagacacaggcucauugugagccauucuccccggcauccccgcgagugcaaauuuguguaugugguguuuuguuuuguauuuauuuucccagcccuuugaaaacagggccuuuuccuauuuaaaauaaauuucagaagugaaauacuuuuucccuuuugagagcccagcccuuccuccauacaaaccuucaggcauuuucagaggacaaugaaaacuugcucuaaaacaccauccauagacuucccuucagucaguguuuuucucacacauuaacaacaaaauaacaaguacuguacauccaaccacugugaucccugaauaaacauaggcccuugacaaguaauucuauuuuuaagagucauuuuuuaugugagucaguuauuacaaugggcaguuagaaugugcuccuauugugcacacccaugcacaguaggaauggaacuguaccgcagucacagagcaagcuagguaguucucugacuuccacagcagacauggaggaggacuaagaggggaagaaauagucacucaugugguuuuagcaacagucaaacugcacagcacauuuucaguugucugcuguucuauuaaauauuuuuacuguuuagacauuguauuuuuucuauucacagcccuuuacaaauagaaguggauuucccuagaucucucauaaagcacuguggaaacguguuuucuuuuuacaaauguuuaaauagcuuugguuauuauuuacauuucuucccauaauggacucaaucaaaacauuuuauaggcuuuuauccacacauguaaagcuugaaagggcaauaaugagaaagcaaaugccaauaaguugucuggugaaugugcugcaauuucaacaaagauuauuuuuucaggaauggguaauuuguaaaacuugaaguuuuauacuuuuuaccaaaagugugcuaaagcaccaaugacaacacaaaaugcuuugcuuucucaaaaacuggggaaacuucucuaaccacuuauuacaguaaauggaaaguaaacaaaauuucuaaacuuucaaggguaauguuuccacuuguuaucaucaccuguuauggacauagccagaguugcagugacugauacuuuugucuacuuuuaauuuuuacaagaaauuaaaauucaaaaaaacgugauguacaaaucuuccagaaagguuagaauuguuuugaccagagguugucaaacuucaauuugaaccauuacaagaccuuucccauguaaguauaaaccuuauuagaaugauccuguuggccugcugugaacauacugcuucuuucucucccaucucacccaucugaacccacuaccccacacaucagaaagauaauuuuuccaucauaaaacaaaguucauauugccuuuguucugcuucaaauuacaaugccaguucugauggagcuuuuauggugacacaacuccaguauuacuuuugcaucugcuugggcuuguucacauuuacaaccagacuuucggcauaucugggaacuggaaagcucacaacagcucuaccaaauaccccaggacucuuagauucuugaaagaucucuguuaccaaaugcuacuuuccaagacuuuuuuucugagauggaguuucacucuuguugcccaggcuggaguggugcaaucucagcucacuguaaccaccaccucccagguucaggugauucuccugucucagccucuuaaguagcugggauuacaggcacgugccaccacgcccagcuaauuuuuguauuuuuaguagagacgggguuucuccauguuagccaggcuggucucgaacuccugaucucagguuauccacccgccuuggccuccaaaagugcugggauuacagacgugagccaccgugccugaccgcaagacuuuuuuuuaaugaguuguuccaguuagcucagagcccugcccucucauuagcuccaugaagacugaugacuuauuacuacauauuccaaagacagguccccacuggggucagguagaacugguuggcauuccugccccacuaggaguaggaggaaaaguaauaggaaggaaaaucacuugcccuuaaauugauguggggugagauuaaaaacauuucuuuuggugaucuguucggucacaguauuucuaacgaugacaacuggaugggaggccuguaguuccauuuuacccagcagaagagaacaguccugacccagugaaagucauuuauuccagcauguugggaacauaguaccuggggcacugguuuuauauugucugaacgguuuagcugccacauagcauuggguaauaauguauuggggugagggcuggggcauacagggagacagugagaccccuacaaggcuguacuuuccuuugacacauuccaggugaagucuuagaaggcagcaacuucuccuguguuugacagauaauaauaaucaggaaagcucucccuaccccccacccccaauauaacaguggcugcuucucauaggaguaacauacauauuuuuaauauguaggaugacaagguauagugggaacuguuuaccuuagcauguacuguuuguuucucaagaauuucagguccauuacaccuuagcaaugaaaagccuucucuuaucuaggaaguacuuguagcauucaccagcuugucuguuccuuuuaauuuuuuuuuuuuccuuuggccaggaccucccaucauaaugcccggauuuucaaauuucuaguaauugaguuucacauuccuaauauuaacacccauaaggaagcuggaaggagaaaauggauacuaguuaucuuaccgacuaaauaucaguaagagcccuuugauuuugaaguguuugaaggaugagugaagaggccuuguuuaggauaguacacuguggucuaacacauugggaccgugauuugcuaccugaauaucuugggaauuugggggauucuaacccaaguguugauuaaaaacaagagagcuuucauuuucaaauucccuaacaugacacccuaauuauucuaauuauuuggaauaaaaguggauaaccuacaauugugaaguuuuaugguuacuaaauauuuuaguuaaccacuucaguuguucaugaucaaaauaauuuuauauucauuauaauaccuucuauaaacugggcaggggaauugacucccuuugguacgauagacauuuauacugucucuaagugaauuugccacagauucagagugaggugcuuauuugugaagcauuaagaaucccugggcuguucccagggaguugaguagaggcauggugaauaacuguucagguacaccuaauuguauagcuuguuuauauuuguuguuguaccacaaugcccuuauuacuuagagcauaaacuccaaucagauucacauuuauuuuaauuauuugaucaugaaccacauaaccuaaugggaaacuuggccugaucuguuuugugaaaugucuugagaaaauuauccaugccuacauuaagcaaaaacaaaacuaacuccacaugaucucacgcauaaaaaaugaaugccuggaaaagaugcuaguuuuaaguuuuaggccaagauugaauuucaauucugggucauagauuaauguauguguccaaguaaauguguauauuuguguguuuguguguguguauguaaugaaugaauagauaaguauauacccacaauauaaguugcugcuaaagaaaauaaaaguuauaagaccugaaaggggacaccaaaaauaugauuuccuuacaaauauuuucaggaauuuuacuuaauugcaaccagaagucugaccuggaaguguaguguuuugaccccccuagcugucugguuuccuauuugcgguguuuuuuuucucccccaacugugagaaaauauauuuuacacaguuuuaacccuguguauucuuagaaacacugaaauagaaaguauuccucugcggggaagaaauucucauuauuuacaagaaugauuugcaaaagcuucacuuaaauagaaaauauuuuuuaaaaacuuaacaaauccuuauuagauauauuugaaaauaaaacagcuucuugguugcccuucaagguagugugaacuucuagaagacugagauuuuuguauuguuuaaguuuacccuuauuuuaguaaaauacuaguguuuucauaacaaaaguguacagaauuuauaaauaaugcccuuaugaugaggguuuuucaugcuuuccccccuucauuuuuagcuuauucaaucuuuuuuuccucuagcuuuuuauaaaagugaaaauuaggcugaguaaacuuaggaaggcuguaguacuauauaguauucuaaugaacugaaagauaacaauaaggccuggcaugauggcucacucuuuuaaucccaacacuuuggagaccaaggcagaaggauugcuugagaccagaaguucaagaucuaccugggcaacauaacaagguucugucucuacaaaaaaacauaaaaauaaauuaguugggugugacagcacguaccucuaguccuagcugcucaggaggcugaggcaggagaauggcuugagcccaggaauucgaggcugccgugaucuaugaucauaccacuguacuccagcugaggcaacagagaaagacccugucucuuuaaugauaauaagaaaugaaugaaugacaacaaugaagcuuaauuaggaugacuguagggccaggaagccuacuguuggaaaauuauagaauucaccaucaaauacucauagauugauuugcugaaucagucaaaaugaugagaaacauuguuuccauauuuccauuguagccucuuguuguuuaccagugugguggaauaauuauauaucucguuuuuuaaaucucagacauuuucacuuacaggaaagccucauucuuccuaacuauuuaguugagagauuuaaaaaugaggaacacaguugucaacaauccauuuagcugaagaauacuucucauuuuuuuaauaacagcuuuauugagauauaauucauauacaauucaccuguuuaaaguauacuguucaaugguuuuuauguauucagaguuguguaaccaucaccagaaucaauuugagaacauuuucaucacuccaaaagaaacccuuuacccauuagcaguuacucuucauuuuccccaauaccccagccacagacaaccaaccaccagcuuacuuucugucucuauggauuugccuguucuggacauuucauacaaauagagucauacaccaugugguucucuguaacuggcuucuuucacucagcauaauguuuucaagauucguucauuuuauaacacauaucaguaguacuuuauuucauuuuauuacaaauaauguuccaugguauggaucuaucauauuuuguccauucaucaauugauggacauuuggguuguuaaccacauuuggcuaugaugaauaaugcuacuauggguauucguguacaaguuuuugaguggacauauguuuucauuucucauggcuauauaccuacgaauggaauuucugggucauucuguaccuguauguuuaacauauugacgaacuuccagacuguuuuccaaguagcugcagcauuuucuguuccugccagcaguguaugaggcuucuauuuucuccacauccuuagccacaccuguuugucuuuuugacuauagcuguccuguguguaugaaguguuaucucauugugguuuugauuccauuucccugaugacuaauaauguuaccaucuauucaaguacuuacuggccguuuguauaucuucuguggauaaauguuuguucaggauuugaacccauuuuuaauuggguuauuagucuuuuuauugaguuaugggaauucuuuuaaacauucuagauauaagucccuuaucagcuauaugauuuauaacauuuuucuucucuucuguggauuuucuuuucauuuucuugaugguggccuuugauacccaaaaguuuuuaauuuuaaugauguccaauucaucuauguuguuguuguugugcuuuugauaucauaucuaagaaaccauugcccuauccaagguaauaaaaauguacaucuauuuuuuaaggaguuuuauaguuuuagcucuuacauucaggucuuugaugcauuuugaguuaauuucauauaugacaugaguuagggguccaacuuuauucuuuugcauguggauauccaguuguccaaguaccuuuuguugaaaagacuauucuauccucauuuaauuuucuuggcaccuuuguugaaaaucaguugacaauaaaugugaguguuuauuucuggacucucaauucuguuucuuuuuuuucuuuucuuuuuucuuuuuuuucuuuuuucagacagagucucucucugucgcccaggcuggagugcaguggugugaucucggcucgcugcaaccuccgccucccagguucaaccgauucuccaccucagccuccugaguagcugggauuaaggcauccgccaccaugcccagcuaauuuuuguauuuuuaguggagaugggguuucaccauguuggccaagcuggucucgaacuccugaccucaugugauccacccgccuugaccucccaaaguguugggauuacaggcgugagccaccgugccuggccucaauucuguuucuacauguguuuccauaugccaauacugcacugucuugauuacuguagcuuuauaguaaauuugaaauugucuucucauucuuuuaauggaacuauuuuuuuuuucuucccagcagggucaaagcuggcauuuacuaguuaggaucaagaaucuuuuuuaaccuagccagugcaaacaugauuuuaaauuguuauaaauaucugaauuuuaaugaauuaauaaaguaccauugauuuugccaguggucuucuccagagauuuagauuaaauuaaaccuuucacaaauuucuugacucuaauuguuccauuuuaaccaaaucaaugaagauaaaaguuauccucauuauagucaaggucuucauaggcagaaaaacuguggugagucaccaguauuugcaagguaugacugagggcacucaugggucuuuaauucucauucagaauccuuucccucagguucuaaaguugaggccagguuaaaaucuaaccuccuuuguucacccuuccaggcuugucccccaucucucucuauuauucuaugcauucugaacucuaggcgucagucuacccuaccaggguugccaggagccaaaaggacuugucugaguuuuugcacagauaugaaugcagugcccuccgcuucucagucccagcagaaugcuccugaugcuuuaauccucugcuugaauguuucccauccuugaggaucucccuccucccaauuugguuuguuacuccccuuuguuaaguuagacuuacccuuuuuuuuuuuuuuuuaacauugcaguugccuaugccuaccuuuguugcaguagcauuuacaauguaaccauccuaccuuuaacuccucugucucucccucugcccucaguugagucccucaggagcagagcauuuuucuugauaccccuaggaccucacauaguacuuauaugugguaggugugcaaguggcaugaguuggaugguuccgguucgauuauuacuauuugaggggcaccugguuuuugacagaaugaaaaaagcauaaccauuuccuguucauacuggcuccuggaacuccucuacugaaaucauuuucaagauuaagaaagaguaaaaucccuuuuuaguggaaugccucacauauacagacauauauacuccaguuugcugccaaacugccaacucaguaauagcucaccaugaaugugauauuuaauagaaaugauugacaauaauuccagacaaagguguacagcccagacuuguuuaacaauguuggccuuaaugccauuucuaaggaaucuuuuuuuuucuucugagccccaaaaaagccuuuuuccagaaaagcuguguugaggagagagcugagaaacagugagacuugcucuaaugcauggggaagggguuugaaugaugcaaacaagcagaguagcaguguguccagaaguaggugcuggugguagagagcagcagcagccuggggaagaccaugggacaagauggagggacagggagcugauagcaggaggugugggcagggcugauguugagaaaauccugaaaaguagugauauuuggcuucauacagaaccuuacagguggcuucauacagaaccuuagaugugagaaccuuggugggagacaucugccacugagaaaagaugaagacaaaccuagcaaaccagugaaaugcacaaguccaggaagaaaagagagagacagaacgugccugaguuugaacaagauguaguguauuauuacccuugauuguguggauauugcuuuacaacucagagcuuucuccaggauccucuuucagagaccccaaagcacuguaaaguaucaaguauuugcaaaugccagguagaaaagucucacaccaugcggacuuucuaguaaaacaaagggagaggccaggugcaguggcucaugccuguaauccuaacacuuugugaggccaaggcaggaagaucauuugagagcaggaguucaagaccagccugggcaacauagugauaccccaucucuacaaaaaaaaauuuuuuuuuaauuagcugagugugguggugugcaccuggaguccuacuugcuugggagacugaggcaggaggaucgcuugagcccagaaguuugaugcugcagugagcuaugaucacgccacuguccaccaucaaagcccccuguaacuggaaacaucuucacccgaagugggaugacugagagcugaguaaugccuugaaaauauuugcauuuguaacagcugaaggacagugaugaaaagugauuccgugggguggaucuccaggaagcugggaaauguggcauaauaaaauguuaugagcuuuugugaggccccagggaauggugaauucucagugugcaacaaaaggaaaaauaucuaaauaaaaggaaagugaaguuuucauggaaugacagggcuguguguacuccugucagugaguggggaccaggaucuuggagagguggcagggugcaggcaggaugcagcuuuagaccuucccagacaccugaucugacacuucuccauaggccauuagagugucagucuguuuguuuccuacucuuauuuuaaauucccucuguuccugguauuuccuuaauauuuccauuuuguuugcguuacauauguaaacuguuuuuuuaaaaccugcauucuguguuuuuagcaggaagguuuccuuuaucucagcuuucagauuuccccaauucagcuuucagagauuagcccuguuuaguacaaggugauauuuuuauugaauggugcacuuucuauuccaugcuuaacggguugguaaucuggcuugagucugcaagauguguguguauguaucuauaacuauguaucuauaaaucuauauuuucaacuugggccacuaguuuaaaaaucucagggugaaguuauuguucguauuuuacaauaguaugauaauuuaagcuuaaggaagauaagagcuuuacaaucaccuauuagaucauuuuuguuuagauuuccuuuaaauuguuaucuacuuagaaaaauuauucuaaagauuauaguuauaguucacaacauaauaaaagauacuuuugccuuccuuauaaaauguuauuuucaggguuaggaaauuaccuaaaaaaauaagcuuuaaucaugauuuauguucugagacuuuggaagagggucuauauuaauauaaauauuuagaagaaaaaaauguaucaucuugaaaggcccugaauauuuucauggugguguuucuuuuuuacaaauaaaucuuuaaaagaauacuuucauuuuuuaaaacaucagaaauuucaaauacauacaaaaauaggaucauauaaugaacccccacuuaucuguugccagcaucccaguuuuaaacagcauauagccaauguuauuucauuuauaugcucaucuauucccugcucccccaacuauuuuaaaguagauucuggaugucauuuaauuuuauauauaaaugauucaacauacagagcucuaaaagagaagugauuuuuaaaauguuaaaaacgccauuaaagacaaaaaaguaaugucaucaacuaucuaguccaucuucagauuuaucugaacgucucuucaguuccuuuauaguugaguuguucuauucagggucugaacaagguugguguacacauucauugcacucgguugauuaucuuuaucauagaagaacaccuccuuuaaccuguaggaacccucauccccaauuuuuuuucuaucuguuuauuuaagaaagcgggucaaauguccucuggaauuucccacauuuggauuuggcuggcugcauccggaugguggcauuaaccugccucuuccagccccuuguauuuucuguggauuggugguuugagccacaggccugaugaggcuggggucccuugugugagaauacuuugugguaugugggguguguuuucuguugcaucucaucuggcaacacaugauuucugguuguaucccuucuaauuucacgcuaacaauguauauacaaugaaaauggagcuuuuuaugauuuuaaaauuaaucaguauuuuagauuuguucauuagguauuuauauuacuaguaaauacuguuuaagcaaaacaaaauuuaaaagacucuuuuacguaggcuucugaaacuuugcuuaauucaggcaauuaagauaaaaauaucaagguaauguuuugcaauaaaaccuggguguuagcauacauaguuccuuuuuaaaucuaagucuauguaagaucuaauuuagcaccuuaauuaagaugguaaguuauugcauaccuaucaucauaaggcuuacauaucagcccaauauacaucuuaugugaacucuuaaggacuuguauaauagaagauaaaaauaaaaagcacauacaugguggguuuuuuuuccccuauaaaaacgcaaaucagcagguaguuaaaacaaaaagaaagaaagaaaagaaaacaaagaaggcaugagaccgguucauuuaaauucccuggaggagugauaauaauugagcuaauaugcauugccuucucauaaauugcuucaguaguuuaggccuugaguggcuuagaaauuagcugucuccccuugccucuucacuguugcuauagaauccagcuaaaggccuguuuguuuguguuuaaagaacuaggauaaccucuuauauucacugacagaacuuacauuuuguuuuugucuucuaagaacucugcaaagcacuaccauuacucuaauaagacucucacuacuaauuucauuauaacauaccaguaaaucaacaaaauaagauuuagagcaguaacuuccagaccugucugagcaucagaauucccuggagcucuuuuaaaagaauguaguucucuggcucucaccccagguucucugggccugggaauccaggaaucuguaugguuggaaaagaccucagccuuggagauucaaauuucccaagugauuuagauaugggcaguggacucaugauugggaauuggaaagacccuagacuaguagauagaugcuuauuugagcuugauaguggauuauuuaauaacuggaagaggaaguagaagagaugauaaguuuuaggaauauuuaguguuuucauccaugacuugagugaaugcaucaaaaauggguaaaagaccuagcaccuuauaaaaugggauagaaauuccaaaugacugugacaaaauuaagaggaaugucuguuacagacaaaugcugaauagaaaauguagaauagaaaacagacuacauaaaaagaaaaagcagaaagcaagcaagcaugcaacugggaaacaaaaacagaagugugacaugaaagaagaaacacacaaugaucuuucuuuaauuuaauguuuuccccugaagcuccuguguuguuuucugcuucucaucuuugcaaaguucccagaacagauguuuguguuuuguguccucuuucauacucucauuuauucuuccacccugaagcuaccuccgaaaugcuaccaaucaccucucaauugccagcugaguauuuuguucuauuucugcugucacuaaugcucucuggcauuugaucuuucaacucucuuuuccaagacuucacuaugguggcuggccuucuucugaucuaacuacuccaugugggccccucuuucucugcugacucuugagagugguccugcccuugcccuuugaucucucacuugacaugcucugccauggacuuuucuuccuuuuggccagaguugcuucaguagaucugcagccaugacuuuuccucugaacuccaacuuuuccuuuuccuuuuccuuuccccuuuccccuuuccuuuccuuuccuuuccuuuuuuuucuuucuuucuuucuuucuuuuuuugagacggagucucacucugucacccaggcuggauggagcgcaguggcaugaucuuggcucauugcaaccuccgucaccuggguucaagcaauucuccugccucagccucccuccugaguagcugggacuacaguugcacaccaccacacccagcuaauuuuuauauuuuuaguagagacaggguuucaccauauuggucaggcuggucucgaacuccuaaccucaggugauccaccugccucggccucccaaaaugcuggaauuacaggcaugagccaccgugcccagccacugcacaccuuauuucuauuggcuuuccaaacagcuucacccagaaaucucauugauccucaucucuaaagcuugguuuaucuuaccaagccuaccuacccucucuauaccuuaggaagcuaccacucauguagucaacaaaguuaaaaaaaauugucauugucaucagucuucucugaacacguuucauugacaaccaagccugucucugauuuucaucucuaaagugucccuugaauaucucucucucuuguuaguccuauggcuacugaugauccuugccuucucccacuugacuuuguuaaaagaaaaacuuuagacaaaauaaauauaacaguuuauuugagcaaauaacaauucaugaaucaggcaacacucaaauccacaagagauucugagagcuccguuccagcaguaugggcagggggcuuucauaggcugaauguggaggcaaaguaaagaaauuacuugauugguuauagcuaggcauuugccuuauuuggauaugguucaauagaaagucccuaguuaauauaacgaauuugcuaguugguuaucugcgauuggcugaagcuccauucaaaauuaaucagucacaaggaaugccucuaaguuaaguuuugguuugcuuauuuauguaaggguuccuaguacagaaacaaccccagacuaaugguuucuugcuuauuuuggcuuaacagcuuguuaaugauagguaugcaguaauuugugauaaagagggaaaaaaagaugaagagaaauauuaggaauagaaguauuaguaaugaaaaaaagacguaauuagaucaggaauagaaguauuaguaaugaaaaaagacauaauuaaauuagguggaaauuaaaauaaaagacuauuaagaacaacuucgugccaauaaauuugaaaacuaaggugaaauagaaaaauucauagaaaaauauaaauuguuaaugugagcuaagaauaaauauaaacccugaauagauuauuaaagaauuuaaaccacugguuaaaaaagaaagcaccaggucuggauauuuuaccaggacaguucgccccaaaauuuaagaacuagguaacuccaguuuuauguacuugaauaaauguuaacaucuccaauucauuuuaugagguuacuauaacuugacacuaaaaacuaggaucaaaaaagaaaagaaaaaaacaggacaauaaaagagaagaaaauuacaggucaaucucacucaaauauaaaagcagaaauccuaaacuaaauauuagcaagcuaaauuuggcaauauagaaaacaaaaucaugauaucauacaaaguuggcucagcauuaaaagucaauuuguaauauuuacaacauuaauaaauuaaaaagagcaaugcauguaacaauuauacaagguacaggaaaagcaaccaguauuuauaauaaaaauuuuuagaaaauuagaaauaugucuacaaaaagucuacaacaaauguucucaguaguaagugaaacauuaacaguguuagcuuuauaauaaggagcaccagaagauaccuaccagcagcaguauucaacacucuacuggaggaguuccagcccaaagaauaaaacaggaaaaaaauauacaggugaaaaaauuggagaugaagaaaagucccuuuuuugguacaugguaugauuguauaugcagaaaaaucuaaaauaaauauacauacaaauuacucaaauuaaaacaaagcuauagcaagcaaaacagaauagcacuggcguaaaaaugggcccuagaccaacagaacaaaauagagagcccagaaauaaacucauguguauauggccaaauauucuuugacaagagcaccaaaaaugcaaaauggggaaagaauagucucuucaauaaaugguucuggguaaacuggauauccaaaugcaaaagaaugaacuuggaucuuuaucuuauaccauacacaaaaauuaaaauauauuaaagucuuaaaugugagaccugaaaccauaaaacuucuaguagaagaaguugggaaauggcuccuugacauugguccugacaaugauuuuuuuggaugugaccccaaaagacagguaacaaaagcaacuauaucaaacuaaaaacuucugugcagcaaaggaaacaaucaacaaaaugaaaagguaaccuauagaauggaauaaauauuuucaagcccauauaucuaauaagggauuaauauccaaaauauauaaggaacucauacaacucaauagcaaagaaaaaaaaggaaaaggaagaaagaaaacaacuaaauuaaauaccccaauuaaaaauggggaaggaccuaaguagauauuuucccaaagaaaacauauaauuguaaacagguauauggaaaggugcuuaacguuauuuaccaucaggaaaugcacguuaugaccacagugagaugucaucucauaccuguuagaauggcuguuauaaaaagagauaauaaguauuggugaagguguggagaaaagggaacccuugcaugcuuuugaugggaguguaaauuaguacagccauuauggaaaacaguauggagauucuucagaaaaguagaaacagaacuaccauaugauccagcagucucacgucuggguauauauacaaaggaaaugaaacuagcaucuuuaaaaaugugcuguauguauacaauggaacauuacucagccauaaaaaaagaaggaaauccuacuauuugugucagcacugaugaaccuggagugcauuaugcuacaugaaguaagccagacauagacaaauacugugugaucucacuuguauguagaaucuaaaaaagccuaauucauaaaagcagagaguagaaugaugauugccagaggcagggguagggacagagucuggcuaggggaaggggucaaugagggaaggaaggggagauuuggucaaaggacacaaacuaucaguuauaaggugaauaaguucuggggaaucuaauguacacuguggugacuguaguuaauaaucauugcauacuugaaauuugguaagagagaucuuuaaauguucucacugcaagaaaaagagagauaacuauaugaggugauaguuguauuaauuagccugauugugguaaucauuucacaauagauacauauaucaaaucaucauguucuauaccuuaaauguauacaacuuuuauuuaucaauuauaccccaauaaagguggggaaaaaagauuuaauaggcauuucagcugacaacauauagaagucaguuacaacagcaggcaguuuaaaaauguaguuuuuaggagauaacauuuacaugacaacacuaaaaaaacuuuauuggaagguauuaaauaaguuauuaaaaauaauuaggagauuuaccaugucaaauguaugggaagugucauuaucauaaagauguuuauuuucuccaaauugaucuauaaauucaaggucuuucugauccaacccugaaagggcuuuucaugcaacuggacaagcuaauaaaaggauaaaaggccaagaauaacuucaaguacuccugaugaagaagaaaaauaauguugggagucaggaaaggaaauugcccuacuagauuaagauuuauuauaaauaaagcucagguaauuaacauaguguuaacugacugaugauaagcuaguggaauaaagugagucagaaagagaggucuguguaugacagaccuggcaaccagggaucaguggggaucuucuguugaauacucaauuuauuauucauuugggaaagaauaaaaacggauuucuaaaugguaucauacacaaagucaauguucauaguacugagguuuuuaaaaaucacguuauaaaacaacauucaucauaugauuucguuuuuguagaaagaaauaagaguauaugugauuauauauuuugagaaaagaccuagaagauaucaaaagucgaaagugacaaagggucucuggguggucggauuguugaagauucauuucucuuuacaccuuuuuuugucuagauuuuuaaaaauacauugagucuauguuacuuuuaauuaggaaaaaaauuuuuuuuacuuugaauuuuuuuuaacuauucuuuuagauuaaauuuagcauuauuuuucgcagcuuccaaacugccuccuccccuuacacacauaaaaaauaacaguuucauugugauauuugacuggaauugucugguacacaauaggcacucgguacauauuuguuaaacaaauaaauaugggaacaauucacaucuuuaugaugguuagcccuuccaguugagaacaugguauauuaaucuuuuuaagaccuuuuccuaauuaauuaugaaaacuuuguaauuuuuuaaugcagaucccacacauuuauacaauuaaugauuucuaaaauuauaucaucuuuucauuuucccccauauugagucaaacccuugaguaucauuuuauuuuauuuuauuuauguauguauuuauuuauuuuuuuaauuuuauuuuuagagacagagucuugcucugucacccaggcuggagugcaguggcgcgaucucggcucacugcaaccucugccucccggguucuagcaauucuccugccucagccuccggaguagcugggauuacaggcgcacacugccacacccggcuaauuuuuuguauuuuaguagagaugggguuucgcuguguugcucaggcuggucucaaacucuugagcuuaggcauuccacucgccucagccucucaaagugcuagaauuacaggcaugagccaccgcacccggcugaguaucuuuaaugucagaccuaagagucagaaagaugauuuuaacguagaaaaacaugcccuguuuaguaagguuaaggaccuggguuuauuuagcuuagaauaaaugacuaaauugaaacugaauaccuaucuucaagcauuugguaguggccagcuuuccuuuagcucugccgaagacacacaaaaaagaaauucaacugaagugugaagaauuuaaguuagagauugcaaacugacaauauaaagcuacguuggcucucagagacauauuauuuggaccacacaauauauuuuaaaaguuugaauuguuugcaaaguuaaaauuugaagagauuucacauaaaaacuuggauuuccagcuuuucugguaccccugugcccuaguuuccgaugaguuugaaaaucacugcuguccccuuuaaacaagcccugagcucucuccaguuuuccagucagaacccaacccuuuuccuguuaccugucuuaccccucaggcauuaaguuugcaaucucaguucauauaaaggacagauaaaguggcacauagguagguauagcaucuucucacucagcauuuugguguuguuuuuaaaagaugguuuuaaugugguccuggcugacaaacaggaaaugaacuaggagacuuccaagguuguuucuuguccuuuggguccaugguccuguuagaauaguccagugguucaugaacucucuuucucauugcacaugaucuagaaucucagaguugaaauggauucccugcaagacagggaggccacagaggauaugcuucaucugguguuccucuguaugcacaggaaauuugaaauccauugcagaggggccugcuugaacagcuaauaguucaaacaagcagcuaccucauuuagaaggcuuauuaaacaucucuguuucuuuuguguauaguuauuuaaagaugagugaaggguuuuaaagagaacuuugaguuuuauaaguacacaguauuauauuauucuuaucauuaugcauggccuggcagaguuaugauugugggaaccauaguuuugaauaucauuucaucuaugcuugcguguuauccaaacacaguuuucauauuuaauguuaagggccuuuuuuuaaauaaacaaaaaagugggaaagcaacauggggaagaaaucugaagugaucauuucucaauuuguuuuauucuaauuuuugucugcucugaaaagccuucuuauuccaugugaacaaucucugaugggucccacagaaaaugaaauuuguggcacaugugcccucuggcauuaccuacaaagucaaaagggugacaggcagaaaauggguguuuuuuucuaaauaaauuuggcuccgaagaauuauuuuauaaauaaugauuuuauucaugaaacauuucaugcuccauuuguuuuggcaucaaauagacauagcuuuauugugacucagagucuaguacuguccuuauuuagggacaugaaauguuaucucaagggaaccuuuuuggaaucucuaaaugucuuggguaauaagugaaauuuuuagccuaggaucaaauauuccacuuacccaccaaauuuguuucccaguuguggucuuagacuaggaucccguauguauauuccuaaacuugggacaggacucuugguuuucaguucccacagaacaaccccuuucuccaacccccccccaucaccagcaauagaggaggucacacuuggacccauaacauguuuccaaaggccccaucaaggcuuuuucauaggccccaucucauacuuagucucuuuucauguuugaagugacagcaucaaacucaugauuucccuacccuuucuacccuaggccuuuugauaaggacaaggugcaacuuucugagugacacaguuugggauguaaugaguuacaacuucauuuuuccuuaaugaaauagcuugaaagcacacguauucuucaucuuuuuuuuuuuuuuuuuuuuuuuuuuuuuugagauggagucucacucuguugcccaggccggagugcagugccaugaucucggcucacugcaaccucugccuccuggguucaaacgauucucuugccucagccucccaaguaacugggacuacaggugcgugccaccacgccuggcuaauuuuuuuauuuuaguagagacaggguuucaccaugugagccaggauggucucgaucuccugaccucgugaucugcccaccuuggccucccaaagugcugggauuacaggcgugagccacugugccuagccucuucaucuuuuaaguauauuauauguuccuagucuagucuaauacccaagauacugucaguacucaguugguaucagccucuuucuuccuguucucuuauuaaaucacaaccaagcuugagaacugacucaugacuucagacuggaaacagucacaugucugaacuggcgugcaaugcagagcugcuuccggguuagcacauaguaaucugauuaugacaaagugcccuuucuuaaagcaaauaucagaccacuauccaaccuaccuaaguaagcuuaucuucaccaaaauuuuaacuaucuacaaauccauaauuuuauuucuuugaaauuaucauuaggaccaaauuuucaggucaucuguaugccagucuuugaauugucauuauagcuuuaguuugaaccuguaauuuccuacagcaguuaaaggagaagucaaaauuaauaaauggcuggcauuuuaaaagagcauacagguugaaauuuuguguuuaggcaacugagguuaaaaaaaaaagcuuagcugggugcaguggcucacaccuguaaucucagcauuuugggagguccaggcagcaggaucgcuugagcccaggaguucaagacuaaccuuggcaacauagggggaccaugucucuaaaaauaauuuuaaaacuuagaugagugugguagcaugcaccuguggucccagcuacucaggagguugaagugagagaaucaucugagcccaggagguugaggcugcagugaauugugauugugccacugcacuccagccugggcaacacagcaagacccugucaaaaaaaaaauucaaauguagaaugggguuguucuauaacacaacuagccugaucucuuuaaaaguucagaguucuuuuuuuaaaagguaaagggagauuauuuuagauuaaaagagauauaagcaaauacaucucuuaaaauccaugaucuuugguuggauccgauucaaaggaaaaucagaucagugauacacauuuugggacaauggagaaauuugaauauaggcugauuauuugaucgguaaugucauacucaguuguaauaauagugucguggugaugaaggagaauuuccuuauugcucaagagcugugcucacauguuuaggaguaagguuucaugauguccacuucgaagcaguuuagaaaauauguguaugaaauacggcaaaauauuaacuguuauugaaucuagaugguggguuuugggauguucaugacauuauuuuucuacuuuucugaauguuugaaauguuucagacugugugagugaugauaauaauggagucaucucagggagagaaguacugaggggcaucguaggucuuccugagccugccuuguaguuugggagaaggcuuugcuggaagagagccacacagguggugggugggguccacaaugaaguggaauucaccugcccggagguccugauggcucaccaagccacacagaggcauuuucccaggcucguccaugaauggucucguaauagcugugggagaggacuucccacuguuacgcaccagaccacagacucccguuggcagcuguggggaagcucaagucgccuuagcuaugaauccccuggaaaacaagugaggcuggauaguuuuacaguaaaaucucucauugaauauuugcucucagugucuugggacugugaacugugacaacccaaauaaaugaccacucccuuaaaaccauuacucauuggaacaugguacuacuugaaacuaaucuacugccuugcuaagccaggauggaauuuguucaauucauauuugaguuuuuuugucguaauuuuugccuuucuguuuaugaagacugcaaauuucuaguagagccauuuuggagcagcuuauuuuagacagaauaugaaauaaaauaguaggaggacugugguuuguccuuucuuucucucauaugcauuacugaccaccucuccauuuuuuuuaaagagacucaauaguuuuugaugaacaacuuagguaagccagaagaaaguuagugugguaacaaguaaucauuugaggcuucaugcuuuggagguuguuuguagaaggauaaggagaagugcaacagcuuuuuacgacauacagagagcaaaugguggcacaagaacuggagauuuuuugggcugcuuggaggccaggggagaagaugggaucuugcugauacuagaugauuguguuacauuaagcaauucaaaaauaucaauuguuucuggaaaugcacauaccugcagacgccuggugguaagauguuucuauugcaaagcuuuuucucccucuaauccaaaucccuucuugugucuaaagacagucuucucagauuuaggagcaccacagucgccagcaaggaaacaggcauacugaaaugugauuugcaagugccucauaauauuaauaccaucauccaguaguuuucagaugaaaagaugaucacuuuaugauuuccauuugcucugcugacucagguuuucugcauuuaaaacaccagcauagcgagcugggagcuggugccccaaguaggaaaagcaaaaggacuuuuggauccuuugccaaauugcuguuuagcuuuagagaguaguggagcuuugcuuuagcccuggguaaguacaaaaucucaguggccuccugaacucugugaaguugauuucauuaaaagcaaagauaagaauguagucuuuaucauugccuuuugucuaugaauaaaugaaauacaucuuucuaagcauuucagugcaguauguuucaagcagcaauaauuuucucuguuuauagaucaaauuuaguuugccauaagaacuggcauaguaccuuuuguguuuaaucucuccucaaguuucucuuuaaacaaaguuucauaugaccagucgaauuuggauuaagcaggugcaaaucuuuuuuacauguuaaacuugcuauuucucuuguaggugccauuugggcagguuuuccauugaaaccacuaauaacaagaugcuauuuagaaaugauuccuuuuaacuuaauucuguccuggggugggagguguaggggucaagguuucaauaaacucauuucuccuacuaauuucaguaacaaaucacuugaaaucugccuuauacugcuuucuuuuucuauaggggaaggugucauauugagacuugauuguucagcaguccagauaggauuuagcugucacucaaguaguaucuucagauaccaggcuuccuggacucaaaacuguagcuuucauggucaacuucagauuuugccccuuccugauaauaacguuuuuuuuuaagauggggucuugcuuugucgcccagccuggaguacaguggugaucauagcucacugcagccuugaagcccugagcucaagcaauccuccugccucagccaccugagcagcugggacuacaggcguguaccaccaugcccagcuaauguuuuuuuguauuuuuuuuaaggagacggggucucaguauguuucccaggcuggucucgagcuccuggccucaagcaauccucccacuuuggccccucaaaguacugagguuacaggcaugagcaccacacugggccugauaauaacauuuuauugcuaaagauuuugcauaggaagaagauuuuugaaauuucgaacaugccuccugaaucuuaaucacuuagagcuauauaucagcaaagguagaauaacagauauuauacuuuuuuuuucucaguucuuuggaagacuugcauuauaaauuaauacuugaaaaauacuuuuaaauuuugcuguauguguuugugagucaccaauuguuaaggauuccacuucuucccucagcaguuggacaaauaaacagauguagaaaugacuuccauucucucagugaccuaagaaauaacguauuuguuuuaaagcacucagaguaaugucagugguguguauauuuuguuugacauuuuaagcagaagaaagccacaugacugaaaugcaaucuauuuucaaguguguuaggaaaaaauuauuuuaucucagcaaauccggagauuauccuuucauagaugucacuguucuugcacaaucugcaugacuaaagcaauuguucugucagagccaucgcuuguuuagacagcaucaagucuguggucacucauguccugggucuuucuacaggagugucggaaggauacugaauaugaaaguggaaacuucuuuaauuguauucuuuauauaaguuauuucagaccaaccauagucauggacuuuggagaaucugaugguccuagagauuacuuccugcaacucuuggccacuccaguuugacagagggggacccucaccccacucugguggagcuuuugcuucugauucuucuaccaaauaacuugacugcugacugcgauaaccaggaacgguuuuacugugauuucaggaaaaucaucaacaaaguaguuuauaccuggagggaagccagaagagaagagaaagggagagaggaaggaauuaagcuggcacuuucugugaaucaucugaaaaucuguugccacccuaugagacgaaugauagugucuccauuuucacagauggcauuuacucuucuggaucaggcuucuuucauguaacauuauguuugugagauguauuucuguuacuaccuauaacuguagcucauucauuuuuagaggcacuauaguauuucagugugugacuauauccccauuaaaaaauuuacuguugauggauauuugcauugguuccagguugagacuauugugaagagugcuauugugaacacuguauguucaugccuaaguucagcuuuagauacucaagcauuuuuuucaaaguggcuguaccaauuuguacuccugccagcagcguaugagaauuccaguuguccugcauucuugccaacacuuuaugcucugucucuuucacuuaggccacucuggugaguuggagaaauuauuuuuuuacucaugucauauuucuuuuaaucucauucuauaugaagauuuugacauacuugaauuaauuuauuuacaggcaaaauacauccauguucaaauagguaugaacugcuucuuuuuaugagcuaauaagcagugaguaugagaagguggcuaagaucuauucgcaagcuccgacugaauuaucccaucugaaaguacguuagaccucauuuauuucguuuuacaguugaaguaacugagggacuucagggacuagggacuaugccagcgucauagucaggccuccuggaagaggcaagauaguaauguucacccuugccucucaagagaagcccucuguuaauuccuuuauucuuucauuuacuaauuauuauuauuuuagauagagucucgcucugucacucaggcuggcgugcagugaucuuagcucacuacaaccuccacuucccagguucaagugauucuucugccucagccuccugaguagcugggauuacaggugcccgccaccucacccggcuaguuuuuguauuuuuaauagagacaggguuucaccauguuggccaggcuggucucgaacuccugaccucaagugauccgccugccucggccucccgaauuguugggauuacaggcgugagucaucacacucagcuucauuugcuaaauaacuauugaaugugucuuuuauggcaggcacugggcugaacuccagagauuuagcggcaaacaaacuuaacuuagugauguucccuuucacuuuccagguuauggcuuucaaaucacagccuauuuccucaagagagggauacgccuucgcugcaucaggagcacacagaaugcugguaagaagccgauuucuugguuugucagacauuucacacaaucugcuugcccuagauagagaagggaugaaaauuaaggaguggagagucccacuugcuucauugccuucaugucuugaguguguccgaaaguuugcgauuucuuuccucccaccuuguacuguguuuacugccucucuaagaacagugagcugggccacaucaugcuuuccuuuccugaugcaucucagcacuuucuuugaguuuucagagugacucaacacaguugaacuaugaaucacuucaguauugucugugcacaccaaagcccuggcauauggagcagguguguacacaagaaagcucuuucccagcccugagcucucagagcuuucccuaggugugugaugaggccacuuucccccaucacuuccccaagucuagauguccacuaaggauaugauuucaaacuuguccagccagcaacaguaaagucagaagcuaaugaucauucuccagguugaucugagcacuggaaagaaaauuuaguucaccuuccauggacaauuucaguauauauauaagauaugauauaggaacuuuaaaaaauuaacauauagaggcuugcuguggaaucuucaugauuaucugcauuuucuuaacuguaaacucugcucgaauauguuauucucuuuuuugcuguuauuuguuuguuuuugagacaaguucucacucugucacucaggcuggaguacaguggugcaaucauggcucacugcagccuccuaaguagcugggaccacaggugugugccaccaugccuggcuuuuuuuuuuuuuguaauuuuugguagagaaggggucucacuauguugcagcuggucucaaacuccuggggucaagcuguacucccgccuuggccuccuaaggugcugggauuacaggcaugagccagcaugcccagccuuagauauacugcuuucuuaacagguccuuccacuuuguucaacucucuaguaaaauaagucagcuaaccuugcacuugugcccuuuaugguaaggacuaucauugccuaaauauuuaauuaaauauuaaaauaguacaacucucaauaaugaccuaaacagagcaaaaggguacagaaguugcuuucuguuaauaccuggcagcaccaaaauguuuaaaaucugccauucgaacauuguuacuuuucagaggaacaaaugcaaauaccgaggaauuauuugauagaacugauaauuuugaauuccaguucugauccacuaaugaacuguuguauuucaauuuuaugauuuuuuuaggggggggagguggaaaaauaaugaauucuguggcucaguuucccucccauaaaaugauaaaaaggcuauauaccauuuaucgcaauaagaucuuuuaagaacuaaugaauaaauauuaauugcuuugcuaauuuuguucuucuggcuuuucaaaauccaccucuagucaccuagccagauaucauaugcccacauggggucaaaguugaaaaaaacccaggcccccaccugaaaugggggcuuuccucaugaggaaggcuaauugggagugagaccagaacaacagguuaaucccuaaucauggagggcuuugaauauugggcacuggggagccaugguagguuuuugagcaggaugaguggagcucuuuuuuuagaacuguuaaccugcuguucugaauaggauaacuuggaauagggagagugacugccaaggagacagcagugguugaugggauaaggagagagcuguuacuggaacaacaacucauugggccucuugggaucauuuaagcuagucuaguaguguaagguguuaacuuguuuaaauucuguguccauguaauugacaccuucuugcuuggcuuccaagcggugcaucaaauugagauaccuuauuaccucagucauugccaucaugugcaguguaccuaaaaggcuuuacucaccugauucauaauauccaucuuuaaaaagaaauuggucucauguaagagggaagcuuucucuguuagaaaaaugacuuaauuucuaucacaaauaucagacauguauaucauaaaaauauucaagcaguacaaccaaguaggaaaaagggagaagagcccccuccccacccgccuggaacauacccuguuggcaucagcuuagcaucacuccagacaucaugccuggguagcuggaggcuggcgaacaaauggauggauggacagacagaugagaaaaggaaagauccagaugucauuaccaucuugccuuccuuucauugaaugccgaggaguccaguucagugauuuauucagucuuucccaaugagaagucaaugguuuuguuuuaagaagcagcaauaauagauuacuaugaguaugguguaauuuuaccaucuuuauuguauauuuaaccauuuucuuaauaguuggaucauuaauuccuaagaaaagcugcuguuuucccagccugcuucagauuaguaguuugcccuccagggucggggagcucucuaagacuagcuaaccaaggagaugauaaguaaaguaacuaggaaaaacauugauaggucacauuuuuagauuuuaucuaauauucuuccucuuccucuaaaguguuacaugcucauuuugaaaacauugauccuauuuucuaaauaggaguucuaaucagaaaacagcugacugacacagaggggaggcuacagagguucugccuggggguuuccuguaauguaauggucccggggcgcagguggaccaauuugcagccucaucagcucucccuagagcuuugcgcucacccugcccuauugacggcaaacaccgaaaggaugggaggagagaagagacguauguuuuauauggaugugcauauugcaguaacuuaaaaugaacaaaaaucuggaacaaccauucuguguuuauaguuuuuugacaccuuuaaacuuguuuuucuucauuuuauacagaacucuguguauucccugacagauuugugguuugugucagucagcuugcauucagucgugaucuuuuagcaagucagaaugaagauuuggugaguaugaaaaaauucuauaaacaaauaagucugcuuaaaugcugaguuacuguaaaaaauagaaaacaagaauugucugcuguugucauucagcugaugagcacccaacgcauguuuuaagggaacaagaagcccuaccuguuuuacgugguaauaucaacuaauucguguauuguucuucuuuuccucaagaccauuuuaaucagcaguaccuuuuccauaucaacuguaaaugagaaagcaacacaucacaaaagcugugauggugcuuaugauaguguuuaaaugaaauaaagaaaagucuuuaagugaaaugaagcaaaauccacauguuuccacuggaggcuuucauuggggucaguggcuuuuaaauuuuauuccauggugaaucaccgacauuuucaugagaaccaguacuuuuccccaguguauuauuucauagcugauaggguucauuuucucccucucucucucucucucucucugucucucugucucucugucucucugucuccuucucugucucccuuuucucaugcuaagucuugaguuccagcagggccugcuucuguuuuauuggaguugucucuucagacaaauagauaaaacugacucagaauugcagcugacugcuuugucuuuuaagcugaacauguacacuugagaaucuccuuguugcacguguguguguuuccugcagccacaguccagucugccugacuucuacacagacuuuuuuucauauuuuuggacguaugacuugaaucuuuaagaaacagggacauaugacuugaaucuuuaacaaacagaaaaaaaauccaacagacauuaaccgggccaugaagugugacaugauuauuaugcuucuaaaauaauuuaugggaauauuagauuacccuugauguuuauuauuuuuuaauccguaugaaaucugaaauuuggcccacaucaucuaaaaccagcuucuuaucucaucuuaaauaaauacauaagaagaguguuucagaggcuacaagggugaauagagacccaggaaaaguaaagagcagagaacuuauauuuaaauuuagaugucugcguuuggugcagaggaacccuuugcaacagccagugugguucauauuuccucuucuucauccaucagucaaacucuuaagaauacacauuaaaugaaugaggcaaauuuggugaaaaguauuaaguuuguccuuugaaauauuuccaggauguugaguuaucuucguaaacuaauaaauacuaaaguggcaaugccauuggcauacaucuaaaauauaauauagcuuaacugauucagagcaaggaagaaauugaucuauggguuuaagaaaacaacaauuaacuguuccagaaaguauuauuacuuucaaaugaaauacaggagaaauuagaucuucuaucugauauguaauauuaauacuuaguaucuuaaauuauuaaggagggauuaaaacaucucaauacaaaugaaauauuaucccccuuaggggccuugguauuuauacagauguaaguuuucuauaccggcugucauauaaauccuauaaucuggaggacuuccuaaacauugagaauuuucauucugaaacucucaccggucuaagccuuuuacaugagugaguucaguuucuuuaucuuuaagauguucugauaaccagugauaacaugaccagaguuaaccacauuaacuuaugaggaaaaugccauuuccaucaugaggcucguuccuuguuuugagugauugucuuuaguuguggucaguuucugucucuucaguugcucauuuacuccaccucugucucuucacauauacauuuucccagccacauaugucagcuaaagccuggcacuacucaacaguuucaucucggggcucaagcucugugcgucccucugccuagccugcucaccucugccaccuccccuccucacaggccuccagcccacuacuuccucaggccuguuguuacuagaagcaauaaaagacccaggucaaguaaaggucccucucccacaaaugacccaucaagccaacuacaccauccuuccaccagaagugucuuguaguuuaauucucauugauauuugaccucuacagagucugccugucucagcuauuuaaggaucaauaaacagcccuucccuuccagaacugccuucugccugagagaaggcauucuuaucacuuguuccauacuucaaaugcccacagccagugaugucaggcuccugugaguauucccuggacuugcuucaagcuuugaauucuuauaucacuuuacauggauauucaccaaagggcaggauccaucucauuuucucuggauagcaauucucaagaacaucugacugggcaaggcugggaaaauugguacccgcaguagcuauguuggaaagauuucuuuggcaauaaacuucaguuguuuuuguauaacuauugacuuaacucacucuucugcagccacagaagugacagaggagugaacuaguacuugagcaacagccugggugccuuacucgugcuguagccuugagagcacacauucccuuuccuucaucuuuuuuuuuggauucucaaugucuaagugacaauuuguuaggaaaucugggagcgucuauucaaaacuccucugucaagggauucuuucaaccuguagacaaggaagccagcugcacuuagcuccccaguacuuaaaggugguugcacaaaagaacugcuguuccagaucaggcaguacaaagggaguaaucccccuccuuuacggagcagagcgaaugcagccacgcugccccuaagcaccacagcgccagggaggucugucccugcugucacuguugcguuucucuuguccacucagggacuuuggugcagggagauccucuguguugcaauagcucugcacagagugcccaugugcuagggaugugggaauugugauguguacuuugggaagaaaggacauuauuaugaaaugagucauuguauuuuucuuacuagaguuucucauaagaaaucuaaaaacucuuguagccucaguuuuugaccuauugcuagauauaggacuggggagucuuuugagaguuuuuaccuuuauuugguuuguuuuuuccucaccguuuuuuuccuuggaaauaugaagaacauaaagugaauuuugauugcgcucagcuacauuccauuccaacaauauuuucuuauuuacaaacccaaaagccuauguagaaacuguuuucuuucucagauguaaaguccuggagccuuugggaaauuuaaaauuauuuauuauuucuuuguuaaaguuguguaaauaaccauagaacucuguauauaucugggacauuucugggucaggacaaagcuacuauuucauuguguguuaguuacagccacuccuucuagucucuggagaucagccuucccaucuguuuuuaccaucacauuuuaacauaauuugcuaagucccagcucuauacugggaacucugguaggcaccaggaaaacaaagaaaaguaagaaaguguguuggcccucaaggagcuuacaguuuggcagaucaaggcugcugaaggauauccuggugaccuaaaaaugucauucaaauagggccuccauuuuuccuaaauauuuuuccacucugcaccuguaucuuuaaggguuccauuggaucucuucugccguuccucagaaggaaaguccaaaaucccccagcccuacuuuuuuuacuuuuaaaccgaagcucucaaagucugugauccuuuuggaaauuaaaaaaugauuuguagugcuaguacugccuacaaguggacauauacauuaagauauuugaguuaucugccuuauacucuuuauuugaguugugguucaaguugugaaaauagcuguuaagacucugcagacguaggccagccauacaaggcuagguccucacuguagcaucaucuaaguagaaggauuaccgggacauccugacaagaaacaauauugaagcacuaacucagcugcuucucuuaaggcacacuacuguuuagugguaaagaaauguccuucuaguuuuugaauacaaaauugaagugaaaaugaguuuagacucauuuucacuucaaauaaacuauugaaggcugaguuauuuuuagcuuggcuguuauaguccucagcugugcauaauccagcccuuugugggccauagcccuccucucauucaagggggaggguaucaaauuaucucaaaaaucuuuucucacaugggauuucuauuggaggaagcaaauaaaacuguagcuaaauaaaaacuacaaaauaauuuugcacaaagaagaaauuuucuugcagauuaaaaaauuaugauuagaaaaacuuccaggguaguuauauuugaucuuaagaaagauguaaauagaaauuauaagcuaacauuauaggccuuauguuuuuagaacagaagaaauaagcuaauuaacauuugacugugcacugauguuuguacccucaugacagaauccuuuaacuuuugcauaaguauaaaucagaucauucaagaaaagaauucucuauuuuuguguuuagaaaaugaaauaaguaguggaugacuuuuccagauuuuucaugaucuaucauagaguuaaaaaaauuuauuuuucuuauuucuaaacaacgcuaguggugaauugcguggaagauauuaacaagagauuccuguagcacuagggaaaguuccuugaguagagagaggcuguuuucauauuucacauuuuccacaauguuaugaacuuagauuuuaccuaauaacugaugaccaauauuguacauauucauuguacaaaaaagcuuuuaauccaaauauauauaaagaaaauaaaaacuagccacaacccugaacacaaagucucugcuagugaucuggaugguaucucuucauacaucauacuuaauaaacugagguccguguguauguauuuuaacuaggacccuauuugucaguuauguguuucuguccauuuuuuuuacugaugauuuuguauuugacaaacucugcuacaugaagacuucuuaucuaguaaggaaaguaacucucagugaguuuauuauuuuccuuucacuuguaugucagugcuguaugguaggaugcauuguuuuuccucagaauuguguuuucuguaaugaucucugcuuucgaugauguugguguuauguuuuucaaauuagauaaacacuuguauuuucuucugauacuuuuauggaauguauuuuaguuuaugauaugagguccuuuuuauuccguguagugaccaauauuaugcuaauuauagucuuuagguuuaagggacagccgagcugugucugccucugccacaccgucagugcacacaugacaaugaggcaucuguagggagcagacucucuuuugccccuuagcagcuggauuucgcugaugacacuaagauauuuggguucucugccuuaugcuucauuugagcuguggccaaaauagccaucaagguucugcugaccugcaucagccacacaaggcuaguccucacuagcaucaucuaaguagaaagauuagugggacauacugccaagagacaauguuuaagcacuaaauagaacacuucucuuaagucacacuacuguuuagugugaaagaauucucauggugcuugcccccucccaaggcugacugcccugucccuuuccaaucaguuaaggccaaggcucagggucagaacauguucaacagauaguuaaggaauagauuagggccacacccucagcaaguggccuacgaugggcuguuuuccuuggauagccaccauccccacccaaccuuauagggacuggcagagagaugacccucugaaaaugcugguagugaggaugaagauguccucuguugguuaguuucucuagacuaagauggagaaaauaagaaaaaaaaaaaucucuagggugagaucauuuuuuaaaagauugucuuuugcuuguauauuacaguaaccugaguucucuuuuguuaauaaugaaauuuguucucuuuucuuaauaaugaaaucuucccaaauguuuagccaguauuugugaaaaacaugguuugugccuccucccaccacugccauuccugcaagggaaccugcccuuugcugaaguagaauaggauagguuaaaugaaugaggaucauuagauaggauaaguuggaauaggauguaucuccauccccaauccuuugugguuuuuuucucauaguguaucuuugccugugcagaggcccgugaucuccauugaugaacccuuugauagauuugauuaggaaaaacgugguggggaauagaacaacuggaaaagggauuugaguuaaaauguaaagaccuggcuuugaccacugccucuccccuuauucacugaugaccuuacacaagucaucuggcuucacaagagcacuagucaccuaacuuguuaagcaaagguaaacaugauacuuucuguacagcguucucaaguuuuccuaaagagcaagugaaauaaugaauauuaaaaugucauagaaggccaggcgcgguggcucaugccuguaaucccagcacuuugggaggccgaggcgggcggaucacgaggucaggagaucgagaccauccuggcuaacacagugaaacaccaucucuacuaaaaauacaggaaaaaaaaaaagguagccggaugugguggcaggcgccuguagucccagcuacucaggaggcugaggugggagaauggugugaacccaggaggcggagcuugcagugagccgagauugcaccacugcacuccagccugggugacagagcaauacucugucucaaaaaaaaaaaaaaaaaaaaggucauagaaagucuaaggcacuuauacaguauuaauuuuuaucaacaucauuuccuuucuucucugaagaagucuucauuuaaaugcaauuaacgccacauuaacagacugcuguacaaucuucuccuuccugcuugaaaggagaaaaauaccugacacuaucauucugcuuauauuauuaauauuuucccaagaaacucgacucccuaauuauuuucuccacuugccagcucaacuuuauuuugcagcuauaaaaacuaaaguaccaaagaguuaagugauaaacccccauuuagccagccagucagugcuggagaaagagacacgcuaaaggcaaaaacuugugaccuucagugggaguucuguuaaccaacauccagaggaggaagaggaggaggagaaggagcagcgaccacccagcucaacaccuucgauuuccaguagcugccagcagacucacauugagauacggcuuuggaggaaaaacccagucaccucucuaaaguacguaggaaucaagagacagcagacuucucaggcuugaauuccuaaaagcccaucuucaucagaacacccacagugauagcacagagaguucauuaguuagcagaugauuuagaauucaauacucauuuucccaaggauacagugucauaacgggaugagguucccagacuaguucacaaaagcuguuacuaucaugagcucugagucuuggaaagaggaggccuuaguaucuguaucucagggaaauggcaagagcuauuccuuccacaucccugggcagaaggccagcucagagcagaauuuugaaaugagacaaucaucugugguguguucucucuagcucuuagacccuuuucccaucagugcccagggcuacugugggcucucuccugguuagcccuacucccugcgcagcuggacuucauguuuacccaccucucuccaccaugucccuguucaggcccacaugcucagucaggugagauguuaggaaagacauuauccuucuuucaucaucccgaaagaggucugucuaccuucccacagguguuggcacuuuucaaccacaggccuuugucagagaaggcauuuuuuuuuaacaagaagaccuccuaaaguggcccaacucugccuuggauaauuccuaguauguuuucucuauuuuuuacagauguuucccuucuacuuuuaaacuggaguuacuagccuaugauucaugaauuccuuaaaauuaaaaaaaaaauguguauuuuuauguuuuuuucuggucaaaguuaaauagcuucuauccaauucucagaacaguugauaagccucacaaugucaaguguuggcccaaacccauaaauucuucaaaauguccaaguuugucacacuuguuuggcaccagagauuugagcauagaggcuaagguuggucaggauauauuuuuagguucuugaggguaggugaauguaaacuggaaaaucccugugaaauguauacuuccugcaaaauaacuuccuugauuauuuucaccgauuucauguuuagggugauacuguuugcagccacuuaugggugcuuccccagaucuacacaagagcuucacuggcaucaauucagaagaaaagaaaacuuuuaaaaaauaauuuuaaagagaaaaugagaguauucacuacuaacccaaaugacagcauuaucagcagcccuggcucacuuccccuuagagacccgcccuuuucaugggaaggcagagaagugaaguccucagaggacggacucugggccagacacguguggaaugaaggcuugccccucacugugggaacugggcagauggcuuggccauccagagcaucaguauccucaagucugaaauggggaaggucaugucugccucgugcaugucucacguggacucacauaccaggugcuagccccugugccaaguguuuugccuuuggucucagaacaaauguccaucaucauugucaucuuuagagaaaaacaacuucagucccaguggaauucaugcgaugccacuuuucauuucaccuccuguuugccucaguucccuugagucaauacauacaugcuuguguguuuccaucuuuucuuuucguuauucauugcgacucugucccaccuguuuugcccuuuuuacuuaguuauuaucaaaaaauuuaaaaaguauuauuagugaaauuuaggaaagagagacuucuucauuuuaaagacagguggcuucugcgcagccauuuugccuuguggucugggauuguagucauugucauucaugcucuguuugcacugcuuuucuguaacuaacugaggcuuucuuaugugucauauuucacaucgcugaugcuccugaaaaucaugagguguccacuaaaguaugguuguaacguucuuuuugccucauuacaaauuaaaauguuccaguuucauacuuuaacauuauuauaugccccccaaauaagcugauaauauauuacacuuuuaaucugcuuuuauuguuggcagaagguuuuaauuauuugcagagggcugucgcauacaauaaccuauucagugcaacaaaccugagaagagauuguaucagucuugaaccuuuucauuuucacgagacagcaaggccaacucaaagcagcuuagccaaaaaaggaagguuuuugucucaugccccugaaaaguccaggcuuuagguacagcuugaucagagacacaaagaauaucauuaagacuccauuucucaccaucuuuggcuccagauuccacuguguuggcuucacucucagcuuauguguggugguuggucccggcagccucagguccauauccuuccagcagggggaggugaggccucuugccaggacagcuguggcugaugcaucucuuugaggcuuguuaguucaguaguuugauuggccugagccacaggccaguuucuggagucagguagggaaacaaggucucuugaaaugcauggacauggauggggguugaagaugugauuuuccaggacaaaaucugagcauugcuuccaggaacugaaugaguauccaccauagaggcauuauuaucaucucucuuuuuauagaugaagaaacuggugcucagagaauaugucaguuguccaaauaucacagucagguagugaccaagagaggacuggagccaaagugcucuucucuuucuauaaguccauaucuaaccaugauggcaaaugauacuguggccauugggcaaagugaagagaguacuacugcacagggagcaggccuccuagacucauuucugccccugacuacaugcacggccucagucuuugugggucucauucuucucauccaucacauagugacaauaccugcccugaugaauacuccuuggggaccagaugagauguugggaaaaggacuuugggaaucauaugaguucuucaugaauacaaggcacucuugccuucucuccagccccacaugguuugugaaggcaucacauuugaaaauguguucaacacucuccaguuuccaaaguugcuuccuacaccucacugcauuuaaauuucccaaacaguccuguaagguagaugagaaaccaaccaucaagggguugagaagcuggcccugggacaagccaacaaugaacaugagaccuuagacuccacuccguuucaccucugugcugggacucgugugccaggagccucagccugauucgaucaacucuggguguaucauucucagcagaugugauuaggaggaaucgagaagcaguaacauuuugaauaugcccuaagacuauguuuuguaauauucuacugugaauugccuacuuuucaaaauacucugguuggguuacuauuauuauuauugagaugcaguuucgcuccuguugcccaugcuggagugcaguggcgugaccucggcucaccucaaccuccgucucccagguucaagcgauucuccugccuccugaguagcugggauuacaggcaugcaccaccacgcccggcuaauuuucguguuuuuaguagugacaggauuucaccauguuagucaggcuggucucgaacuccugaccuuagcugauccacccgcaugggccucccaaagugcggggauuacaggcaugagccacaacgcccagccauuaauuauuauuauuuuuuuaaucaucauguuuuaccuuuuuuauuuaaucauauacaaaucuuacaaaaaugcuugaaguaauuuaacaccuguacaucaguacaaaaccuggcugaguaaaaugaagagagaaucuauucaagaucauuaagaccaaauguaaacugggaaguauguggaagauagcuguccagcaagugucuggaagguguucuagcuggguagagagccuauucuaacagacacgcacaucgcagaaagcggcaugaacagaaccacauccuagauaagagugcuguguacagaagauccauggaggcaagugcugucaggaagggacacugccucccuccacccucccaacugucaccaccaaguuccuucaggugagaccucacacaaugucaagugcuuucuaggaaauacuaagaucagguugagagauucugcuuggucuagucaaucugaaaaauucaggcuggaaagacaccuuuucucaagaguugaauugcuuuuugccuucaagucuugccugcaccuugcuuacaauggcaucaauuuacaccuaaggaccuuugaagagaaaaauuccauuauuucuuuuuuuucuugagagcagauuuuuucccuccuccuuuggaagauuugcaguacuuugcuuccaucugagccagaaaauuguccauuuccuuuugccaauccuuuugucugcucugaauggcugccuucaggcuauccacgccuucaucaagccccaacuccuuucugcucauuucugcuucuuuggccucuuccugagcccuccuuuucuuugcauucaucuuuuguguugauucuuugacaaaggcguuauaggaugggaccucuccggcgucaauagcuugcugaaugauauuccuuauccuggguuccucuguguacugcacgcaaagcacagacuccaugaucugauccaugucacccuugaaguccagauaggccugcuuaauaucagccagcucuucuuccaaaccuuuguaugucuuuucaaaagcuugaacguccucuaaagauaucuuuuuaaagaguagccgccaauacgccucccagucuugaucuuggaugagcacaggagaguccucguccaccguucccugcucaucguacacugcucucuguucucugucaccgagaauggaauagacuuuuuccaggaucuggaagcagcggguggcguccuccuugucgcccucgcccacccgguccagguguaccugcagggacaccuugugguagccucgucggaccucgccaucggaggccucgcguugcacgcccagcacccaguaaagccagccauuaauuauuuucauuugggguugaauguaacagaaucagaagaaacucauguacauaaccaugagaaaacagauccagcucucaaaagaugaagacagaauucaugaaguccuaccuugagaacaauuuuaaagacauugaauagcuuuuuuucaucccuuuauugccuucacaugacguuuuacaauccuaaaaacaagaguuuggugggauagcuucugccauaugcuuccaguauggcuaugaaggauacuaggaggaucauauggggugggccauguggucaggaugagcugggauuggcuggugcaccccaaggacucuuggagugaccaguaaccugaugacauggccccaaagaucugccgccauaaacuccaaccucagcuaauauuaaugucuuagagccuucagccaguugcuggagagcuggcugcaagucacucccaacauaggccguguuugucagauggguagggguguuaccaucccauguuguguguccaugucacaucagguucuagccagcagcaucugacccuggggcgugguguuaauaucugccucaccaagcuguauugagggugacaguggugggugcccccauuucucuguucucccuuacugcaaaauucuuccaaagugguguugucuagaccugugcuggccaguacuuguagccacuggccacauuugacuauggaguauuuaaaauacggcaagucagaaauaauguaauccaaguugaaagugcacaccagacuuugcagacuuaguauauaaaacaucugaauauuuuuuacauugaucacguacuauaaugauuauauuuuauauuauguuaaauauauauuauugaaauguaauuucaccuuuaaagguguccuuuuacuuuuuuaaugggucuguagaaaauuucaauuugcucguacaguucacauucuguuucuccuggagaguucagucuccagucugccuucauacuggagaagugccaaugcagccacuugcacuucucccuugaccccaucucagguaggcuuggaucccagcacuucaccaaaaacagcuuaugucaaagucaccuuccuuccagugaucaguuuucacucauaaccagucagcaguguuccauacaguugucacuuucauugacauuucauucuucacuuccaugucacucucucuugccuccaggagcaauaugcuaucuugauuuuucuccuccucacugaugcuucccucauagucucuuuuccugaauccuccucaucuucucaacuucuuuuacucauccaaagucauuuccuaguagagcucauccugacugacucugaggacuuugugucugcagcucagaccucccugcuuugugucuacagcucagaccucccucugccggaaaccugugucuuaccugccugcucagcaccuccauuuagauauccaggaggacccuuacaucaucuuaguccauuuguguugcuauaacacaauacccaagacugguaacuuauaaagaacagaaauuuauuucuuauuguucucaaggcugggaagucuaagaucaaaucaccagcagguuggggucuggugagggucuagucccugccuccaagaugaugucucauugcuguaugcuccggaaaggaggaacaguguccccacaaaguggaaggacaauagguccaacuccuuccuucaggcccuuuuauaaaaacaccuaaucccauucaugaggguggagcccucauggccuaauuacaucuucaaggccccaccucuuaauaccaucacauuggcagcaccugaauuuuggaggggacacagucauaccauagcaaugccuaaaacugauuucuuggucuuauuccccaagccugacccuaaauuuacuauauuuucuguguugguaaaggccaacuuccuucauccaguuauuuaaaccaaagauugucgagucaccaaugacuucucuuucucccacucucuauaucccguccaucagcacauuguguugggucucccaucaaauuauauuuccauucuaaccacugcuccccaaggagcaggcucuucuccaagacccaucaucucugaaucaaucaaucauugccgaggccucaucacuagucuuccuccuuguaaccuugucccucuacaacgcccaagguauuccuuuuaaaaugucaagucccaaaaaaaaaaaugaaauaaauaaauaaauaaauaaauaaauaaauaaauaaauaaaaugucaagucccuuuucuucuaggaagcuuccauggguauaucaucuuccucacaauaaaauaugccauccuuacaaaagucacacaagaucugccuuuucaccaccaguacacacacacaccccucuuuccugcuuccugaccucuuccccugguuuacgcuccaguuucugcaccuuccaggcauacucuguccucagacccuugguguucacucuucccccuacccaaaaugcucuuccccgucugcuuuuguggcuuguccuucacucaggucucaguguaaagcccaccuuguuaccuaccacagccuuuccugaccaccauaucuaacauagcaccccauggcccuuuagauguuuauuucuccucauaacaucauaaccaccugacauacguuuauuuguuuguuuguugucuucuccauugagauaggggcucugugaaaccaagguccuuucccucaagggccucaagcauugccagguacagaggucaauauugccugauuggauuacucugucggauucugcucaguuaucaauucugugugccuuuagggcagaaguucaauaauucugcuggguaucagaaucacugaggggcuugcccaaaauauacaugcccugaccccacuuccuagagauccaaauucugagguggaaccuagaacauuuuuaaacacacuucccacaugauuuugaugcaugggauaaauggaccacacuuugcaaaaggcugucucacuguaccaguuuguguuuguuuaucugcugcucugccuugcugaguguuguuuuauguauaucggcaguuuuugaaucaccugggaaccuaaauauagaugcccucgccccaucccagaucuugugaaucagaacuuccagggaugggucuugggaaucuccauuuucaaaaggcucccucugugccucugaugcagccagucuucccacuggccugcgggagccccuccugugcuuuacagacuucgugaggagguuggaagcucaagagcagguguuuucucugccguuuuaggccaacuucucucccuaucucccauuaauccaacaguguucuguucaaaaccaguuuuuaguaagucacuguggggugacuccuugguuuauccacaguuucaaugugccuuugggacuuaaacauugcccaguauuuauuuuuucuuucuuucuuuccuucuuuuuucuuucuuucuuuuuuuuuuuuuuuuuucaaagcauuacucugucaccuaggcuggaaugcaguggcacaaucauggcuuacugcggccuugaccuccugggcucaagugauccucccaccucagccugcugaguagcugggacuauaagugcacaccaccacgccuggcuaauuuuuuguagagaugaggucucacuauguugccuaggcuggucucgaacuccugagcucaagcuauccuccuaccuuggccucccaaagugcugggauuacaagcaugaaccacugcgccuggcccaguauuucuaacugcaucucaaaucagccuguucucugauuagaggcaagaaggauaucuuaggcaccuagcucauccugguggggacucucuuugcaguccuuucuauccuggaauuuaaaauguguuucccaggucagcccauacaggaauaggguaauaucacccauugucauacucaaacauucaucuguucagccuuccccuugguucuguacugggacaugugcauugacugucuucauccuugggguacuggucuccagaguacccccaaagaucgagaaaaguccugaucccuugccuuguggccugccuaggcugcuuagguugcugagggaggguaucucccuagaggccagggcuuugcccuauuucuguuugguuuugcccuagaacuguguacugacauucuuuauagagagaaacuuuugaaccaaaaaucuuaaaaguauaaccaaaaaguaaaacaaaauaggagguaggguggacaugaggcagauggcuggaaauggaguauaccaaggaaugauauuuguagaauuuuauuccuuggcccaaguguaagagcuaccuuccagguuguaaggaaucauuuaugaaggcccuggaagauccuguugguuaaucuaauuuuuuaauaccugagucuccauggacucagaaugucccauucuggacuuuggauggccagcucuuugguagccucuuugaauauguuggguuuaucuucauucuuuacaagacaugaugggaucauuauucauggcagaaucugaaaaguaguaggguugucccguaagcccagaaggcacuugcaacccucuuagcacacauuauauaucugcaccuuggcguugugccuccggauaagccucagauugcauuuugaugccagaugugagaagccuuuaguaaucaggaugacucccuuuaggaaauccuguucccaggugauagcugcuuccuaaggaauacuuguuugggggcuuggggguugggggggcgggggaggggagcagcaccagaggcucugauuuagagacaaaggggaguuaauugacccuagaaauguuagaguaagagauuucuaaugagaccugacagcucaggggcugaagagggagucuaaucuuuuuuuuccugcccacccagucuucauacaaauguaaauaugccuccuucaacaaauugccaaaugugguuuuaauuuguaagcgggagaccccgccuugcuuuucucuuucuuuuuuucuuuuucuuuucuuuuuuuuucuuuuuuuuuuuuuuuugaaaacuaagucacagauuuuacacuuuuugaacaggacauuuccuccugucacucuuaucaccuuuucuguuguccuuuuucuuccaaggacauuuucccccauuguugucagaggaauuugggaugagagccgacugcucugcuucuuaaaggaguuuuugaaguucccauaggaaaugcauagugcucuuuaaacugaauuuuaaaaauaaauaaauaaaggcagugauugaauuuaauacgagauuugaaagagugucacuaucacagcaucauacuuuauguggcauaugcaguauucauuguuguuauuuaugacccugucugccuuccauuguggauuucuuccagccuuggggaauuuacaucauuccuaauagcaaaaggcuuucugguucccacagaguuguucaaagccugacucaugcuccuuauguuaauuguucagcucugaaaauacagcacuuacaggguguggcugugaggggagaaucuacuguacuuauagggcauguuuagaaguguuucacacauaaaucucgauuccucucgaucucucucuuucucucaguugaauuuuaagcugucacucauuuuggccaacuaguaagucuuagaaaacaaaaaaaaagggaguauaauccaauaaaauccaauaaaaccuagaauauucuguucacuagcuuaaaacucacuuggguuauaaccagauaugacuuugagugacacuggcccaggucugagauggauaggcacaauugaagagugugaagagcccauccucaguggugcagggcagugauuaggcaaagcacauccccucggcuuguaggauaaccaggcacgguacucauggcugccacccaccagguacucuggggcugucacugcuaauuccaguguaggucuaaagcaaggaccuacugacaacuuacuaaagcuguuucuggugguagcaacauuuuauuggaauuugauggagaagaauacuuaguuucucagaaaauaugaggaguuaacaccuuguauggauuaucuacuugauaaccaaaaggagaagagauuccaaaagcaugaaauggguuaauguuggcaagguagguaggcuuuuacauuuuauaauuacuuccuuaugaugcuuccaugggaacacaaaaggcuagauaggcagauaaucuaugaauuauauaaaaccagaguggugguuaguauaaggaaaaaagucccgaauuuuuugguagccaagaaucacaaacuacaguuuucaaaauaccaauauuaaaagauuugacuguugcuauggucuugggugugauaaaauauucuuuuuuuuuuugagacagagucucgcucuguugcccaggcuggagugcaguggugccaucucggcucacugcaagcuccgccucccggguucacgccauucuccugccucaaccucccaaguagcugggacuacaggcaucugccaccacgucccgcuaguuuuuuuuguauuuuuaguagagacgggguuucaccguguuagccaggauggucucgaucuccugaccucgugaucuggcugccucggccucccaaagugcugggauuacaggcgugagccacugcacccggccacaaaauauucuuuguuuuugcagauagagaaaauauggggaauucuuaggaugauaaggguguagaccacugugucaccaggucuugcuagaagaacagagcucacaggcacguugccccacacaguaggauucuggggcuuuugucacagccugagccucacagauaccagauauuggccaagaguucccagaugguuuggaaucaacauuauuugccuuacaguuuuguauguuuaugacgcauguuaauguaugaaauguggacugggaguccaaaagaaguuacaauuaaccauaaaguccuagguaaaaaagguuaaaauagcuuaccacugagcaguuucauucagucuuuacaaaaauaaauguguucauuggggcauucagaguguaacuguuuucucucauguucagcuaauagauuucugguugaaccuuuguuaucuuuuggaguagacagaaagaguucuccauggagugucugauuacuuugcugagugugcagagaguucacuuccucccagugcaaagcuccggagaaaugcucugaaagaaauguaggugcaauguguuuccuuuuucucauuuuugccugucucuauguauggauagauaacaugaaguccagaauuaaacagagugccuggaacugaagcacaaacuccccuccgucacguacuuacucuccccucccuccugacucucuugcuuucuggacaauagggauagaauccuugcuucacagguguguugcaaggaguaauuaaugacacguucuuugaagaugaaaagcaccuguuggugguguguuucauaccacuuucggagggacuacagacagaucuagaaaaaaaaaaauuccuuuccuaggauccuuguuccgacuuuaauauaauuacgauaauccucaugcuccuggugucaacaguaagaacaugaauauuacauguauuuguuuucacacugaagcuagccgaaauaaauauuucagcuuucaauguuuuggugguugaggaaauuucuugccauucacaaaccuguaaauauaugcugaaguuaacaucuuuagucucuaauucucccugugcagcuucuauccugccccucaaaguucacuuuaucaucagagugaaguuacauugucuguugugcacgcuguaaggagcaaggggcuuauauacagcuauaucgacacucuuuugucuuccacgauuguauuuuauugccuuucaugcugacuaucugaaauuucuuccaggacauuucaaauuauauuaacuaaguccuacucccauuuguugaucaaguuuggucaacaaaccugauaccagcuaaauggugguuauauuuggguaacaucuugaaauagccugagagaaauuccagaagauuuuucuuuacucacaaguagaaauuguguguauguguacauuuguguacacagagccugagucuacuccuggaaaaaaaaaaucaguauauaggcaguacugacccuuaacauuggaaaugaauaccuauuuaccuuaguuaaaaugugaacgccaucauaaauccauuuuuaacccaaugauugauaagcaguaucauguauaauggaauaugugaagguuuuugcuugauucagucugcauuuaaacauacaccugugguggggaguguuuccagauuugcuggggaagcgagagggcagguagugccugccuccuuuuucagguguaggaaaugugguagagggaaucuggaggaaacagugcagugacagcuuuacaaaccauaaaaucauuuuuguuuguuucagugugaaaagaacugaaacaaaaagcagugucacgagcaaaucgcagaccagaagagacacuguggaaacaucuagugacucagugauugcagagauagcaaggaggaggaaugauggucaggcuuccuccagucccccaucagaauccaugggacaagcaaaggauuccauaaaggcagcugagagccacugggggcuuccuguucaaaagcuggaaaaaguuaaucagacccagccagaagacacuaguggccagcaaaaaccucauccuggggagcgguuaaagacagggcuucuaagcaggagccccgucuguagcugugagucagcaucaccauguccaaaacaaaguccacgaguggccaaaacccaacagaaacgcaggaacugcagcucugcggaagacuucgaccaccacgggagaguuucucuuggaagugaucgauuagucccgagagaaauaauaguggaaaaaagcaaagcugucaggguuuugccagcuucagaguugucagauccaggguuacuuuugaaacaagauuuggcaaaaaccacgucuaaggaagaguugcauguuuuggaaagucucuccuccagacaucuuaugaaaaauaacccagggcaggcacagcaaaccggcuuagccacaaacacugaaagauuaucuacaauucagaacagcccaaccaagaaaagaaagaaauacgaaagaggccauuaacaccgaagagguuuguaccguuggaguugaggacauaguggccaaaccugugacaagagagcugcgaauauagaugccgggauuuuaaaggaauuaauuagaaugacuaauuuaaauaggaaguguguuaucuguguuauggcuaugguuuguuuucaaagcauuucaaaccgggaggcuauaugcuuguucuaacagcguugcuucuuuaucauuguauuuuaugacugucuucagagaauuaguaaugacaaagagccauccaccuugucagggaggagacugugcaaggacugcaugaagaaacugaucaugagccccuucuuggcacaucacugugcagaccacacaauggaccgugcaaagacagugcugccgugcugccuuucagcuccagggguacaauccaucccccugcuccucagccugaguaggagggcagugaaagaacaagcuagugguucuuagcgcgugguccugggaccagcuucguugucuggaaaugugcuagaaaugugguuauugggcccugccccaugcugaguaacugccuuugggugauucugaaacaugcucgcguuugagaaccacuggacuaauagaacacuccccagugcuuccugcagccugguugccauggccuccagcucaccaguuggggccagaugugcacaugcauccccucggacucccucaaacucguaaaacacuuggguuugguguaugggucacucucuuccggguucuacaguauggcagccauggcacccaugaagguguuacuuucccuuauaauuguugaagucgaugggcgauucugcccaaccuuaggagaagacaucagagaggcucguuguugccuguagcucaagcaugucccagucccugcucuugcacccaccuccaggauuuugguuugggacagacuauaaccuaacaggaacucagugaccagguuccaguuucccaguuggaaggcuucgcaggcaguucaaauuucaagaugggagccuucccuuuacaaugucacccacugucuccagugggcuugaugaaaugucacauagugaauuguagcaaugacuuauuuuggauggacacccgcuaaaaguuuccaauaaccgaauuucacucuaaaagaggaaagaaacaauauucaagguccauucauucaauacaucuuuuuuuuuuuucuguucaacauggggugguccuuugaaauggcaccuccccuaaguaauaaggaaaaccaaguauauucccuaaaguguugaaguuagcagaaaaaucacccagaaaagcccaaaacaaugacaagaguacagaaacaggcauaguguagguucaugcuugagauggauuagugguuuauuccaucccguucuauccuuucccguaucuccuguccccacuuguuaagaccaguaagacucaugaagcagcagcuauauuucauggcaccauuuugggucaugaaauuccaucuuggucaccaagccugacuguggugguagauacuguuacuuuaauguuccaaacccugccuagaaaccuguuccugucccaugaucccagccucaccacccccacuugaaacagcccuuccuacugguauccuguccucuucccucuuggcuuuuuuccugcucccagcggaacccagucaggggauucuauaggagaagagggagcccaacagaauacuaacuucaguggagcugacucugcuuauacaauaggggugggcugcacagaguggaaaccgaguaccugguagaaugugcauuuccauggcccacuguaggcgccucucuuagagcaaacaguauuuuaggugugcucuuuauugaacacaggaccacagugugucacugaaucuucuuaaacagaagcaauuagaacgauuuagauauagggagggcacaaguaauaaguaacccaggggauagaccaagaagcagcucucuggaagagucuggaauuaaaaagacggcuguacuagaacaguagccacugccugcuccagaacuaggggggagauauuugagcuggagccaccagagaacauuucuauugagaaguuuuuauuuguuuguucuguugguuuuuuguuauuucuguuuucuucuaaucuuucucugaaguaucacucugguauugagaaauuuuuauuucauuagcuaaccugggcuuggugguuaaggcuaguacuuguacuuagaaugauucucugucaggaaaagucuuggcuuuagaguuuguuauaguuggggauauaacaauuacugugaucgaagagaaaaaauagcaccuuugguuguagauagauguaguuuuccucacagcccucacgucccuucauguaaaagggauuuuaacaggauuuacagagggaauggcucucaguucccacacugugacauguguuugaggaauuuugccuuuaagcauuuuucuugcacauggcugaaacaccccuggcucucuuguuauuugagugguugcaugauucuuuggauauuuggaaguacaaagggguaaauggaugccagggguuuuuuguuguuguugcuuauuagguaggauaugaagaguucucacuguugggaaugguauguguuuugacauucuuuuuuuuuuuuuuuuuuuuuuugagacagagucucgcucugucgcccaggcuggagugcaguggggcgaucuuggcucacugcaagcuccgccuccuggguucacgucauucuccugucucagccuccugaguagcugggacuacagacgcucgccaccacgcccggcuaauuuuuuguauuuuuuuuuuuuuuuuuuuuuuuuuagcagaaacggguuuucaccguguuggccaggguggucucgaucuccugacucgugauccgcccgccucggccucccaaagugcugggauuacaggugagagccaccgcacccggccuguuuugacauucuuaaugaucuuaauaauuuggcaucugaaagucugaaacagugucaguauuguuagucaaaaagaacaaguucuucaaccacuugcguaguaccccaaauuauauucaagucccugugacuccaaugcuuggagaagucauugauaugauuugauuaauguuauaacuuugaauuuccuaacuuucucagcggcauagauucuaagccacuuccaugugcuuucagauggcaucuuaauagauugguguugagguuauuuuaauguccauaaacaagaaaggucugggaacaaucuguaugauuuuucuuucacauuuucuuaucuuugccacuggagguuaacugucguccagauaugcauaugaauugugaaaugcaaagaagcaaacauuuggggguaggggaguaagugcuguaguucuuuuguucacuuauuuuaauacuauagaaguguauuucauuuuauaaaaagcaagaaucauaaaaacccucuguauuuugauuuaugaagaauauagcuucucucugaaguaucucaagauauaucuuggggaccacaaugggaucacaguguaauuguuugcuguuggugucauguuuggauuuuagcaugguuuguuaugcaugucaguggccucugauuucagaaagagcuuggcgagggcagaacacauaagggaaggaaaccucugcucaagagaguggccugggaucacagugucgucauucccaauuuccuugaauuccuucuuggcagaccuuacuguaauauuacacaaaacuguaaugaguggcccuccuuuggagguaacagaugccuuuccuaagaacucaaaguucucuuuucagcgugcugugacuugaauauggaaaucauuuuaauuucuucuuuucucuuauggggaaauuuccaugcuugguuugucaagacaagagaauucauuccuuauuauugaaacauuaaugaacugaaacacguugaagcaaguaaaaaaucaaaauuagguugguuuaucuuaaauaguuaaaagccuuccuuaguacaaaauaaauuaagcauuguaaaacgaaguuaauucagguaauuacucaguacagaaaucuaaccguauauaucauugguauugcaauuuaaggguauaauuaaauucucagaaaucugcaggacucacucuaauuugcuuucuauauuuauuuacaagacagggaacaaauaugugucaaugugcagcuuaacagaggggacuugaauggauaaaauuaucuuuaauuaucuagagcuacccaguacugggcuugaauuuaaucauagucaaauguuuccucuggcagcauaauauuaccauacaccauauuaccuuauaauugccauuacaguuccuuaucaaaaauguuaauucuuugcuugagcaaaaaucaauaaaaccuuauguuugacccuaaaguauuugaucagggaacagaaggugugaauuggacagaucccccgaauaacuuucuucaaucaaguugaaaaaccaaacagcuauguaaguccccaggagagcucuuuuucccuuaucuucucauuuguuuuguuauaaacuguuuaaauaguucaaaugguugugcaugccuaggggaugaaaccuauguaauagaaauguacuguuuuaugaauaaggaguaaaauuguuuuaaaaaa

SEQ ID NO: 13427 - RNA, 7390 nt, Homo sapiens
uaggcuuuuacauuugucuuguaaaaggaggacggucuaagauauucgccuuauuccuuuaguuuguuccuggcuucuaaaguggcauccacgugcauaaaaaugcaacuuauuucaucauuugucagcauuuccaaaacagagaaauaccacuuuccuuguaaaaguuauauuuaaauauaauaaaauuauuuuucaggaaggcaacaccacaaggacucaaaagagacaaaucuauaugcucagagcauggucacugaauuagagcuuuggaagaauuagaaaaaaaauugaaauuuuaucaggaggagaagugugcuuuuaacuaucuaaauagucuacuagacauaaaaguauauauugccguaucuaauaagccauuacacucaccaauaagcauugauggucaucuguucagguuggguagacagguaccaagugguaaaaguguuuaagaagaaguucaugugugaaaauacgaacacugagggcucggacucagacaagugggagaaacgaccuaccugcacugaagauguaaauuuaaugauggagugaaggaugacuauuuugcuuauucaucuaauuuuaccuaaccuggacugauguuaacucaauuuuuuuuuauauucuguauuucauguuauuuaaauaaaaauaucauguuuuccauugucugcaaucuauuggucugaccaaaaguagagagcacauuaaaaauauagcaggauuaaacucuaugagagcagaauaauauuauugcuacuugagugguaaucuaaucauaauggcaguaaugguucccaagaauccaaacaagacauuacaggaaaaaaucaaggcccaccuccauaggcacugacuuguuaaugcagcuuucccagaugaggauaugucugcauguugugauagagucuuaagagagaaucaggaacuuauacaaauaaaauuguauuugaugaaccuaccauuucuaaaauuagaacaaauguauuuaaauccuccaaucacucuccagaauuaugaugaugagcuauaagagaucaguacauuuuucuuacccauuuugccuucuuugucaauuugaggagugaugguaggaagguguguauggcuaaagagaggcccacauggccaugccagccaggguggccuugagugaauuuagugggaaaagaaguuguaaggucauagguagaucauaauuccauuuuucuuauuaucaaugcuacguauuggauauuacaaauuucuugaguuaggaagauuuuauauuccucccucaaauacauuuugauucuaaauaauuagcuuaaaucaagucagccugauagagagaguacugaauuccgaaucuggagaacagagguuucugucucagcccuguuccuuaugguaggccacacuguguuucuacacaucaacaugcaaugugaaagguaagaaucuuaaauauuuauuuauguaucucaaaagguugaugugaagauuaauauugcaaguggaaaaucagaagcuauugauuauaugauuauauuauuauuacuucugcuaagauauuugaaacugaucauuuuccauaaugcaaaguaaugacacaauaucaccauaaauguuuaugugagaccuaaaugaguaacaacagaacuaggguguguugaugccucuaguucuuacuuuuuuucagagacucuuaauuuauuucaaauuguacaccagucugauuuauauccagacaagcccauuucaguuugggggcucaggaaggcucuuugcaacaccccauucucacauguaacuucuacuuuuucucauugccuaauaaaaaucucaguaauggcuuucauuccacagugugcacuagauuuaaaaaacuauugcccuccccaccccugccagguaagauaaugcaaugucuucaauccacuagaaguuaggagugacugauugcugcugcuuggcugagagcuuuggugguagguggggaaagaacaagacaccaggagucuggagaaucacccauguauuagucucuccucauacugcuauaaagaacugccagagaguugguaauuuacacagaaaagaugucuaauugacucacaguuccacaugucuggggaggccucaggaaacuuagaaucauggcagaagggaaagcaggcacaucuuacaugguggcaggagagagaacaugugaaggaggaacugccaaacacuuauaaaacaaccaggccucaugagaaccauuugcuauuaugagaacagcauggggguaaucacccccaugauccaaucaccucccaccagguccuucccuugacaucuggggauuacaauucaagaugagacuuggguggggacacagagugaaaccauaucaacccacaugugaagagugaggauucaguaggguuaaugaaaaaguugugguuauuuuacccaugaaugucucccuucaguaaaauuagaauuugacagcagaucuucucuuagaacuguuaauaucuuuuuauuuuaaggucuaagagagaaaaaaagacaaauuccaaauauaucaugcuauggguuuuuggauaaagcaaguuugauucaaaaggcuaaguacuaggaguccauuuauguagaauuccagcaaauacugaaggaccauaaaagcaaauauuaacuucagagaacuaaaauaauuagaauaguuuauguauacauauaugcacacaugugcuauauuauauacauaugcuacauauauacacauuugcuccauauauacacagauaugcuacauauauguagcacauaugccacauguauauguauguagcauauguguauauauacauauauacacauaugcuuucaacauuaaucuucauaucaaccuuuugagauacauagacaauuauuuaaguuuuuuuuuuuuuuuuugaaacggagucucaaucugccgcccagucuguagugcaguggcgugaucucggcucacuucaagcuccgccucccggguucacgccauucuccugccucagccucccaaguagaugggacuacaggugcuugccaccaugcucggcuaauuuuuuguauuuuuaguacagaugggguuucaccauguuagccaggauggucucgaucuccugaccucgugauacacucgccucggccucucaaaggacaaauauuuaagauuuuuaccauucacauugcauguugguguuuauauauauguagcauauguguauauauguagcauauguauauuuauacaucuauauauacauauauauaaauauauauuuaaauuggaucagcaguuaagaguccagauuccaggagaucagauguucagucugcccuuguaagcgcaguccaauuggaugcuaguguguaagauaaaccaucuucuuugcccugcauagggccccagaaguuuauuguaguggaaaggacacuggggacaugagauaaauccucucacuaauagaggcaaacauuuguaaguaagauugcaacuaaucuucucucgcuccagccuugcaugauggaaaacuuugagugaagauaugaacaaaaacaauggguugcguuaauccuuuucaaccugggaaaaggcauccacaccugucaauuuggggugguugcccaggagggaacugugggaauacagccaugggagaauuagagcugaguugccaggcaggccagauaauuccuucuuuaacagcuugaagcccgggagucacauuuccuacuuacaaaaagcuuuccaggacguaaccaaaucugcgguuucccaggaggucuuggcuugucucaccaacagcccauguccuuggaagacacaagcuuuuguuguuuugggggaaauuuggguugugagugugcucaacacaccccuggcagagccuggaugagagaaagaggcucaucuuucaaguccucugccacucccuuugaaacagggcuguuuuuaaagggccucgagacuuacuuccuggcugcgacuucaaagcacagaugaaugcuugauuuagagcuccggggccuccaugucuauuauuauuauuguaaaauacgaacaagucagccacguguuuauaaacgucccaugacagcaaacucacuggcuagaggaugcaacauuaggcugugucugcaccagagguagggaggcuuugccaaggggggcaagcccaaguaagguucguuaaaugccaugaaaaaaaaaugcuucuggagcacaaggcgcaggagcauuuccucauuuuuggugagcauuguguucguuuauuaagaaauggucacugacagcaauacugucugccauguucacauauucugagaaugcagaacaaacuugugacucagagggcugagagaaagcuguaaggaguuggggaagggagcucaacauuacuguuauaauugaacuaagggcucaggccuuuaucagcccaccaggcuaucagacggcgggguaaugugacuguaagucuuugccuacgaaugaguucagugcauuuccugaaaguaagugaaaauugaauuuauugguuuacuuucuguuuucuuggcaggugagauagaacagguauaaacucauauuaguauaaacuaaugagcaaaaaaauaaaaaagaaaagaaagaaacagcaaucaaaagcaacagaacacaaaguaaagaaaaagauaaauacagaaaaaaaugaacaaaggggugucuugguucagguuccuuagaagcagggcuuaaaacaagaacucaggugugcaugauauauugagggaggacucguagaagaagagaagagagaaacaggaagagguagggguguagacugagauggaaucuagccuuagccugaugcagugguaagcucuggagcaugaccugaacaagaguugguguuaauuugaggcaagaagacuguccuuucauacuucaguguuaguugagcuuccuggauggggguuaagggagaauagcccucaggcugauggcucuugcugaaagcaguucucugaggagggagcggcugugagccauuagcagcccacuuacagcagcaaggcagaugggucugcaagccagcaaagaauaucuacaagacaccaacaguauccacuccaggggccuauuggagugauagccagaaaucauccuccuugccaagaaccacucugcaucucucacuccuucauuaucuacgugugggauagauuaauguggccuaaagcaaugggcucugaaacauuggucccuuggaagguuuggaauugcauuuaaaaauucccauccccuauauccuaguaaauucuacguuuaaaucgaugucaccagagaagaucuuccacaugugaacaagaagacaggcccaaggaugcuuguugaagcauuauuugcaaugaugaaauaagauaacauucugaagguucaccaauggggcaacaggaaaugaauugugaugugucauucccuagaucacuguguaccagauaagugaacucacugauacauauagaaaaccugaaguugaaugaaaaaagcaagaugcagugcaaugaaaauaauaugguauauguagauaacauuuuuaaauauaggcacaaaauauuguuaugcuuucaucucauacacacauacauaaauguguuauauauaauacauauuuauuugucaaaauauuuuuuaaaguuuaaaagaaaauauagcagacucaucaaggaggugagaaugaaaauggaauuugggaugaggucaaagcguuuucaacuauaucuauaauauugcauuuuucuaaaaaaaaaauuuuuaaauuuuaaguaauuaagccccuaaguaauuaagcaugcaagguaagguacuacuaggaaguaugcaugugaggaaccaaugggccaggguguuuuagcccugaccuuguacacauccagucuggcuucauagacacauguugcagaauggcaaggaaauaguugggauagcaaaggguucagcaagaggucaaaugggacaagggaaauaaagagcaagaugaagacucugaagaggaauccccuacuuucauagauauuucuagaaccauuguuggccccagugacacaguuuaccaaucuucaguuauagcaaugcuguucccuaugcauauguaccuuaaucuuacagaucauuuguuucaggcauuuuuuacuugauuaguuuccaauacauuguuuagauuucuuuagauucggagagaaggcccaaaacauaaaacaauuuauaauuagaagucugaagcuauaaaagucaccuaacauuugugcauacuauuuucaaagauguggaauuguguuacauacuuaaaacagcauccuucuaaguguauuacaaugaucugcuuuacucaaagucuacugaucucucaaagacuccuugaucucucaauauguuuuauuuuauauaauucaaagagaaaacaaaggaggaucccuugguuacguaucuucuggaaauauuggguuacagcuaaucaucuuucuguauugucugacuucuccaaaucuuuaauauuccacagugggcugugaaugcacaagugugaaacauaguaugcaauauuucccuaaccuauuugcacagagaauuauuuguuauuggggcuuuccuccccacaccagacuuuagaaaauacagaccuagaauuuaaccaguagaucaaaugaaacuuuaguuuuauguuuaaaacaaaguugaaaaacacgcuucucuaaucacaugaguguuuuucucuuuggauugagacuccucugcccaaauuuguauauagcuuaguguguauaacaggggaggggagggauuucaacuacuccuuggagcugucaaguacugaaucccacugauuagcaaggaguuucucucaacgucugaacagcuucuugcccuggaguaauaugucgcugagucauagggaaacauugcuugguaauaauugauguacagcuaaaucuucuaagcacuuuuuaacuauacaaaugcuucuugcccccacgaacaaugaacaagagaagaggcuuccuuuuaacuuuaaauuaacuagcauuucaaagaguuccagaacaucuuucaaacucacuucucugaggacaucuaaauaggaccagugacucccugaaggcaccuucuaccccagagcucuguuuccuuuagauacugaaguacaauaaaguugcuuuauagucauagaggaaauaaacaggcugcuguucucaaagaaugcgaagcccuuaccugugccuugaagauaggaacguuuaugagucccaggggacagggacagcccccggaugugaguaguuuccagagaaacaaguugaucugaaguuuuuccuggagaguuggaaaaucugc

SEQ ID NO: 13428 - RNA, 964 nt, Homo sapiens
guggagaugaacccuuuaacuaaggugaagcugaucaaugagcugaaugagcgagagguccagcuugggguggccgauaagguguccuggcacuccgaguacaaggacagugccuggaucuuccugggagggcuuccuuaugagcugacugaaggggacaucaucuguguguucucacaguauggggagauuguuaacauuaaucucaugugggacaagaagacugggaaauccaaaggauucuguuuccucugcuaugaagaccagaggagcacaauucuggccauugacaauuuuaaugggaucaagaucaaaggaagaacuauccgaguggaucaugugucuaacuauugcguuccuaaggacucagaagaaauggaugaugugaccaaagagcuccaggagaagggcuguggggcucguacccccucaccaaguuugucugagagcucugaagaugaaaaaccaacaaaaaagcgcaaaaaaagacaaaaaggaaaaaaagaaaaagagacaacugacugggagguacaggcagagcaaccauccucuucgucacccagaagcaagacaguaaaggaagaggacaacccuggcccuaagaagcacagcagcaagaacuaggagagagcucagaagucagugcccagggaggggcggaagcuccccaaggccaggacugccuacucugguugggcagagaaccgagagagggagcugaagaaggggaaacccaagcacgagcacagguccucaagcaggagggaggcaagagaagaaaagaccagggauaaggacagagggcggagcucaggcacacuuucuagcccguacaacgggcguucugaagggcguagucauagaaguagagguaggagcugagauaaaucccauaggcauaaaaggacccagcgcugccgggagcaggagucuuugaauuccagugacuguaggcgucacugaa

SEQ ID NO: 13429 - RNA, 964 nt, Homo sapiens
uucagugacgccuacagucacuggaauucaaagacuccugcucccggcagcgcuggguccuuuuaugccuaugggauuuaucucagcuccuaccucuacuucuaugacuacgcccuucagaacgcccguuguacgggcuagaaagugugccugagcuccgcccucuguccuuaucccuggucuuuucuucucuugccucccuccugcuugaggaccugugcucgugcuuggguuuccccuucuucagcucccucucucgguucucugcccaaccagaguaggcaguccuggccuuggggagcuuccgccccucccugggcacugacuucugagcucucuccuaguucuugcugcugugcuucuuagggccaggguuguccucuuccuuuacugucuugcuucugggugacgaagaggaugguugcucugccuguaccucccagucaguugucucuuuuucuuuuuuuccuuuuugucuuuuuuugcgcuuuuuuguugguuuuucaucuucagagcucucagacaaacuuggugaggggguacgagccccacagcccuucuccuggagcucuuuggucacaucauccauuucuucugaguccuuaggaacgcaauaguuagacacaugauccacucggauaguucuuccuuugaucuugaucccauuaaaauugucaauggccagaauugugcuccucuggucuucauagcagaggaaacagaauccuuuggauuucccagucuucuugucccacaugagauuaauguuaacaaucuccccauacugugagaacacacagaugauguccccuucagucagcucauaaggaagcccucccaggaagauccaggcacuguccuuguacucggagugccaggacaccuuaucggccaccccaagcuggaccucucgcucauucagcucauugaucagcuucaccuuaguuaaaggguucaucuccac

SEQ ID NO: 13430 - RNA, 3318 nt, Homo sapiens
acaucauccaaacaucuauggguccaaaaacucuucuucccccaacagcuuuaccuccaaaaggcaucaaauauuaaaaguaacaaaaauacuagaauacucuuugauaauacagaccuuuuauuaauaauucaauuggccagagagacaaaugaguagaaaacaucaugucuaaagggaagacauacgacccaccuauuuuauauauggcaaaucaaagagcugggaagaauuacuacuuagaaauaacuacacauacaugaucuguuauaugcaucccccuguaagaggagauucucuagguugaaaaaauaauuuucuggucucaauuuacccauuugagcucaacauuuccccgcucuagcucgugggcagaccaggccagcaggaaacaagauuugaguugaaaauccucuuuuaucugccaccuccaaccccuaagcccuugcucuucuguaagguaacaaauucuuaaaacgucaguccaaaauuacagacaugcauuuuuuggccacuuuugcucuuuucuuuauuuuugguguuuucuuucuauuugcaguuuuaacuaauuuauuacucgcagaagaagucaauauccuggaaaaaaacaaaaacaaaaaaagauugaacgaaauagccuaggcuaaaaaaacagauguagauucuguauuuaaagucauaucuaaucagagaaauuuggauuuaaaguaaguaaagguugacccccaaaaaauaugaaauauuuaccacuuuaagucaaaaacuacuuacaaugaagguccuaaaaugaaccuuuaauuugcaguuaucugacagauuucagcauaaugcuaagaagugaugacaagugagucccauuuguguaggaugagcaguguuugaagcacaacaauuagcuccagaagaaucacuucaaaacaagcaccuugcaaaguagcucagaaagcaucuuuuauuucuguccugaguuuacaggaccccagggcauuaggaagaguauaacuuuauuucauacauaaauagaaucuauuuaccacaaaaauaagacauucaaagauuguucuagaauauuucgauuugaucaaaaacauaauaauuuuuuuucagccuaucuuuagugaaaaccaucuguaagagucagugcugacuuugguuucuuuauuuguuacauagacugcuuugcaagacaacuugcaucuaaaacaaaagagguacuguauuguauacuugaaauuuacuaagagggcagaucuuaauguuuucacacacacacacacacacacacacaaagguaacuaugugaggugauguauguguuaacuagcuugaaugugaugaucauuucacaauguauaucaaaacauaauguaugcauuaaauguaugcaauuuuuauuugucaauuauaacccaauaaagcugaaaaaauauagaaaaaagaugagacaaaaaguaguaaacugaaauaaaacaaaagggggugguauagagaaaguuuacucaucuuucaacuuugacaguaguuauaaauggucccccaaaccucauuaucucagaaaagucgccacugaaaguuggaggcuuuguucuauacaacuuguaaguugcaugaugcauuuuuaacaccggccuacauugccccaagaucugaguccuugucuagucacuuuugagaugcuuaccguggugggaacuuccuugguagcuuccugguacacacgcuguuccuugaccaaguuccuggggaaauaacccacgacucccaucucguccuggccaucaccauaaaccuaagugcccagaagaauagcaaucaggaaaaagcugaugcugagugucuucugagaaacucgcaggcguccucuuugcugauagugagaaucauagcugccaauaccucccuuucacuccgggguccagggggcgcugcggcaaauccgaaguuuacuuggagcacuaaguuaacccgcaggaauugugcaucuacuguuuaguggcccagucuuauuucgcuacuuuagcaugacuuuauuuuacgcaaucuugugaguugccugaaaucuuuuuugaacccauaaauaaauauauaaagacaguacauuuuuuuaaaguacuguagacacuuauuuuaaaugaugcaaauuucucaguuuucaacaauucaaaugaacagacuuaaauggcuuuaaauuuaauccuucauuaauuuagaacuuaccuuuaggguugcagaugaggacagaaaaucaucccugcuucaucccuccccagggaccgccccuguauauuuuaacugaagaacgcugauucuuucgaauuaauuagggugcaaaguuuccuaaaagaauauugauacuuagacucacugccaacacacaugccuucuacuuggcaaaucuucucagacguuuucggauaagauucaaauucuuugggauguuuaagcccccauguauuugacucuuuuuuuaccaaaauaucacauuaaccuacauuugguuuuguuacgaaauugaucuuucuuucuuuaaaaugcaauagcaaauauaccugaauuuuugcauuuccaucuacaaucacuacaugguucuuaacaacuaguauuaagcauuaaaauagguugaagguagguaaucaaggaaagguuaagagcaauauucgucaauagguguuuaaauuaucuuacacugccagcccaaaauucuccagcuccauuuucuuuuaccagcuuugaguacacauagaucugcugcccuuuuuuaacguuaaugaaucuacaguccggggcauuauaaucuucuugagcacuagccagagaaauaguaucuggaagaaaaaaaauuuaaaugauuacauuuuaggcuccugaauuuuauaacaguaaaaggcaauguauauuagaaaaacuagaaaaucagagugacugauaauucccaguucauagcuggugucuauccaagagaaagaagacagccaagauauuaaagcugcaacaaaacucagccaagugaauucuccguaguaagauaccaaacaugcagaccagaagaaacaaagcugauaacauacacauuggagaagauucacuucaaaguauaauucgauuuuaugcuauuaguggauauauuuucaauuauguaauagaaagauaaugaaaagcauaaaaaaguccuuacagacacacucaucaucugcacagagcuucuuggaagcuagacgguccauaaauauuccaugcacagcacauacagccacaagacccgggaggaaaaguaacaauauucuugccaucuuccuuuuuucuguuuuaacuugaacu

SEQ ID NO: 13431 - RNA, 2898 nt, Homo sapiens
gcuccaagaggaaauuauaaacuuuuguugaggauauuuccauugccaggaaaauaaccugcucuuauauuagugaaauggauaaaagcuuggcuuuguuuuuauuuuuuaaaauuucguuuucaaggugaaaacaguauuaauuuuuuuccaguuuuuuuuaaguaucuuuucauuuuuauaguaaaaauacagggguguggaaucugugcaguuugcucucaauuuacguuggcauucggguuccuucuccuugugucugccuaaccccaacaugucuuagcagaaauuccuucuccuuacacauagcuuagguauuuuacauggaaaugauuaggauguuuggcacaguagugcacagccuugaaacgcagaaauaacugggacucuaugugagcuuaucuuuucaaaggagaacaaaucagggccugugcacugugaauccucuuaauccauuuuuauauauccagauaaaagcccagacaagcccugggggggauugucacgguuucguuuuuuuuuuucccgugaguuucagucugggcuugaguagaaagguccaucucugacaggauucccuaaggaaugagucaucccagcauuuucccuggagggaaugaaaugcauuuuuaccacccccagaaugugcccccuuagucuccucaguccuguaaugugaauucaccaggccuuaacuuuuccugucggagggaccgcccuccuuggagcccgauuaugcccuucccacgugaccauggguagugcugacucaggaugggggaugaauaucucuccucccguacccgaucccaggcagguaugaaugggccucuuucaugcuuucacccuuuagccucuucuguccccuuauuaauauuacuaaccauggaaccagacacuccccgaugagccuccaaggcccucccuggagcuuuucuugccugcucugcccugggauuagacaggacaaggccaaacaugugguuuugcccagggaccaagagaagcauguuagucuacauagcaugcuuuccuuccuuccacuguaauguuuguuauuaauacaguuugggguuugguuauucuuuuucgagcuucgaucauguuuaauucuaguaauauaaguauguagagcucuuagggcuuuggggaaaaagacacgccgguuucacuuagaaagucgauucuguugcugacaaugugcacucaggacaaacauugcuuguaucuuguggcucaaggauagaaacagcuacuuccugccccuuucccagauuggcccagggcaaggcccuguguugaugacuaauggacagguggcugucuucuccuccacgaaucccacaagaaagacaagggcacagcuagugaggauacaaaagcugcuggugagcucgcacuuaaauagagccugcuuccacuuaaccgugucuggggcuucuuggcugccuuccuugggaaguaggcggcccaguuggguuggcugugaucacagaccaggccugcacagcaucgaacugaagcuaugcagccugggaggaagaggcuacugagcaguggcaaaaauacagauuggacuuuuccgugccugcccaaaguccucuuugguuugcgggguagcagccacgucuguuuuccgcuguuuaagcagguauucucauuuaccaaaaaggcgucauagaaucccuuagaagugcacagcucuugugguaggguuauagucuugcugaaauuuaaaaccuucucuaauugcauccacauguuucaaaguguggucaauuuugugcuuccagcauuugaguuuucuccuuagcguccugaacagaugagagcuagggagucuaaaauuugaaguccaaaggagccccccuccacccccacaaagauuguaacaguucuccgaguccuugcucaaauccugacccuccauacggccuuuccugaauacuuauguucauauugauuucuccugaaauucuccauguagcaucuguauucuggauuacugaguuucacacacagucacaugcugauuuguuuguggggcgaauauuugguaaagaucaacaauucaaaacucuuaacuagggugauuauacuguagguggcaaggucuggaaaacccuucagaucacucuauacacaaaaagcuugacaugugaucaauggaaagugcauggcucagggugacccagauuaugccgcgggaaaaaauaaccucaagucuucaucugcaaccugaaaacaagaaggguauuuuucuuucucguguucauguccagcacgaguuugcagggcguguggcuccugauccacauggaggggacaguugccaucuugcauauugccacuuauugaccagagagaggcuucugcagggucucacaugaauaaagcuaaauacuuuggcccuaaaggugacacuucugcacaaaacucauuucgccaaacuaacuucuggucccugcaggaauaaauugccagugucuguuuuuuuuuuaaaaaaaaaaaaaaaaacaaaacacauucauaaacuucuggagaguggggacucagauucuauuucuuacaaaccuacuuucuucucuguagcuguggcucacaguagagauucaaugaguauuuugacaaagaaugucucuaaaucuaaaauaugcugugcccaauuagggaauuuuuaauaaacauucagggcgaccccuaguggcucuucagcgcagagaccauaaguuccuccccaggcaccuaauuauauguuaggacaaaaacuaugaaggaauacauacacaucuuacagugucgucagcccuuuuuacacuccucaagaacauaagagaucauuccuaaauacaccaucacaggaacaucacuuuccuguaaauuauuuuauccuaaaug

SEQ ID NO: 13432 - RNA, 439 nt, Homo sapiens
guugaagagugaagucaugagcaaauuauucaggcauuuacuguuaacauaguugauuccuuaagucagcuuuuaucugcauuacuagaaaugcaggauuugaaucaguggagaggaaaaacuggguaauuaaguuggcucuggaaggacuuagguuguaaaguuauuuucacagucucauagcugaagucaaaguaggaacuacccauuaauuuuucagugcaauuauguaagcaucaguguauuaagcaucuacuguguaccaggcaccagggacagagggaacaugauauucauagacuaagaggaggcagaccgcaaacaaacaauaucaggugauaaauggagagacuuagauaugguauggucaguagggaaguagacuguagaacuuugggguccugauucucugcuuucuauuagacagugcuaucaccau

SEQ ID NO: 13433 - RNA, 3030 nt, Homo sapiens
agguacaucugccgcaccuaccgggcgacccccgagucccggcccccuuuuggccgccccaucgcccucccacccugccaggcugaggagcugcggacgcgcugauuggcuccaggggaagcgggaggcgagaacaauggcccccuccccccguuaaaagggagcggcugccgggcccggggacagggacgcgcgugcagggcgcagagcugggccgagccgucgccggcgccacgcgagucccgcagccgccgcgcccgggcaaugggccgggggcacugagggccgccggggccgagcgcggaggggggaccgagccagugccgugcccucgggccgcgccaacaugccccgcggcuuccuggugaagcgcagcaagaaguccacgcccguuuccuaccggguccgcggcggcgaggacggcgaccgcgcacugcugcucucgcccagcugcgggggcgcccgcgccgagcccccggcgccgagcccgguccccgggccgcugccgccgccgccgcccgcggagcgcgcccaugcagcgcucgccgccgcgcuugccugcgcgccugggccgcagccacccccgcagggcccgcgggccgcgcacuucggcaaccccgaggcugcgcaccccgcgccgcucuacagucccacgcggcccgugagccgcgagcacgagaagcacaaguacuucgaacgcagcuucaaccugggcucgccggucucggccgaguccuuccccacgcccgccgcgcugcucggagggggcggcggcggcggcgcgagcggagcuggcggaggcggcaccugcggcggcgacccgcugcucuucgcgcccgccgagcucaagaugggcacggcguucucggcuggcgccgaggcggcccgcggcccgggccccggccccccacugcccccugccgccgcccugcggcccccgggaaagcggcccccgcccccuaccgccgcggagccgcccgccaaggcagucaaggccccgggcgccaagaagcccaaggccauccgcaagcugcacuucgaggacgaggugaccacgucgcccgugcuggggcucaagaucaaggagggcccgguggaggcgccgcggggccgcgcggggggcgcggcgcggccgcugggcgaguucaucugccagcugugcaaggaggaguacgccgacccguucgcgcuggcgcagcacaaaugcucgcgcaucgugcguguggaguaccgcugucccgagugcgccaaggucuucagcugcccggccaaccuggccucgcaccgccgcuggcacaaaccgcggcccgcgcccgccgccgcccgcgcgccggagccagaagcagcagccagggcugaggcgcgggaggcacccggcggcggcagcgaccgggacacgccgagccccggcggcguguccgagucgggcuccgaggacgggcucuacgagugccaucacugcgccaagaaguuccgccgccaggccuaccuacgcaagcaccugcuggcgcaccaccaggcgcugcaggccaagggcgcgccgcuagcgcccccggccgaggaccuacuggccuuguaccccgggcccgacgagaaggcgccccaggaggcggccggcgacggcgagggggccggcgugcugggccugagugcguccgccgagugccaccugugcccagugugcggagagucguucgccagcaagggcgcucaggagcgccaccugcgccugcugcacgccgcccagguguuccccugcaaguacugcccggccaccuucuacagcucgcccggccuuacgcggcacaucaacaagugccacccauccgaaaacagacaggugauccuccugcaggugcccgugcgcccggccugcuagagcgcgcccuccaccccggcccccgaacugugccuucgcuuggagacccacaaagagagugcgcccugcacuccccgaacccgaguccgcgcugggggagccucgcccccgcccccaccgggugaaagugucgucuccgcuucucucgguguggcgugacgguaaccccauacucuccuuuugacuccuuuuggaacccccacuuuuacguugugucccuccgccucccccauggcgcaacaggagucagucucuuucuguacaagggagaaaagcuguacgcguuugucucgugguuggaagccuccccuuggcggggagaagcuuuuuuucuugcuaguauucgcuguguucauggucuagaaaugcggucuggucucgccucgccuaccaaucucugcucucuauguauguagcguacggguuguuuugggugaaucuugaggaauaaaugccuuuauauuucacaggcuguaaauugaacuucccacacgauuagcuuuauuauggcuugugaacugcuggagucuggcuuuaccuuuuuguaugugaacaaaucaaauugcuuaaaaaagaguuuucuuuaguauagccacaaaugccuugaacuguugucugggauuguuuuguggggggagggaagggaguguuccgaagaugcuguaguaacugccucaguguuucacguaagacuuuuugguuugaucaucuuuguugagguaggacuaucaguucccucuaaauguauauguugauuuaugaguaauuguuauuuauucuuuauuuauuuauauuaauuaugaagauuaugauauuauuugauugcagauuuuuuuggcgcgcugcccccuccccacccugccacucuugacauuccacugugcguuuuagaagagagccuuuuucuaaagggaucugcuuaaaguuuuaacuuuuauaccuaucugagugaauuacagacaaccuaucauuuauucugcuucgaggguccccagggcccuuguacaaccgacagcucuuacuuuuaaaugcaaucucuuuucuacauacauuauuuucuuaauuguuagcuauuuauagaaagcuucaauagaacuguuucaacuguauaacuauuuacuauucaaauaaaauauuuucaaagucaaagu

SEQ ID NO: 13434 - RNA, 323070 nt, Homo sapiens
ggcggcggcggcggcggcagcagcggggcugggggcggcgaguggcccgcgcgacacgcgccggccucgacccuaugcuuugauucgcguggcgcaggcgccuacugccccgccggcggggcccgggcuuccugccgcgggauguucucccgaaggagccacggggaugugaagaaguccacccagaaggugcuggacccgaagaaggacgugcugacccgccugaagcaccugcgggcgcugcugggugaggcgcgcgccgggcgcgggggucggggcgccggguuaggggcaccugccgggagggcgcuccucugugcaggggucgguggcugggaggcuggggagggggaugggugggcguccgacccccuucccuggaucugggcuuggacccccggggcuuuguuuccagaaagccgcagccuggcccucgggcacugcucccgucgcccucgaguuaaacuuagcccagauucucgcugggcgccugcgcucccggagaaccuggaggccgggcacagagguaccuguccccuguccucccagcaagugaacuggaucccaaguggucaucacgugcacacauugaacugucaccucccccuuucauuuuuaaaauuuuauuuuugagucugagacccuaaguagaccgagaccccaagugaacccagcacagaccuaauugggcucucaucucugucaucccccuuuuaaauuuuauuuuuacuuuugagugugagacccccauauagaccgagauuccaggcgaucccagcacagauuugucaucugucuucccaugcugcuuuuuaaauuuaauuuuuauuuugggucuggcugcuucaguuucuuuguguccuuggugugaaggggccuucucuuccugcuuggagagaggggugguuuucuuggguucagggaggcugcuucuccuuuauuaccggcaugacagugaugcugucugccaccuucugguuuauggccugccagguggagguucugaggagcucaggugggcuuggaguugaccugugaugaagcucgccccugugggugugagguguccacaaggcuuccugucaccugcugcaugugaucuguagcugguucgccuaggcuauguuuuguuuucuguauuuuuuuacauccuaagucuuaacuuuucuuugggaugaaaacaccuuugcuaucuauagacacacuuaccuguguauuugguggcgaaggaaagaacaccuuauguuucuuccaggugucuuuuagucccaaaauucacaaaaaucgccuagugcuaaugugucugucacuugaaagaauauugcauaaaaugauuuaacgugugaagauuuuaaauaaagaucuuguucaugagaucagaaguugcugauuauuucuauuuauauucuaccucugagggggagaagaacccaagccaaaccaaaccacaccugauuuugccaagugaaguuauucacaaucucacauaccuugagguuacacugacuuguucaguuugaaaugaaauguaaauuaguugcuguuacagggauucguuuucaagacuuuugagagugaaguguggagagugaaguguggcguucuugguaaacugaauuuucuacuuccuguagauaccaugcacgcacagguugcacaauacacagguugcauuguguggaguuccugguagugacugauuaacaccuacugcagggacauuuuugauaaaggagaguugagcuguguuuuaaagcguuugauacuuugagccuuuuucugugcuuuagcguuuaaauuuuuguucuguccaggucugcaagauuaaguuggcuacauuuuauaaaggcagaaucaaguaaaccuagaucagguuauuucuuagcacacaguacauuguucccauucugagaaaguugauucuuuucaaguuuguaaaauuguaguuucacucuaagguguaggucuuauuuuagggaacuuucuuuuaucauuucacugaacucaucaugaccucaguuuuguaacauggagagguucuuuuauauuuccuuagguguauguuuuuuguugauauacuuacuaguggaguggcccaguuugcuuuguuuauuacugugaucuuuguagggacuagauuuuuguaaaaugugucugaggaauucuagucauaauauuuaauguaaacuuucacuugcuccugugauuuauuaaagacuuaaaaaguaguacguaaugcacuaguuccuaccuaaucacauauucuauuucauugcuacucgaaaaaaagucuacuuagaaaacaaaggccucuugaacugaaaguuaggaauuaagccaagauuaaggaaacuauuugaaggaaaugaauaguaauuacuauuguauuuuuauguguguauuuauauaacacuuuugcuuuucauauauuuuaucuucaagugauaauaaaguuuuuuuuuaaguaugcaaagauuaugccacuuacuuggguauuugcagccugucccugccgccugcagcuucaugacuugagcuaguuacguagccugucucugaaccucgguuucuuugcucuguaaaauggguaugguaauguuugcuuuuuaaaggauuauugugaguaugaugaauaaaugacuucagcuugaaguaggccuuuaacaguuucuuucccauuacauaucucccaccauuaauaggauaggaccaguauuuugauagguaauuuuucuccgucuuucuuauuuuugauaauagugaugaauuuguucucuuuuccuaaaaaguagucuguauuuaaaacaacugggugagaaacauaaaauuagcuguggaaguagaguauuucuuaguaucaugguaauaacuccaauuuggauguagauacuuucaccuggcuauagacuggucugguaugauuaacuuuauuuuacagagggguaagcugaggcacaggcaggcuugacacguaucaagccauguagcagacgguuuacuuauguuagaggaagaacgaagagcuguuagguccugugacuuccaguucuuccuacacuguugacaaaacaaaaaccaaaaaacccuguguauuaccauauugcuccagcaaagauuccaugucuuuuuuuuaacaggaucuuugcucuguuguccacguuggaguacaguaguuugaccuugccucaacugcugcagccuuggccucccuggcucgaguaaucucccaccucagccccuggaguagcuggggcuacaggcauguaccaccacacuaggcucauuuuuguauuuuuuuuuuuugagauggagucucacucuguuacccacgcuggagugcaguggugccgucuuggcucacugcaaccuccgccuccugggcucaagcaauucucaugccucagccuccugaguggcugggauuacagguguguaccaccaugccuggcuaauuuuuguauuuuuaguagagacagggguucaccguguuggccaggcuggucuugaacuccuggcuucaggugaucugcccgacucggccucccaaagagcugggauuacaggugugagccaccauguccggccagauuuuuguauuuuuuguagaagacgggguuuugccauguugcccaggcuggucuugagcucacagacucaaacgauccucccacuucagccucccaaagugcugggcuuacaggcauaagccaccaugccuggccagauucuaauuaaaaguugagugcuuacuaugaguccuaaauuaggauauagaacuggcauugauguagugagaagaauagauacaaaauaauaguaaauuuaugguguguuauguaauuagauggucagguauaugguagaauccauuauaggauuucagagaacaaaagagauaauuaagaaugucauaaaaauaggggcaucuuuaaggagauuuguaguagucuguucucacucugcuaauaaagacauaccugagacuggguaauuuauaaaggaaggagguuuaauugacucacaguuccacaugccucgggaggccucacaaucauggcagaaggugaaugagaagcaaagucaugucuuacaugguggcaggcaagagagcuugugcaggggaaaucccauuuauaaaaccaucagaucuugugagauucauucacuaccaugagaacaguaugggggaagccacccucaugauucaauuaucuccacccggcccuugacauauggggauuauuacaauuccaggugagauuuggauggggacacagccaaaucauaucaacguuuuacuuacgcuggguuccaaagaaugguuagacuaguucuguccaauagagauauaauguaagccacaugugcaauuuuaaucuuuuuuagugaccacauguuaaaaaguaaaaagaaucaggugaaauuaauuuuaauagugcauuuuauuuaacuccauguauuuaauauauauuauaucugcagguaaucaauauaaaaugcuaucaguauuuuuuacaucuuuuuuucauaugaaguuuuugaaauucaguguauauuguauacuuacagcacauaucaguucacacuagcuguuuuucaagugcucauuagccauaugucacuaguggcugcacacuggacauagcaagguuagaaucugggaaaguagaggggaaggucaauuacaaccaggggaagauggaagagcugguggcagaaguaacaugacagugaugguaaguaacauggcgaggugugguguugggcacugaggacccuugcccagaggauguccccaguguccugcauaggccagggguaggguagguuccuggggaaggaguggaacaguagccugacaagcagaagcugaggcuggcugggggaucagaagccagacucaggucaaaucaagugaccuggguuuggaccagagaguagagaaccgucucucacaaaugcuguauauacaaacagagcaaaacauagcauugucguauaguuccuuuugugcauauguugcucauguugcucuagguaggaacaaauugacuuacaguuguaacuguugucuuuauuuuaucauuagcauuuuugauguuuuguuccucucauuuuuaaguacaaacauuuguugagaccauaucccauaauuuagcuuaccauuuccuggauugugaaauuuuguucuuuucucuccuuccuucuuuccuuuuuuuucuuccuucccuuuuccugauagaaguaauacugcaguaaacaucuugagaagcagcuuuuucgauauuuccuuagauuuuauugaaguaagauugcuggguuugaacauucgaugacuuguuucacagugcuuuucuaaguguugcuccauuggcccugcuagcagcaaggauugaggcugccauuuucacuguagucugacuaccaauaaacaccuuuuuauaauuugauaauuggugguagguauuugggauaauaggagugucaucuacagagugagaacaauugggaagggggaagggauccugggcaaggacggggaagaugaguuugguguucuacauguugaguuuaagaaaaggcaagauccaaguggcgugucugggggguugugggacaugggaucuggaccuuaaugaaaugauagaaugcuaucauauauuuaguuuuauugguuauuaucaucaugacaucauugaaucuuuuugcaacugugacaaaggaaguguuccuauccccagcugaggaaacugaagcucagugagaauagcuacuugucugccagcaagugggaaagcugagacuuaucugauuaugaaggccauguuaugcuucugcuaguuaucugauucaaaaggaaauuuacauaucagaaaauguauuuaucuaguagaaugaaugauaacauagaaacaaaaucacaacaguuuuugcaugccucccagaaauguugcugugauauuggccucucucuuucugguccauuuuucugcauuuuucuagggagacuugggauuaucauauuugauuugagcaugggcagacgauaaacaaucuccuccgguguuuuaguguucauugccuucccuguaaccuuggcaggccuagcaggugauaaauauuugcguggacauuaaugccacguggacauucuacaacuagaacaaagcugggagguguaauuucaaacucuucaggcagucuuaguauggucucucucuguugaccuuauuugguacaaagugauuuugucguaaugcuuccuuugcuguuuuuucaucaauuacauuuauaaccucuagaauguaaauggaacuuuggacacguauauguagcacaaauacaccauccaucccucuaaggcuugagguugucuagacuucugaugugagaaaagugaacacaggguaaauguccaaacucguuuaagauaacugaaaaagguuggcuuccaucuuuuacucugagaagggagauaauugguaggucuagaauauuuugcuguaaacuuuuauaauuuggauuuuuauuuuguaaguacuuuauuuguggacaggcauaauacuuuuacuagguauguagaguacugauuuuugguuaccaaacgggguaucaauauaaaacuauagagaauuuuuuauuuagaaaaaaccuuggcggggugcgguggcucacgccuauaaucccaacacuuugggaggccgaggugggcagaucacgaggucaggaguugaaggccagccuggccaacauggugaaacaccgucucuaguaaaaauacaaaaauuagccaggggugguugcgcgugccuguaaucccagcugcucgggaggcugaggcaggagaacugcuugaaucugggagguggagguugcagugagcagagaucgcaccacugcacuccagccuaggcaacagaguaagacucucaaaaacaaaacaaaacaaaacaaaacaacaacaacaacaaaacuugacuuucaaaauagcaaguuguuucaauuugaauuuuaaaaauuuuuuaaaagaaggcauauaaauuauuguucugugaaauuaagaauaacgaauauaagguauuaaacaacuauucuuguacuugaauuaaaaaaaaaucaagcugggugcaauugcucauggcuguaaucccaacacuuugcuaggguuaagugagaggaucagcccagaaguucaguacuagccugggcaauauagugagaccccuucucuacaaaaaaaaugaagaaauuagcuggguaugguugcaugugcuguggucccagcuccucgggaggcugaggcuggaggaucacuugggcccagaaggucaaggcuacagugaaccuugaucaugccacugcacuccagcuuaggugacagagcaagacccuguaucaacaacaacaaaaaucaagucacaaacauuguuuuaaagacugugugagugcaugccugauauaaguaagucuguguuuggauguuaauaaggcacaagcccaggauuuaugguuugguaggagaaauagccauguaaacaaugaaauuuaccgugaggguuuugaguggcacagaggagugugguggaaccauagaggugggcacaggugcagaggaggaacagcagcaaagccuccuggagacaccagccagugcuucuuuagggagcuuaggucugagguagguuuugaauaauggauaaaggauuuuaccagauggacaaguuggggaugaggguucuguagagagaggagcuugugcaaagguaaugguguguagcaccauggaguuaagugcacaauggcuuuuauccuguggcguaaguagauguugggacuccagugaaggguuuuaagcagaagaggagccacauccuaucucuucccauuuagugucugagaaucccauucuccucugagauuugaaacauagaugcugggagagagagagcucccuuccuuuggauugcaagcccugaagauauagucugggcugcuggcauuuguuuuucccaccauguggggagcaugugccuuaaauugaauccuacucucagagggaaugacaauagagagguggagagugagaggaagcccaugaguccugaguuuggccaugucuuugccaggaccuucuugagcugcucaguugcaggaacugguaacauguuaacuagcuugagucauauuucugggucuuggaguugaaagaguaccuaacauggagguguuuguguauauggagauuugacuuuuauauuuuuuuagaacuggaggaauuugaguuuauauaggagaaguagcuaaugaagagcaaaacugaagaaacgggggauaauaaugcagaacggugugaucugcagugagacugagagccuggggugggagaucaggcuuaacaagagggacaccucuuccucuaaggccacuugaaagaagcaggaauggggugcuagaugauggggacauggagggaguucucacaccauggcuucuguacccucugugaagguagcaggugaagucauuugcugagccaguuuucuuacucauguggugauaggaacuugaauaugucuugcucccucuucugugccacauaaccucuuaaaaaaaggacaucuguuaucuggaaggcuuuguuuuuuuuccuuagggagugacugaaaaaugcauuuaacguuuauguuaaauauucaucaagaaggcggaaaaucuauauagaaugaggccaguuuaaguagcacagauguugugugcccuuccacucaaugaacaugugcccuagaguggaccuaaggugggacauaggaacccgccaugucguccauagucuucuuuccuuuaugccuuucauugugagaacaucccccugcuggguaugacuccagaguuaaaggaucauuuuaauuuuuucuacuuuugccuuucuugugacuuaaccgcauauaaaauguaacucuguugauaucucauguucauguaccaguuuacacuuuugcaaaaugucuucucauagucucauuuaaucaaauuacuaccuuaagcaaucaguucauauuaauuauaaaagaaauuuauuaaauaucuauuugugaauguauuuuagguggucucuaauacagguuaucuuuacauaguuaaagccuccuggaugugucaauacaaauagcauuuucaggugagaggauccagaauccgcuagcaaaaucuagcaauugagaauuugauaaaguuaaaauaggaauuuuagagagauuaugucauuuaaaggauuuaccauauagauucuuaguagauuuguuucugaguucauucugaauccucaauucaggguuuuagccuuaauuuucagaaaagugauguuucauaaccauuuuaugucuuuuauguuguuuuagaaacugaagccacagcuauuuuaaaaauaguuguaaucucuuuuuuuuuuugagauggagucuugguuugucacgcaggcuggaguucaguggugcaauuucgccucacugcaaccucugccuccuggguugaagugauucucaugccucagccaccugaguagcugggaucacaggcuugugccaccaugccuggcuaauuuuuguguuuuuaguagagacaagguuuugccacguuggcuaugcuggucuugaaauccucgccuccagugauuaguccgccucggccucccaaacugcugggauuacaggccugagccaccaugccuggacaaaguaguaaucaaauuuugauauuacaauuaugguuaaguuaaaaaaaucccuuuugauaaaguucaggagcccauggauauuguguuugauuucaggugaugacacauauucauugaaccuuaaccaugccugaaaguacaagcaugguacuugugacauugcuugugccugacuaugagagccauaagaaugugcugcuucuccuguuguggggagcaugauugacugauggccccagcugcugcucccugaaucuaccaauuuugagccaaagcuuaguuucccuugggaagcucuuagcccauuacugagcacugcaggaguauuaaugcugccuguuccugcacacuucagaugccucugaagggccacuuuggcuugaggacuuccuauuggccuaagaccuucucagaccuauguugaagucugacacuuccuacucaaccuuccuucauuccccuucuccuucccaggggucagaccugcaucguggucuaaauccucucccugccuucaccagcuccuucucauuuauccuucaugggcauuuaccccaauaaaucucuugcaugucuaauccugucuuggccucuacuucucagagaacccacacuaaucuaccauccauuuccuggaugguguuguccauccugccaucuacaguuuuuccaggagacauugccaacacuuuuuaucuuccaugugggcuuucuucauccucuugcccugaauguaucucuucucagaauucccacagcacuuuguagcuuuuguuugguauuaauggccuuuggcuuugcaccaugcuucuuuucuuuucuuucuuucuuucuuuuuuuuuuuuuauugagauggagucuugcucugucgcccaggcuagagugcaguggugcgaucuuggcucacugcaaccucugccucccagguucaagcgauucuccugccucagccucccgaguagcuaggauuacaaacaccugccgccgcgccuggcuaauuuuuguauuuuuaguagagacgggguuucaccaucuuggccaggcuggucucgaacuccugaccuugugauccacccacuucagccucccagagugcugggauuacaggugucagccacugcgccuggccgcaccaugcuuauuuauuuauuuauucuuugagaugaaguccugcucugucgcccaggcuggagugcaguggcacaaucuccacucacugcaaccuucaccucccccguucuagcaauucuccugccucagccucuccaguagcugggauuacaggcaugugccggcuaauuuuuuuguauuacuaguagagaugggguuucaccauguuggccaggcucuucuugaacuccugaccucgugaucugcccgccuuggccucccaaagugcugggauuacaggcgugagccaccgcgcccggcccacaccauguuuauuuguguucaugccuuauccguguucuuucccacuaaaugauaagugcauagagaaccugagcagcuucuuuuucaucuugauuucuguugguaacuuacucccuuauuucaauaauaauaauauuuauuuaguacuuuuuaugugcugaacagugcccuaaauauuucuacauuuauuaaugcauuuaaucugccccaaagagauagggaauaucauuaucccuauuuuacacaugagauacagacagguuaagaaccuuguucaagguuacacauccaaugaguggcagaaucagcauuugaacccagggagcuggcucgaguuccuuuauuuauucagcaguuauauguccaacacaaacuacguggcagacauugugcauagcacuaggcauaccagagcuugcaaucuuaguuuagaauaaguaacuuuuuaaaaaaaacccacaacaaccaaaaaugugauuucagaauagcuagaucuaagucuacuggggaguugagcugguccgucauggcuuaaacaauuccugaaagccuuccugccccaaaggcuuguuuucaucagucagaauuucccaacauuaaauuaaugauucaagaucaugaauuaagaguggugguuucucccaaaugaauucucuaaucuccuuugcuuacacacauucauuaucagaccaaucccuuggauucuaaggggaauagauauaagaaaggacuauuucugugaaccaaagggagaagagauugguguucguaaaccuugaugggguucgggggaaagaggggcaguaaugcuggagagcuguuggcaagggcaggcuuaggcaaauuccccagauagucuuucaugagaacaaaauuggagagacauuauuguaaaguuuaaauuuaugaaaaccaaaacugagucacauuccccaccccaucccccaaucaaagaccuguuacagcuagugaggaaauuguuuuuuuacauuucaacuuuuauuuuagguacaggggguacaugugcagguuuguuacguggguauguugugugaugcugagauuugggguauggaucccgucauccacauagugagcauagugcccaauagguuguuuuucaacucauaccccacucccuccauccccccucuagguaguguacggugucucuuauugccauguccccuugugcuugguguuuagcucucaauuacaagugagaacauaugguauuugguuuucaguuccugcauuaauucgcuuagguuuauggccuccagcugcauucacguugcuguagaagacaugauuucauucuuuuuuauggcuguguaguauuccaugguguauauguaccacauuuucuuuauccaauccaccacuaaugggcaguuagguugauuccauguuuuucuguugugaaucgcauggcaaugaacauaugagugcauguguuuuuuuugguagaaugauuuauuuuuccuuuggguauauacccaguaauggaauugcugggucaaaugguaacucuguuuuaaguucuuugagaaacucaaaacugcuuuccacauuggcugagcuaauuuacauucccaccaacaguguauaaguguucccuuuucuccacagccucaccagcaucugucauuuuuuuuaacuauuuaauaaccauucugacuggugugagaugguaucucauugugguuuugauuugcauuucuuugaugauuagugaugaugagcacuuuuuuauauguuuguuggccgcuuguaugucuucuuuugugacauaucuguucaugucuuugcccauuuuuuaaaugggguuauuuggaaaaauuuuuaaaugaaaucuuugauaguguuuucagaacugcauggaagagaggggaacugaagacauacauugcuucuuuacaacuucuguuagggauuaccguguuuuauuucugucuggucauauuccugguguaaacagugcagacucucucucgauuccauggacucuauaguaucuaauaagaugaggaugcauuuggccaguuaggcuugacgugguauagcuuaugcugaacuccuggaguggaaguaaaauauccucuagucuuucucaacaugugucugugucuuugucugugugugucauauugcaaauauuuauuuuggaaagaauuguuccauuucucuuucccugcuccuaaaauaaauaaauauagaaacagacacaucaccuuugaaguaaaaaguaaauaaugaacuggaaaaauauuugaaauuuauaagaggagaaauaguuacauacauaauacauaaaaaacguguaauuaaccagaaaaauugugauaaauaaauguucaaaauauauguauauguaaauugcaaauggacaaaugccaagacccauaagaauguuuucaguguuuauuccucacuaguaaucuaaauauauaaacuuagagauuaaaauauauucauccauuauauuagcaaauuugcuguugucuuuuuucucugaugauaguauacuguguaagcugucuccauuuuugauaggacuguaacuuggaacaaucuuucugaaaagucauuuguuaauacagaucaaugaucuuugaaauguauaucccauuugacccaguuuccucuuucgcaaaagccuauucuaccaucaagaagugcuuugcagcauuguuugaauguuaauuuuuuuuauugaugugaaauucacauaacauaaaauuaaucauuuuagaccaggcacgguagcucacgccuguaaucccagcacuuugggaggcugaggugggcagaucaccugaggucaggaguuugaggccagccugaccaacaugguaaaacuaaaaauacaaaauacucuacuaaaaauacaaaaauaagucaggcgugguggugggugccuguaaucccagcuacuugggaggcugaggcaggagaaucacuugaacccgggauauggagguugcagugagccaagaucgugccaccacacuccagucuggugacagagcgagacuccaucucaaacaaaacaaaacaaagaaaccaaaaaccaaaaaccuugaacccaggagguggaggaugcagugagccgagauugagccacugcacuccagccuggacgacagagugagacucugucucaaaaaaaaaaaaaaaucauuuaaaaguaaacaauucaguggugcuuaauacauuaacagcauuuugcaacugcuaccucuaucuucuuccaaaacauuuucaucaccccuggaaaacuaaccauuaagcauucacugcuuauucccuccucuccccagcucuugacagccaccuguauguauauguuuaaccagacuaggcuuuuuuuuuucuuuucuuaauuauucugcuccaccaggaggguaguauauguugaguacauuuguauuuguaauucuuaggacuuuuagguugcaaguggcagaaacccaugccaaagaggauuuaaugacauacguaacuaaacagucuaagggagcguuuggcuuuagagaugacuguccacagggauguauguggucaggguacuuacccagucucauauccacucucuuuucccaccucccaacuugguggaaaauugucucuaccuuugguuccguguuuuuuguuuucugugcuucugcuucauucucaggccaacucugccagguacaggugugguggucucuagcauugccagccugacauguccuggcagcuaguaacccuugagaggaguguggccacuccccuagggccuguacccauuccuguaccaaucgcugggugagggagaugggguacugugauuggucagccuggaucacuuguccuguuccuagagauagaaccucauucuggcuccugucuuuccgagaaaguagaggaaaggcauucuggcacauuaccucccacaacagaacugcuuauagcucugcccacgcccauuuguaccacaugacauucauugacuuuugugcuaauaaucauaaaacauugagcaaaccuuagaugacauucuguaaauucuauuuaagauuaugggagucauauuugaggauuauuuuucuauuuuuuuaauuaaaaaauuuuuuuugagauggaggucucacucugucacccaggcuggagugcaguggugugaucacagcucacugcagccuugcucucccaggcucaagugagaggauuauuuuucuaguuugauggaaguaaagcguugcccuuuuaacaaaugggauugaccacucuuuaagucuacauagcuuagacuguuuccacuguuuuuaaagucauuccacauauagugacugagugucugcuauuugcagaugaagcccuagcacuuaugggacuuucauucuauuaggguggauggacaauaaauaacaggcugggugcaguggcucaugccuguaauccuaguacuuugugaggcccaggcagguggauugcuugaggccaggaguucaagaccaaccuggccaacacagugagaccccaucucuaaaaaucaagaacaaaaaaaccaaauaauaaauauaugauacaauuucagguaaugaugauagaaaaauuaagcuugauaaggguauguguaugcuuauuuagauauuggggugagggaaggccucucugaagggagguuuggacugagaccuggguuaagcaagggagcagcuuugugauuauuuuuggggaauaguguucuaagcagaaggaacaguaaguaccaggaucugagucauaaauagacuggaaaucucauggaagucaauagggguggagggguggaggauagaaggaacugggaaaggagcgggggugggagaggggaaauagggauaagaugguguggaacuuuggcaucccaguaaggacuugggauguuacucuaaguaagauaagauggggcacuccagugaagcaaagagcagaggagugaucugaacugaccuuuagguguaaaggaaucaaugugguucccucauagagacuacacuugcuugguuagcuugccagagauagguuuucugaccacaagcuuuguaacaaagcuuucuuuggcuuacuuuauaaaaggucagaucuuuggcccaaaaaccgaccagugacuggaggcagacaagagaagagggaagagagagaaagaagugccagagaagaggaaugaguggcuguggaaucuguagcaagcaaagguguuaaggaagauggggacaggcagccugugucccuccuuacugcagcagcgaguagugaugagaagacaggacggaaacacuuuguggccagugggacaggaaagcuggaguacauugggccauguaaugggcccacacagcggccugagcuuguaacaauauggagacgggcuugcuguuauccccaaaucuacugacaggcagagagcaggcauauuaaaaagugcccuugaugcugacaaaaaaaaaauggagaucugucaguggcuggagaagaaugagaccagaaaaauguugaugggucaguacaacaacaauuuaauaugaaugguugcaaaggcagcaaacacugcagauuggcuccacaucagauauccacccaaauuaggaccccaguugugcuuuauguuggucuuuucucaauggaaagaccugagggaaucuuaaucuuuggcucaguguuaauugcaaagauguaauucuaugaaccaguguugcuaacugaaccuuaugucuuacucagaaagguggcugugguguuucaaaauaugacaguauuagguuagcuacauacaggaggacaaucauuuguauucuuccagagacaucauuucugagcauaaaccaggucuuuagcacuuuuauagugugcuaugaagaagcuucuguucugucaguugacagucagucagcgucagguuuaagcacaacaaggaaagguugacucauauggacuaaggcucccaggucuugggaaugggucucauugugacuggaaauuucaucacaucuuugcauucaaaagugucaaacauuugcucaugccuacucagugcuagcugcugaauggcuggacagagaaaugucuuucugcccaguucuauuauuuuuuauccuuuucagugaaugaugucuagagaaacacaaaaacagcaaagcuucuccagauaacuaggucauucuaaggcauuauguaccauguaugugcuguuacagaaggaguaauuuaaaaguuggauagagaaaauuuaagucauuugcuguuuuuuacaacauuuuagaauugguaaagauacucuuuuauauauuguuugggucuuaagauuucuucaaaguugaaaaguaagacagguuuggaaaaaaguauggccuggugucaugauugaugaguuuuuugcaguaaauauucaggcuuugaaaaaaaucccuuucucgaacgcccuggaaguaccccccaaaacagcuuuauagcuuuuucugguucuacaauuuuacauacucauuauaaacauuuggauaauaugaauauaugaaaaauaauuuagguaucaagggguucucaaauucugcaguccccugccaagcauuacugaaaucccggugaacgugcuuuccaggcuggcucuugcuugggugcauuccuuucucucucucuucccugcaccugccucgcuuacacacacaaacacgguuuuacaugaauagucaucugcauggucuaacacuguguuuuugacuuaaagccuuggauauuuuuccacaucaguaagugaagaauuacauaagacuucaauggcuguaguguguuccacuggacuccuauaacaaaauucccuaucacccauccuucaggucaugaguuucaggccuucacaugcuguuagcagauugugugccugugagugacugcccagugaccagaagggccuucguuuucuuguguuagggacacagcagagaugacaauauuggaggcugcucacaagcugggauaauaugaugauuuccuggagguaaagaggguuccuuggggaaagccacuucagucuuuacugaguuaauuucacagaaaugccaccauuuugaacugucuaggaggaaggucauuccaccugcaaacuggcucugguguacuuuuuaaacaaaccaacuucuggguguacuuuuguauuuaauaacuauuaaguucugugacuuguaccauaucucuccuguguucuuuuuguuuuacagcaaaauaaaacaaaauagauuuccaggcaugcuucccuuaaccuccucccucacuuuuuuuuuuuuaaaguuacgguaucuuuuuugaaauuuuuucauuuuuuuugagacaacgucuagcucuguugcccaggcuggagugcaguggcucaaucauggcucacugcaaccuccacaucccaggcucaagccauccucucaucucagccucccaaguaguugggacuacaggcacacgccaccaugucccgcuaaccuuuguauuuuuuguagagaugggguuucaccauguuaccuaggcuggucuugaacucugggcucaagugaucugcaggccucagccucccaaaguacuaggauuacaggugugagccaccgugcccggccaacuuucuauuaguauuacacuuaauugggugaacaguaugggagccugacugucuggguucgagucuuggcagugaccuacccuuucuaguggggguaagaaugguacccaccauccugugguuguuggagguugagucaauguauacaaagcuguuuugugagcuguuauuacuguuaaucauaauuauuugacaugagacauuauucgacagcuguaaacacucuccucaucacuuuccugccuccuuaguuagagggguggaggugacuacagcuccuaggcuguagucauuuuauuucugucuccaacuuuuccccucaggagcgauuuugauuauaauguaggcuagcuccaauucagaucaagaaaaggagguccaagugugcauugacuuuaaaaugucuaaugaaacuugauuccugauagauaaauauauuaaaauguaauauaacucacauuugauuuggauaucaguuucuauaguguguuuuauuauauugguauuugauaucuguuaaaaacaaaguuuuagaauccuguauuugagaaacgugugucaaaaauguuaaguaaaaauagcucuacuuuuaaaaacuuuaacacuaaguauuuggacuauaucuuuauacagaauuacuuuuacacaaggacuaucacuccuggauaauggaguguuacuauuuaucugauuucuaagaauuugauguucuacaucugguuuacuuuauaggaauaaagaaaugaaaacaauaugcuuucagaaaugaaguaggauuaauauuauaauuucugugaucauuucaguugacacuaguguuuguuuccuguuggaauuggcaaauuuuauuucagcugucugccuacaaggauauuuuugguuguaaguaacaaaaaacucaaauauaagcaaguaauaagaauuucuuucuccuauaaaaagaggucccaaggcagggaggccccagaguuggcuaauucaugaguucggugauguugacaguccagaugcuuuccaccucuuggcuuugcuauccuuaguguggcagguuuguccucaggguggcaaaaugcccacagccauugcacccagauagaaugauauccaaaggcaggaaaaaaaggcacacuucuuccuuaaaaucaguaaagcuuuucucagcuaucuucaucagacuuucuguuguuuuguauugaucagcauugggucacaggcuugagucacuggcaaggagcauguugccaccauaauuggcucagcaguaucagguccucccucuggggcugcgaacaggccagguuccgagaggggcacugcuuuguggaggaggagaucccugagcaaauggaggcucuauuaggaagagggagggucuguuugugguuggugggugaggugaaggagcuggagagaaagcaacagugucugcuccaggcugcucucaguuuuuaguuuaaaauacuaugaagaaugcuuguggaaauaaauggucaguuaugauaaauuuuugaauauauauuuauggaaaauuuuuuuauaauuuaaacagguauguacaacauggcuguaauuguauguaagaaacaaaccugucaguggagcuaaaagaugacuuuguuucauuuccuauggucguagucccuuuguguuccuauaaaggaauaauggguaauuuauaaagaaaagaaguuuauuuggcucaugguuuugcaggcuauacaagaagcauggcaccagcaucuuccucuuuugagggccuuaggaagcuuccauucaugguagaaggcaaaggggagugggcgucacaugauaagagagaggagguggugccagccucuuuguaacaaucaguuuucaugggaacuaauagagaacucagucauuacuguaaggacagcaccaggauguucaugaggaauccacccccaugauccauaugucuuccaccaggccccaccuccaauacuggggaucagauuucaacaagagauuuggaggggacaaauauccaaacuauaucacuuggaauaggaauauacacuuuaggccccaccauacauccagaaguuuuaugucaggauucuaggcuccccuuccuucugauggaccaggcuaguggugcuuggacacagauuacauggguaucugcuauuggcccuggagagaagugaaaauuggccauuggauuagcgguguggaacuccuuagcacugugucggggaguggugucaaagccugauuggacuggaugcuuuuguugggugggugauuuaagguguuuguuuuauuauacaucauaaauuauguauauacaaaacugguuuuuuucacauggauuaaauauuuaauacaaaauuguaaaaaauccuuuguaucccguacauggccugugcucugauaaauacuuucaauugaaucagguugaaacugagacugggguuuuauugugugaauacguuagagggagaaagaggcagagggguugaaggacagugaaaugacugacuaaaaagaggaacuguggaaguuaaauugagaaagaagggaagugaggacuugaggggcaucagagauagugacaagguggugggguuauuggauucaaggacccaguaagguugaagaguuguuggacuuaggguuccagaaggagugggcgggaaggauaagaaauagcgggugacgagagaguggauuucuugaaacugaggcuugcaggugggaagauuguaaguaaccaucaggucuaggaucuggcugugggugugggcggcagagguaggguagaggacaaccucauuagaaaugggggagucaggcaucauauauauaaauguugaaaccaccaggagugaagacagugcuaguaauauacugaaagacagucgggcccuggaaucuucgggagagugucuugggaugugggaaauauugugcaacuccagucagugaaaguuggcacagauguaguuggagguagauggugugagcagcagaggagcacucugugugugagggaaggaccagaauggucuggagauugcaguggggagcaagggggccaccuaucucaucuuaggccuggugguaugugaguguaggaggaagacaaaagccuuaccaggcagacugcaaggaagcagugugcugaggggacuuccagguuucagguacagcugaaaggaaacagccuuuacagguggcauagaagacggaauuuggugagcuuuauuggauauagugggugggaggguagggugaggaagcuagggugagauuagugaugcccagagcugugugggggugacagucagagaugaagaucaugugggaauuggauuucccaggagauggauggaaaccugagugcaaggccugaugggauaucuccugauguguaccuaggggguggucaaugauuacuucuaauuauagucuccuuacugaguuugguuucuuaggcagcucaugguagcuagguaaggaggagggaauggggggucuugcaaggagcaaggggaggaucucccaucacucugguggggugcuguguauuaaaggaggggccaggguuaucuugaguauguuauuacuuaaguucuggaugacuucaggaguaauuccauaucacauguuuccagugauguuuaugcuaaagugggugcagauugaaaguauaauacuucagagaauuuuucugaaauacgaaaucuugaugauauuagacaaguguacuuguagaauacacuuaugucuuuugguucauaaagcuuugcagaaauucuauaaauaaccuuagacugaaaaagauaugacagagaugagggggguaguggacagggaagguuuggggaagggugagugagguuagggguggauuuucuugaagcagaaaauccaggaagggauuugcugcugguauuucgguuugugggauggaacucagaugacaggccaggaacugagggaaccucugcccugagcugcuggcugaaucugcaggaggagugagcucccuaacugagaguguuuauguuaauuuucuuuaauuuuugaaacuccuuguaacaauuguauuaagagucuuuuuuugugaucucuaccaauuuuccucacuuuaauugagaggaggaaauugcgggccugaggacauauuguauuuuuuuauuuuuaucuuuuugagacggagucucgcccugucaccaggcuggugugcaguggcgcgaucucggcucacugcaaccuccgccucccggguucaagugauucuccugccucagccucccaaggagaugggauuacaggcgugcaccaccaugcccagcugauuuuuguauuuuuaguagagacgggguuucaccauguuggccaggaugaucuugaccuuuugaccucgugaucugcccgccuuggccucccaaagugcugggauuacaggcgugagccacuguuccugucuuauuuuauuuuuuagaaagugugauuuugguaauauuuacucauaguuaugccuuaaguuuuacauuuguagcaggcauaauauauauguguguguaaaacaaauaugauggugauaauuccuugcuguuuuguaaaaaauaaguuguuaaaagguaaaagaauauaauuaaauuaacauaaauucacuuaaaauauaucaacaaguuuaaaaauuuuagugcugaggaggauguuucugauuucagauuuuucuuacauaacauagagacuuuuauauaauagaugguauauaaaagguaauuuaacaauaugaaugcuauugguaacuuaagggaugaacauacauuugcuccaucauucuuuugaaaauguuacuauuuacuagaaauuaauacuagcugcaggguggaccuucauugcuuguuacuuuuaguaauuuaucaucuguaucuaggguaguaguccugacuccugauuuggaggaaucuuuuuugguccauuauuguaagagguuuuaccucgauuuuuaaaaaaucauuuuuguuauuugcugugaccuucaggaaugcuugaaaggauuaauuaugaagccucucuguauaucuaaauucugcuguuugauguguuuauuuaguacacauguauucaauaccugugcuuuggcugaauggagaccugacacucucugcuaacagucuggucggggagacugagguauagaaguaggaggggaucuaagagcaguaugugaggagcugggcaagguguccuuaccugugaacugacuuguggggaugacuagggcuuagcuaaggggacuaaggggacucugugcuuccuucacagcccacuuccuauuccauccuuccccaccugggcuugucacaccgcaucuuugaccagaucucgaguuucacgccaugauagcacuggggcuggagucuuuugucugaugcauuaaguuuucugcuuuguaaauuaguauuuucauccacaugaauacuuuguauuugcaaauaaucaguccaggauacuuuuuuuuuuucuuuuuuugagauggaguuuugcucuuguugcccaggcuggagugcaguggcgcaguguuggcucaccgcaaccucugccuccuggguucaagugauucuccaggagacauuuuaaagucuguauuuauaggcauuuuucagaugugaauuucucuuuaauaaugaugaugaugauaagaguguugauuggccauuaaagccagucaucccugguauaccuccuguuuaaugaucugauugccugcugaaucuggaaagucuuauuuuguagguuuuugccuccugauguagauaagcuucuaaccugcaguuagcacauuacugcacgcauaggagguaccgaaacauacuggcuggugucaggaaaaggaauuccugccuucacucuggcuagcauggaucacuguugacagaaaguuugugucagugggcaagccucuguaacuuggauucauuuuuccugcuuuuccuucuuuaauggaggggaugauguguuauacuuggggguaucucuucauagguuugcuggcucuuaugaccagugaggcuguucuguacugaguuucuucuucugcaccaccauuucuauaauaguguugcauaacaaaccuucccaaaccuagcagcuuccgugagcuuuacagcaacaggcauccauuuuucucccucacuguguugggucuguauucgcuggggugguucuucuucucacugacgguugccugggguuggcuccagacugguggguuggguucagcuuuucaugaauuuucucauuuugcuuggaucagcaacuacuugcggcucucccagcaaccacugccacauuuuuaaggccuuuuuggccaaagcaagucaggagaucaguccuggaucacugugguugggcaccauccaaauguguggauggaaggaaggaaugauuuguggcauuucugcaaacuacccagggaccuaggcagcuguuuaaaugugaaaucgccagaaucauauuagccuauaaguaaguaauggugcauuacuaaugauauccauccuugucugcauuuucugucuugugucugacuaguucuuuugcacuucauuauuuuccuuguucucacugagugcuucugaaugacuguuuuauuaaguugucaaguuugccuuacauucuucacuuacccuuuuuccuaucaccagccuguuaucuugaucaucaggccuucagugccauuauccagggaauuucacuaaaauaguaaaggacaccuaucuucaucuacacacaggacuauaggcagggcuuggauggcucuuaguucuggcuugggaauggagggguguaggcaguauagaaggugcaggggggucauucccuauuagaggagaacugaacacgagcuccuuccucccuugauagcaucccacuggggcuccugagugagaugaggacuuuuucccuuccuuuggugcuuucuaggggucugcugaagcagguuuuugugagacuguguuaugacccuuccaaauaaaaagcaauagaauugcuauugaagaggauuauauguggaaggaaauagauggauaaucccacugguuuuguggguguguauacugguaguacuuacugcuguauuaggauuagugaccuuugccaggagcaaaguaauucuaaaacuacugacauuucuauaaugcugacugaagcucuuauaagcauucuacauaugcucauuuuaucaucacagcagccgugugauguaagaaccauuguuagcccuauuuuuuuuuuuuuuuucugagguguagucucacucugucguccaggcuggagugcaguggugcgaucucggcuccucccagguugagucaauucuccugccucagccucccgaguagcugggauuacagacaugugccaccauacccagcuaauuuuuguauuuuuaguagaguugggauuucaccauguuggccaggcuggucuugaacuccugaccucaagugauccaccagccuuggccucccaaagugcugggauuacaggugugagccaccaugccuggccuguuagcccuauuuuuaagaugaaauugaggauuggaguguuuaaauaacuuguccaagguccuguggcuucugcauuugaauccaggcagucugccccagagguuuugcccucaaccuuugcuguugccuuccagcuagauguggagaaauacuuaaucaacaagagguuuagcuggacaaaggaguggaagagggugauuuugggugguauguagaagauuaucuuugguugguggugcaggaaaaugagaaguuaaaggagauuucuuuaaaaauucagaaaugaccucuagcucugccaggcugucugccguuugcuucucugugguuaauuuggacaugcuucccugaguucuguaauaguaguaagccagugugcuagcauccauuccaugccaaacccuggaagccaucccuucaaaggcggguucccaucuggacucuggagcguggccuugcccucccucccuuuucccuacagcccugagaggcuguggggcaaguuccaggagcugcuucuucagugucacucaguccuguuucuuaccuugggcuuuuccuccugcucuuucuccucuggcucuccugcucauccucaaggugaugauuuauuucuuuuauauuccugacugauuuauucccauuugucccuuuguaccacucaguuauggagucgcaggaccagagcagggguucuguugacguccccaacaggcuguguuaccuugggcaggucacuggagauccugacccugagguuucuuucucuuaaucacaccugcccaucuauuucauugggcuauggugagggucaaauaaaauaaacucaugaacauuuccuuuaaagcauaacacaugacauaaauguaugacauuagcauuccuagcuuccccauguggccuuguccacucccuguuuugguguccagcaugggcuucagccauggugccuguucuguuacuuguuuguuuaccugugcaccccugagggccucgggucuuauucucuuugaauuuuuuaaagcuuagcaccgcacuuguugacauggauaggggcuaguaaauguuugaaugagugggucaagauugccugucugaaggaaguuuguggucauaguugucuuuuuuuuuuuuuaauugagcaaagccuuccuguuauaucucuguuuuucuugaaauuagccuuguuaaaaauuaggcuuuugauccuuucuuguguuucuuuucgcagguugcuaaauuccauugccugugauugucuucccugagaccuaugcuugcuuuauaaauauucuucugaugagucuuuuaaaaaaagacaaaucaagaaaugauucuagauuuugaauuaaagauaaaauaucugauauuuguuauuugguuauucauuuaacaaauguguuaaguaccuuucuuguaccaagcuccguucuucaggcuggggaugcaacagugaacaaagcagaugagauuucugccuucaugccgcuuacauucuagcagccagacaacgaggcagcaaauuaauaaagggaugauuucaacucuucugaagugcugucagggggaauugugugaagagcgugcccagaccacugaggaguucucaacacauguacauaaacugagugugcuguagaugcuaugcuucuggguucacuguguuuuggguucccuggaauguaucuaguugucuuguuagugaguacuuaagcucaacaccaccaaugccuuauccacaagaaagauauuggauggcugaggauaaaggugguuguuaccuggacuuuuggccucaugaggacaucucaguguguaagagggauccuuaaacaugcugaggacccucuuuguuugguuugcugauacuugagugucugagggaaugagggaauaagggagggaaagauggggacuuguugaucucccaguagcuuucugugccagcuugcugcaucagcacacccaccuccuccaugcuagagaaauuguuugccagcuuauggcauucugaggcacguucacugcagagccuaccaagagagagggccggggggaggaggaaauguggagugacacaugggggcacuugcagguuucuuugaggaagucaugugugacccagguucugaaagaggagaccuguugauuaaaaaaauuaaaguuaguuuuauucagaagucuugcugagguucgcaaccagggagagucagagagugucuguuagacuguuccaaaguagugcuuuagcccacaguuuauauacagguggcgcacucugcaugugcucagaaguuacauuaagugugcucagaaguuacauuagagcaaaaucuuaccaagguuugggugugaggguccaucugguuauagauuauagaggcguagucauuaauccugucagauauuaucuuauauacaggaagaggcaagggcuaagacgaguguaucuuuuuugaaaauguggugauucaggcaggagaugugggaaccggugcuguauccugcuuaucaucuucagggcauucuucucaagggcugcgccgagucuuugagucaggggcuuuguaaaauucugcuggcaagggguuuugugcaauucugcuguuauguaagcaggaugaacagacauagugucuacauuugcuacuuugucucauacacugaaccagcugcaugaagaucugggaguggggguagcauccugcaggggccccaagugaagaauauguucgggaaguuuggggaauggaaagaauccacagugguuagaggauagggagugaaggggagaguggugugcagugaaguucguguugagugggggaaaucaggcagggccuugcccggccaugguaaagaguucggauuuuaaguacuacuggaggcagauggaagguuuugaguggaggaguggucugauuugacugacucuauuaaauauucgaguuggccgcuauggggaauggaagaagaguggaagcagggaacccaggcaaugggcagaggucacagccugugugaggguucauggccacacagaccaggcagggccguggagagcagaagcaguccagggcuggaacacguacguguuaaaggcaggcuaacagaauggcauacuggggauggguagugaggaaugaugcccaggcuuuggccagagcagcgggguggauggagguuccaacuuacugggacggaaaagccagagggaagaacaggaucugauggaggacuucccuguggacguguuuaauuugagaggccuuuaagacccucacguggagaaaucagcuggcagcagucugugagacuagagcccacagugggagaugucagggcugcagauggaaaucagaaguccucagcagagaugagaugagauuugucuuuugauugccccaaggauugaggguuaggcuauuucuucccuguagguuuauaaguuguagucauuauuuuaucauuguauguguaggcuaauucauggauucucaauucaagaaaauauugaacuaaauauugugcuagaugcaugggacauaaugauucacgagauagacuguggguucugugagggcagggaauaugucucauagacgagacagauuauuccaucagaauuaagucaggaauucaaucagaauuccaccagaauuaaguaaagugugauguguucugugacagggaagcauagagugggggccacacagcagaggugcagaccuagucuuggggguaagauggggauguuuuagcugacuagugagggugaguaggagccagcugagugaagcuggcuucagaaagagggcucaguuagugguagaugggcuagcaguuugcauuagaguugaaguguacugaacucuuccuuggaacuggcaaauucuccacaaggcacucaaggauuccuugucaagauuguauagaucauaggaagguuaauauucauguggguuggugauacuaguuucauugcuaccugcuuucacacaguaaauuuguuccuugcuaggaauuuucacagcugugugcccaguuuuauuuuggugcaguaaauauagugugaaauuggcagcucauaagacuuuauaagcaccuuacaugcauuauuucaaagagccagggcacauuuuugcaugaaaagcucuuauacaauuaucagagaaaaacaacucuucagaaucaucugcauuauugcuaacguuauauaauuugaaaaucauaauauguauguucacauagauucacaguguuaggacugcaaaagcaauugguaccacacuguuacagacugaagagcaacacauuuuuuucuugaguaauccuugcagaauuuuaaggaagcuuuuuauuguuuguuuguuuguuuuuugcuuuguuuuguuuuguuuuuaagagacagggguuucacucuugcccaggcugaagugcaguggcucaaccauagcucacuguagccucaggaaacuccugaguucgggcgauuacccugccucagcuucccaaguagcugggauuauaggugugagcuacaaugccuggcuccagaaagcuguuuuuacuuuuccucagaugcuaguguauucucccaaagugccaacuccuuggucaguacucuguaaauggcacaaacaaccuuguuuacugaggaaaauguacaaagguguguugacaguggauaacuacuuugagcccccagcauugugagguuuuacccuggcugaucggggcccuuggaagaacuggcuguauugcuaaucagccccagugggaguugucacugugcuaaguuccccacacccccgccuaucuauccgcagucugugguuuagcaaaacugucuaguacaagaggggcaacucuaggaacacaugguagauccuacaguguccauacaugagugggggcaggucaucuagaagcuugugguuggggagcaugugcuaguucacuugagcugguuucucuuuucaugcccagagaguuauguugguggggagggagcagagauugguccauuuaggagcuccaccagcaaaguuguuuuucagagguacaaacccaucccucuucacggccugugucaaaaacugccuccuccaugaaccucuacuuccucaucccguaacaggaagucaugucccuccccagaccugccccugcuuaccuccagccuucuagcugguccguuguugcuggcuccugucagcuccgaccucccugaauuggcuccacggucuccugagcagggcugaguggugggugguacucaagguucaaguaagaacucucuuagguggagaauaaacaaacaggaauacuguuuuguuuuguauugucuuauaagggaaugaaacuaguuguacuugccuucuuuucugagaaguuuguuucuaaauucuugugauuuuauaaagugaauugucauaaauggaaacuuuuucuuuucagauaauguggaugcaaaugaucuuaagcaguuuuuugagaccaacuauucucagauauauuucaucuucuaugaaaauuuuauagcacuggaaaauaguuugaaauuaaaagguaagcauuucaguaguuuuuuuuuaaaaaacauucgggcauuuuuauaaguuguauauaucaugagccacaaauuauacauuuuuaagcuuucuuucuugccaagccuuuagcaaagcugugagagcaugguggacaggguggcaucuuuguuucucuugagcuuucacuuauauggauguuaauugaacaacacauggcuagcaaaaauagcagaaggaacccuuagaaagcaugauuuucaaaggaguaaguuacugaaaaagaaagaaaaguaauacaugcauacuauuaaaaaaauuuagauuccauaaaagggucugaaaugaacacucaagugucuguuuugcccugcuugcagaggcaaccacuauuaaagauuuccugcaucuccuuccagauauauuauuaauguauuauguuuauauauguuugugacuauauucuuugaaaaucaaaccaacaaggucacauuauacauucuguucuguauacauuauacauccugucaccuaagugguaggauaguguagccuggggagccagacuggguugggaaccuggccccacccuucuagcuguuucuccuugggcaaauuaaucugucucugagcuggcuuccuccugucagcguuaaacagguucacagguauccuagcauuuuaggacagaguuugacacauaguccauggucaguaaguaguagcugcugucaccaucuucuuucauuuucauguagucugugggcugaaucugaauccccacagcucuaugaaguagaugucauucauuuauuuaaaaaauaagccauaugcauaaauaacugugaaaaaaguuaaaaagucaguuguucuguaagagagauuuagacagaauucugugguucuugggaagugggagagaugacuuccugcugaguauauagaugaggcuuuggggaagagguggccuugggaauggaccuugaaggacagcaggauuucagguggaagagagcggcacugcugcuggaggggagaacaugaguaaagguagggcuguucuuacgacauguaugggaaaugcauuuuuuuuuucuugcagcaaaggugugugaaagagauuugcaggaaauuagauaaugcuugcaaggagccuugaauucuaggcuaaggaguuuggacuuuguucuggaggugguuagagcucuugaaaguguuuguuacuaucacaaguaucuuguaaaguagcgauugaaccagaggcaagaacaccaauuggaaggcugaugcugucauucaucugagggauggugaugccugauccagggaggcaguaguuaagggaaaagaaaaguguugugucucagugggucuaccaucuaugagacuugguuauaagggaaagggagaagucaaagaugcuuucaggacacugagucugcuuugugaggugccauuagcgcaggaacccuggaggggagccagauuuggaaggcaggagggugagaguggcuuugggcagucuguguuugaggugcaugggggauaccuugguguagguguuggcuggacaguacaauauaggugacuggagcuugggagaaaagaggugaaaucguguuauugccaagggaaaaaguauauacagagaaagagagugauggucagaacuuuuagauaauuccuuauuuuauuggguauaugcaaaggaaagcgauggaguaguaggagggguaccaggaaaggguuuugucacagaggaccaggggagagagaauugaaggcauguagagucagccuauuggugcaugaggugcagcugggcuggggaguaagagcucaucagugugguuguuagugagugcggagagaaagguucuaggugaggagcaggucggaagccaaacagauggacauggagucacagggcggugagcuguugaaggugacccaugagaauauccuuucagaaaguuugaugugaagacacagauuguaucucacccuggucacgggaagguuauugaggaaugcauuggccuguuugcagauugaggagugggucagcuggagggggagauaacuaauggugcagguguugggggaagugaguugagacaggucaaggaaaaagaagagacauggagaggagcguacaggugaccuuucuauguaaggaggagcagauaaggggauaguguagauauggagacauuuugagguggagaggaaaaaucaagggaccccuugucagaugcccugauugcuccuguagaacaggcaguugucaagcauggaguggaaggaauucagggugaggcacugugguggucuuugauuguggccauucuugcaaucuacugcaaagaaucauagugaagaaccaauaaaaauagugagauuuuugaagucuuuugcuuuuaguauaaucuguguucgauuggagugcagggaagacacuguaccuuaaaaaagaauaaaagaaaaugccuacaaggaauaaugaaauaaauaaucuugugauaacuugagccuuugcaguuauucaggccaaaacuccggaguuauuggcucuaucuucaaaauacauccagaaucaccggccuguucucauugccuacacugguaacacugaaacuccugauauccucaccuggauuauagcauuagcugcagaaauggucucccaccuccacacuugugcccucucccaucccauaguuucuugucaaaagagcagcuggaguccuccuuuaaaaauaugagucaggcgcgguggcucacaccuguaaucccagcacuuugggaggccgaggagggcagaucacgaggucaggagaucaagaccauccugguuaacauggugacacccugucucuacuaaaaauacaaaaaaaaauuagccgggugugguggcaggcgccuguagucccagcuacuugggaggcugaggcaggagaauggagugaacccaggaggcggagcuugcagugagccgagaucgcgccacugcacuccagccugggugacagagugagacuccaucucaaaaaaaaaaaaaaaaaaaaaaaaaaaaaaaaugggucaaaucaugauucuuggcugcuguaaaguuucaaacggguucucauucccuguuauuacaguggucucaggcuccaccuaaucugccuucuuuugccucaccuacucuccaaccucagcuucuccaacugucccgcuugugugcuccagccuuaagggccucugacuguuuucugacuaagccagacauguugagcuacacggacuuugcauuguucaguuccucugccuggaauacaccuccccuaaauuuccguauggcuugcuuccaaacccccacauuuccauauggcuugcuuccuaaccucaaaggaucuuuucucagauguuaccuuaccagagagauguucucugacuuccccagucaaaauugcauaccaucuuuuuuggcuucugugucugcauuccuucuuguuuuucucacucauuuauagaaugcccccuccugccagaauauuaaauuguugggggcagggauuguugucuguuuugcucacuccuguauccucagggccuagaauaaucccuggcauauagacauucuguaguauuuauucaaugaaugaaugaaugaaugauaucuacuucauugagcuguggggauucaguuagaucagggguccacagcuuauagcugccuguuuuauaaauaacguuuuauuggacaagccauauccauuauuuauguauugucuguggcugauuuuguacuguaacagcagauuugaguguuuguaagagaggccugcaaagccuaaaauauuuauugucugacccuuuacagaagagguuuguugauuccuauauuaaaugauaugcgccaagcacuuagcacgaugcuugguacacagagaggaccgaaaaugguaaccucagcugcagguguuguagguuuuauuacuguuguuauuaucaauaggacagugugcaguugccccaaaagauauacuacuuuuauaguuaucugcucuaugacuuuuuauauuaccaacuuagaaauuuuucguuugugcugugcauucugccacaauuugagccaauaaguaacuaguugagaaaugaauaaauuacccaucauaguuugguaacaaguuggaaaacauggaagcuguguucaaacagcuagcaaggggcagcucugcuggauguggaucugagcagucgggcucgguugucuguuugcaauccuaauguguucuccauacugccucuugcuauuuuuugaauaaaugaauguauguugaggcuuacuaguuuuaagcugccuuuuagcauaauuuguaguguccugaaguuuaaaugaugucaugauaacuaauuauuuuuuaauauuccagggaauaauaagucacaaagggaggagcuggacuccauccucuuccuuuuugaaguaaguuuugaugaguuuauuuagcuuuuauaauucuuguuggaaauaaaguauuuuugaucuuuaauuuuauuugaagacaaauaaaaauggcuguugguggacauauauuuuuuucuuuccuuccuuccucccacccucccacuuuuacaaacugugcuacaaauaauuuucucgugauuuucuuuuuuugcaagcaugugugauaguuuuuccuguauggguaccuagaugugaaauuauuagauggaggaguacacacaucuuaaauaguagcagauauugcugaauugcucuccaaaaggucauauauucacacugagaaacugcccuguaaaaaauaaaaaaauuuaaaaacccaaaaauguuauauaaacugauauguaagucuuauguaaauuuccuauacucuaacauuagagaugauucgucucauauauauaaauacauauauauauaaaucugacaugcaaaaacuuuuuuugauauauauuuuucuacuagugagguuaugaucuuuaugcaucuguauaucugugugcauugaucauaucuucaaaguugaaacaauguuugggugugguuuuugacuuauuaagcuuaaagucuuucuuguccaaauguauuagauaaguggccagauuacggguaccuggagaacacacucagaacugaauuauagguuccgaaaguuaauuguugguuuuuuagaaauuauuugugguuugagagguguaggcuuagguuagugugagaagauaaacuuuuauagcuguaaaggaaaggccuaaugugagcaggugcagagcuggcuggagggcaaagcacuguaggaaagaucuccuacaguaggagaguucuccagggccuuauggugaggggcuuucugaguuuauggaaaaaaaacaagauaugggaaacuuccugcccaggacuuggcuucauggcuagugcucaauagcccugguuccccuuucucuccuuugagagcuauacuccuuucccagaguacagauguugauucgcuauugauacacauauguugauacacauauucuguagugguuauuauguuuccuguguuuaccguccuuugaaugaaaccugugaaaugaguuguuuuuaacaggagcuuuaauuaaguguguuacuuaaauauguaucuacugaccaucauuuguuuguacuauuuuaucaacuuaauuauauuauuuauguaaugguuaaagaaucuauaacauauguaaguuaggaagcaugguaauaaagcacauacucuugacacccucccccuucaccauuuuaggaacuaaaagcuacuuaggugcucuuccaccauccuuuuucaccucugugacaguaacuccccugcauuuuaucauucucuuucuuuuaaaaaauggcuuugccacacauauuuguacccuuaaauaauuucuugugugguuuuguuuuguuuugaguguaauagaaaugaucuccuaugguacauaaucaccuucgacaugcuuuuuacccucaacauuaauucuaagauuuauccauguuuuuaaauuuaguucauguuuauucagucccacugcuggauuaaguaaauauaugugacuuguuuaauuccuacauuuugucuacagguuuuuuguuuucuugguagacagauugucuaugaguaaggaguggacauacuugccaguuggucugcuuuccgcccugagucagccuuccaguacauugguaaauggaagugauaaagggucaucuuguuuuugaucuaaagagaguuuuguuaaugugaaauauuaagaguaauauucucuguaacuuuuugguagauucucuaucaaauuaaauaacuuuguuucuauuccuaguuugagauuuauuuaaaaaaucauagauggguuuugaaguuuuuaaauuuuuucuugaaaaaacuugauugagaugauaaugauucuucuugaguauuaauauggugaauuacaguucuagauuuuuggauggacuaauuacuauuacuauuauuauuauuauuauuauuauuauuugagucaggguauugcccaggcuggaguacaguggugugaacauagcucacuguagccuugaccuccugggcucaagugauccuccugccucagccuccugaguaggugggacuacacgugugcaucacgaugcccagcuaauuuuuuuucuuuuuaauuuguuguagacauagggucucccuauguugucuaggcuggucucaaacuccagggcucaagugaucuuccugccuuggccuccugaaguugugggauuauaggcaugaggcacugcacccagccuggacuaauauuuuguuugcauuuuuggaucucuguucacagcugagguuggccucaguuuuucuuucucauacucauguuguuuuugacugguccugugguaaugguuauaaaaccuguugucaagcauuucuucuuucucuguuauauaacauaguucuauaagauuggaaugagcugucauugaaauguuuuuuuuaccuuuccuauaaaaccaccugcaacuggggugcuuuuuuuacuuaugugaagauuuuaaccacucauucaauuucuuugauaguuuuagacuuguuuuaguauuauucauauuuucugguuuuuuuuucuugauucaaguuugguaaguuauauauuuuucuaagaauuugaagaauucugaggauuuguucuuaucaccaaaguuuuaaaauguauuggcaaagaagcaucucuuuggagagucauaaucccuucaguuuuaucuccauuagcuuggucuuuauugucuucaagcaguuuuuauauuacacacccuaguaguagugguggugguguugguaauaguaguaguaguaguguuugugccacauuuuuacuaucuucuaguugccauuguagcagcuuuaaacucuguuuuugguguaauuguuguuccuuuaaaugucuuuucuuucuggcuucuuuuuuuucauuuuuuuaaauuuuauuuuuauuuuuauuuuuauuuuuuauuuuuuuaaagauggagucuuucucugucgcccaggcuggaguucaguggugcgaucucagcucacugcaagcuccgccucccggguucaugccauucuccugccucagccucccagguaacugggacuacaggugcccgccaccacacccagcuaauuuuuuuguauuuuuaguagagacggguuuucaccguguuagccaggauggucuugaucucuugaccuugugauccgcccaccucagccucccaaaguauugggauuacaaggcgugagcuacugcacccagcugcuucuuuuaagaucuuuugugucuguuguucuacaguuuaauuacaaaauaucuaguugaagauuucuuaucuugcuugguauauguauguuucucaagucucuggauucauauguuuuauaguucucuaacauucuuagcuauugucuucucaaauauugauaaguuucuguucauucuggccauacuuucuaggauucuuacuuaaacuuguugaucuauccucucuguuucuuaagcuugcuuuuauuuucuccucccgcaaucuguuuguguugcauucugggaagucucuucaguuguuucuuccaguucacuaacucccuucguuuggaacaaaucugcuacuuuaccaaucuauugagcuguacauuucaaugauuuuuuucauguuuuuaacagcuuuuuugguuuggcauucuuauguggcugguugcuuucgauugucucuugauccucguucauuuuuagacaucuuuuauuuuauuaaacauuuacuguguaauauuucauauuuuguagaugauaauccuaguagcuuaaguguuugucuaauuaugcugguuauuucagcugccucucauucacaguggcuucuuuuuuugcauauuuugugauauuugauuuugagagugguacugaaugaccacagauuucacauuuguuaauccugguuucucccagaggauuugucuuugcuuuugccgggagucugggaaugcucuugauugagagcacuuuagcuccauuugaggguucugguuuaugaauggaaauucagguucaguucccuaaacuuaccauagcugggaacugggggcuggaggggauagucaccuguaaauccuagcgcugguguuggcaucagcuccuuggcauucugcaguuuuuucuuuugcauguugcuuacagaucagguuuuggcuuacuugucuucugccuccuuucuucuucccucuuugcuccuccuucuucccccaccauuuuuuagucccuuguuaguuucucuguguucuucaaagcccagcaauguuuuaagaauuacauuuguugucauggauccauuggccugcagcaggaaagcccuucagagacucuagaccuaucccucucacagaaguuuugauacuuucucuucauguucuuaaauucuagacuagggaggguguuaauacugauacauuaccauuuacagaggauuaguugccuguauaauagaacaaauauauauuguucaaggcuucauaaaacuuucauuuugcaugguaaauaugagugaauaauaaacuugcauuacuuuuguuuaugcuuauguucccucugucucuggcuuuagaagguagguuguaauuuguauguuucauucuggguacuaaguaacuucguugcugcuuuguaggauagugcccuguaaagcuuguaaagagauaguuuauaaggguuuggaagugaauacuuaccacuuuguaaauaauuaggaaaggcucccuugagaagagguggaauuaauaagauguguuaaaucacaaaagcgauaccauguagagauauucuauaaauaagaaauggcuuggaagaaagcauagagguaagagauaagaaggcaugaaagaggaguauguaaagagagcugcugucugccuuguaagucagggaugcacugaaagggaaccuuggaaaaggaaacaguaguuuuuagauguagaguauuggagacauuacaguauucugauaaaguaagugaugugcagugaaggccaccagccaguccaggucauggucucaggcagugagcagaccuuuuugccugccuuccucucuagugggagcacuuguaccuuuuggaaguugacuccagcugccuuugccuguagcuucagauauguacaccacuuagaguuucuguugguucauggaguuguuuaucauauuuuuuuuuuuuuuuuuuuuugagacggagucuugcucugucgcccaggcuggagugcaguggcuugaucuuggcuuacugcaaccucuaccuucuggguucaagcaauucuuccugccucagccuccugaguaguugggacuacaggugccugccaccgugcccggcuaauuguuauauuuuuuaguagagacaggguuucaccauguuggccaggcuggucuugaacuccugaccucaggugauccaugugccucggccucacaaagugcugggauuacaggcaugagccacuaugccuggccuaucauacuuuuuuuuuuuuuuuuacuaugguuaugacucuuacuguacuuuaaaaaccauauuucauccaucauugcuuugucuuucaaauggagauguggggaugaugaugugggacuccacaacaugaauuuacauuuaccaucuuaaccggaaucuacauguuuuacaugggcuagucuguuuaauccuuuccuucugaaguagguuuggucuucccaguuuuuaugaaugaaauguuggaggcuuuguaggguuaggugacuugcccaagggugcacacuuaguaaaugggagaguagggauuuaaccuuuagucuaacucuagaaccuauuauucuaacuuacuggcaugcugccuaccacuuaggaguguugguauucuuucuaagcuguauuccauaggcugucuauaucaacauauacuauucuuuacaauucauuuauucaucagacacauuuauuagguaugcacugugucagacacacguaggugcuggagauacaacaaugagcaagguagccagagccucccguccucauggaguauaaauuaccauuucguggugagcggaagagucuacugguaagaaugaauucaugucagagcuccaguaaugaccuucugaaucacagaaaauccugaaugguucuuuucagaagugauauuuuggugaugguucuugaauuaguuaccugcauaagggaaaggagaguugguguagaaacacaagguacuuggugaaugggucucaagaucaaauaauucacauugagaaccuucuggauucaagcuugacagguuauuuuaaugguaccugagauucguuuuaaucaggugugguaaggcacagaaacaugaaaaugauuguuaugaaggaagaaguuuuaauuaugcucacaggccucuagaaacagacaugucacacagagccaaacagggaagcaccaaggcaaaaucaguacgcaaagaggaaagggagcgacagagacagaacugagggcaggagcuuuuauuguguuuuuuugcaggaaggaaugggcaaggccagguaaguaaacuacauaggcuuaggacuggauaguuugaauaauuucagcugacagggcuguagggguagcuccugguuguccagcaccuggccccuggaugauugaggggagggggauagaguccauaaaaggaugugguugggguuacggauuugggauugguugguuugcauaucagaaacaugcucugagccacuaucuuugggaauuugcuaacccuuggaggggcauccuuccuaugucauugaggccccagaugucagcacaucaagaauacagagaauaagacaauauaguuaauucagagauacuguuucaagcuuucugccauguuguaugccauccccuuuuacuagagaaauagaauaguuuggaguuauacauguauguuuuagaaaguuuauagaauuugauauuuccucacccucccacacuccaauuaaaauacaucgacacaagaggcuuaauuucaaaacguaaacauguucuggcauuggagugccacucauuuggauguucuucaaauaucacaggauuugaaaucacagauaaacagauucuuuauucuaaauuuuauuuaaauuaccccacuauauuaaacccuguuucuaucuugucauuagccuuccuagagaccugaaugaguucuuuauagucuguaaaguguggcccaggcuggucuaacacucacaguccucucccuggcucucaguguagcucuucuucauauuuugugguuacucuguggaagugcucugucgggcuaacacugccccuuuaucucucuuugcauaguuucacuucugccucuuaguuuauucaguucucuuuucagggacugcccuuagcucuucuccccaucuggcccauucucucaggaccuguuuagacccaccaauuucuccuggcaacuccugcuggaagugcucauucuuuccuuuggacucauauaauagcccugccuuguguuaucauuugacuguggcuggauauccauaguuaucccuuaauguggcuaugccuuaguuuccuaaugagaguguaaaaacucuaacuccauguuuuuuaugugcauuuuuguacauauuuuugaguggaagagggacaaggacauauaaaaugaacaagaaaagcaaauucuuccaaagccaacaaccgugacuuaacaauccuuuguuacuuuuuucuuuucuuuucuuuucuuuuuuugagacacagucucgcucuguugcucaggcuggagugcaguggcacuaucuugguucacugcaaccuccgccucauggguucaagcaauucuccugccucagccucccaaguagcugggacuacaggcaccugccaccaugccuggcuaauuuuuguauucuuaguagagaugagauuuuaccauauuggucaggcuggucucaaacuccuggccucaggugauccauguggcuaguggcuacuguauuggacagggaggcucuagaguccuccaguagagccguaucucaucguuugaaagaccacuuuucauuguuaaacaugguuaaauccuuaguaucuuguacaucuguauccuuguaaugcaggggacuuugacuuaagguuuaggauuuuacugaaaugguuucucugggcuucuucuuauuaccagagugcccuuggcugaggggaaugagcauuuaccuccacagguuggagaagcauggcuccaaagugacccucugcaaacagaauugaaaagccaugcacaaugucauucuacuguuuucaugcauuuuuuaaaaugaaaauaauguuaaauaaaggcuagccaaauuccuuaggacuucaucuccccaccacaccuucaaccuuucuccaucuguuuccccuucaagauaaagaaaacaguuucagugcacuccaggaugaugcaccaugucucuuucucacccguccuuugguaggagauucuuauuugagaagcauugguggaagaggcaaacugcagcaggugaaccacacagcaagugcagaugacauguggguuucuucuaggacauacagagaaagaaaaauaauauuguggaugcuagcuuuuguuuuuccuuugguauugaaauuugauugcuugcgauuuauuacacgccuauauguacugacucccuuccuucucugcaguuugguguuaugcuggauuggauggcuggacucagcaugugcacagucuggguguaguuauguuugggauucauaauuugaccaguggugaauccagggauguaguggaaucuaugucuuacuuuaauggaauucagcacugggucucuuguucuucauugcuccaggugagcuuauauagauaguggauuuagccccuaauuuuuuuccuuagaguaggggaaaagaauuuuuaaugauuuuccugauaauaguaauauagcuauauccaguacagugccaauaagaugaaacaaauggcugauuuucacucucuguagcauuguuuuguauaugcaauccaguaauuugaauguugauuuuauuucccauccaaaugcauucauuuauaacuuuucacauuuaguagcaccauuuuacuucagauacuaauagugaauugccuaaagaaaaacuagaguuaugaauauaauaggauuacaaacaauucugagauuuauuuccuuucuucuuccuuuccuucuccuccuccucuuuuccuccccccaccccugccuccuccucuucuuuugugagaauugcauaucuuuuguaacucuuugaaaaugaaaacaaauuaaaagcuccuguggagguucagugaaaaugccugaacugaauucuaggcaagucaacagauucaggcucgguguccuacaggauuaaguaacgauuccuuuucuuucuuuauacaauggcuaauggcuuuucuuauaagcaaauaauacauagcaagguggcagaaucauauuuuuacaauuaacuaguugccacaguuucugcgcuuuucucugcuuuguuauuucuuauuccaggcuguccagugugcagccauccuuccgugcugcucccuccucccaugccgaggugaaggacuuccucuacaaaccucucaggcugauacugcuuuuuauuuuguuuccuguaagggccacuucacgguuuuugaguggaagagggacaagaacaacuaaaaugaacaagaaaagcagauucuucuaaaauccuuggaauuuaaguucuuauugaggauuucaaauauuuagaugcuuuaguagauuuuguuuucuuuuaaaagaaugauuccaauuuugaaugcagcucuuuggucacugucauaauucuaaaugacugauugcaauugagaaaaagccacuaucaauucagauuuucuggagaacauuuuuaaaagaacugagcugacaaagacacccaucucucauccccaaagucucccugaguuccaguuggcaaagugaaugucucuaguuagcaugacuaagauuuugggucacauuuaugacauggggcuauauuuaaaugauaauagagguguguaaucaucuggcuuucuuuguaaugccagccauacuuguggcuuuuauugauguugaacccuugguugggaacaacuccaaaugauaacauuauuguuauggcauagugugaucuugccuugagacugcucugcagggaucacaguagagggccagguggccaagguacccuuuuucacuggucucauauguugccugugguggugaauuagcucuguaguugcuccucggugcuaucgccuguacuggauacuggggaaauaauaaaacauaggacugagauccuuuaucucuauagcaugugguuauucuggugucugauuuugauugugaaaugucuaugaucuguacaaaccggaaggugggaacaaaauauaaacaugugguccauuuuggagauucuuugcaugcacuuuuccugguuaaaaugugauuauccuauuauagaauguuaguaauuuuaauuagacaaauguuugaguugaaaggagucaguuucaauggauaguuuaauaugcaaauuuaguauuaaagacugcagucucccuuuugcaucaagacuuauaggugagaaacuugggauugacccaacgggauauaccaaauuacucaguucaccuuggaggaagggacacuggagauaagauguucguggaagucugaaauuacauucuuguuguuaucuguugcaguccaggugcccugagcuuccuggcaugcuggccucuuucacauagugugccacuugauguguugguaacugacacucuuaagaggagauccuguggaaggcaauacuagcaaaaaugcuuccaagaaucuuuuaagggcagaugguagaaacugcauuagggcuaaagauaugggaaauucacacugaaaccugagcauguuuauuuauuguuaggauagcaggagacauguagagagcuuuuuucucuuuaauuaaaauuaaucuguuaaugcaguuuugguaaguugauuuuuuuuaaauuaauauauaccuuuaggagagaguuguacaaaaacuugcuauuauaagucuauuacuuguuuucuguuuggauauguagugugguggcuguuacagagugacaucuaguguuugaugugguuugugacacuguacagguuggaagggucuggcuugaagccuuugugcacuggcuuuuccugcaggccuugggcacuugcugaaugaauuugacaggguggccagucccaagacaaccugcagguguacaaugcuuucuaauugugcugaggcaggaguuuaaauccucugaauuuaugggguggugggaaccaaguaguggcaucucacugggguuuuguuauucucuacucaucacuccuauagaaacugucuuggagugauuuuuuccccuaaaacauggcauaaaacggauggccaacuagugcuaguaccaaaacugaagagaucggaaaaaugcaguaguuuucaggcagaaaauagaaacuugcaugaaaugaagaauagcauggcagauuugguugugacugagaucuccuguguaagauacuuuugugagaagaagacuccuuuugaaucuguuuuagugaaugcuuuauucggggcaaaacccacauauuauggguagaauuauaugcuacuaauuuggggauuugugaaggucacugaauguucguuccgucauuaaaaaaaugaggaguccggugcagugugauuuuuuucuuuaaaaagagauuagaccuuugcaugauccuaagcaaagagaaaaaauaaccuugaaaucuauuaagugcugccuuuccaguuuuugaagguugcauuuuuuguaccuaauaaaaaacauuuugaauaucacauuuuacuacuuaauacgguagucccccuuaucugcaguuucaccuucugagguuuugguuacucguggucaaccaggguccaaaaacauuaaauggaaaauuaaagaaauaaaccauucauaaguuuuaaauugcaugccauucugaguaguguggugaaaucucucaccauccugcuccauucugccugggauaugaaucauucuuuuguccaguggauccaugcuguagaugcuagcuaacugucagucacuuagcagugguccugguuaucagauaaacuguugugguaucacauugcuuguguucagguaacucuuaauuuacucaauaauggcuccaggccaggcguggugguucaugccuguaaucccagcacuuugggaggcugaggcagguggauugcuugaggccaggaguuugaggccagccuggccaacagggugaaaccucgucuguacuaaaaauacaauaauuagcuagguguuguggugugcuccuguaaucccagcuacucaggaggcugaggcuugagaaucacuugaacccaggaggcagagauuguagugagcugagaucgcgccacugugcuccagccugggugacagagugagacucugucucaaaaauaauaguaauaauaauaauggcuccaaaacacaagaguagugaugcuggcaaucagauaugccaaagagaagcuguacagugcuuccuuuaagugaaaaggugagcguucuugacuuaauaagaaagaaaaaaacuauaugcugagguugcuaagaucuacaguaagaaugaaucuucuaugaaauugugaagaaggaaaaagaaauuugugcacaguguauauaggguuugguacuaucugugguuucaggcaucccuugggagucuugaaacauaucucccuagcauaagggaggacuacuguuuauuuuguucaguauugguaguauuuuucuucacucuguggcucuguauauuuugugcuggugcucuuuuaucucuuuucugccuacuaccuaagacuuuguucagagccucaguuuccccaccaguggaguauccugcuaagcagucuuuugguuuguaaucuucuaccccuucucucucccucacucaccucagaugcugugugauguaauuucgauucucauugccuucaggacaaaagucacacuccccaguauagccuucagaauguucuucgucuagucugccuccuucucuaucacuuaucaccugucuucugcccucacuggcagccucuuacagguccccaaauaagcagcaaggcuuuuuauuuuuugcugcuguuuggucugccugaaaugcucuuccuugccuggcucaccccuguuguccuucaagauucaguucaaggguguucucccuuuggaagugcaccuugucugucuucauuuccuugugcauguacugacaucccugauuuucucaccuuuucccucuuagggcucuaacuuuuagagcaggaauggugucuuuuauguaucucugaucccucacaugguaccucgcacauaaugggcacuuaauaagacuauuuuuuaaugaauuaaauaaauguuugauuaagaggauauuuaauuaccugcaguacuaccaguucaacugucuguagcuuagugauuaacaauacuuggugauaauuucauuauguaagucauuuuugcuuuuauuuuuauugauuucuuccuuaauaaaacuuuuuuauuucuauuuuuugaguuuaaaacuuaguucuugcauuguaggaaauucaagucuauggauuugucucuuauuucagcuuuggccaguuuuuguuauaugcgaaucacaauguugauuauuuuucguuuauauaaucaguuuuuuuaacucgaguguuaaaauccacaaguaauugagaauuacuuuuuuuuuuuaacuugaguguuuaaaauccacaaauaauugagaauuuuuuagcuuaaacucuugaugguggacucccaguguauugaguuugcuugugaccuguguaacacuuacuuugagggauuuauuugcaucgcuuagaauaauaacuuuguaaauguuucauagauguuggauucugugaaguuugauauauagcuguuaaaccagucuugcuauaacuacauucaagucuuccguauuauacuguauugccuauuuuauuucucaaagauaguguguguuaauaucccccauuuaaaaaguguuuuuccccuuuaguuucugaaaguuguuuuaauggaguaugccuccauuguuuuauuuucaugcuauguuauuuguugcauaaagauucauaaguauuauagguauaucguaaauuacauauuuaaccuauuugaaauaauucccuuuguccuguuaauacuuuuuuacuugauauuaauauugcuuugugugggugugugugcaugugagccuccuuuucuguauuuuauugucagucuuucuguguuugaaagcugggucugauggacuuggucuucgguaggggaauuuaaccugcuuauacuuacuacuuuuugugugugguaaccaguacacaucuguguauucugaugcccauugcacuugguuuuagcuuuucuucuaacuuuguuuuugggggagaggucacugauuuuggcuuuauggaauaugcuuuguaauuuggaaggugcacuuucuauuuucauuccaauaacuaucuuucaauuaacaauaucauuugcauuguuuuucuucuaauaucaagaacaaagcaguauuucagccaggcacagugacucacaccuauaaucccagcacuuugggaggccgaggugggcagauuacuugaggccaagaguucaagaccagccugaccaacauggagaaacccugucucuacuaaaagauacaaaaauuagcuggaugugguggcacacgccuguaaucccagcuacucaggaggcugaggcacaagaaucacuugagccugggugguggagguugcagugagccaagauugcgccauugcucuccagccugggaaacagagcgaggcucugucucaaaaaaaaauaaauaaagcaaaauucgaugauagcccuauacuuuuacuuuaacuccauaugucuuuuguacuucuucucaacuauuuuaagcaguuuauacccagauuauuauuaauuuuauauuauuuuucccucuuuaguaguuuauuguaauguuaccuauuagaguauucuuuucuuuuuuacacauuuaaacagggcuaauaccucaauaauuucaagaaaaugacagacccugcauuugguucugccuaaagaucaacuguacagcacacaggagguacauaauaaccuuuguucaacaagacugguguuaguugcagacagauucuugggguacccacaaaccaagucaccugggagggaggugagacauagucuaggcucuaucuacugucaguacccacaaaagcaauuauuagggauuucauuuuccuucugaacacaggaaaaaaguauuuuaugcaugaucgugaacacagccaaaaccuuaaugggagguucuuaaauacaaaacuuucaagcuuuacuuuucacuuuacugucaaacuucaugagguuagaugccagguacuauaagcuuuuguauucuccauggcacuuugagcuuaauaaggacugcauaaaugucuacuuaaauaaaaaaaaaaaacaggccuguacuuuuguauuaugcucuuccgaucaacucugcaauucucauauuuguugauaccuacauguuaacuaggaauguuuagggagaaaccuaagaaugaacaaaucugaucucucagacaggucagucagcuaaggaaaccagaauuuuaaauagguuaccaggaagguaaauaaacaucacgauauaaauacaggcaugagugaacugucagggcuccauuaaaucauugagaacucacagaggcaaagguaucaauauguuugauagucuuuuuuuuuuuuuuuccaagacagagucuugcucuguugcccaggcuggagugcgguggugcaauaucagcuuaccgcaaccuccgccucccaggcuuaagugagaguagcugaaauuacaggugugcgccaucacggcccccggcuaauuuuuguauuuuuaguagagacuggguuucaccacguuggccaggcuggucucgaacuucuggccucaaaguauucagcccaccucagccucccaaagugcuaggauuacaggcaugagccacugcacccagccaaucuguuugauauucucuuuguagcucuguaagcuggugagauggcuagggguucuccuggaauaccagaaaguguaguuguacuguaggggaugcucugcugguccagggacaauagcuuuccucuugcugcugcucugauucuugucuuguucuguuuuuuccuucucuccaucuuucugugugcuguuuucuucauucugagcaugguccccagugucaucaucuuucaagguguauaacuuguucauccucucgcugcugcuguugccauucagauuauuuuauuauaauauuuuuaggauguugucuuauguuaguuguuuuaggaauauacucuuuuuuauagucauauuaacuccaauuauguaaauauagcucacugucacaguguuuagaaccccacacccuuguuuucggauuauuuugauuaaucuguauauuuucuggaauaugaauuguguaggauauauugaagaagggagguauguggcugauggacuuucaguucuagaauaacuuucuuuuaacuuuaaacguauagcagguccucaaauaacauuuuguuauaauguuaaugagaaaguguucaaggcaaauauucugucuucaugaaagaguugagucauuguaguaagagaugaguguccaggccuaagacagcaaaugaucaaguugcccucucuaugggucucccuggaagcaucuaugcagcugggcugcuaugcacgugggucccucugaaaucagacuauacuuguagcacaggcauucacagaauguuuucuuuaaaccgaacaguccaguucucaucauaaguuuucugcauauuuauuauucaaaaggucaaguaacuaagaccucuguucuuuuaaaccaaaucuguuuucuucucggucagcauuuucuuuacccagagcucuucuguccugcagcuaguuuggggaaggguugcuccccacacucugcuuucagauguaacauguuaguuggucauuauuguaguugauuaccuucccaugaguuaguauguaguauuuucuucauucuucacuguccuagcuuucuaaguggaauugaaaucaagugugaauccacugggacauguugcagucaucugauaauaauuuaaaaauauuucccacacaaaucagaagaccagcaguuauaaaguagacuauagcaucuuguguagacuccagcuuacauuucacauuauuccuggucaugcaguagguucugaagaaaaaagaacuauggauaaucaguuaaaagaaugacagauucccugaugugcugaucaguaguaauaccuaauuucgauuucgaguguacuauaauggauuaccauauagaugcagcugagcacugagcauuaaauagagcuguguguuuuucagaaaaguaauauuuauucacacuguguggcuuucuugauuuuuuuuucuuauuuuacuuuccagugaaacuacaaacaagaugucaguagcuuauguggcauucacagcaguauagcuuagaauauuggcugcaguagaagaaaugccagauuguauuugucccaguaaagguagccuucaucuagggcuuucugagggacaggcuuagcauuuggacauagauaguuguguugggcuuuauuuuuauugaccucauagacuuuaaacaauggcucuugcaauauuuggguacaaaaagcaucaguguggguaauguuucagccuuugacuuguuguguaagauuuugucuauuugggaauauucuuaguagcucagauacugggcaugcauuucauauccaagccuuuuugaguguuuuuaaaguccauccauuuugugaaucugaaaacuuacccagaaguggugauaaugauaggcuugaccucagaauaagcuggaaauuacuuuuguggcagacugacaguaucuaagcauguagauacacaucgucuugcuguauucuguguuuuucuuuguugugugcuaacaaaagaaaaugaaaucaagaagaccaauauguauuuuggaaaacuaaaaagcaugauuuucacugccaaauuaguuuccugaccaaauuaaagaccugaagaacaguggguaugucaagcauucaucuaaucuaagaucuauucugaaucuuuacuuuucucagcauuuccuauaugaaauguuuaaguggcaagaugggaucagaauaugauccugggauguagcugggcugccaggucccuuaaaggagaaugcgugagauaauaggacaccaaguuacugcugugccguuugcccaggcacugugaacugcauggaaggaagcacagaaagcauggggagaacucacugggaccagguuuccaucaacgugagguagcagccagcuguugagaaacugccaguagagaagccaugucucucaaguagggggcccgucucuuagaacuucagcuuuccaaugugaugagaauauucuaauuaauaauuugaagauuauuguggcacacauagagauggacuguacauauuccccuucaagaaagaaugugcugcccagcuacaaaaguggcguuagcugaugguuuccagcucuucacaccuucggcuuuccauccuuggucauacucuuugcaucauggccccaagccaguaacugccagaggcaguaguacaagggccucgccauuucuggucacacuggacuccucucaucuuugcucuggagcuuccgcuaggcuggcagagauuugucagcucugccucguggucugaggcuccccugucuaaucuugcugccgucuuuucccuuucacagguguuaguccucaguaggccauuuguacuccuaucuccuccauugcagcauguuuuccagaaaacucaccuugcuauuaucauuaauuuuuuaucaaagauaccaaauuggggucuauaguaaauuuuucuguuaagagaaaguuugaguuaaagaaccagaggaucuaacuuagaugcaggugcaggcuugucuucaucucucgcaucuggugauccccaggccaucuccagauuguguuuguggcccuagaguugcucauuuggccuggcagccuaacuccugagacccucauucuuauucucaguuccagagucuuugcauuucuuguucuaaucucuuugcuugugauuuuuuccuguagguuguaaaccagcuuggguucuugauccuaugugcccauggggauguuugaguuuagguucuguugguaagacaaugcucacguggguucuuauuaagauauucuguagagagcuguuuuacuuauucugauucccuuuuaauguaauguaacuugacauaacauaacaacccaguuuuuauauuuagcuccuuuuuuguguuauccaucuaaaauuaauguuagagcauauugcaaggggaagacuuauuuugauuuuuuuucccuugaaacagccaguuuacuucuguacaauuuauagauggaucugucaugccuggcauuuggugucuggcuuacaaagguuguguguucucaaggcaagagauuaauauugagcucacuuuauuuaauauugaagucauucuguuaugugacaucaauuuccccacauuuucuaauauguuuaacuuuuuagaacuaguugugcauauaaauacucguaaauguuucuaaucuuuauaauaaguaagcauacaaauagcuggcauaucaaagauuucuccuuggauucgagcacauuagccucuggcuuuugcuuuaccuucauuuuaccuucuuagcagagcucccucagcucacggauaccuccagagcuucaucuugucguauuuuaaacucucucaaaagagagcucucauguacacacagcuucagcugcugcccauaucuguuaccguccaaauccugccucuguacuccagacccauuuacacauuugccuagaagaacauuuccaguaaggucaucccuugacaccucaaauggcaggauguccagaaucaaacuugacagcuuauucuccucgggucuaagauugcaucuggauuugaucucuuggauaaagguguugccaucuacaaagccacugggagccauggagaccuccauuuacuacagccccucuacccacuuauccugacaauuuuaucuccugcauaucacuauuauauguucucuuuaccuggccggccuugauccaggccuucuuauuucuccucugaaaugcuaccauugccucucuuuagugacugugucuaccuccccucucagcugccuccaguucaccuccagcuggaacccauucagggaccacacugcucccaugaggacauuaagcccccagccucgccugccucuccaggcccaucuccuccccuucucacugccuaccagccaaacugacccuccugcugcugugguuccuguaaggcaccaagcuguguuggccuucuaacauucucccauggcauuccuucugucccuauccacuaggcgaauuuaauucaucuucuaagucucagcucaaguguccucauuuccaggaagcauuccaugaagccccugcugaggugaagcucuuucccccuuacgucuguaauauuucgugcaaacgucugucaagguuuuuuuuuuuauuuaaaaaauuuuuuuuugcuaacugauauucuuuucuuuaucaucucucuugcccacuauucaugaaaucuuggaaggauuacauauuuuauuuauauuuauuuuauuuuucaagagugaagucuguugucugguguguagguauuuuucacuaaaugggauuuggaaugcauguggguguguuugaguguuugucagaauuaucguguaguaacauuagauaugagauaccuuugagaguuaugggcuugaaagauaaggugacuugaauagacuuucucaaaagaauacauagauacauuuggccaacaaguuuaugaaaaaacguuugacaucacuaaucaucaggaaaaugcaaauuaagaucacaaugagaugucaucucacaccuguuagaauuacuauuaucaaaaagaugacagguaacaaguguuggugaggauguagagaaaaggaaaugcugguauacuguuggugggaguguaaauuagugcagccguuauggagaauaauauggaaguuccucaaaaaaacuagaaauaaaauuaccauaugccccagcaaucccacuucuggcuuuaugucccaaggaauuaaaaucaguaugcagaagagauaucugcacucccauguuuauugcagcauuauucacuguaguugagauauggaaacaaccuaaguguccaucagugaaugaauggauauagaaaaugugguaugaauacacagugaaauacuauucagccuuauaaaaggaaaugcugugauuugugacaacaugguugaaccuggaggacauuguugccaagugaaauaagccaggcacagaaagauacugcauggggcuggacgugguggcccacgccuguaauccaagcacuuugggaggcugaggugggugaaucaccugaggucaggaguucgagaccagccuggccaacauggugaaacccccaucucuauuaaaaauacaaauauuagccgaguguaauggcaagcaccuguaaucccagcuacuugggagacucaggcaggagaaucacuugaaccguggaggcagagguugcagugagcugaaaucacgccagugcacaccagccugggcgacagagugagacuuugucucaaagaaaaaaaagauacuacaugaucucauauauauggaaucuacaaaagucaaauuuguaaaaguuuggggauauucuuaacuauaauucuaaaacuuauuaguuuuuuuggccauuaauuucaugaaauucuugccaccaauuucauuuucuugucucacugaguuguuuacagucucauucucuuuguuuucacuuuucuucccaauccuguucuuuguccagagacuaauagugauuauaaugaaaaugggaaggagauggugaaaaagaagaaaccuggggaaucugucauuugggaaauuuuuauuuuaauauuuaagaaauggcuauuauuuaauuaagauaaaaauaacauuuuagguuuuuucuuguuuucuuuuggagggaauuaaacuugggacagugaucucuuuaaaacauucagguaagaaagcuugccuggggcaagugaaagaaacuaucucauaggaauacagcaugaagugcaguauuuauguuauuguacauaguuuccuuuuccucuucuagaacuuaccuacagugaguaauaugggccugucaugaaaauguguaauuucauuuguuguuuauuuucuuuauaucuuuuuuuaauagaaaauacugcaguuucuaccugaacgaauuuucuuucgauggcauuaccagaguauagguaagaacaauuaaaaauuuuuuaguaauaugaauuucuuccaguugaauuuucaguaauguuuuauauaauugauaucaucaagauagcuuauagaaaggaauauuaauaaggguaugguauuaugguaaugaaaaccaagacaaguucaacccugacuuuggagacaaauaugucucucucuuccucugugugcuccuuagaguauaguucauaggccagcagcauaagccucacccagaagcuuguuagagaugcagaaucucaggucccagccagaccuccugaaucacaguaguguguauuuuuuuuuuuuuuuuuuuuuuuuuuuuuugagauggagucuugcucugucgccuaggcuggagugcaguggugugaucucggcucauugcaaccuccgccucccgaguucaagugauucuccugccucagccuccagaguagcugggauuacaggcaugcgccaccaugcccggcuaauuuuuuuuuuguauuuuuaguagagaugggguuucaccauguuggccaggcugucucgaacuccuggccucaagcgauccacccgccuuggcuucccaaagugcugggauuauagguguaagccaccgugcccagccaagagaauucuuguucuuuaagccuguaucauugacugaaaauuauucucuuugaaugcuuuaggauguggcauugagaggaaacuugaaauaaagcaaauuaccacagcugccuuuucuguccagcuuuuaaccucuaacaucucaucccacuugaauauacacagcacagcuggaguaauucugggaaaucaaucgugaauucugccuuccguuuuaaacagugucuccuucaauccccugccguacaagagucuagcauguccuacaagauuucuuacuuaccagaugauuguauuuguggagagugugaccuuaugauggaaucuaacucuguuugaucauucauucauucaaauauuuguugagggagagacauuugugugcaaaguucugggacagaaacuaagaauauaucaccauucuuguauuguauaggccuuuugcccagucaggggauagaugagaaaaauaauuacagcaaaauugucucuaugaaagaaguaugaugauaacaaaaaagaaaaguugaauaauucuguucagaggaauugaggaaggcuucaagagagguaacuuugaucugagccuugaaagaugaacaggugcaguuuggaaaggguuuucugggugggagaucaauauguacaaaguuguggaaccugaaagaaugcaacaugauuaguggauauuccaaaauucuaaauccuaaauuucauuuaggauuauucaauuauuaaaauugaauugacuguuauagaaacugaauuauuugaaguuauauguucuuaauuuaaaaaaguguauaugucaauugaaccaaauguguaaaucauuacuuuaagauagugccuuuaucuuuaaauauuucaaauacacaaagaaaguuuuccuuuaaauuuuagagaguucuccauugcauuucugcuuaauugagacuuucagcuuguguuuuuaaauuaaaguaaaaauaaaaauuuaaauguaagguauaauccaaagagacaucauggggauuuguggugcuccaugguaccguaggaauggcugacaaugagaaauaacugcaugcaguauuuuuuaucugugcuacauauaauccuucuucaauuuuguuuauaucauuuguaugaaaacuaugcuaauuuucuuuagauagcacuuuagaaugucugaagauuaguaggcucuucacagcaugaauaaacuuauuaggacuaugugugaaaauuaauuugcauuuguguugugaaacuaugugucuaguaggcaguguguaguauuauuuuaauucugccuaauaccacauaaacugguuaaaauugcugguacaaguagcuuuuuacccaguuuggcagcaucuuagcaagaacaaugacuggaggccucagacuccucaauugagauugccaaauacugaguuuccugagccaucuaauagcaguauguguuguuuaucuggugugcagaacaagcuggugcuguaaaguggucagaaugaauaauauuucagaauguugaaauaugagcauuugcauguaaaauaauccacauuuauuacugaugcuuauauacuuaaagucaaacaggcucuuuucagacaaauauauuuuugcauaauaaucauauuggguggaaauugguguugacacagguccacaucgcuucuacagugaucuuuacuagaugugcuuuggaaucaggcauuuucagauuuuagaaugacaauguggugcguugauguacaaugaagcaaauaaauuagaacaucaagacaaucuuaacauaacacuuccaguggccugggcagcgccuucuccucccggccccaacuaagcaaguuauuauuucuauagcuuaagauaagaauauguaccauuaguggaauaucuacacacaagauagccuuauucggguguugcaggcauaugaauucagauuagguucuguccacuaaugacuuacacagaagaacuucaguuuuccuauaaucuuuuggauuuugaaaugguccauaagagauuauggauuuguaauuauauacauauauaccucacuguaccuauugaauuauuuccaguuuauuuggauuuuuaaaacuguuaccauuagucaguccgggucuugacugaguuguuguagaaacuuagaaacuauagggaaauaccagguaucaaaggaaaggaauaugcuuuaaauauguccucagcauuggcauccugacuuuuacaaaacuucugagucuugggcaaggaggggccuucucaccaaccagugucugauauucuagguagcaaauauuccuuaccuacuagggaggacacuccuauacuaaugucuuacuaauuaaauguuacugcagcuggugggggacaggguauucuaaaauguuggguuaaaaccuugaaguuguaguuauacaccacugaugcgguaugcuucuugucccacacugcaaaugacagugucucuaagcagagaaaccuaaaauaagggcaacugcuguauucuaugagucucgaaagccacauuuuauccugagaaggaagaaaauaguuugaaacaucaaccaccacagugcuugaagucuguuucuuaucaugucaucuuauuuugucuguagaaaacagagacauucuauuucucuuaaaacugcuuuuaaagggaagggauaaucugcgguuuuuguuuugguuuuuaauggcuggcuccuugcuuuaaaucguugaaugaggaaacauauuugaacucguaaguuuugcaaugugaaaugaacauggguucauuauuccaucuggagguauuucuucaagugauguuuguacagcaagaugaccaggggagugguuggcacaauacucaugagcucugcauuguacacuaauauacaacucaacuauuugucaauuucuauuacugacuacgaaagaaaaaauuguuuaucaaauuuuuucugaagucauuuuuuaggccaguaaaucaugguggauaaaggugacugcuugacaucucauuucugggcaauaauuagaacugauagagagugaggcaauggcaaagaaucgcacuggcagcaaaccagggauauuugguauaagggcaggcugcgcaucgucaacacaggacuuaaguuauauguguguugacuuuaagaaggcuuacugcucuggagccucuagaaaccaaguuuccugucucauucaguguacagugcugugcccgaacucaauaauuauuugucagguaggcagaaggauauauuuuguauuagagauguuuuauauaaaaaauguuaaaaaugaauaaucccuagguuuaaaggggugggguucaguuauuggaaaauucacauaugugcaauaccucauauguuuuuuaugagucauuauuaaaucuaguuuguucaccuagguuuuuuauauacauaauguaaaaaccaaaggccuaacuaagcugaaaauuuguuuuuugcuuuuuaaguguauuccaggcuuugggccugggacuaaccaguggccccacauugccugggaugugaacauagccucugaccagucucauuucucaaggucccuacuccccacuggguccuaacuuuuccuugggagccugagucuggcagcuuucccugcuccccucauucagaccauaccauaccucacucuuccugagagagcaggguuucccugugcacuucacacaggacucccucagaagugcaucacagccaggcugggugaaaucagggaccccaccugccuccauguucagcaggagaugucuggaacuaaugccccugguagcuuaggggccaacucaccugguguuuuuccaugcccucucagggugcuuuuaccguuacugcucugugcuucuuccccucccaggcacuucuuuguguuuugcccucuggggggguccucuucuugcguuaaacaauagcccugaaaccucagccucuuucuuucaccucccugaccaucugaaaccugacuuuugucugaagcuccucugucucccucaggagugggggugagaucauggucuuucuuuucucccaugccaauucuagacaucagccaccauucccucuguggaaaccucugucccuuuuacaugccaucuucuaccuccugguugcugccaugucuuuugaccuccugcucgcuugccuuccccccaucccccauggcuuuguucucuccuagcccuuuuccuucaugccaaguuacccaucaacccccaccgcaauccucugugccucaauggcuucagacacugaucucugucuugaccacauccuccauucuccugaucuuugacccaaucacuuccaggucgccugaucuuuuuuucuuauauuaaaaaaaaaauauuuauggggggugguuaacaauuuauacacaguaaauuacauauauuuaaaaugcacauuuugauaaguuuugacauagguauacauauaugaaaucauuacuaccaucaagauaaugaacauagguacuacccccgaaaguuuccucgucccccuugguaaucccgcucucccaucuuuucucaucucaucccccagucccuaggcaaccacugaucugcuuuucuggcccuuguagacuagcuugcguuuucuagagucuuacauaaguagaaucaugaaguauguacucuucuuuguuuggcuuuuuucacuuggcguaauuauuuuaggguuuauuuauauuauuucaugaauuaauaguucauuccuucuaauuucugaguaguacaguauuccauuguguggacaugucauaauuccauaauuuauucagguauugauggucauuuggauuguuucuagcaucuggggcuauuauaaguaaagcuacuauaaacauuuaugcucgucuuugugugaacauaugguuuccugucucuugggaguggaauggcugaaccauguaacaguguauguuuaacuacuagacuguuuuccaaagugguuguaccauuuuauauuccuaccagcaacauaagagcuccaguuacuccacguucucuucaacauuuguuaugaucagucuuuuuauuuuagugauagugguaucucauugacuaauaauaauaaucuuaagcaucuuuuuaugugcuuauuugccauuacuuugucuucuuuggugaaguucaaaucuauugcccauuaaaaaaaaucucagauugaugccuuggaaauauuuucuccccauuucuggcuugucuuuucauucccuuaauagugucuuuggaaaaguugaaguuuuuaauuuuuaagaaauccaguuaaucaguuuuuucuuuuauggauugugcuuuugaugucauguguaacacauguuugccuaacccaaagucacaaagaucuuuuauguuuucauauagcaguucuauaguuuaggucuuugauccauuuugagcuaauuuauguuaauuucaaauuuuuuaguggaaugcugguuccucaugcuuaguguggaucuuguagugccaggaaguucucuguucguauuccacuggccucuucuagcaggcuuggcauaccauuagcccagagggaguuucucucuuucuugcuucuuguuugaugcugaugguguacugcauuguguguaauuugguuugaagugugauauugagaaggagguuuuaaaaaauuaaaacuaaauaagaaaagauuuuauaauguuaaaguuuuaggugagaaauaucuguaugaucuccuggccuuaaaaauauuauuaaaagaucuuuaaaagauuguuacuuguucaaagagaaauugucaaaugugacaauucuuacaaucuaaaaugagaagcaaagaaauagauuuugaaaauauuauugaugaauuugcuuucuucagagccaggaaaguaauauuauaauacauucuuuguuauaaauaaaauauuuaaacuaaugcugugaguuuuaauacauccaauuuuacauuuuuaagcuacuuuaauguucugcacgagaaaaaaaaauuaaaaguacauagaaacacacauacagaaguauacccuuuuucuuuucccucugguuccuauaugguucagcggaacauuaguaauuaaaaauuuaauauuguucauuauggauucuuugcauuuuuuaaaaugcaauuuuuaaaaaccauugcaugaaaauauuuaucuugauuaaugaguuuuuuaguaucccuuaaauuuuuuucagaaucuacacucuucucucacuaguugcagcccugacguuuuuacugccucuucaaaaguaguaagacuuacauucaaaggauauuuaugguuaaaauguaguaaaaguuagccaauagaaauuagaaauucauagaaucagcccaaguaauuagaucuuauuuacuuauucuuucaguuauucccauggucaaggcacagaagaggugggguggguauaauuauaguuugaauaagaaguuuaaaaauccaaacaggcaugacauauauagaggaacuuaaaaauuaaaacaaaaugagaaaugacuugauaauguuaaaguagaaauaucuuugugaacuuaaggccuuaaaaaauaccuacagagggcugggcgcauuggcucacaccuguaaucccaggacuuugggaggccaaggugggcggaucaccauauggugaaaccccaugucuacuaaaauacaaaaaauuagccaggcaugguggcgcaugccuguagucuuagcuacucaggaggcuggggaacaagaaucacuugagcccuagaggcggagguugcaguaagcugagaucgcgccacugcacuccaguuuaggcuacagagugagaccccaucucaaaaagaaaaaaaaaaagcccuacagaggccaagcaagguucucagcuacuuauuaccaguccucaugcuaugugccuccacugcacauguuuuucuugcuaauuuuuuuuuuuuuuauuauuaaaaaagaguuccuuagagaauagcugaugcccuguccuguguggaaaaugugcuuaccacauacccggcacuguucugugcauuuauauguauuaacucguuuaaaucucacugucaguugucugauaaguacuauugucaccucauuuuacagaugagagaacucaggcauagugagaugaaguuacuaacuuagguuacaguuaauaaaugcagaaccuagauuugaacccuagcagucuagcuucugaaucugacuuauaacugcuaagcuguacugcuucccauguacaaacgaguuuuucacuacaacagaauagacuagaucaaauacauauguauuaguuuucuguugcugcuguaacaaauugccagauaaauuuuaaaaaguuugggaccauugaccaauaugggucauguguucuauaugucugcauguaaugcccuuucuauauguauuuuucuccucuguguguagagaacagugguuauaggcaucuauagguaguccaaauacuuaaaaaacaacacuaacggccgggcacggugguucacaccuguaaucccagcacuuugggaggccgaggcggguggauugccugagcucaggaguuugagaucagccuggcuaacacggugaaaccccaucucuacuaaaauacaaaaaauagccuggcguggugguaugcaccuauaaucccagcuacucaggaggcugaggcaggagaauugcuagaacccaggagguggagguugcagugagccgagaucguaccacugcacuccagccugagcgacagagcaagacucugucucaaaaaaaaaaaaaaaaaaaaaaaaaagcaccaccaccaccaaaaacaagccagacccaucuuaacaaggggaaggacuaacaagcaccaaugcucacacacaaugaccaggagaaaguauuuccaagaauauguugcaagaugauggauuagccagauggcuggaaagagaacugucugugcagacuuuaucauuaggucuccugggaggucuaguaucuguuggcucugccagccaccauaagguguaaugaaguagauguuaaacugacuuagaacaaacucuccaagaauggaugaacauggggacaaagaacaaggccccagguugaggaaaggugugggcuagauggacacuugaaccuuagcugugacagagagagccagccuaguaaauguuggcucuagaccaaaaauuacuggauacaguuuugugaagggagaaguuggggaaggggagacacuuucgcuucauucacucaagcacaaacuauuaguuauuuaagugcuagaaccuagccugagucaugaugaugaguuuccuccaagcccuaguguuaguuguuaugaacaguagaaucguucuaaaagguuccuucggauugccagugauuuuuuucuggcuaaugaauuucuaaagaguaugcauuuaguuauuauauauguauuuaucaauguagcuguggcuuguaucaguugccaaaacacuggcucucuuguuagaggagcucuaugaaauucauugguggaguaaauauuauuugauauccaguuguuaaagagcuaucacaaacuuuucaucagaggaucuaaguaauuuuuuucuuaaaggaucugaaauuugacugagaggaaaguucucuugccucagauuuucaguauauuucuguuuuaaaagaucaucuccuuuuuugagguuaagaucccguuuuagaggcuacauaagauauuuaggugggguugccaucuccauacugaggucaugaauacauuuauagaagacuuaguaauaguguucuauccuccuaagagaagcuuuucucauucuagugggcugcagcaccaguuuuuguaguugacuggaguuccgagucagccuugauucugccuccuugacagugaccaaagcgcucugcuagaggauuuauugauggaccaaaccccauaaaugugguugucauugccaggagagaaacaugccauucuaaguauuuguaaaauguucuuguaaaaauguuuugugagcaauuguuuuacauuauuuuuaccuuuagagauuaaaaaaaaaagcauccauuuuaugcaugacaagagauauaugcgcauaauccacugugggcauuuggcuuaccuuaauaucagucauuuugacuguuuuaaaagaauucugaagagauacauacuuaagguacuuuuaucuugaaaacgucuuucccucugugacauugcuuugcuucugaaggucagccuucuuccuuuuauuuuuaaaaaguauauuuuugucauaaguacauauuuucuuaaaauagaucuuugauaugcauuuauauacucuauuuauaauucauuauuuuaaacuuucaggcucaacuuuaaagaagcuucuacacacuggaaauucuauuaagguauuuauuuuauuguguaaugacauuuuuuauuacucuuaaauuuguuaaugccacaaaguaacaauguuagggcauuuuggaaaaaagaucuuuagaaaccacuugacuuaguuuuaauuuuuaauugagaaauuauauuguuaggguuuuguucuuacaucauaacuuauugcgagagacauuuuaaauaguauuaggagaaaauggguugggcuucagaguuuagaguucugaguucuaauucugauucugcuggguauggguagggaccaugggcaaggcacugacugcuccaguuuuaucaucagaaaaaggaagugcagucgcccucuaagcuucagagcucacaugcuugauucuguccaucuugguaaccugguuguuaaaauuauaguugucucuaauuaauuuuacuaauugugagagccauugugggagaaaagaacaacagggucucacucuugaauauuuauuuguggcagauuuauagguuaaaauugguuuauuuugaaauggauaugucuuuuauuauaacauauacuucuugaugcugagauaagauuacccuaaaacauaaauggcagaaaaaauucagccugggaugaauauuuuaugaaagguaauucacuuggaguuaauuaaguugugcgaaugccuuuaauaagcuaauauauugguugguuuacauuggcuuaaacaaucacagccucugaaaacuugauauguuaacuauuucuuacauguugaaaaaaaacgaagugaguuauuccuagcgucacuguagauucuauauuuugucccucuuauuuuaaggaaauaggcuuguaguuaaaaccuaucagguuguuaaucucauguuuauaacuacccuuauuuauauuuaguucucuuaaauacaguuaacauauaacaauuggagacuugugguagaauuucauagaaacuucccucuuguucaauuaaauauaauuugauuagauauacauagagcuggccaggcacaguggcucaugccuguaaccccagcacuuugggaggccgaggcaggcaaauugccugaggucaggaguucgagaccagccuggccaacauggugaaaccccgucucuacuaaaaauacaaaaauuagccgggcaugguggcauacgccuauagucucagcuacucgggaggcugaggcaggagaauugcuuccaccugggaggcagagguugcagugagcugagaucaugccacugcacuccagccugggcaacagagugaaacuccaucccccgaccccugccucaaaaaaagaaaaaagauauacauagagccuucucuucccuccccuccccuccccuccccuccccuccccuucucuccccuccccuccccuccccuccccuccccuccccucucggucugauggcugaauaguaauguuaccacucauuuuaccugcuugggagaggaggacaggugugagugggcauggagguuugugcagaacagugguggaguccaggacuguguuuggaaguacacugugaauuuaccccguuaauggggcaguacugucaccagcuggggugucuguccuaguguauuuuggcuucuauugggagaaagcagaauauuuuuauuuauuuauuuaggcuuuucuccacuuuuugguuugguuuucuggcaaagcuuuguguuugacuugcaauauucuugcucugguggagucagcaccaccuugaauuaauugaaaggagaugaggcagucacuccaguugcuggcauuuggagcucacuacaucuuucagcugcaugugacauuuuuucaaccucuuuugcuuuuuuuuuuuuauugacauaaucuuuucaguuauuuaggaauacagaaauggagggacaugugcuuuugaauucuaggaaugggauaaauuugaaguguaaagaaagaaaaaggacacaucucccuauguagaugucuccuacagcgugaugcuggcaauucagagcauggcaaagguguuggagaaauagaauagggacauaagguauaagaagagcugcucugucucauugagguuauuuagcuccauaucuucugauucucaagaacauuaucaacauggcauauuauagugauagcacauguaaauuuggagggagauuaucuuugucauuguuuuuauggauaauugaggccguggguacuguugccuuacagaauaagauacuauuaacaggaaacacuuacauagugcuuacugggaguuagccauuguguuauuugguuuacauauguuaacucagucuuuaucauagucuuuugugguaaaugucuuaucauccuuauuuuacagauggggagacuaaggcauggagaaguuaagugguucuccaugggucccagcuagaaaguggcagcgcuuacauuugaacccaggcacuuuggcuccagaacccaggcucuuaacucuugugcuguauugcagcaucuuugcuuauuugucacuaagugaagaauuugguuuacuacuuaacacaccuuuaacuuguaguuuuucuuucucaagaccgaugcuacauuguaaugcauuucuguaaauacauguguuucauuuucauuguuuuuaauuuuguuuuagauaagaugugaaggaaucaggcuguuucuucuguggcuucaagcacuucagacaaacugugcagaagagcagguucugauuuuugcuugccuggugccugguuucccagcagucaugucauccaggggcccuugcacacuggagacacucaucaaucccagcccuaguguagcugaugguaaguuauguuagcagaucucccauguugaaauuacucuugaacuuacauugaggaauucuuacuuuuucauuuucuugaauagaaauccugauggagucugaagaggaauuauuccccuuucauauucacuguagauucuuacauaccuuagaaucaaaagacuuggagcuuauuuuauaugaaaugaaaacaggagaaauguacugaagugauggaagcaggaauaggaggggacagauguuggcaguagcacgaaguagagacacaugggaagucuggacugguuuucuggcuguuaaugagauuaaacuccaccauccaaagcuauuguuuuuauuguucuuaucacuguuguucguaaguggacauucaucugcucaccaggaucuuauuuugccacuguauuuuccugcaucaucuauggaaggacaauaguggccucaugggacuauuaacgguggucauuuguguccugugaguuuucaaggaacuugccuguuaggaccauugauuuauuacuguauauugcguuauugcuuaaugacuggcauuugaucuugggcugaccaaagcagaauuugaacgggaaagaauggugcagcaggagaaggcgcuucgugggcaucugggcuguguuuccaggcccuuuaugcacacugccuuggagugugcuccucagugugagcugcuucaguggauggagagauguauuuuaauagagaccauuuuuaaaacccuaaauucuguuuaaaauuuaacuuuggugaaugagcugucaucauuuucuguccuuucaguaaagauauauccagaagaaaucacuccacuccuaccagccauaucaggggagaagauugcugaggaccaaaccugcuuuuuucuucaaauacuguugaaguauaugguuauucaggucagagaaaaauuaugacuauuucagugauggguuuauucucagcaggaagaggaaauauugccucuuuucccucuguguaucuauauuuuuccucuuucuuuuucuuugaggugauuuuaugugauauuucagcaaaugcagaguguguaccauuuuuuaggucacuucagcaagaccagcuguauguacuauuuugugaguguguuuaaaccauuuuucucucuuuacuccuuuccuaccccuaaucucuaugcuugcaagacagguugaaggaggaggcgggcccagaggcugaacagguggacaggaauaggcagagcagaccaggggaucugaagggaagcacauggagcaaucuccucaugccauuggcacaggccuccuuuaugucauguauuauuuuucucauaugcaccaauugccuacagaacugaaguaacugguuuaugauuuuaauaggagauuugugacuccuggucuagauuucugaauaauaguuagaauaaaauguacugauucuuuuuucucagcaaauacuucucuuguccuugaguucauccuggguauuguccaguaucugucuuccccuucacaaccgaguuguugaaguaauaaucucuacugaguucacauccucauucauguucuuuugacacccacuguuagcugccuucugcccugucacugcuaaaguggcaagccccaaaccacaaggguucuagggucagcccagaaggagggcacacuucagguuuugcucuccucauucuucgaggggauuuaacuaccccuccuucaugagauucucuccucuucugauauuuucucuggcaauucuccucccuuccuuucacuccuuucuaguuuucuuuagggaacugugcuuuucucugcugucucucaagauucaguacuuggcugcucuuucugaauacuuagcaauuuuguccccuuuccuugccccuuugccuuuagccagcaacagaaacacaggacuucacaauccugagaaccugacuggggcaugcuuucauauucuggaaacuccacauuugaacucuaauggcccauucuagaugcaucucaaaugccagcuguucagaaguguuuggacauucaguuuauccuggaaaaucaacagaguauccagaacuuguguugggggccuuggguucucauucuaggugugucacuaaugaguugugugaccucagauaaggcggauggaauugauauaggauagagguuugcaugcagacugugaacuuccuaauugugugcagaguuuuaggugcauaucugugccucccuucugccuucucuucugucgauugagaugaguucucagagcacagcuuuuggcagguuauggaugcugaaccccgcugccccugcgguagccaaagcaucucaucccuuuaccucaggugcugcacaaauuucauuuucuaagugggcaugucaggaaggaaguugggaagcccugcuuuagagugcucuguggucuaacaagcauuaagaaccaccaacaggucuuaucuaagggcuguguuucccuaagucauguugggggugacugcacuuguguaaccaggcuguccuccuggcuccugaggggcggucccagcuauugagcaguuuuggagugcucccacuaugcaaacacugauggguuuuugagggggaggauauuaucucaacacaaugaaacauuuaaacuuaauccauaguggacuggcaugucugguuuaucguagccuuugaauuuuuuuaauacggagaaugcauuuuccaagauuccauggcuuuugccuuuugauauugguuuuacauguagguaacauugguugaaauucuugagagggauuguuucuuuaauuucuauuuauuauaaauggccuuuuucugaguuuagaaaaaaacaccugauuguuugugacuaaauguuuuaaaggcacaaggaauguuagauaauuacaaaaaacguagagaaaaaauaugggcaugauacauuacagcacguuauaaaagauacgauaucauugagcaauuugguucuaaguaaaaaugcuguuuuuaacauaguuacuguuuuguuuugaaguauucauuccugccaucuuuugagcuuuguuauuauuucauuacaugauugucaauauuauuugucauuuuuuacauuuagguuaggaauuuuaguaacauaacaacacuucaguuuaguauauguuaauuugaaauauaaauauacauauguucuuuuccacauauuauccaaaggcugcgagcuuggaguggaagaauaaggagaaucaagauacugguuuuaaauuucuuuuuacauuguuucgaaaguauuaucuuccucauuuauuuccaucauuuacuaaguuaacaaacaucuacaaaccuguacuugguaaguacuguuggagccguguauagaggauauccaaaggaaagcuaugcagucucuuucaaagugaccuuugauuauuuuaaaguaaaauagucauuuuauuuuuguauugaaugguaacuuuauuauuaaauguuuaaaguuucuuaauaagugauuuuaauuauuuguaccaacuaagauauaccucagcuuacagcaguaaaagggaaccguggcuccuauacucagaaauaauuugaaauguauuuaugauauuuuugguauaauuacauugucaucuuuuaauguaaaaaucucugcauuuccugaagucuuuccuuguggguggugggguauggcgaccucaggcuuugcucagugacuggaggccagcccaaggcaaacagcugccauuguaugccuuuuauuuuaugcuggguccugcauccagcagcuacuacugacaggugcuuauggagaaccaaauuuuaggugauuggacaagcuauggacaguaagccccagaggacuaggaaacagaaaggaauuuccaauuuggcuccuaauguuuuuuucuucuguaagcaaugaggacucacaggacagaagcaucccuuagagugguaaaggugggggucaaaucuuccucucccuauuauuuaaaacagguaaaacuaguucaaaugaauaauuaaaaacaguuuuggaggggaaguggugacacgagauguuacuuuuuuggggaacauggucaccugauucaguugucuguacucuguguguuucuauguaugcguacacacacacacacacacacacacauacacacacacacacacacggggagagaagccaaaacuuggugaguuuugaaagauguagaauuacugacuuuuaggugcacugggacauguauuucuuuagcuauauauaugugaauauuuuuucaaaauuuguuucugauuuuauauguagucuaaauucauuuuaaaaacaugguauauuguuaauauuccuagauuaaaaguuauuuguugaucauuuuucugccucauacagguauuccagauauacaaaaauuauuaagauagagaguugaacuuauggcaaguaguaucucaaauccaauaccauauaauuuucauauugauuauggaauuuaaagaaugagaaacugacuucuuauuaagucuuuggaaaagguagcauuugaugccucaaaggugaaaugugacuuucuuaauucuuuuaaauauaaaguagaugauauugauucuguuucauuggauucaucuaaagggaaaaggauauaaaccucuaaaguucaguggauuuaaucacugcaguguuagauguuaaaauaccuaaaaugauguuuuaaaaguucauauauacuuuuacauuuguuccagcuauaaaauaaaauuaaauuagguauaauguaugugaaaagauguuuacuauuauagucucauguaauuuaucaaaauuguuaaaaauaguuguuagcuuaguuuuuccauagcuguauaucauagauacauaaacaaucaccaucaucacucauucucagucagaucacaaggcggaaucagaaaggagccuaccaaaaaaaugccauuuuaaauaauugcgguucuucauucuuaguugcuauuuagacaaccaaaaauuggauuuaauuggaaaccaaaacauuuguagggauuacuuaauguuaugauuuauuaaccuaaucaaucauguguucuuucuucuaccagacaucccccauuugagaccaaagccuguguacauuacuaccacucgagacaaugagaacauuuacaguacaaagauuccauauauggcagcucguguuguuuuuauuaaguggauuguaaccuucuuuuuggaaaaaaaguaucuaacugcaacacaaaacacuaaaaauggaguugauguauugccuaaaaucauccagguaugccauccaucaucuuuuuaucuguuaaugcuuguguaauaaaauacacuggaacauagccaaaguuauugauuguuagaguuauugguucuuacaaguuguugguuauagguaagugauuuuauuggccuacccugucuguaaugccaagguuucagagggaguugugaguuugaaucacuugcugugcauuguugggacugccaugaugaugcaaucucgggagccauuuugagaagauagcuguugugugcacacuccuggcuccuccucauucuccucacuugaguaccaguggccucugagcaugagaacagaggccugucuugcuuucaccaagccccaguagcuggaaggcacuuaggaaacuguaaguggccccuggaaaggaccugugaagcugccgagcacccucuggcaucucaggagagggaaguagaucagcagcucaggauuuggggcuggcuguugagcaaugguggggccccuagaagagaagcccaccucuucccagaggccuucagaagagaccucuccuuguguggggccuguugugcuuuuucucucuuggccuuggucagccauacacaauuggggucuuucccaacaggcugaguuacuuagggacuugguggagcacuaccauuuguggaggucagagagcagccacuucgcuaagggaucaugguguugugugcucuuuuguuuauuguccccaagaacagggauaggaagucugguccacugacugcagauuugccgaugcccuagaagucucagaacuccgaccuaggccugagcugaaagaaugcacagaccugaggaggcagauaaguggcucuugugcuucaagguuauuaggaaccuugauggaggaacaccaaacagucuagagcaugcggcuccacuggggagaagucacugaagaguuagaggagaacuuauuuuuaagaucugagggaggugcaguuacaguaagaacaaugaaagacuugcugaaagaaaguuuuaagaaaccuuuaaaugucuuaguuuaaaaaauuagcaaauaaaaugaaaaugauaaugauuauugcugggaaaaaaauuaguuuucugaaaaaagaucccaugacagugacuaaaaacuuagaguucgaaaucagaaauuaguagacaagaucuaaguacaggucccuaccuuacaaauauuagguggguggaagaagaagagaaugagaauaauugaacaaauaauaagaguuuaucugaacugaaaaaaaaaaauaaaaaggugugccucaaacuuaaagggucuuugagucccaggaaaaaguaucaagauacaaaccuaaacagacauuugauuuucaggaauuaagagacaguaguauagguuuccagacagguugcuucaaaggaaugagacugagauuaguauugaacaucuaaucaaaucugcaauccugcaaucucuuucucucucuccuucauacacauacacauccccccacaggaugucagucaagauuaaaagaaagaaucauuaauuaaugguauuggaauaguuggcuagaaccuugccucuuacaacauacugaagcaaaugucagauuuauuuaaggucuacaauaaaaacaaaauaaugaagaaauguaggcugggcacgguggcucacaccuguauucccagcacuuugggaagcugaggcaggcagaucaugaggucaggagaucgagaccauccuugcuaacauggugaaaccccaucucuaguaaaaauuagccgggcgugguggcggguaccuguagucccagcuauucaggaaacugaggaaggagaauggcaugaacccaggaggcggagcuugcacugagcggagaucgcgccacugcacuccagccugggcgacagagcgagacuguaagagaagggaaaauccaggagagugucuaaauuugggaagugguagacuaccuuagguagaaauaagacccaguaggcugggcgcaguggcucucgccuguaaucccagcacuuugggaggccaagacaggcagaucacuugaagucaggaguucgagaccagccuggccaacauggugaaaugccgucucuacaaaaaauacaaaaauuagcugggcguggugguaggcgucuguaaucccagcuacucgggaagcugaggcaggagaaucgcuugaaccugggagguggagguuggagugagcagagauugugccacugcauuccagucugggcaacagagugagacucccauuucaaaaaagaagaaagaaagaaagaaaagaaagagagagaaagaaagagaagggagggaggaaggaaaggaggaaagaaagagaaagagaaaagaaagaaaggaaggaaagaaaaagaaagaaagaaagagagagagagagagaaagacccaguagccguggaagaaaugagguuugacuuuauuuaaaaaaaaaaaagugaaagauuuuuaugucuaaagacuacagaaggccaaauccaaucaauagacuaugaaguaacauugugacuguuaaaagaguuaauaucucugcuauguaaagaguacccauggacugguaagaagacaaacaaccccacugaaaaauagacuaaggagaugaaagggcagcucauagaaggcagacuacagggaccccugauuucaccggcagucagagaaaugcaguuaguucugaaccaugaugagauaccuuuauucacuuaucaggcagacaaaaaucuguaugaaauuauguguaggaaacucagucaugcucuuuggcaaauuuacaucacaucuuaagugauugucacucaguucaaaaaagucuuaauuaauggguguaaccuuuccucucugguuuaaaaaggucagaaaaccaucaccuguauuuauugaaaauaaguagcucauucuugaaaaguacaucuggaugaugagaaguagaaagaacagcaaauuaaccacugcuuccagcuucugauuuuuucuuuuacuugacucuucacaguugugagucaucuacuuuuacuaucuagcuuuuuuaacaucuuaaagguuggaacuuuggaaucaauuaggggccgggcacgguggcucacacauguaaucccagcacuuugggaggccgaggcgggcggaucacgaggucaggagaucgagaccauccuggcuaacacggugaaaccccgucuguacugaaaaaaaaauacaaaaaaauuagcugggcaugguggcgggcgccuguagucccagcuacucaggaggcugaggcaggagaaaggcauggacccaggaggcggagcuugcagugagcggagaucgagccacugcacuccagccugggcaacugagcgagacucugucucaaaaaaaaaaaaaaagcugggugugugaaugggccaggagaugucaugauuguccuccacaaaacagauuggucccuaguacuguggauggggucagcuuccugcaagucaguugaggugcaugggaggaggcacacagaggacugagguucugguagggagggagaaagagugcugggcugacagccauuuguaccuucugugccaucauacccugcaguugacugucccuagaaauggccacuaccauucuagagacugccacuauaccucacaguaaguuguuguguuaguuucuuacugccacuauugcagauucucacaaacuuaaugucuugaaacaguacaaauuuauuaucuuacaguucugaaagucagaaauccaaaaucaaguuauuggcagaucuguguuccuucucaagguucuaggggagaauccuguguucuugccauguccagcuucuagaagccaccuguauuccuuggcuguggcccugcaucacaccaccuuuucucccaguuuccaucaucacuuagccuucuuugucucuuauccuccugccacccucuuauaaggacccuuggauuauauugggaccauuuggauaauccaaaauaauuuuucuaucccaacauccuuaacuuaaucacaucuguuaugucucuuuugcccuggaagguaacacauucgcagauucuggggauuaggacauccuuggggaagucauuauucagcccaccagcacugguuggucugcaagguccaagaugacuucguucagaugccugcuacuugaugagggcaguuggaaaggaaagcugggcucauaugggacuucuuguucuguuuucugguuaauaagguaguugaacuucucauaugccuacucagggcuccaagagugaaauguuucaagagaugggaauuguuaacugucagccucuugggcccgggucugauaguggcuaggucucuuccacucuauucuacuggcuaaagcagucauacaguccauguagaugaaagggaggggacaugggccucacgucucuguggaaggaguguuaaagaauuuguggucaucuuuaauuugcuaucuaugugcauauuuuuuuuuucuuuuuuaguuuguggggaaaaugggaguuauaggucaaaaagucacagguuauugagccauaagagacuuuagaccuaaucuagccucuguguccuacagauuaacauauaugcguguguauaugugaaauccaagugcguugcguggguugccuuacaguuaggaauguggagaagcaaguuuuugagacuuaguuugggccucuucuuucuguaccauacucauccuugagucauuccugcugaagcuucagauagaaaaagaauaaaaugaauaaaguuuuauuuuccuguggaagauaguggaucuguaaaaaagauaaaauaauuuccauaggugagcacaucuuacagugcgacagugccuuucauaagccacacaggcuuaguaacuaaggcaugaagagaaaaauuauuacaaguauaauccauuaauuuucucuagagauuacuauuggauaucuguuuuguuuucaaacuguccuugguaguuacugaaauuacuguuuuguacuauucauaucuugucucuucuuguaaaaaauacucacaguggguaaauuuuaguuguauuugggcuauauauuuuugacacuuaaaaguaauaauggaguuugcaaaggugaagcaaaauuauauguauauuuuguuuggaguaaaccuuuaauucuauguggauacgagagcagaaaucaguguuaagcuuugugagugauugcaugaauuacuucauuucuuuggaugccuaaagucuuuuaaauguuuaaaauuuugugaauauuuauuuauguuugaccuaagauucugaggauaaagcucagaucagcauucuucugauaaaauacacuuuaaagaucuucacacuccacugucaagcugccgcuuagucauaugaaucaaaugaugccuccuagcauuguugcugcaagaaguccccugaauauuccaaucucugugaccauaggagcaaaugcuaaaguguagagaccugaugugaugauaauacaaauguuuuuacacauuaauuuauucugugguuuuacaaugcaaauuaaaccuuuuagauugggaaaauuucacagcccuccuuucugaaauagcuuaguaguuuuccucuuaaaauagcugaguugggagggauuuguugguuaguuagaaaauugguaaguacaggcucuggagccuaucgugcuucaagcugguuuugguuugcuguacccugugcacauugaugguaaccagaguuacuuaaaacaaggcaagacugaaguuuugccagguguucuugagugggggugagcaucauugagaagugugcugacuuucuuccagacuguuggugguggugcugugcaggagagagcgccugagcuggaugguggugggcccacggagcaggacaaaagccauucuaacagcagcaccuugucggaccgaagacucagcaacuccagccucuguagcauugaagaagagcaccgaaugguguaugaaaugguacagcggauucucuugucaacacgagguuaugucaacuucgugaaugaaguauuucaccagguuaguguguguguguguguguguguguguguguguguguguuacaaguucuugaaauggaaaugauuuuguuucauguucuuuuacuuguaacacgccaacaaauagaauuggugaguuggguuauguuacagaacugaauaauaaagaacgaucccucuaaucuuuuaauuugugaggauuguugugauuuuuaaauuuuguuguugcaaaauauuuacacaaggagggaaaauucuauauuugagcaaaaucaugagacaaauacuuucauguuuuuauaacaaaguaaacccagaguuaggugggaagaaagccguuccugaauacccagcaacaaaugaacauagcaaagaagaguccagucuucuucccagagccucacggagcucucugaggagcuggagguuucugcaaaaacucugcagaggcguguggcacucacaauaugauagaauuauuuauggcacaagagaaaaagguagguggcaaggggaauaaaaggaaagaaaggagcagaggccaagacacgaaaagaggugugagcaaaggaaggagacagaagaggucagaagcccaggcuacgguuaguggccgugagugacaucagagguuugcaacuggguuugaugcuacucccuaggggacauuagcaaugucuggaaacaguuuuggucaucacaacuggggagggggugcuacuggcaucuuagugggucgcagccagggauguuguuaaauauccugcaaugcccagaauggcccccacccccaccaugacaaagaacuaucuggcucaaugugucaguagugcugcuguggagaaacucaguacuagccuucaacacagcaaacagagcucccacaggucuggaguguggcguguggccagugccacuugacucuagguacuggugcucuugaaaacagggaauguggccuauugguggguauguguauaugagguggaauaguuguuuuguccauagaccugaaaaguagguuaagcccuugaauggcagaguccaguuguaggugaggaggagaagaagagucuuagacauaugaaugacgggaaugcaccacagagaacuucuuauggugaggcaaguuuuugagauagugaauguuuggcccucucacuucugggacuuucauuacaaaaaaucaaccaaaaacaaagucacaaccuaaucuauagcaguguagagauuuuaccauauuuucauuuuaaugaagaaaaaauuuuacuuaagaaaauguuuguuuagucugcaauuaacauuccacuuauaaaauauuuuuuucugguucuguggcccggcacugccuugguucuucucacucucugugucuucucuguuucaugucuuggccccucuuuuuguuucaccccaaauuacagguguuaaccaagauucagggcucaagucucugcuguaauucuacacuugccuccuuggggccuuuacugccuguccagugccagcaaccacuguggcauaugacucccagucaagccuuuugucuggaccucacuuguaaauaaaaacauuaauuucauuaaacaaauuuuuuauacucaugaaagauuuguuacuggcagcggauauaccacaccaggagccggaaagcauaaugcaaugcuacagaggccgguuacaccugagcacagcuucaagggcccucccucugcugcacagaaagugugcccucucgggaucaugauucaccaacaugagagugagaugucugucucagggaagacagggcacaaguuuacugagagggcuuuuagaccuaacuaaucacauggccaaaaucaggcagaaugacuggguaaaccagguguagacucucagugucuacauugucacugaacaauguagacaagguggcacugggugccuccuacacuugccuuuuaaaaugcccacgugccauccaaucugauguuccuguaguaucuuaaugauaacaagaccaaagccgggcugauuuuuuccccuaauaucaacuucuucuccugacuugacugcuucuucaaagggaccuguauucauguuugcaucuuaauuuuaaugauccuagguuccccaucucccucuccuccuaugacagucacuggacaagucacacaggaguuuugcucacuccuuuccucuccauuuucuuugacugugguuagcagcccucuccuuggagcucccauccuucugugucaucccuuucuagguaguacugcacacaucauacugccacaacuuuucuuuuuaucguaauaguccacgauuuuaaaaucuaccccauucccuacauuaauguugucauauucaugcuccuguuguacaugugaaagguccauagcaacuauugauuugaaauagucaagguccuggaguguaucaucuauagcaggggucagcacacuuuuuaaagcaaaaggccaacuaguaaauauuuuaggccucguggaucguacgucucugucacaggggcuaaacucugcuaugguagcaagaaagcagccagagauacauguaacaagugaggauggcugcguucuagaaaaauuuuauuuacaaaaauaggcagcaggcuggaugguuugcugacucugaucuauaguaacauuuuuaaaugcuugaaugaaaauacuucauaucagauaagaugacauuagcaaggcuuuuagaucuuagacaacagauaaaugcuauauuguugugguuuuaccuuuauuguguaauuguuaauuuaucauacaaauaauucugacuguaucuguuauuggcauccuaccccuggcaauagugugcucuaaauucuaaauucagucuaaauauuaaacccaaucuaaauucaauuuugaaguaguuuugaucauugaggugacuauagacuacauaugacugaaguuaugagacaucuuagugucaugaagcuuaaaaacauuuacauuuuauaauuuuucuuaaccagaucuaauuugaaagaguaacuguguaugugaaguuuaaaaucuaaguauuauguguuguuaaaauacugaaauagaaacauuugggaaaagaggaauggguuuuacaauugcauuuuauugcucuguuggucaaugaugaauuucucuuuuauggaaaacaaaaugugacuucuuucaaaauaacuauguuuuuucaacuuuaaauuaagauucacagauguuuaagccuaacgguuauuauaguuuaaaauggauguucaagaagugcacauucucaguggagagauaagguguguguguaugcugcagagaacagugugagaugguagaucagauguccaugagugacuugggaauaaaugcuggugagcuauuggggcagagaggcucaugacagaggcuaaagaaccaccuggugugggucaccuuggacuggguaguucagugaguugaaugugggugguggaaauagacaguaacugaaguaggacaaggcucaggguaucccucaucugcugccauccccagcaggaaggccaggcagugguagaaugcuucguguaggcaguccuggucacugggucacuucacuguaaacucgucuucucauuggcguuuuucagacuaccuguugugaccuauucguaggucaugaaaccaacuuagugagucaaaacuaguauuuuuuuuaaacaaugaaacagaauaaaauagaauagaacaaauauuucacaguguaguucaaguuguaaggauuacuauuucuuugugaaacuucuaauuuauuuauguguguacaauacuauauauacaaaugcauauauccuuugguaaagugucuuacuuaggcuaugaucugaaaaguuugaagcacugcucuaaaggauguuuguucauuagguuguuuuauugguugauuuuauuuuaaacagcuuuauuuuuauuaaaaaaucuauguucauuagauaaacaaagucucucuguauauguaauuauagaggagaaagcaaaagcaaaucccucgaaacaccaccauuaauguuagaagaaagucuggucuuucuauauguguauauauggcuggggccuggcuagcuacauagaugagacaccagcagagaggagauggguaagaaaggauuauaaacagacagaaagcaggcugguagagagacagggggguguacaggugaacugauagacaucagcaaacuggcaggcagguguagaagaacaaacaggugggugcagauaggccagcuggcagagauggaaauaagcaagcagguauagaccaauaggcagacagaaauaggcaggcaggcagaaaagcaagagggagggaggcauggguagagacaggugaagguggaaccagacagacgucaguugagauuaaggcaggcacaaggggagguauggaaaagugccugggguggggauggggacugacggaguaacuaugacaauggaauccuuaauucuucauucauucauucuuaauuaaugaaaauucugaauuuuacuugaauuuaacagaagaaaagacaguaaaggaaaagugaaggaauuguuuaaaauccaaugaauauuucuuuaccauaagaaguauuaauugcugaaagauuugucuaaacuaaaaaaaaauuauaauaacguugagguguuagaaucacuuuugaacuacacaugguaauuuuagauagcacuauggguuuccugcuaugaaauaugaauaaauuagcagccauguauuuucuuuagcccccucuaguuacuaauuucaucuuauuauacauuuauauuauaaauauagcaucauuggcaguugauuucagaauccuaauguacagaguuguuuagucuugauucuguauuuacacagauuaauucauccuguuccauaguucuaaaauacuuaauuuuucuugcuuggccuuguuuugucauugaguguuuucaggaagauguccuggaacgcuuaugccuuaaguccuuuuaugauggggaagguuuuucuuuugccuuucuuuuuuuuuuuuuuuuuuuuuggagauggagucucgcucccaucacacaggcuggagugcaguggugcgaucuuggcucauugcaaccuccaccucccggguucaagugauucuucuuccucagccucccaaauagcugggauuacaggcaugcaucaccacacccagcuaauuuuuguauuuuuaguagagacgggguuucgccauguuggccaagcuggucucgaacuccugaccucaggugauccacccgccuugguguuccaaauugcuaggaucacaggccugagcuaccgcguccagcgucuuuuuccuuuagguguaaagagcagcuuagcuggguauaaugaucuugggucauuuuuuuccccuugggaauuugugagucaaaacuuuucuagacauaaaaaucagaagaaacaggacaaucucacaaggacuucaguuguauaauuugagacuuuaggguaaauagguuuaacauauuuaaagaaauaaagaaauaaaagacaccaaaauagaugacgaaugcagauuaggaagaaaauagaacuuccagacauuaaaaagacauguaauaacuggaauauuaaaagaaaaccuaaauggauaaguuuaauuguagauuagaugcagcuaaggagagaaugagcuggaugacaaaucugaagaaauuauccugaaugcaccucagagagacagagaggugagagcugugagagguugagaccuggaggaucuggugagaagguucccaucuccccuggcugcauuauuuuuuugcuuaguguucuaccacuuuuggaagaguauccuacucugauuguggauuuguuuuuuuuuuuuuuuugaaagccuaucaguuuuugcucuauuuuuggcaaaauuauuaguugcaauacagacuuagaauuaguuuauauuccuuugaauugaaugcugucauuaagaaguuucugucuucaucucuaguaaugguuuucuggaggaggggcgcaaagucuaucuugucuauuuuugauauaacucuaccaguuuucuuuuggcuaguguuuguaugguacaucuuucgcuaacucuuuacuuucagccucccccguccauauguuuuggaugucuucuuauaaauugcagcgaagucuuuuaaacagauuuuuaaauuaaaucuuacaaucuuugucuuuugauuggaucauuauucauuacguuuaacauagcaacugcuguuagguuuuagucugcugucuucuuacuuucuaguuguauuggaccuucaagcucauuguuuuuaauaucccauuuuucuucucaaauuaaauuaguuuuacggucauuuguaguuacuuuaauaguuaacacaugcauuccuaacauaaaugcuagcauuaauuucaacuuuuacccucaguacacauguuagcucuauuuacuccucaguuuauaugccauuguuauuauuaugaauauguaauauguagauauuaucccuuucagaaccacuguaagguuuguuucauccaguuuuauucuuuuuauucauauauauuuucauauauauguuuuguucauuuagauuuauccacauucucuuuuuauugcauuuuauugcuucccaaaucucugaccagggaaaauuucccuucuaucuaaaggauaaguuuuaauauuucccuuagcucaggucuccugguagcaaauuuucucaucugaaaaugucuguauuuugcuuucauuuuagaaguguuuuauuucugggugucaaauucuaaauuggcagcccucugcacaugaaucuuuuguugcauuguuucuuggcuuccauuauuucuuugagaagucaucgaaagucacgugguugcuccuuuggaggaaauacaucuuuuuucuucuggcugcuuuuaagauuuuucugauuaucuuugguuuucagcaguuuuaccuguaauauacuucacauuuauccuuguuuuucuuugugauucuuaaaucuaaggauugauauauuucacccauuuuggcuaaauucucagccacucuuuccucaaauauuguuucuuucccccaucuuuuuuuuuccuguuuuuuucugcaucuccagucauucauuggauaaccuauucauuguauuuucucuuucuuauccucucuucugauuuauccauucuuuuaucucuucauaguucauucuagauauuuucuucugauuuuucuuccaguuuucucuucagcuauguccauucuguccaucucauauacacugaguuuuugaguuauuucauuuuuaaaucccauuacuuuggcuuuugauaccacaguuaucucgauauugauauauugcaugaagcuuuguuaaagugaguucugccuguaacuggauccuguggcaugaaccuuaagggcaguauuaaaacaagugccagcaacuugagaccaagaccuggauuuguggcuaacuuuguaaccuuggaagaauaccucuggugcuguaagccucgguauccucaucugugacauuaaagcaucugaguauggggaaccucucccucuuguuccccucaaauauagaaauaguccuuaaaacugauaagcgaaaagcaaaugcauuucuccuuuaaauuguuuaacauuauuggaaucuucucacauuaaaucaaaauuguuguauggagauguauaagggaauuccuuaauguuaaaaaguucuuauaaauaugcacaaugcuacaacuuugccagaggcucuuguuaacauugauagcugaacucauuaguaaccugauauauuagaaaccugauauauaugauaucaaaaaaauaauaauaacaaaaaaggaaggaaggaagggaaaggaagaaggacaaaagcaaagaaaaggaaaaaaaaaaaaagaaacaaaguccugauuuguaacagaugcugacuucuguaguagaaccacucccaccauggcugauucaggccaacaccaugacaucagugaacauggagcugagaagaggugggcacgacugguugccacuugcuguaccagcaugucccuucuaaccuauuucugauuuguugggaaaagguccagguugugcauuauaauuguguuuuguagccaauuaaaauauuucuauagauaugauuugauuugguuauuuuuauagacaaauuauucagaauauaaaaguuauuuuuuucauucuuccuuuuuuuuuuuuuggagacugagucuggcucuguugcccaggcuggagugcaguggugcgaccuugacucacugcaaccuccaccuccuggguucaagugauucucuugccucagccuccugaguagcugggauuacaggcacacgccaccacgcacagcuaauuuuuguauuuuuaguagagaugggguuucaccauguuggccagguuggucccgaacuccugaccucaugauccgccugccuuggccucccaaaguguuaggauuacaggcgugagccacugcgcccggccuauaaaaguuauuuuuaacgccauuuuuuagggcucucuuaugagaaugucuuucuugcugcugguaaguuuggugugcacaaagauuuguggcccuguguaguauauuuauaagcuguguguuccaaggaaagugaaaugggugaugcucauugggaauguccgugaugcugcccuauacugaucugaguguguuuguaguuaaagggaguuuucucuuuuccuuucaggcauuuuuguugccuuccugugagauagcuguaacaagaaaaguaguucaaguguacagaaaguggauucuccaggacaaaccuguguucauggaggagccagauagaaaagauguugcccaagaagaugcugaaaaauuaggauuuuccgagacugauagcaaggagguaauuuuuuucacuugucuuuugaguugaggguaaauauauuuuaguaaaguauacuugcucagucaagagucuugucaaugggacaaaggcagguggaucucuuuuuuaucccaucugaugcuucugaguugcugaguucugugaggaucuaccaaggagaguagcuucuguacucccauucuagauuggcagucaucuccugcaacucuagccagggccaucugcguguugcaucuuuguuggucacuguugcaggagaguuguuuaauaagccaucauauuuuacaugucuauuugugagacuaaaaaaaucacuaccuucuccuugacuuguuuaaauaaauaucuuuuggagaaacuaaauugagaauguuuggguagacuuuuguugugcaguggccuguaccagaagcagcuggguguuaccccugugaaaggacuaaccaaacagcagugucccuccccuuuaagccucgcugagugcuggccuccuggaggggccacuguccauguuagauaaagcuauagguuggauaaauccaaaaugacagaguggaauaucuccugaaacaaaagaaacuuaagugacauuuauauuucugucauacuauuaugaaauuaauuuaaaauguuuuaaauuucucacuagaggcaugucacuuuaaaauaucuguguuccauaauuuuaauuuuucaauauuggugaaaucauuuuaauaacuaccaugagaucuaaaugaauagguaagcaaauuaucauucauuuuaaagggcuguauuccaugcucacucagucauuggacaaacacaacucauucuuucagcacauacuaagugcugagcacuauuuuagguguugacgguugaguggggagcucucuaccuccuagaaccuauuuucaugugaauccuggugaguuuaaggaauuaaauaugccaacuaaauauaacuuaguuuauauaauauauuuaauuauauuuauaguuaaaugcaaguuaaacacgugcaucuuccacucuguuaauggaucauuaucuucugaaggccucaucugaaaguucuggucauaaacgaucuuccaguuggggacgcacauacuccuucacaagugcaaugagcagagggugugugacagaggaggaaaauacaaaugugaaagccggcguccaggcuuuguugcagguauguggcuggccaggacaugaagaccccuccaccgccuacagcuggagccauuuugucuuuuuguuuauuggggauaaugucauauaaaguauggugguauuuguagccaucugucaguaaacgauaaacagcaauuuaauuagcuauuacauucucauucugaguuuucuuucuaauuccuacccacaauuuacaaaaauuuuuuucuagucaaagaagacauaaaaacugguuacagucuuuuugagauuauuauauagugaauaugaaauggcugauauuuaaaucuuuaaauuaucuuccaaacacuuaugaguaguaaguuaucugggcucuaauuugcaagacaagcuuggcaauuauaaaaucuuauaaguaauauuccucuuaaaauuggcuguguuuacaaagaacaaugacugauguaguuuuuagauuugaaugaauauaugaaauagaacugacuccauuugggaacauuugaaagagcaacuuuggaacauuacuuaaccuccccagagcucaggauuuuaccucaaaaaugggaauugggagauuuccucucagaucucauguagcuugaagaguaagugaaaauacagggugccucucauucccugcucacugcccccucgcccgccacccuucauccacauuuggagaugugucacuuaggccucucauguagaggccagguguggagucuggggaacaucugggaaugacaugcauuuuucuaauuuucugucaucuguuucuugauaggauucauuuucgugguauccuuuuuuuuuucaagugaauuagcaguuuaauauaccauacucaugaauuuucucacuuuucauugaaaaccuacacauaauuuugaaguuaacuuaaaaaaguugagaugauuucacaugugcaucuuuaaagacuuuuggugcugcucauaaguaugaccugcguccccaucagagaaacacuugcaggaguccuugcccuuugucccucaguagcuccaucuuuuagcuaaggggaucuccagcaacagccuguggugguugcaggugccagugauccccuugguucaaaagagugcuuuuuauuuucugaaagguugaguuacauuuacaguagguccucacuaaugucaucaguggguucuuggaaauggcgacuuuaaaugaaaugaguacagcaggucuuugaguaacaugguuugauucaacaucauuucaucauaauguucaugagaaaaaaaauuuuuuuauaucuugcuuaaagucaucauuuccaacaaccuauugaugacguuaaaugaggacuuacuguccuugccugaacugagaaaaaacaauuucuauuuuauuauauauagugcuacaguuaaaaaaaagauuuacuuuggauuuaaauaguugguuuuguucuuauaucuaauaccuuaguccuuuacuuuguuuauuaagaaaaaggggccaaauggagguuugauaagacaguaauuuucuuucuuuucuccgacugugucucagauguucaagagauaguaguuuucuauaguugcuuuugacaaauguacucuggacauacuaauuugguuuauuuuuaccuuaacugauaccagcacauuaauaagaaauacucaugcaguaccuuugauguuuuguaaaaaguaaaaguauauaaagacuccuuacaugggaaugugcaaaaaguuuuuaauucauauucaagaagccaaauacauugaauuaaaaggaucuguguugcaauauaucaucuguggcauacuacuuucaaaaacagaaccacuaaaauugcuguaaucaaaaagcucuuuguuuuuguuuuucuuacucgaaggcuaguaaauucuucaugacugaaguuaucaucaucaucaacuauauuauagugcuuauuuagugauuuuucuuagaaaauugggacauaauacguuuuaaucuuaccuaagauaacuuuaaaggcugugaauauuuuaguucauccacuugacuuuugauguuaauuuuaauuucgucagauuguacauuuauuuugauacaauacuuuaaaaaauuuuacuuauaaaugagcuagagaagcuccgucaugcuuugaguuuguguuauugaacacaaaggagaccuaagaggcaauauaccucuagguagauagagcaggucuguccucguaccaaauugacaacucagaauaucugcagaugaugggacacuggugucaacuguguaaaugguaacacaccguuauuuugcuguagugacucaaagcaguaauaguauaugauauccuggaucagugcuucucacauuuuucugcugagauaccccugaugguagagaacagugaacuuguaugcuaaaggucugaggcagaggguagaguaguuggcugauaaucugaauuguuuuugaaaucucagcuuuuaaucuuaagaauucacuuagauuuuguaugcuacugcauaauauaucuuucauauuaaaaaaaaauagccuccuggaaggcgugugaugucgauggcuucgucuguuucuggacacaucacagcuccuugagguucugaccccuguugaguggugcuguccaugcuucugucagcaaggaguucaugugcugggagacucaauaagaaucacauaguucugucugaccacugucuggccaucuauccucuacuccucccauucccccucuacaguuucucacucauaugcaacgauccuacuuuuuucccuuguuuuccuuuuuuuguugagggguuguugaaaagucuucaaaagcuuuucugacucauaaaauuucuguaguugcaauuaauauguaauagugauuuuuucuuuuccccuagggaaaggcuuuucaggugucucuguauuuaagugauucuaaaaggugaaccaaaaaaaaauuuugaauauguguugguaccacuugccuuauugaaauagaaucuuuuggaaauaacugaaaaaugauuucauugguagagugaaauuaauaucuguaagcaaaauuuauucaaauguuuauguucaguuauauuuucuaauguaaaguuguugauuuuaagguauuuuugacgaacucugcaaacaucuuuuuguuggaaccaugugcugaaguuccugugcucuugaaagaacaaguugaugcuuguaaagcuguuuugauuauuuuuaggcgcaugauaauggagcuuacaaugaauaaaaagacaugguaaguuuauaucaaauuaauuaguauuguaaaacagauguuucuguuuuucaacauaauuaaaauguuaaggcuugcauuuauuuaauguuuuuacgaacuuaacaacaaaaugucuuuuguaacaguuucugugaauuaugaagaagguaguuacccaguacuuugacagaucaauuauuuucauuauauuuuuaaaaaauguucuugaacaauaaguauuuuacuuaauaguggauuuuuccuuuuaaacguuaaacauaguuuuguggaaaagcagcaacugguguuuuauaauacucaccauaagcucaggagaguuuguuaauugcccugaaaugcugucaacugauuuuuauugcuucuaacuugacguuuuaaauucauuuuggaaaagcaauuauuuuaaaugauaaauuaucagaaacuaaauacauagugcagucaacaaucuguuccugucauuaaaacuacguuuuuuccuuuucaucuuuguuuuuguuugauguuuuuauuuauaaugucccuacagguaaacaaugcauuagauuuuuuuuuccugcucuuauuugaaaguuaucagccaggugcgguagcucaugucuguaauuccagcacuuugggaggccgagguggguggaucaucugaugucaggaguucgagaccaaccugccuaacauggugaaaccccaucucuacuaaaaauacaaaaaauuagccaggugugguggcacuugccugugaucccagcuacucgggaggcugagacaggagaaucgcuugaacccggaaggcggagguugcagugagauugcgccacugcacuccagccugggcgacagagugagacucuugucucgggaaaaaaaaaaaaaaaaaguccucacguuacuccaucugaugagguauuuucacugaugcucagcaacagaccagaaagccucagagucacuuuccauuucuuccucuucuccaugugucaucagccucucacuucugccuuuaaaaugcuccucaagccuguccuuuguguguucccucucauuccacugccacccuugugcaaucaagcugcccgcccagcuguggucagcaucccccuaggugaucuucugccuugguuaucaguccuuggaggcccugcagaccaguggcaccuuuccuaccugaaaccagaaggguccucugccuaugccuguauucuggaggcccuugaaucagcaggaaaggggcuuuggaaagugucugcaguugguaggaaaccauggacacgaggcaggucugaucggaaaggaacuguaggccaccaaguccaauucuuguucuucaaagaugagggaaggguggacucaagaaucuuggugugcagaaaguucacaaguacagaaaccacaggcaucaaaaugauacuaugauguagauuccaaugucaucuuucccagacuucuaaacuuagcacuauuugccaaguuaaacaauuguuaaaacuggaaauauuacagugaugcacaauaugauguaaacaaauuccacgucaguaauauugacaguaaugagaaaugcugguauaugcuuucaacugaaauaucuguuccugaauaccauaguuuuaucaacaucauuuuuaauguuuuuuuccuuugaaaacucccugaguuuuguauacuacuguaucaguaguuuuuugauauuuuugauaaucuuuuuauuuugaugaaaauucuaggaaauaaaauuaagcaauucuguucuguuuuuuacuaauucauagauuccuaggugaaaguauagaaaagaaaaauuguagaacucgaugaaaauaguuaacggaaaaauggucaauagagcauagaaaagagugugagcaguuucuguaauggauuuucuuguguauuuaaguaccagauaaucccuugccucccaucccuccuuuccuucuucacuccuucuucuccccucucuccuuaccuccuuuucuuccaucuaauaaauaacuaucgagcuucuacugugagaauauaguggcgaacuauguagacaaggucccugcccucaugagguuacauccucauaggacugagaggcauuaaaaaccuagaaaacaauuucagagacuccgaaguacugagaacagugaagguugcaaaggggaaagaguccugaauuggguguguguugcuuggcauggacagacggggaguuuuuuccgucagcugucagagaaggccuuucugagcagagcccugagugaagggaagggggagccuuggggaggucuaagggaagggcauuccugguagaaagagcagcagauacaaaagcccugaugggagaaaagguaaaagaaaaguggcuuguuuaaggaaggacaagaugauggccaaugugguggaguagauggagugagagggagcgugagaggggaggaggcagggggcaggccggggccagguugcucagggcccugcagaccaaaggaaggacaccagcuaccucccugugugccugcaagauugugacauaacauaauuuaugcuucugaaaggccccucuggcugcuggagaacaugcagugcagugccauagaugaugguggcugagaccagggcuguagccagggaacuguaagaaaugguccugaaauagggaauaacugguauguaaaugaguugaaauccaccuguaugaggagauagagaucaggaaaauaaugaagaaugcaggaaaauccucacuccuguguuggacccaaggauggcacacaugccucauuccaugugcuccaacagaaguuuauuacacucuuugagcaguucuccuugguggagucagugcuucacaaaauagaaaggaacaagcaguugucaaaacuggcagcuuuggcagguugugaaucuuucuacuauaaggaaagauuuuuccaaaucauaguuuuucaacccuuguuuucuuccagaagacucugcaugccuuuccaagcuuucauagguucagaaaucaaauuaacuguuuuugucagucauggcuuugaucacauuuguggcuuuugauagcaguugccaugaucaaggcuuuacuugaaacuuacgaugucuguuguucucaucacauucucaugauggaucuguaacuaguuguguguaagggauuguuuuucauugucuuaugcaucauguaacaugaaugggcaguggugauacuaggugcugcccuucucugcccuggcgacaggggccuggguacccugaaugugaugagcgacaagcugucccccagcacugugccauugcuucucccaguucucuucaaagucaccauccugcuucagcgugugugcccagaagauagcccuuccucuucugugcuuccagaauccguaggcagggaauaggaauacauggacaaguagcaugcagugcagugagaauguauaacaacagaugacucuggggaccaaaaucaaauggggccagcuacaaagagggcaggaaauccccacaggugauuuuacugugaggaauuuuaugagguucagcaucauauauuguuaggagaaaaugcuguuuugauaagcagagauaugagaaaaguaaacgggaacuaugauuuagagaucucaucugauuacuuuguccuauucucaguuuuauuacuaaagagcaguaaagccaaggagaaaguaguaaagauuagaugaaugguuagcaugugaaaccugaaaggaaccagagugauuucccucgaggaacaaaugcacuucucuuacauaugaaagaugauguguucuguguucccauagaaucuagggaaagaaaaagugagcagauacucugauaugagcaauauaacuuagguguaagaaagaaaaaugucuuuuggcuguucugaagaacuuauuauuguaauuagcaguguuauguugucucuguacuauuuuauagucuucaaaguccuuuuacauaaaccuucuguaagagacuaugaaaaaugcuggcacauuggaacugagcugcagugauggcauuugucucaguugugcccuguagugcagagucaggaucuuccagacaugagcacugugccuguaaguguccuguaaugcaaaccccuccugccugugagaguacuguggcauuccaccuuaccaagauacugacuguguguguccccaaaauaaaggccagaaagucagcuucaccuccuguugcaaugagagggagaccuuacagguuaaguaaaacaguggauagcaaaauuaaagagugcugcauauguuccaguagguuuucacugaguaccuuuaagcugcuggcacaguuggagaagacgaucuugccucucuuuuugcaaggggagaaaaucaggcuggaaugauguuuuauccugccuguuuguguggacaugggaggcauguuuuuaaaacuguuauaacauaagggagcuuauuuugguaaaauaugguauucauuauguaauuggcaucuggacuuuaauaguuucgaguaauacauaauuaucaauguugcugaauucuuaagagaauuucugguaccuauaaauuaaagugcuuuggagacaugauuauuaauaugagcuuuuauuuuggguggcccagggaacagauguugcaaauacuacucaggauaacagaagcugucaugcagaagccaaaggauaaacaaauaaaggacuuguuugcccagagcuuggcaggguuacuauuuaggguaagucuuuuuuaugaaagcacugcaaaugcaagaaaugaaucagauuuuguagcaaacuaguuuuaaucauugagaauuuuaaaaauaauauuaaauuuaaauuucuagaaauuuuucuucuuagcuuuguccugaagguuaugaucuguucuuuacaauuagugcugggcuuuuaggcuuuucucccucucugcuaccuacuuccucuuuuaauuugcucaagggugguaggaauuaggaagcucugauggccuugguggaaggcuagguagauuuggagagguaaaggaugaacgaaaguaugggaaugggauaaaacuuugagagccaucaguguguugggcaauuguauuuaaagccacaggaugggcuuaccuagagaggacaauguccacaggugaugggagagaugcugagaaaggguggccagugagugaggaggaaaaccagaggaguguguauccugggugccuggggaugaguauuggguaggaggagagcagccaguugaccaugggcuuugacagauguaguugguugagaauguucuaugggaugagucccaccuggaguagauggaggagaaaaugagagcugggcaguggaaguugcaaguguaguuaaggcuuugcagaguucuugcuguggaaaggaagaggaaaaggggagcuagcugaagucgguggcauacauggugggcgagguuuaaggugggugguacuaaaguauguuugcucaccaaugggaugguccagugagggaggacaagauggucuuggggagacagaggauaagugaggucccggauaugguggagggcugggccggucuuuggugcgagcagagagccaaagagaugccugugcuucuugcaucucauguggugagcaggugaagaccaagagcaggcugauaccuggugagcugccuggggaacagaugugccagagaguccugagcauggcagccuacugugauguugcuaauauuuaugaggaccuuagaguuuaugaagcauuacugaaagugaacagugugaaagggcucuggaaaaaugcuacauucuacauaaauaaagauauuaguacaguggauggacuugacuuuggauaauuacauaggugauaguuguggggaggagaaauuaacuucccuccucaguugaccugaaggugguuuuggaggauauauguuaaaaagcauaucuagaauauggguaggacauguagguaaaagugacaaaaggagaaauuauuucuuuaaagcuaaauauugccauuguaacacaagauaacggaauuuugaauaacuuaauaugagucaaugcucuuggcuugauaaaaaauguaugagaggcuauugaaauaauuggccuccugaauauuacaauugcuuuuacucugauugccuugccugguacauuggaugugugaaguggcccuaaacuuucuuuugcauguguccagcuuugcucugcugaugcguggagggugguacugaccacugcuuugcugccugccuggacauauggacacugcacacuuugcuuucucagcgaagcgucucacuguuggcacccuuucgagcuccccguccuggaccugggcugccaaguggacaugagcugaagccagucucacacuggcagaugcuugggccuuauucccaccaauugccuggcucugcaucuguuuuguguguuggaauuagagaacuugucacagaauuaaacaaguaucuauucugggguucggauuuuuuuguuuuguuuuguuuuugguugguugguugguuuugaucuuuggggaaaaaaaaacuccccccaugaauggagaaaaccuugucagauauuacuucccuccucagaugaccugacuucccugaagcucaguuaaccugacuucccugaaacuuaguuuugaguucaugauuauuaaugauuuugauguuguuauuauuuuggcagugguuagguagaucgagaaggaugcuuaaauuaagaacuaaccaaaaggcugggcaugguggcuuacacuuguaaucccagcacuuugggaggcugaggcaggaggauugcuugagcccaugaauucaaaagcagccugggcaauagagugagaccccugucucuacaaaaaauuuuaaaaaaauuauccagccauaguggcaugcaccugaaguuucaguuacuugggagcugaggugggaagauugcuugaacccgggagguugaggcuguaagcaagcuaugauugcaucacugugcugcagccuggucaaaagagcaagacccugucucaaaaaacaaacaaaaaaaccuaccauaaaaaauagugaagagaggaugagcuuuuuggcauuaggcagauuguguuucugaucucagcucugcuacucucuggcuauguggccuugagcacaugacuuuagcuuucugagugucuucccuaaucugucacaaucaggaaaggacuucuucuuacccugcaggguugucaugagaaucagagugggcccauugggauuugugaucaucuguugaccucccacguucuuacgugagaugcaagaggcaagaauacuaagggucuggacuuaccagccaggcucucuauugggcaucaucuuggucccacgcugccguuaaaacaugcuaucuaauuaguauucauuugaucauguggacugucuaaaauggcuagacacuugauuuuuuuuugaaaaauugagaacaaggagacuguuaaaagggacgggacauuuuuaaguuuuuauuacccuuuuuaucuuuuucuaguucuucuaguguuuguuuuuuuuucugucaguagauaaccugggccaccaaauuuucuuuaagugaugacugaauuugacuuaguuuuaaauauuuaccaaauaauggugacugccuuauugccuuaagugauguuuuaauuuauuaucagugcuaaauaugaccuuaugcuugaagcucugaugguauaucaggaaacugugguccugcucuuuguaauaugagccauuacuuuaaaguuacgcaguccccuuaguguguugguagagugaaguaggaagugguugguuagcaaauguucauaagaacaggagugauuuauuaguuaagguguuuuuaaaauacaucuugugugccaaaauguaucugauaaaacaucaaauuucaguacugaaggaaccuuggagaagcucuuaugcacuucuuauuuuuaaugagaaaugugacuacagaaaggccaagugacuuuccuaggucacaaaccaggguaguccaggcuguuuguuucccucuuccuuuuagaaaaugguaauugauuaaaaggacacccugccuucauguccacaggugccaccacucaccacccaacuguauuuuaccauuuuaccauuuugcucugugcacguguugucaguugugaauuaugaugauaauucaacaggucugcauacauguuuguaauauuugcuaaguugauuuuauaagcugcaagaagucauucugcgcuuguuucauaauuagucaauaaagugaagccauuauaagauccccaguauagagcaucucauuacaccaagacaucugcuuuuauccaugaagcuggcgcuauauccaaaugugagucugaguccuaauaacauuaucagucucuacuuucuucucuuacuuggcucagauuauauuuauugaucuaauauuuauuaauuuuauugucuauagguacguuauggcaauggccucaaauucaucuugaaagcagggguauaaaaauuaauaggagauggcauuuuagucauaauaaaauauuuaauaaagauaaaauuauuuuauuuucuuucauauuuuuaguuuuaccaaguucauacauguuagaaucagacuuuaaauauaagugguuaauaucuuguuuuuuauauaauuaacuacuuuaguccuacuuuaacauuuuuauguucuuaaaaagugguaaacacaaauugaaacagagaacaggcguauuacagaaggaccacuuuaaauaagauuuuccagguggucagaauaggccugucugauuuuauagacugauuucuguuuaucagaguuuuccuguaucuauguuaaagaguaaauuccauuaaaaaaucuauauauaauuuggggaaaaaaauuaagaagugaacucaccuacgcaaagaagaauuccugacaagagugggagccuauuugcaucuggguugggccaaugcacaugcaagcugguaucuuaacaagugcauuucucuuugacaccaggcuaugggacuuacauagacuuuggguauaaggauuccuuuucacaaggcuuaggaaagcauuuguggcucauuugagauggacuuggcuauguagaggcacuucuuucagggaagauauauuuggauuugaauuuuaaaggauggugaauauuuuggcagagguaaggaauggggcaauuuuaugggaaggaaauauccagcauauaggcauaauugucucauagggcuguccaggugaccaguuguagugcuguggacuauaagacugggggcagacacugauaagugaauagacugugaaggaaaggugugauaggugcauugauggggggaaaaugcagggaccuggaggacacuuccuggaggcugggagguggugguggggagauagucaaggauaccuucuuggaggaagugaugcacaaauuuugaccugagaaaugagggggaguuauacagaaacaaaaaggaggaaagagagggaaggaagaguaugugcaaaggccagaugcaggagcgagcaggugaaggcacugagagaaagucaguggaagaaauugaauaccuuuuacuauuaugcucuuugauaggugccugaggguuguguaaguagcacugucuaguaccuagguagauagaucaggaaaccaguagagaggucuaagcuggacauggagauucagaagucagcagcacacagaggauaacuggagccaugggaauggagccaaaacucaggcagaagguggaaguggccucagaaaggggagaaccagagcagucuguugccugggggaugaggaaguggagauggagcggguguggaacauucguucaagaaguuuggcugugaaaauggaaggaaaagggcuguagcuagacgggggaaucuggguucaagggaauuuuuucuuuuaagaugaggaagaguuuggaguauauuuaaaugcugaagagaaagagcuggggaagugggguuggcuggagauuaaaggagaggggugguuaagagaggcaugaagacuccgaggaagggguccagaguguaagggggcaacaggguagcagagcggggccccucuuggaguucagcccacagguggagguggagcugggugaauaugggcaagaaugugaguccaugggcagagguugaggggagucucauugaauggguucuguuucuugugaagucugcagugaauccaucugcucaaagucagggaggauuuggugggcuggcgguuuuccuguaggagguuugaaguagccacuguggaugguaggaaaagagcagucucaggaagcagaguugucacugugcggagggcuuugucuuuucucugauuauagccagggccagcugcagacacuagaacaauauugaaucaguaacuuuguucauaaugauaacuaacuccccaauagcuuaaauuuugauuauaguuggucaaaugaauuuugagaauuaaaagaaaaacaacuuccaaaaguacuuuuuauuuuaaaauuuguguuauuaauaguaauuuaaaacauuuuguuuaaaaguaugcuuuuuccaaaugaagaugugugaauucucuuguugguugguugguuuuagacgcucaugguagcuuggauccgagcaaaccucuguguguacauuucucgagagcucugggaugacuuucuuggugugcuguccucccucacggaaugggaggaacuuauaaacgagugggccaacauuauggacuccuugacagcagugcuugcaagaaccguuuauggaguugagaugacaaaccuaccucuggauaaauuaagugaacaaaaggaaaagaagcaacgaggcaaagguauuuccacucuuccagguuaacaccagaugucuaggacuggggacgaguguguauuuguaugacuaagcaauuaaugcgcgaaauuuuauaaugaacugaaccaacuacacagugucuucuuaauaguggcauuaauuugugucucauaucauucuguucccuuaaugagauggugaauuucugaggaagcuaugcaagaaggaagaugcaaggaagguaguaguaauaguagugauaacuaacaguaauaauaauggcuauuacauuguacauauuaucucuuuuuaccuucauaauaaccuagugaacuguagauacuuguauuauccccauaucacagacaaagaaacugaaguacagagacuuugcagggauguccaauccuuuggcuuccccaggccacauuggaagaauugucuuaggucacacauaaaauacaguaaaacuaacgauagcugaugagcuaaaacaaaaaaagaaauugcaaaaaaaaaaaaaaucucauaauguuuuaagaaaguuuacgaauuuguguuggucuacacucaaagccauucuuggcuucauguggcccaugggucacggguuggacaagguugccuuacagugauugacucauccaaggccacauaguuaagaaguguuuagaaaucaaagcuggauaaauacaacucaagaugucacacuauuaagaugcauucuacagccucucuaggaaacguggagaaauucugaaugcuucagaugggagcuauuuuggcuuuguuguauuucuggguaaaaguuguuuugggacugagaaccucaaaugaaaguuauguuuucaagguagaaaacaucagugguaguuucuauuaggaaugacaauuuggcauccccuuaauuacugugcuuaaggauguggcaugguccuuggauuaauucacuuguacuacaccuuacucuguaaagauuugaggcagcucauagaaaggcauauaguacaguagaucaaauacaaaauagggucaaaaugagugagguugcagggaacugccauugugauuaaaaugccaaaauacaugccauagagccucgugggcuugcuggggagauggaaaagucaaacauuggauuugauuuuggucuuugcaggguuacaucaaauagagaaucacagagcacauaggguaaaaacaauucaaucacuuaggugaugcuuagcuuuuauuagguccuccugagacuugggaggaauuuuuccuucaaagcuucuuaaaggguacacacugcuuauuguguagacuacccuuuaauaauaccagcugccuuauagacaguaucagugugcuuuugccaugugacaaaucaccccaaaacuuauggcuuaaaauaacaaccacuuauuuaucuugauuugaugaguuggcaauuuggguuggacucagccagucaguucuucugcuggucuuugcuucuguguuugcagucaaccacgcugugaaauagucagcuaggcagcucuacuuuuacggguugacuggcugucagcaggggcaaugaggugugacugggccacguguuucagcagccagaggcuagcucaggcuuguucaccaaguggcuuagaguuucaggggcaguaagaggguaagcucaaauuuucaagugcauuucaagucucugcuuguucaguuuugcuaccaaguaagucacgugaugaagccuaaugucauuacaggagagaacaacagaggauguggauacagggaggugugaaccaguuacagugguuaguaaaccauauacacguauaauaaaugugguggauucuuauaucuucauugaaaucugagaauggcuugccaaagcacuaauuaauaaaagcaaguuaguaagaagccaaaauaaaguaguugaaguacauggcaauccaguggaacaguuuaaucccaauguagauuuagacugucuaaugcaaugauuuucuaacauuuuuaacagauccguuuuucuucccgguugaagguauacacaacuccuuucuaaagaaauagacuggagauuuaggauugaaguaggggcagggagccaagagucugggcccuuggcguccaucuaguccucucugacagcucugaggaccuuuguguaaacccggggccugagaggacccagauacuuccaacuaggaacuugccucccuaagacagucguucucagcccagaagagaacuuaccuggcuaaggauaccuuucaggccagaggaggagagcugaaauaggagauaaggaccuaccuucaauuguuguaauccaugcacgagugcacaugugugcauacacuacacacacacacacacacacacacacacacacgccugccauucugcaagauucucuuccuacccacagauucaucuaaagagacagacuuaucuuaggaaggcaaacaacuucgaaaacacuguuuucaaaauguaccgaacacauuauuuaauuagugaccaugacuaauauuucugauuuauguugcuuuauucuaaaaaggauuuaaauauuuauuauagaaacacuugccuucuaagggcuagacuacuagaaacaaaaagcacaggcagaggaaacuggguguggaaacaugccacagguggcagccacuggccacaucauaccugugcagaaaucuguaagucugccauucucuuuccuccucuauuucuuuugguccauagccucucauugaaauaauuaaccagaacaauaugaggaaaaauaaaaguugaaucucagacuacaauguuuuauuguuuuggaccuuugcuaaaauaggauuuuguauuauuuguagauuuucauuauccugcccauuugacugaauccacauuagaguuuauaggcauggauugcucuggggauuuguggagggguuggugucuacaggaugcaguacuauucuaacaucaggaucucugaguuuuugguuuauaaguagugguuuuuggaguguccugggaacaguaguauaacuucauuugauauuguucuuguauugagaaagguuuauuaauacuuucuuuuguauauuggaaugaguacuaugaagauauaauaauauccauaagacuguuuuagauucuugaaaauauuuuggcaacaagaauucuuaaauuagugacauaugagcaacuuccuaaauugcaguguaaggaagugguacuuaauuugugacaaggaaaccugcugauuauauauaguuguagguacaccauuugcugagcaacacaagcgugaaaugaauaauaaugaauucagccuuuagauuauuuuucuuuuccuuuaucaggcuguguucuagauccucagaaaggaaccaccguggggagguccuuuucucucagcuggcggagccacccagaugugaccgaaccgaugcgauuuaggagugccaccacgucuggagcaccgggaguggaaaaggcaagaaauauuguucgccaaaaagcaacugguaaacauuuauuuaaaugcuucucaaaaaucuaauuguuaucuaaaauaaauuuauaggcauaaaguguguuaaaaauucuacucaaaauuuaaauauuagaccuuauauuaaaugaaaugucucuacaucuuuuuagcuuuaugcucugguuacuuuucaaaucacaguuuucaguuacuuauuucuaaauccuccauugugagaaagaacuugugauguugauauugagugagauauuugugcgaaauagagaaaauacagguuuuguuugaaccuugaagaaaauagauuguuaauaaauacaccaguaguugcacuauugucaguguuaaacaauauuaaucuuuagaguguggcaaccuguuucagcaaagaaaaggagaauuucaggacuggauagacauuuucauuuuuugcuccuuuggaaaauugagccuuuucaugccuguggauguuaucuuugcagcguauuucaguuaacaacuugaccaacaacccccaguuaauuggacuacuuugcuacauuuuacucuuuuuuucuuuucuuuucuuuucuucucuucucuuuucuuuuuuuuugagacagagucucgcucugacgcccaggcugaaaugcaauggugugaucucagcucacugcaaccucugccuuccggguucaagcaauuuuccugccucagccuccugaguagcugagauuacaggcgcgugccacgacgcccggcuaauuuuuguauuuuuaguagaaacaggguuucaccauguuggucaggcuggucucgaauuccugaccucgugaucugcccgccucggccucccaaaaugcugggauuacaggcgugagccacugcgcccgcccuacauuuuacuuuuaaaacaaaaagugaacucuuuaaaaagaagcuuguauacggcauuuaauaagaauaaauaaagccaccuccuccccagugacuuugagccuguaacuuagguuuaagacaauuguaauugauauuuaacauguugacuucagaaagucgcaagauccucuggccauaaaacaaagauucauuaaagcuuaacauauucuauagugcuuaguaaaggcuuaauacagaugguuuagaauccuguuggaguuuuuaugaaaauauauuccaccuuaacuguaacucucucauacuuuuuugcuguagcauuugcuggaaauuaucaccuuauuuacaugcacagccuauucugcuucuuucuuucuuucugucauucucuccccugaggagagacccaauucuuuguuagcaggcaacuuuugaggaugcucauucacugauuuccuuucucauuccaauuccuaaaaacuauuugcuuuuaucauuggauucuuuuuuuguuuuguuuuuugagucggagucucaugcuguuguucaggcugaaccgcaguggagcgaucucagcucauugcaaccucugccucccagguucaagcgauucuccugccucagccuccugaguagcugggacuacaggugcgcaccacuaugccaggcuaauuuuuuuuuucuucaguagagacgggguuucgccauguuggccagacuguucucguacuccuuaccuuaggugaucugcccgucucuguuucccaaagugcugggauuacaggagugagcugccaugcccagcucuucuaucauuggauuuuuuuuuuauuuuuuauuuuuuuugagacagagucuuaaaaaaaagcccaggcugaagugcaguggugugaucuuggcucauugcaaccucuaccucccagguucaagcgauucuaccaccucagccucccgaguagcugggauuacaggcaugcaccaccaugcccagcuaauuuuuguauuuuuaguagagaugggguuucaccaugucggucaggcuggucuugaacuccugaucucaggugauuugccugucuuggccuuccaaaguguugggauuacaggcucccagccuauugggaauucgaauaggcaaaggguaggagaaagggcaguaggguaaaaaguuuguuccgguuuuugcaaauguguuacuaucauuuguaguuccauuucauuaauguuaacugaugucauaugaaaauaguaaagcagcaaguaaaucuuuauauuuuuguuuuagaauaaaacugauuuuacagauugugguuuuacauauaugaagcacguuuuccuccuauguucauucaauuccuccaauauuuauuugacuagcaguauauagaaaacauaagaacaccguaaaguagacacuuaagauguauggauuuaauaagcaugaaaugugacauaaaaggauggguuucauggagauuuuaccuuuuccucaaauaucaaaucuuuuaauguucaacuugacuuuuauguguucuugagcuuuuuggauauuuaauuuacuaaaugauuugcuuuugaauacagucagcucucagcaaaccaacuucugaaugaaggccagauaugcccucucucaccauggucuuuuuguauuuguccuuuaggaaaggaaaacugauuauaaugucuguccaggcaaauaaccugaaugugaaucugauacacagcagaaagaaggaaaggcuaaacauauaaagcauuucaaaauaaaauuauuuguggauugcccauuguccugugucaugagaaugacugacugaaaguuggcuguauuuagagacuacaauuaaauacuauacuuuguacugacuuccuuuaaaguuuaaaaguuuaaaugaccuccuuuaaauguuuaaagagagcccagaaaaguaauaauaauaaagugaaagguccuauuguucuucugacauaauuauuacuuuaucucuccuggaagcuaagcgaagccagucuaucagcaacuguguccaccuuucugaggcuuugccugccacuaaaagcgucccgcuccuccuucacaccgugagcgcucucuuaccuggucucucuuacucuucuugcucucacaggcugucagguacuguaauacugucucauguguccaucacuguuccugggcuucucccgcuugccucugggcauugcuuccuuuguuaauauccccacaucacacacgugccugaccauuacacuaguguuaaauugcaaugaaugcuaguaauugcucuuguguaguuagauacuuaauggcaauuagauagucaagaaaaauuucuauaacuuuggucuuggcaauaacaauuaagaaggauagaaggguuuuucaguccauagcuauuuaauagggggaaaugugaugccugccuuagugugucuucuauacagugcccauagaaaguaaggggauuuucauaaaaguuuugagaaugucaguauuagaaugcuuacuaugccuuccaaaaaaugaauaaacuagaaaaauguauguaggcgggaucuacuuggaguuaauaaaucauauaugugaaguaaugaccaguuauauagauuuauacuauugaaauuugagugcaaaaggaccagugccaaaaagcaguaauuuccaaaacaaagaaacguuguuccuguacuucagccaauuaaaauugaauuuagccaugugugauuuacacacaguacauuuuuuauuaagauaucauagcaccaaaagucauuuuuggccuacuuacuucaacagaaggauuuaccuuucucuauauugaauaauuaggccuaugucuauuuauuuuucagugauucuaggaugaacugaaucuucuuccuuaaaagagaaagaucauuuucaugaucuuuuuuauuuucagaaauuuggcguuguagauuaguauuuuuuguuguuguuguuuuugauuuuuuugagacagaaucucucucuguugcccaggcuggagugcaguggcaugaucucggcucacugcaaccucugcuucccggguucaagcaguucuccugccucagccucccgaguagcuaggacuacaggugugugccaucacaccuggcuaauuuuuguauuuuuaguagagaugagguuucaccauguuggccaggcaggucuugaacuccugacuucgugacccaccugccucagccucccaaagauuaguauuuuuuuuaacauuggagauaaccuaauuguggcuuucuguaguacuaaacuaugucauacuguguuuuagcaaagcaaaaugaaagcuuacguucucugauggcuauguaaauaccauauuacuuuauagaauuuaagggaagaaguuuuaccaagagcgaggacuauaauguuucuuagaaaacucuuuuucuccaguaacuauuaaaggugaaaaacaguaagaaugguacaugggaaaauggucacuagucaauuacauuacuguugaguuuuaacugcccaauuauuugguuuucaaaaaaagcuauuguuuggagaugauuaauaaaguauuuaaaaugauuuuacccccuguuuggcuaauacacaccccaaaagaauuuuuuucauggugaaaaguuuucuuaugucacaguccauuuuuuucuauauuuuguuucucuuaaguuuuucacuaguuuguccagaacauguucccacaagaaaucucuuccuauuaguaauuuaauuuuggaagcuuuuguucucauucaauauuacauuuuauuuuacuaagacucuugguuccuguauauacguauacaguuccaacugaaguuaaaugugauuuagagcagugauucucaauuggggacaauuucaacaaugccuggagacauuuuuaauugucacaagugggacagugcuaguggcagcuuguggauggaagucagggaugcugcugaauagucugcaaugcacaggacagcucccaaacaaagaauugucuggcccaaaauaccagcugugccgaggcugagaaauccuaagucagagugaaaucaaguggccugggcucggucugcaguuuuccugccuuugccaucuuuguucuugguuuuguagcacaaagggugaaagaacuuuagaguauagugacuuugagaacaaccugacauuccaacuaugauagugagcuucuuagccugaugccauugguucuuuacuacuuaaaauguugccauuguccuuuaugacuguccuaucaagagacugacccaagggcagauuguauauucuccacugguuggcacauuagaguauugaauuugcccuccaauuuaaauccaaguauguaggcauaccccaccaacauacugcuagauaauaugacacuuaauuuuacuuucuggcacaagcuccuuacccuaucaaugauugcuaauuuuguuuacauuuaaguuaacaugauugcuaauuuuguuuacauuuaacuuuuuuuguuuuuguuucuaaucuaugugauuuagaaacccaccaaaauuguuuuaauaauauaagcaauagacaauuacuuacuuuuagcuacgauuguuuguuuuucugaucuuuuggggacuguauuuggcggcagcagcagaauuuuggguggguuguucauauucugggaggaagaagugacguuuguauuuuggagucacaaccaccuguuuccauuaauaugaauagcuacauaaagaaacacaguuggggagguaggacuggcacuuuuugugauuuucuuuuauuuguuuuuuucccuucgugagaacaguucuuuccagcuguucuacaguuuuuuuguuuguuuguuuuuuguuuguuuuuuuuugagauagagucuugcuuuguaccucaggcuggagugcacuggugcgaucuuggcccacugcaaccucugccucccaggucccaguucaagcaauucuccugcuucagccucccgaguagccaggauuacaggcaugccaugcacagcuaaguuuuuguauuuuuaguagagauaggguuucaccauguugaccaggcuggucuugaauuccugagcuugugaucuacccaccucggccucccaaagugcuggaauuacaggugugagccaccacguccggucuguucuacaauuuuaacugcuuuuuagguuaaaacauuuaucaaucuguagcacuuacagauaguagauuuuauuuuucuuuuaggaauauuguaauaguaguaaugagaggaucaacaaucuccccuuauucuaaaaaagcauauuggaaugguauggcaaaccuugccucgcugcuucugcaucugguuugugugcuucuaggaagugcuuuuuugucaggaccuggucugauuuacccuugggaaguuugaucuugugggaaaccucaagaugcugagcugauaugcauuuccuaugcuuuuuauaggaucagauugguaucaugcaagguguuuuaaaaauuaggaaauuauacuauuuauuuugcuuaugcaaccuuguauaagggauaaauggaacucagaauuuugguuauugaagaaugagccucacuccacuuacuaaauguaagacugaguaaggaagacuuaaaaagugagugaaauugcugugaaaaauagagaucuggaaaaaaaaauagaaguuacugaagagcuuacacacuuaauuugaucacacugccuuuucucaguggaaaaaaaugaaauuaaguaauccuuauuugaucauuuuucgguguuucgaauggagcuuuagaaaguaauaguuuaggccgggcgcaguggcucacuuuguaaucccaauacuuugggaggccaaggcggguggaucaugaggucaggagaucgagaccacccuggcuaacacggugaaaccccaucuuuacuaaaaauacaaaaaacuagccaguugugugccuguagucccagcugcuugggaggcugaggcaggagaaugccaugaacuugggagguggagcuugcagugagucaagaucacgccauugugcuccagccuggccgacagagcgagacuccaucucaaaaaaaaaaaaaaaaaagaaaguaauaguuuaguaaugguauuguguaacuuacacugucaagagacgagaaaguuagugcuuuuaaaaucuggguaguuggaacuaacuaggcuuuagagagaguacauuauuuggugaaucuaagauagaauuuagcucuuugaagugauuuaaacaaauugugugauauucaaaauagaaaaugcaauagaucuaggauguauuauauaauuuuauuguaacugauauaauucuuucuccauuuuaaauaucagauaauccugucuuuugguauuugcauaucacuauuaaaaugauuuucauucguuaugaaagagcaacugcuaacagcuaaccccacagaaugagagcagauuuaacauaaauugcucuuucuuaaauaaaaugccagcagagggagcccaagaacuauuuaaaaaggaaaaauaguauaaagaaauuguuucugucauucauguauucauuuauacaaaacauguauuuaauauaaaauaugagaaaaucccaauaaauauacuguuacaaaucaggaaauuggauuuaaauugugggauaaggagaauugaaaauucucuuuucacaccaucucaauugauagucaacuacaggaguagguagcucagggcaccuacaacccaacagcacacuuaagcaucguggcucuccccuuccuucccacuaaaucacgagugcuccugcccugcuacugaccgcuauuccugaaggcuuggacuuucuccaucugauacgucccuccugacagcuuuauaaaaacaaagccuuaaaagcugcauuaggccagccuguugggaaggcagaccagcuggugguggcaggcucuccguccgucugcuguguugaggaccaguggggacgcucuaauuuggaagcaauggugcuguggcuauauugcaucccaccagauggcgauguucuuuaucuuuaggaagaugcugccaguguuggcucagcucuuauuugcuccugcucauagcccagaaaccaacaucuaucuguuuuuggcaucaggcuucagagacuaacucuucccacuauccauaaaaaauggcauuugccaauuauaguuuagaaaguuaggaagcucuugggcucccccuucugauacuggauuaaccaguagauucauuaacaaauauaaacuguucccagaagguuucaacaucuugcauaauuagaauaaacaauuagagaagacagccggaagggcuggcccuaugguguuauuuggcuucuguugcugaaggcugaagagacuagaaauagaucugugagaaggacguagucuguacuuugggauguguaaguagauuaaaaaugugcacauaugcuuuguguuucucuguagaaaaaugaacaguucuuggcuguucaaaagaagaggaaggcaaagacaaccugggaaacaugaggcuuuaacauagcugucuuuucuugcuaccuuggccuaucuuugcuuguacuccaaacaguuucccaccagcaucugaaguuagacugugggcugggcaccauggcccacgccugcaaucccagcacuuuggaaggccgaggugggcggacuacuugagaccagccuaggcaacauggcaaaaccccaucucugugaaaagacaaaaauuuuuuggguauaguggugugcaccagaacucccagguacucaggagggugaggugugagaaucaguugagccaggggggucgagugugcagugagcugugaucacaccacugcacuccaaccuggcaacagagcaaaaaaaaaaaguaaauugauaaauuuuuguaagugaaggaucacacaaauuucauaguuuugaggucuuguaaccauaucagcacacuauaaaaugcauuuucauuuggauagaaaaaauagcaaccuuuuguugaaauccucuguauuaaauguagaaucuuccaacauacuucuugcuuaaggugagccaucaguuugccuuaugacucagauuaaaggauuauacagaggguggcccauugacagugaguuuccauuucaggugacaaaccaggugacccagccaguuaagauaauacaggcugaguuuugauuauccucuucuuaguaguaguaaugagcaaauuaaaauuuguggaaaauauucuaguuauguggauguaaaguuucaugacuacgucagugaguguggaaucuagugagaaacagagcaauggggcuugcaugcagggccagggagcagguccuguaggggauauucccagggcagcaugguaaggagggaugagggagcaggugugaguuuagcauaggggagugaacagcaggaagaacagaguagcaggugccaacuggguuaguacuacuggagacuaaagugagcuagaguaccuugcaaggggaucaguaugucccgugagaucaaggaaagccuguguucacccugacuaggauguuugacgaaucucuaacaagagagggcuuugguggguuuuaagaggaguggcacagccagaucuuuauuuuagauggaccauggagaggauaaauaugaaggugguaagaagagagggacagugauuagugauuaguuugcaggcuauuaaaacaaccuacguaaaagguggugcaacccugaagcugugacucuagaaagagaggguggggugauaauuccagugccuuggguggucuuuagagauuaaaguguacugugcaguuuagaaaugagcuggggggaacucauucuauaggggaauauagcuuguaauaauacugagauuauccuguggucccuacccagcuaugguuuucuauuuuaugucucauauauauugguuuucuacaaauaccuguggaucauucuguacuuuagagaauaauucagcauugcauuugaugaaauaagccauuacauaacuauagcauuuuauuuuggacaguugggcacuuaccuguuaaaaaggcauaaugcaguagaaauucccacauuuccuuucaucuuccuucaggguguaugugugugugugugugugugugugguuuucuguucuucucaaauguacauuacccauucugugcaucuccugaaucucucuuuccuuggcaugccuggcccugaaaugucaaaugacuuuuacaguucuuaaccuuuuauuguggcuuuuuuuccuuuacuuugauugaaaaauaaaaggcuuuauagaacuuaaguggaaaagguacucuuggaguagaauauuagggguuagcaaguguaggaaacuugaucauuuaaaugcagauuaucugacuauaaauuauuugugaaaagcauuugaaacuuuauuuuuuaaaucgguuguuuuaaguggugaauguguuuuuuaaaaacuugaacuguaacuuugcauguuuuguuaaugcucacagaaguggaggagugucaacagucagaaaaugcaccugcagccggaucuggccaucucacagugggacagcagcagcagguccuucggagcagcagcaccuccgacauccccgagccgcugugcucagauucuucucaggguacaugaugucuucaguguuuaauacagaacuauagauucuggcagaggaauaaaagcugcauauaguauugcuuuguacauauauucugaauauauuuauuucaagggaauuaccuuuuuaauuugauuagaaggaugugauuuauggcaaugaaauauuugcacuauuuaaaccuguuuaucuaaauuauuuuuauauaucuauauguagauauauacccacuuuuuuaaagguuggcauguuugaggacgagacaggaguccaaguggcuggaguagaaggaagacggaggcuguuacaacaugaagucaaguagggcaucaaguuagguauuauggaaggcagggaggcaggaugggggcagggacauagggaaagggcugugagaagagccguuaaaguugaaaaugagaauggaaagcugaccagacuugugaaaaaguuuauuaacagcuugccgacucugcugagauggaaaauaauaacuuuuaauagcauuaaucuacacgguuucaccaacaacuugcagcagcaacaggguguggaaagcagggagacagaugguuugaccuguaaacagugaagaauagauuucucaaugaaagagugugcuuaaagugugucuaguaucauuggaaauaguuauucuguuuuggugucaugaauuaguuaagaaaucaacucuauuuaucaacaaguuaucucauaucuuuuaaugucaaagucaugcuagucucaucagaugaguagggaauuauucugucuuagaaauccucuggaaauaagaaaauacaguaaaagcuucagaaaauguauuaucugaaagauuuuugaaagguuuuguauaaggcuuuuuuuuuauacauauuugguagaaacuaccaguugccugcauuuuucuuguaggaauguuuuaaaauaucauuuauauuuuaacauaauuucacuuauggaggaggaauaaguucaagaaauguguuguacaguauggugacuguaauuuguaacaguguauuguauucuugaaaauugcuaagagaguagauuuuaaguguucucaccacaaaaaaguaugugauacauguuaauuagcuuaauuuagccguugcacaguguauacacauauuucaaaacaauauauuauacauauuauauuaauauaauuuuuauaugucaaguuaaaaaauuaaaaaaguuaaaauaaaauaguuauaggacuauuuagauuuuccauuucuuguucugacuuugauaaauuauguuuuuguagaaaaaaauuuuuuuuuuuuuucaaauuuauugcccccagauuauucauaaaauccucuuaugaucagcuuuaguguuuucaggcuuuguggugauauucccuuuuuuauuacugaaacugguuauuugugcuuucgucaaucuuuauucucaagcaauacugaggcaccuuacugcucucuucuuccuguugguucaucuggccaacacaggcacuuuuucucugagauaccuuccccaagaccccaggaaggguuuuguugcccuccccugugcgaacauaaaugcgcuaagugaaccuguuggccacagugaacaguaaucaauccacucucuucagagcucucugugggccagagaccaggucuaaaguguggacuugacccauaggcugcuguuuugccaggcccauaacuccuguuuuuacauaccuuagaauauuuaaauuuaauaguuaccuauauauaaaaucauuuuccgguuuuacuaucugaaacauuccuucuauuuccgcuaccccccugccccaccauuucuaggucaaaaggcagaaaacacacagaauucgaguucuucagagccucagccuauucaagagaauaaaggacaugugaagagagaacaugaaggaauaacaguaagauauuuucaagccauuucaguuugucauuaaaaauaaacauuaauuagugcucaguaaguaaauuuauugguggcagugauaauuaaaauauuuuuuuccauuuagacaguuuauaggcccaaaugauguugagaucuuuuaagauuuugcuugcuuucuauguaaaauuacagucacauuacaaaaauaggaaaaaaauuaacaugaaaauggaguucaccaccuggucuguguauggcacuguguauuuuuaagcaguuaccuuugccuguuaaaccuacguuucagauuccccauuccugacauccauuuagguagccucuaccugacaugaauuacuagaaucagugaguauucacaaagauguuagguuucuuaaaaaaaacaaaaaacaaaaaacauaaaauggcauuuauuuaaauauauauaaaguauaaagaagaaaauuaaaacauaagcccauaacucauucaugcagauaaccccuauucauuuuuuuaaaauguagcauauauucuuagaaaacucaaacaucacagaaagauacaaaauaaaaaagggaaggccucuccuugcuccccucccacuggacaauaacccauguuauguuucuuuuuucuuuauuuuuaaaaagggcauguaccaguuuacauuuguauauucuguuuucagcaaugaaauaaauacccagaaacccaccaucagcuucagaucauuuuggcuucuacacuccuuccuuguucccucucucugcuaucuccccucagagaggggccuuaucuuggcuuuguguucaucauccccuugcuuugcucuguaguuuugcuauguaacuauguaucucuaaacaggauguucuuuaguuguccuuacuuuugaauuuuuuaauaaaguauuguugcuuuguuuacucaguuacauauuuuuaagauuuauucacauugugcuauguagcaauaguucaucaaguuuucugugaugugguauuccacuauaaguagaccacaauuuauuuuuucauucucuuguugguugacauuuagauuguuuccagcuuuuuguuuuugugaaaacuguagccauguacauucuuguauguguuucagcaucugcauguuuaauguuuucucuaugauggcuaucuaggaauggaauuaaugacuuauagaauaaaauaauuucuuuacaagauaaccccuguucucuaaagugguugcaucacucauauuuuugccagcauuguguagagcucccauucaucuucauucuugccaacacuuucuauuaucagauuuuuucauuuuuauuggucaacugagugaaaauaagaugucuuauuuuguauuucuuagacuacuaauaagguuaaaaaucuucccauauguuuauuggccauuuuuguuucaucugugaaaugccuacugauguccuuuguuguuuuucuauuuuuugucuuuuucucuuuauuuauauuuacuagcucuuuguaugguaugaauacugauccuauuuugguuauguuuguagcaaauaucuucuuccaauauaugguuuauauuuuuaccuucucuaggguaucuuuugaugaacagaaguucuucauuuugauauucucuauuaucauuuuuauuguugaggcuuuauggaauuuuuuaaaagucucaacuacacaggaauaaaaauauuauauuuauaaauguuucagguuugcucuacaaauuuaagucuuuuauauauuuggaauugauuccuguuuauggagugagguagggauccaauuucauuuuuuuuccugaauagauaacuacuugugucaggucccauuuauugaauuaauuuuucuuuauugaucugaaaugccaccucucuuucauaugugcuauuucugagauauguaaggccuccuuuugguguuucuuaucuugauucuugguuacuuuaucuuucggacaguacaacaucucaguuacuauaguuuucccaccucuuucucccuuuuccuucuaauggaaguuauuuuuccauaaucuuuugucuuucuuuguugcugagaagucuucuguccauccgguccugucugguuauuguuccuugcuguuuuuguuuguccuuuuccuuccauuucacuauaguauauuuaggugcaggaaucuuuugguucguauguuuguucuuuuugguauaugcuaugugccaugcaucuguaagugcuugucuucugucauuucuggaaaauucuugguaacauuucugcauauauugucucauuuuuuccucauugguacagugguaucuccaccuguuacaugggacacugggguuuuaaaaaaaagaacacaaauauugccucuuuuauauucucucuuugcuuuccuccuggaauucuggguggaaauauauuagacuuucccauucugucuuccuugucucuuaaauguuuuuuauauuuucuauucucauuggcuugguguuuccuggauaauuuuaucagcucugucuuucaucaguucaguaacuuuaucuuuacuguuaauauuuccauugaauuuuuuaguuuagcaauuaugccuuuuauuucugacaguucacguuuauacuuuucaagcauaucuuguaauuucuaauaaucuuuuguugcuugcuuguuuuugugauuccaacuuuuauuccuuuaaaauguuuacaaauugcaauucugaauuuuuuaucugauuaucugaaauccuugggggaucuaaaucugauauuuguuguuucugagauucuuacacauggugauuuauuuucuuuaguguuuggugauguuuuauuauggguuccuagcuggcugaucuuaaucugcagaaaacguggauuucuaaauugaugacauuucaacaguauguuugcauuuguuucuugcaccacauggagagugcuacuuuaauccuggagucuugguccucuugccacuggcagugguacuauuggauuuacccuugcaauagccacguuucacugcccugguuucugcucacuuuuaaggguugaagguagauuucuuggaaguuucuuuuacuuccugugagccccaaauugcaacuaaaguuuuauguaggaucugguucuauggcugggagguauugugucucucauauaguuagaagcagaagagucuacauucuguuuuuuaacuaaggaaauauucugugcauauuuccucuuagcacauuagauauguaucauucuucuuuaaggcuguguaauaguuuuuucauauaguguuaauccucuaaaucuucuaaauauuuuauucauggcuugcuuuuuauuagcuuaauaauuauucuuucuuuuaauuuuuuuuccaguuuugccauggucaacauuuguggggcauucuuuuuuuucuuuuaacucuacaucuuguuccccacuugaaccuaagguucaaggcccacuggcagcugugucuuuuuagaaggucugcauuucuuauuuuuguccuucuucaccugggugcccugcauggccugguauaaccagcaucucuuccuguacauagaacuugcugauuaccacccaguacuuccugccuugaauccccuccugucuucccucuaccacuucauguccauugcugucuugaacagcucuccuauaaagcugagccaauuaaggcaacaguuuauucugcauccccuucagaggcaguuuauuugcauauuuugcuuauauacauuauaauuauuuuguguaauuuguguauguuuugucucuccaagcaaauuauaacuuauuagaggaugcagauuuccuccugauuuuuuuuuaauccugugaauuuaauacaagguuaagcaaugcucaggagagucuguggcaugcuuaacuaggaagacacugaauggaccuuuagaucucuggguggaguuugcgccuucccuaccagcacacuuaucauuugugugcauaacuuaugccuccuagagcauuguguucacaauauaugugugccugaccagaagaacaaauagaacuuuaaaacaaauuccuuccauauaauuuagcauuccuucuuagaucaauuuaauuggauggauguaaguugacaaaguagaggauauaaauuaaaguuucagaucuugaguaacauaaaauuaaauauagugauuugugaaaacauauccuucaaauggaaaacaucaauuuauuuagcuauuauuauuauuuguuucuuuuucuuuagaaauuugggcuagaaacuuaagucuuauaacaaugaaaacuuuccuguaguaaaugcaauauuucuuuuugucugaagaucuuaguucgaagaagcagcagcccugcugaauuggauuugaaagaugauuugcagcagacacaaggaaaauguagggaaagacagaagaguaaguuccgggaaaugucuguuccuccaacuacagaguugauauguucuauuuucuuuuuacauuuuauuauuauuauuauuagagacucagucucacucuuucgcccaggcuggagugcucuggcacaaucauggcucacugcagccucaaccucccugggcucaggugauccucccacccaauccuucugaguagcugggacuacaggcacaugucaaugcgcuuggcugauuuuucuauuuuuuauagagaugagguuuugccauguugcccaggcugguuuugaaugacugggcucaagccaucuucccacuuuuuaccuucuaacuugaguaauagcuuaucaauuugagagaaaugguugugaaaugggaccuucuuauuccuggaauccuaggauugacaaaagguucauccauacauauaauaaaacaguucuacucacccguaccuugagaggccugucuuucuaccccuggaccuuucuccaggugagugguacaucagagacugauggcaugagugagcagauagaccggagagaaaaauuaucuuccccagaaaguucccagaggcuagaagcaaaaagcaucagaaguacauugaagucaauggguuaaauacuuagaaauggaaugagauuggaauccugagacguauuaucauauauuguaaaauacagccuuaguacucugcuuuccugaagucaggugccagaguagcaaaguaaacaccuccucaaguucaggacaguucuugaugggugcagaggaguucuaccuucacccugcuagcuuagagcucuuuaggagaugaaguuugggaccuaccauuggucaccugguuacugagacaacuuuuaguucuuugugaguaaauagaggacagcagauuagaaacagcaagaguaagggacuguuaggaguagauacagagagcagccagaagggugagcagacagagauguagaugcauaaaguuguuaugaaguagacaggagacucugagaagcagaagugucuagguucauuuuaugucagacuaaauaguucuauaagucuuuguggccuagccuuauuauauuaugauaaauuagaacuuauuacuguuuaaaggggagaauuucuguucuagaaaaucuguuguauugggacacuauauccccagaugacccugaaugagucacccuaggucuacgucuaccugucaggcuuggggcauacagcaucuuuagacucuucuacccgguagaguaaacuugcauuugugguggaucaguuauuaucuucuuccuccacccauccucauuuuguaagucccagcacacuuuaggacuugguguaguuuggguguaggggguacugagugaagacacguugaagagugccacuugaaugauacauaguggugcucauaauggcuauuaauauccuuauuuggaagauucauuuucuugaccaagagccccacguggacacuuuuugagcuccucucaaguucugcagguucugccaaagaacaugaaugauuccuacugugucugcuguuuguuuaguuacuuucguaucaguaauugugaacauucugauuuucagcuauuuuuuaucuuaaacuuugguucuuccauuguaccaggugaaaguaccaacagugacacaacucugggcuguaccaaugaggcagagcuguccaugggcccauggcagaccugugaggaagacccagaacugaauacucccacagauguuguggcugaugcugaugcccgucauugguuacaacugagucccaccgaugcuucaaauuuaacagguaaauugcauuuugaaaaagaggcacuaaugcaaacagcugggagaucaguugugaaucauuggagucuuguauacagaggguucugaaacaguuguaggaggaagugugccaugcuccugaccacuguccaccauaggaggaagugaugguauucaugucaagccuuuacuaucccugacugaauuguucuaugcuagaaagaagagugauuuuuccaacucauacauguuauaaauccaggauaagucaaagaguuuagauagcuuauugauuaauuuuuaaauaaaguauuuugauacauaaaauguaaguuguaacauauacaguauguaaguuacggggaacaguaaugaagugaacacgagugagucuacuacccaacuuaagaacuagcagggcacccaagccagugaggucuccuagagguccuucucaagucccuccccuucucccauuaucuugggacccuaguccaaauuuguuuuuauacuaauuuccuugauuucuuuauaguuuuaccgugugugucaagcaauauaucauuuaguuuuguuucuaaacuuaaaaaaaaugacuucauacucuguauuuuuugcaacuuuuuuaaccucagauuguuugacuucagagccaaacuuucugggucggcuuccaggcaccuccgaggaauugcuggguggccuugagcuaguuauuuaaucucuguccuuuuguuucuuugccuuuaaauuugggauaauagcccguacuuuaugaaggcuguuggaagaauaaaugagugaacaucuaagucaggugcccaaaauauugugugugguguagucugcaguuuuagcuacacacacacagacacacacacacacacacacacacacacacacacacugugugacacuggguaagucaaccucaaaggucaguuucccucaccuguuugaccaggcugaugagaacggggaggccauggaggagcuggguuugguuuugcuuuguuuuguggagugucaggagagacucguggucugaggaaucagugcgggaaaggcugaccagagccaagacuuuuauggaugcacauucauguucacacacagguaucuuguaugaaaacaaccaccacaaaguaacauguuaagaguguuauuaaaaugccaaaaaauauuuuaaaaugauuaacauaaaggcuaaaauuugaccuuaaauggauuuuuuuuuuuaaaccaagcaaacugguuuucacugugauuuaaaauuuaacuaacgucucugauauuugggaaauucuugauagaaugucauuaaaacuucauaaaauuaacauaugaaggugguauucaguaaaauucuuuauagacuaaauaaugauuuugacuaauaauacuauacauugauaugagauucaacauuuacaaagaauuuugaggcauucucuuugauucuguaugggaagcaggccaagucuuaucaugucuguuuuagagauggggagauugagacccagagaaauuguuaucaagcuggagugugaguuccagagaugaaacuggcuuccaaaauguuuugacucaacgugcagugcuaugucuacuccuuuacacuguguuccuguuaaaauuaaaauuacuguaaagcccuuugaccuacuugagaauccuuacagauuauccaaaagaaagucaucauugugguacuguaggaggcaaaacugaagcuucaguagguugaauuuacuuaaacauggacuaguuuuaauuauuuuuauugaaagggaagaaaauuaggugauuacuucuuuugucuguucuuuggaaagauuaguuuugaucccauuucaggguauguauuggacagcucaauuuaauaaaccucugugagguaauuuuauaugaugcacuccauguugugauuaacuccuccaaauacuccguucuucuuugaaauacuaauauagagaaucaguacacgcaguucaauaguucaccuugucaucugugaaaaggacaaacuguaaugugauaaggcuuaaggauuaucacaguucugaauuuaacuuucuguucuuaagagagcaauuucuucauaaauguucaaaauaaaacucauaugagccugauuuuuaggacaugcaaagagaaacaauuugauuauaucuuuguuucuuauugaauaauccuaccaguuaucaaaugcuuagaauaauaaacugccuccaaaaucuuaaauuccuucaucacuggcaaacuguuuacuuuuauauuugcuuucucauuaaaucauguuugcugaaaauaacagcuaaauuuacugugcauugucuuaaaguuuaccugggauuuguuuuaaucagaugugguaagacauacagacauggaaaugauugucauggaggaagaaguuuauacucacggaucccuggaaacaggggucaugcagggaaguaccaggaggcagaaggaacaaaauggggcaaccgcuuuuagugucauuucuauggaaauagcaaggcaaggcaggguaugcaguuuuaggauuacuaauaugaaugacuucagugggcucuggagcauacgggcuguuucuaguuuccugguacccaguccuaggaugacagggcaggggauauugacuuaguaugugagaacuagagaaaggagguaguuggagggucugaauuuugaauugguagguuugcaugugaaagacaugcugccuggugaauagacuucuaucucuaggaauuagcuaacccuggaaguggcaguccuucccugaucagugaggcccuaaugccagagcauugagaagacagaaaauaagaaaauauacuuaagacaugcauacauuuaguucuguugaaauagucaggggagggggacauuuaugagucuacagcuaagaaucaguauugucauuuaccucaucccuuauuuaacaaauaagcuuauagucuagaaauacugauuuagaugcucugagaaauaaaaagaugaauaagucauaagccacuauaguuuuuaagagcuuauaaaaaggacagaagacacaacauuuauccuaauagucacaaauaaugugauaaauucuaugacauuuacuuaaaguuguaaucauagagauagacaaauagacggauggaacagaagauaaaauauagcacugagugcacacagacauggaaucaugauauaugauauauguggcuugucaggucugacaaggaaacaauguauuguucaacacauuucugugggacaaguacuuagccauauggaaaaaaaugaaauagaauuccuaccucacgccauguccaaagucaguuucagagggauaaaguacauaaaugugaaaaggaaaauuuaaaaacuuuuggaagaaaacgucuuuuuuaaaagguucuaugauuuuuuuuaaaaaauagcuaaccauaaaaaaagugucaguaauucaaccucagcaaaaugaaaacugcauuaccagagaaacuuuuaagaauucugugguuuagcagaaccacaaagggaaaaagccagcuuuguugcucuuuucuuuccauguucuuguuagcucagugauaacuuuuaaaguaagguuuggugagaaauguuaucuagcaucuugguuuaguugggagauuccaaggucuuucucuacuggaaugcagacuccaggagggggacgccuguugucugcuaugugcacagcugauucuugcuuccgagaauauugcaggacaggagagaagcauuuaauaaauacuugaaucagcgaacaaauacacuuuaagcugcaagcuguuguuuuauauagcugaaaagagcaauuaaauuuuaauuuuuuagaaauaauacauaagacaauuucaaaaucucuuuuauuuagugugguuaucacagucuugcauccaaauguuacagaaauuuuuuugccacuucugcuuuuaauuauggcugugaauaugaauuacagcuccuguuaccugccacuaaaauuguuuuuccaagaaugcuuugucagcauucucugucaucgccuauauuuuuggcauuuccaccagacuuugauguguuucgaagucaugaaauauuagaaagaaaaauaauaaugauagcuacuggggcauugguagcucaccuucugaaaucuuugcagugagcaguggacauccuugaaaaggaguggaagaaggagaggagagccaggcugcacuggugggagcaggaugccaucuuacuguuucuccacuugaucauugacauccaggccaggccugaauuuucuggcucuagaauuaaguuguuucacucaggccuuugaguuuguuuuuuauguuuaguuuucaaaucaaaaggaaaauuuuuuucagagaccgaggcuacauuucuuuaacacugugccuagcuuauauaaaauugcagccauauuaaaucaccauuuggccuuaaaugcuuauuuugccaacuaccaagacuuauuuuguggcugaaauccuuucuauauuugcaaaguucuaaacuuuuagaucucuuuguaaaaauuauuuauguguuuggagaaagaugauacaauuaugcuuguaagaguuuucacuuuaauaaaaaaauuuuaaacacccguauagcauuaaguaguaauaaaacaaaaagauagcaggcuagcauacuaggcugcuaaugaaaaauaaaauaaaauaaauauuggguauuuuuagggugaacgugaaauugucugaagucucuuaaauucccauuuuuaauuaagugcuccuucacugaggaacccucuacauguaaaaugucagcaucuguucugucacuuacgccaccagcagaguaauuuugggcaaaacauuucaacucauuaacauuuuuguucauaguaauacugaggaaacucauacaggcaucucagaaacuccuaaagaagucagcguaccuugauaauuuuauggaggauguugccuaggauuuuaucauugaggcaugaauuuuucugaguguaaagcaguacugaagcagauuuucuaugugggauucuuucauaaguaagggcauauucguuggcagguugaaaagaggugcaggugaugaugagguaucugucuacauguacuuggagugguuacucaagcaaaucuccagugugauugggaugcuggggaccaaucucuguuuuggauagcuacauuuuuggagugaagguuuaaccagcgaugaaacaaagcuguaaauuaucuaauccccuuacuuuuuuuuucuccucaagggauugaaaaaugccaugacauccuuuaugagaaaaauaaaugccauauuaugcuucuuguucacuugggggcucauguugauucauaagcauuuauugaugcuucagcauaccuuuucagacuaacagaugccugauauuguacuuacuuuacagaauuaggaugaugagucuuucuuccgagguuuuauaaaagucagagaacccagaaggcccauaauuagguuuuuugcacucugccuuucaggcacaguguguaggaauuccaguuuggaugauauuugcacauuuugaugugucuccugaguugaguauaugauacucuugugggaacuacagguguguuuuccucuaagaaggaacagugcuucuguguuugggaaggccuuuccaagacaccaugugccaucauuauuacaucuuuuuuuaugugugucuugggaucuuuccaucacuaauuuaauaagcauagcuuauuauagugagcagccauuuuuggaccugcccuccuuuucaguuucauuuuuuucuugccuuuuguugcccuugucauuccucuacuugaguuccucagauccagagauugugcuucaguuucuuugauuaggccuuaaaaaugccaacaacauauacacucgagaugacacucaguggggacugauaauugccuagaaaucaguccggcuuuauuuguauggggugaagaagagaacuuugggaauaauuauguuaauaaauuaacacaauguguucuauucaaaaauuaggaaaagaauaacagaauaacauacauguuaauaaaaaaggaacuaauaaagcugagagcauacaugcauguacuagaaagcaaauaauaguuagaagacaacuaaaaauuguucuuugaaaacacuaauaaaaauagacaaacaggcaagacugaucaagaaaaaauguuggaggugaaaagggaacaacuacgaaaccaauauaaauuuuuaaaauaauacaguaugcuauucaaauagaucuauaaaaauaaaggauaauuucuagcuuuacuaaaccuucauguaaaagagaaacuuuaccuuuuucaucccauuccguagaaagagaaacucacuucuguuaucuaccuuauguuaccuugaaacaaaccacacaaggucaguaugaaaaaaacauaauuagagaccaucucacuuauaaacauauaagcaaaaaauucuaaauaaagcaauaauaaaugagauugaagaauguuggaaaaauaucauacaucagggcuaagagaaguucauuccaggaaugcaaaagaaaagccuaugagaaagauauccaauagauuccaauugaggaacaaucuauaaagccaguacuccuuaaaaaccaugaaggucaucaaaaacaaaguuuuaagaaaacucacagucaaaaggaggcuauggagacaugacagcuauuuguuaugugauauccuggaugagauccuggaacagaaaaaagaauuaccuaaaaacuaaggaaaucucaaugaaguguagacuuuauaauaaucuuuuaguauugguuuguuguaauaaauauuccauucgaauauaagauguuaauaguggagaaauuagauacggaguauauggaaacuauauuauugucacaauuuuuuauaaauccaaaauuguucuuaaaaaauaaauuuuauuuuaaaaagacuaauucaggaaaaaauuaccaaauauaaaugcauuaaagccaacaacaaaaauuauaaaauaaguggcuuuuaaaaauaagcaagagaaaugaguaacaaagacauaaauuauaauaaugcauauuauuaaagacaguagagugaacaaacacaaauagccccacuuauucuccaaaccguacuuaagccacauugaaaggauuuauauuaaauaagacauaaauccacaaggacaaagauggcaggagaaagacaguagcaaccaacuucuugaaguugcagaacagguggccugugguaaauuaauuggcagaccugagaauauuaaauccugugucaguaauaggggaagccaagaaacaaccugacuuaaauuaaugcggguucucuaaaaggguuagaaaauuucccauaccagguagcuacaaaaguaggaggugaugauggggcuaaaaacaggaagacuguaagucuguuuaagaacuaguuagagcucuguugccacuggccacugcuuuuucacccuagaaaauggugaaaguaaauuaggcggguucuggcuuggagucaccaacacgucugagugcagagaugcugucuugaaaacagagggauuaaaggagaguuuucauacucuuugagcaggaagagagucuuuugaauuccaggaaaaaaaaaaaaaacaaacucaacauacauauaucugagguucuucaggaacacagugaaacugaccaaagaccaugccugcuuaugguuucugcuucaguucaguccugagcauguagagcugucaaauauguuguuggagaaaugaguuuaaacuugaggaaagaaaucuaggccagaaaugggcauguagagcugugaguauauggauggcauucaaauaugucuggcaguaaaucuguaugagauuaagaggggcaugaguauagauagagaagacaaaagcuccagggcucuucaguguccacagucugugagaugaagaagcaccagcaaaagaagaccaggugagagucauaccugggggucaaaugguugaagcauuucagaaaggagacaugauuaccugaaucaaaugcugcugaggacuggacauugagcacuacauuaaacaacauggaagucuuugguggccuacucaagcaccaugccaguggagaagagggauagaacacaugggggcugaggcuaugacacaugagaacagagacugaacuuugugcaaaggcugcagguuggagauguggaauccagaauuuaaaaacugagcugcgagagauuagaggaaugugcuuggucauggaagcaaauagagauagaauugucuaaaaagggccugagaagaagcguuaaaugcugcaaugaagucaaaaggaugaagagugagaaaauacaaugugcaguuaaaaugcuugccucuguugauuauuacauacauacuaugaaauaaauuuuuuuguuauaauacaucauucuuuaaguggugccugugugucuuuggcugcuuuucuguuuacucuaaaaauucaaaggcuuauuuuaggaagcuggagacguacucaaaucagucuucuagccuuuacucauacuaaagcaacagguauccaaagaacaaaauucuauaacuuaaucgguaaaauuagauauacauguaaaucauuaaauucuucauuaacuauuuguuucaaugcacaguuucauauuucauaauuaaauauauauuacaaagacauucuaugccuugaacuuguuagcacacuccuaucucacagccuuugcucuagcucuucucccuaacugacucuuccccacagagcugcacagcccauuugcacauugucuucaaguucgagucacauaucacugcaugcuuaaaaucuuuagucacuggagaacugcaaaugaaaaccucagugagauacugcugcaugccuauaagaaugguuaaaauuuuaaaaaccaacaguaucaaguucuagcaaggauguagaacaaguggaacucucucauacuuugcuugcaggagugcaaaccguaacagcacuuuggacaacaguuugacaguuucuuucuucaguuuaauguuuauuaagcauacacuuaugaccggacccaggaaucucacuccuagauauuuacuuaagagaaauguaaacauguuaacacaaaagcuuguacaugaauguuuauagcaacuguauucauaauugccaaaaaacaggaacaaaucuaaauaucuacaggugaauggauaaacuaugacacaucuguaaaauagaauauuaaucaguaauaagaagagacaacugauacccacaacuguacagaugaaucucaaaugcauuuugcugagugaaagaaaccagacaggcuacaaacuguagaauuucauucaugugacauucuggaaaaggcaaaacuauaggaacagagaacaaagcaguaguugcaagaggcugagaauagaggaaggggaccaauuaugaaggggcacuuuuuggagugaugagauccuccauauuucaauuaugguggcaguuuauggcaacaguugcaugaacguauacauuccuuaaaacuccuuaaaccugaaagggauggaaauuucuuguaugcacauuucacccccaugaaccugaccuaacaacaaccaccgcagauguuacuccagcauugaggcuucccuggccacccauuuccauggcacuguuucccacccauccugcucaagggucucccucuuccucuccccugaucuauaaaacccaucacagggucuccaggaacuguuaugucaugucuuagcuuguugcucuuuuaguuugaagaaucaaaaucauuugaccuuucuuccuugauccugcuuuucucuccuuuuaaauucucagcuguuucacauuuuuugccuuaauuauuuuacuuugaauaccuaagguaauuugccuuaaagaaaaaagguaugaugaaaucaagauuguuuacaggguuaacagacauguuuuucugcauagauagcagcgagugccucacagaugacuguaguauaaucgccggggggagccucacugguuggcacccagacucugcugcuguguuauggcgaagggucuuggggauccucggagaugugaauaacauccagucacccaagauccaugccagaguuuucugcuaucucuaugaacucugguacaaacuagcaaagguaaguucugcuauguuacuuuuuauucuaauccaggaaaauggucuuaucauuuaauguaaaaacuguguuucaguuaacuacugaacauauuccgaaacacaaaugguacauuuagacaaaguccauuugauuaucaaagaauaaucauauauaacaugacuauuuuauaaaugcaaaaguuauuucauuuagugcaaaaguagaauauugcuauaggauauuaaauacaggauguuaagucauucuaguuacucucuuuauaaaagugauauugguuguauuguauacaauuugaaaaauguagaaaaauacaaagaagaaaauuaacaucaguauucauagaaauagccaauauuaauauauagucuucuuucuuuuuaugaaaguagaaucuuagaguacauacaaguuuuuuuuuuuuuuuugaaauggagucuugcuugcccugucgcccaggcuggagugcaguggcgccaucuuggcucacugcaacccucugccuccuggguucaagcaauucuccugcuuuagccuccugaguaguacauacaauuuuuauucugauuuuuguuuggguucugacauucacauguauuaaauuuuuuuuucaaaaacaugguucauguuuguucaguauaacucauuaaaauguuacuuaucguuuggaauucaggaccuccccagccauuaacguucaaggaaaaacaaugccuuuguuuuguauauaaaucuaaaaccacauacaguaagccaaacauguaauucaaaaggauaauuucacaauaaaagagaaacuuguaaauauuacagguuuucacuuauagaaauuaacugaaagcagcuauauggucacagaagacuguugaaauacuguugggauaaacguaauguuaccuacccuaaaauucuccucuuugugaauuagauacgggauaaucuagcaauaagccuggauaaccagucuucuccaucuccuccaguuuugaucccaccacucagaauguuugcaucauggcuguuuaaggcaaguggauauguguuuauuccuuuauugcgauuuccucuuccuuucugaaauugaguuugaaaaauguaauugcccaagacugcauguuuugaagacaggcugggucuuacuaaaguaacugcaucccacauguccauaaacaacucuuaaggaaaacugagaaguaaaugaaauguugaaauacucugcaccugggcuugauuuaaucuggaaacaucaucuccuugacaggcggcgacacugccaaaugaauauaaggaaggcaaacuacaagccuacaggcugaucugugccaugaugaccagacgccaggacguucugccaaacucagauuuccuggugcauuuuuaccuugugaugcaccugggauuaaccagcgaggaucagguauucugcgacuccuuuauugugauugcccauuaauuggaaauagcauaucacucuuuaaagacauuaguaauauuuaugaaaauacaucagaaguguugaauuucucaguaguuucaacucuuuuacacacagcaagcacaauggucuuucaaaaauguaaaucagguuucacaucccugcuucuucuccccacugacuuugcauuugcauugugccaaccaaauuuuaauuuuauucuauggccucuaugaucuaaccucugccuguguugucaaccucaaaauacuauuauaaccacuuuuuguuuggguucugcauuaaauaugguuugaagaaagugguacugaucauuuaaaaauguuugaaaauuguuguuuuaguaguuaggauguuuuugugaaagacuuuaccuguaagauagaagaugaguccagacauuucuugauaaggaguuauuuuaauuucucccaaugcaauuuaaguuugguucaaguucgaacagaaaggcccaaggagccacuagcuaccucuuccuccuuguaggcccuagguuugggagauaggguguggccagacccugaccuuccucccuugggaagacuucugccaguugagggagauuacggauagggacacauggauucuugacuugauuugggauaucaagcaggcaagugaugugauugauuuaugcuucacagagauucuggacugcauuuggaagauggauuugaaaaugugauaguaggauagaaucagagauuggccuguagauggagaacaauuaggaaguguuuaauacagauuuuaaaaaaaugauaagaacuaagccgguagcauuggggauggaaagaaaggaauagaaaagauucaauaaauuuuaagacauuucauuuuauuacuagguuuucuuaaccaauauagagguauagggaguguuugagauuuacccuuuaaauuguaaauacuuauuaaugaacuugaaucauuuauuaacuaucaaguaacuguccuuucugcauuuuuuguauucguugaagguaugaugcagacacacagaccuuuugauaccucaggguacauguaagaaguuauucuccugauaagcaaacuuuuuuuguugcuuuagaauguacuugaauuuaaauaguuugcaguauguauuucccaauacuuacuuugagcuuuaaaaaucauugaacucuuauaugaaauaauaaccauacuguccuagugaguagucugucauauucauugugauuuuagcaguguauagaggacauccauguagcaggcuggcuuagucccauaaucucauuuauuuccuagauaaauguagaaauaggaacacaaaguagaauuguuuguacucccugcucaaauauuuuacaggcaucauugcaaguggaagcaucuuuuacagaaugaugcaacucaggguauguggaggauuaugggguauagaaaagacaauuaacucucagauaauaaugaacuccuucagugaaagaaacaaaagaggaagguuuacuuaacaauacccuacuuuaaagaagccuuaugcuaauauuuugcaggaaaaaaaauuuacuuggaaauaauaaucaacuauagauccuucucauuuuauaaaaacaaguaaguuagcaguaaacaauguuccuuagaaugaauuuuuuagaaagucacauaaaugaguuuagaauugucuuucuauuuuaagauguguugauguggaaaugaaacaguaaaaugagaugaaauaagaguauauuauauaacauuugagaaccugaaaaaaauuauuuuauaaaucauuuucaagaaauacaauuuuauaguauagacaaaagaauuuccaaauuuugugcuuaaaauuguuuuuacaucuuaaugcauguuauguuuuuaauuaaguuaaggcucaauaucuuuuauaguucauaguggaauacauaaaucuuaaaagaugguccaaugcuaacaguaaucccaacauucagacuucuaagaugaaaugaggauaucauaaaucucuauuuaaaaucagccuauuauuuaggcuuaguuagaagcuugaauuuuuaugugaguuuaauagaguugacuguuuucuuuaaccuuaacaauuauuguuauauauuuuagaagcgcugacugucugccaaacagaauuacucuaaguaaacuuuauuccuuugccagaugaaaauuacgcagaagaccuaaugaaagaaacuuuuuuucauuuaaguuaagaaaugucucugguaauuaguuuaacuuuugauccacacgucuaaauagaucauagugguuguuucagaacuuauguaauucuggaaacacauguuauauuaauuauaaaaagaaaagaaagcauuuaugguagagaauacaguuaaauucaauuuuuuaauuaacaaacuauguaccugugacugguaccaucucagggcuucuuucuauuuugugagaauucucaaagggccacacuuuuauguauccuagcagcaaaaggauuuauuuaugcagagagaaccuuaugaaagauguccuguguuuuuaaauaaauaaucauaaauaauuguuuaaaauugaacauuaucaguuuugucucacaaauaaaauccaagguggguuucuuccuuuugccucuggguggcacacuugucugcacgacgcagcuuugugguucaugggccuuugaacauuaugcuuuguauggcuugguuguuucaugaaguucuuucuuaaaucugaagguaucaaaauuaugucaguagugaccaauaaaguguugaauuaaauaaguuauaagaugcuaaaaaguauuuucaaacauaaugauguucauaguaauugaagacauuuuuuaguuuaaaaaacaauuuguaaaguagaugucucaugaguuguguucucuggcaauccuggaaaguuauaguuucaucuaauaugauagcaaauuuauuauguaaacagacaugaccauuuguaucuuaaaaaauaauaauacauauaccaaacagccagaaaaauguagugcauuccaaagcaacuguuuuuaguauuuuuaaccaguuuugguuauccuaauaacuuauguaauacuaacacaaugaauuuaucaaguaguauuucccccgguacauauguaacauggguucgugguugauuggugugaucgaaaacaugguuugaaauggcuuuauuuuuuccuugacaaugaauuuuuuuuaaaaauugauguuagugguuuacaaaauaauuaggauuauaaacaguuccaaaauaacuauaaauuaugaagaaaauuuggcgugacuuucagggcuacccggccugccugugaaggagucucccaguacgcuucccucugcucagcugcuuugugucugagggugggcuggugauggugcuuaggaguauuuauuucuucagcacucacagugcuggacucugugcuggggacugcaugauguuguacuauugaaucuucucugcaauucaauucaauaaauaccauggccuauuuuauuuuauuuuauuuuauuuuauuuuauuuuauuuuauuuuauuuuauuuuauuuuauuauugcuuuuuuuuuuagagaugggguaucgcuccauugcccaggcuggagcgcagugacacaaucauagcucacugggcucaagcaguccucccgucuuggccucccaaaaugcugggauuacaggugugagccauaguacccaggccccugaggcccauuuuauaaauaaugaaacuucaaaaaaauaucuaaaacuuuugcccagugccacaggcuaaaaagccuguuagaauucacauacaggcuuggcuuauuccaccagguauguuuucuuuuauugauucacagcaagcguauugguccaacagccuugauguuguuucucccuuccguuuuauuuugccugggcucugcccuugguccuacuccacuucagaauccuccuuauuaaacuacccugccccaaccuggaaagaccuuuccacaguugccuucucaguucuucaucauccuucaguuucucuucuaaagcuguuucuuguuguucucaguuuuuccuaacacuuaagcagcuuuuucacaucagaauuccccaaaauaguuugacaugaaagaaccuaugauuuggauuuauuaaaaacaguuuuuauuaauuucaugauuauuuaaaacagauggaaagaucaauaugugugaaauggaaaaggacaguugaggaaaggaauuuuauuuucauguuuguaagaacauguaucagagacuggaagguuuucuuugcuuaaaauaagugagcuauuuuuuaacaaugacuuacagauuuaaugucuuaauguaauuugucuguuauacaucaaaguuaaauucucuuuuaaaugcaaagccuacauuaauguaaaauuauuguugcaaauaugcauauagacauuuugggaaaugugggucuuugucauuuucaucuauaauauuguguuuuauaaugcaccaaaaaagcaugaggccucucuccaaugcagaaguguuuguuguucugcccugaaguaacauauuuggaucauaacagcauaaaguuaagaucuaguguaauagagugugauaaaguguauugguuaagagcauggaccucaagucagcuugucugauuuccugucuuggcuuuguuacuuauuagccaaaucauuuggguuugcugugcucuggcucccuuaucuaucgaaugaggauaauaauagugccuaccucagaggguuguuugaagacuugaaagagguaaaaacauguaaugcauucagucuggaucauggauaugaucccuuaguaagcaugagcucuuguaauaauauuaaggguaaggagaagaacagcaacaccaucauuuauuucugauaucuuaaaguguugauuuuuuuucuuucuccauauacauuuucuuacuuugaacauaaugauuugacuaaaaaacauaacuaggcauuguggaauuuuacaacguguggagaaauaaccacucccugugcuguagacagacauaccgauugauacauuuguuuuacccauguaugcuuaugauccagaaaugcuucuuuuguguccauggcuaucggcucacuuucccucacuuuucaccccacccaaugagccucuguacaaggaaagcuagaaagcugaacacugcaugucccagacuccuugcagcuggguuggcauugacccagguucuguccagcagagacaccagccaacauggcacuugaagguagauguggggaguggugggcagcagcacagggggaucuggguccuccugucauggagguucugcuccggcaccaccaucacuguugagaugagcagacagugggcucugcuggaacagccuugugauguggcuggguguuccugcuuaccagcuuuuuccuggcuguggagauuugugauugguucccuggcacuucuagacauucuccagaccaucuaacacccucauagaagucucuuucuucuuaaucucaaaacaguggauucucuugccugcaaguaagacccuggcucagccaguaacugcucugcaaagugcugugcuggucacuggcaauacaugaucaacacugguucauauuucaguugcugaaugcacuugagcauuaauuuaauuuuuguauuuuuaaaauuuuagccacuuauuuuguaggcaauaauauuuagcuuguaggaacauuuugcuuucauuuaacuccacauuuuuaugaacguuuugucacaucaauguuaaaaaaaaccauaauuuuaaacaucauauauagagcaguauucuaucacagaagucaaaguaguucaugauuuucuuaacggguguuacaacccccucucaugagguauaugauggaauaauauaauaauaaacagucguuuguaaaaagaucccaugaggccccucagugagcauuaagacucagcagugagcuuugaaagcaaggugcaggggugauacuuguaaauuggccauaccugacucuuuuaauaaccccagacagccuguaucaugcagucauauguaauaauugcaucaccuuuucucagacaaagaauuguucuuugcugaaaauuuagacuuguuacuauggaaccauauauguuagauaaacauaaauuucaaaguauauuuaaggugaaacauaagugaguauucaguuccaggaaagguaaagaauuaggauggcaaauuggaggccuuguuuaucucaaaucccuggaaauaauuuuaauacaugucucuaaagugcucauucuguacagcaagugauuuuaccaagguuuuaauuuauaggauuuuaacucaacacuagcagauaaaguacuuauuugugaauuuaaagaucuaacugauguuccgaggaugaaauaauaacuuugauguguaucaguagaggaacuuuagaccuuuagaaggcuaacuuuguuaaagcuucauuuaaaaacaguuuaaaaaaaacuauagguuuauacaacaaguaaaaauaggacuaauguggggccuuauuccuaagguuucuaagaauuggaaaauguacuuccaagaauucaggauauaagauggcuucagaauauauugacuuucaagaauaacauaugacucucauggauggcaggccugauacugggaacuaaaauaccuuagagcuagacucagcuuugucacucacuggccauggggcccucaccuauccacaaguagucaagugaaugaauugggcuagagagccucucagacccuuucccauuaagcauucuuagauccucugauuuauuuuuaggcacuuuauuauuagggucacaucacuccuuccuaaauguggcacaaaguucaaugaucuuuuuauguugaauauuuuuuccugccaugguaaagaccuagucagguuaugagagugugagaugcauaaacaaguaucuguacuaaccaucaacuugugcagaagaccaaauaaguagugauauacauguuaugaaaauugaacuguugaauauccuuuuagcuaaguugauuugaaagcagcucacaaaggagaggggauuuagcaggacuuucaagaauggauaggauuuaaauagcaggacaagaagcaugauggaguuucacaucaaagauacagaacuuuucaggcuguguucaggaacaaugacuagaguggcuuugauuuaaugccagauauaugcguagaaauaauauauggucaugaauccaggcagcacuguagagagccuugauucaaaguaguuuucaucccauggacaguggggagcuguugaagguuuuugagcaugauacuccacaugaccacaagagcauuuuaagaagcuuaaaccacagugauaaagugggggugaauuauaaucaugaaagaaugaugacaacaaacacagaaaggaaauuauuauaauagcccaggggcaagguaaugagggcuaacaaggacugaggcacagaugggguuugugugugugugugucuauguguauaauucauuauauguguauauauuuuguauauauaugcacauauguguuuugugcauguguguguguguguguuugucugugugugagaaauauguuggagagguaggauguaguacugauugguaagcauccugagaaaguaguguccuggcacgauucccauuaucugucaaggcaaauguugguucagaaaggcaagaagaugaauugagaaaaggaagacaugugggcaugauaggauaaagggacuguaaguuucgacucaugucuugaugacccuuccucaccuuggacauuauagcauaggacaggccaaaugggugcauccgaggauacaccaagggguguccccaaagaauucuugccuguuaggaauuagaaaugugcaggaaagauuuccagggacauuuucucuguacuuaagagaacauauuuucuaauucuguuggaauucaagcaguugguaugcaaauuguaaauguauuuauaauuauuaaaaugggacaucuaaagggcucuguaauugauguuuuuguuagccaagacauauauuuguuacuaauuauuucugaaaguaauguagcacuuaaaaacaaguccuuuuauuuuucuaaaaauacaacuucugaccugaauuuacuuuacucaaguuaaugaaauauuauugaauauaaggggaguuuacuguagcaauaaacaaaacuuccaaguuugacuuagguuugauugaaggauaauauuuauaaggacaggugagagaugacaguccucuccugacauguauuguuaaguuaaucauaauuccuguuugugcuuauuguacaaauucagagugauaaaauacagaagcugucauauaauuaacguuacaccaucagguagcauccacugccuuccgaguguuuuccacaagguuuugugggaauggacaagccacagauucaucaaaauuuaucaaugaaaguuuuauuauaacuuuauucagcuaucaaucgccauaaagacuucagauagaugacugcaccaaaaauaaaugcgagauauuuuuucuuuuuuuuauagcuguagaaucaauaauuauuuucauuaaucuguagacagagcccacuuguaccucaaugaggaaaguaaaaauauguaggagguaacagauggcagagguuucgguuaugagguuuaacacaugugcagugaacuuguuucacagcuuuaaaaaguguaagaugauagcauggaggcugauccagagagaagaaaaucuaccugacaggccagaaacuacaguuuuguuugguuuccuuuguuggauuuaaagguguaaagacuuucuuucaaguaaauguuaucagacaugaauaugaauuauguauauuuagcccaaaaucuuccgguaucuaauaagacaugcuacgugaaauaaagcauaaaaauaguauagcaacucucaguauaugugggaaaaggaaagauuuuguucuuaguaaacuguuaccgugugauaucguguaucaguuggcauacauuuuucaguugagaacauguucuuuugcucugagguuucucucuggaaggagacucuacuguggccugucacagagcccagaucaccggaaucuuuuuuaauagagucacuggagugcauucugucuuuucccagagaggguagaugcucaguagauauauugauugauagaaaauggaagaaaaaaaaaaagaccuucuucugagacuggcuauuccaaaucuacacagcaucauggggaagaauggguaaccaaagcagcugagcugagccacuuugguugcaauuuuggcuccaacuaucaguuucaaggcaggcauuaacuuucuacuguggugagcuagucaacuuucauuacccuagaacagugauucuugaggggcaggggaauuuugcccccuccagggaacauuuggcaaugucuggacacacuuuugguugucauaaagugcacugucauuuggugggugaaagccagggauguuguuaaauauccuguagugcacagaaacacaacaaagaauuuaugaccaaaaaugucaguacugcugagguugagaaaccuugcccuaaaggaguacuucugcagaugacauuguccuaagaaaagagcuagguaauauaaauuaaaugacacaacucaguaaucaaagacaguaugaaagucucacucuguuagcuuaaccaagggaauaaaugcauacaaaaauuuaaccagggagauuaagagagucaauguuucagguugaguuaaaugaguuuucaaaaaggggguacaauuucauaaugguucagcuuacuaaauucucugucuaaaaaaaucaguuuaagaaauaaaacauggaacguucugauuaauucugaaguuaacaugaaaauuaucugagaugaauuuugucuggaagcccaaaguagaaaguuguguggccugcaucugcaaagcccaaggcacuguauguaugaaaggaggcaggaagggggcucagguuccacuucuugcaugagcacugccugaguagcuaagaggaagcaggauggcugagagaacagcuugcauggaaaagggcuggugcauggagacagauaauugccuuuuucaaaugucugaagcagugcugugugagagagacuguuuuacccagagccaggacuaauagguagauucuagcucaucaucaggagacacuaaauccaguuuucuguucaaauauggcaggugauagguucuguguuuguaagccuuucaagcucuaaaguauucaguccaaggcugucugacgcucuaggacagccucagaaaaagggaacauucacuuuagagcuugagcccuaccuagccuugcacucaagucacugcauccaugaauuggugaacagauacauagccuguuuggcuugugcugcuuauuccaugaaacggguuucugaugacucugggacuuugggaagggaaagauaguuaggccuucaguaggcaaugguacauuucauugcagaagggauuuuccugcucuuuggaauauagcuauugaccuguaagaccaucuuuucucauuuagaguucuaugaagacuuuaagaaauguuacauuuuucuccaggcacagaggcacugagagacacaggaauagcuucuagagacauuucagguacuaaaguuauacuuggggaaggaggauacauuaacucccauuuggagaggaaugauuuuugaauauaagagauuuaaaucaugacugugguuuauaauucauaaagaguagacuuggauagaaggauauaaugucaagaaaagcauuuuaaauugcaauuuuuguuuccgugagaaaagugcucuccuuguggggaauaaucucuuuuugucuguugauuucuuuuuaauacauaacaauaagugguauugugguaauugcagauuguucagcuauuaaugcuauuuacugaaacacauuuuagagagaacauuguuuucugaagaagcaauaaacaacaguuuuucuuuuguucucccauggaaaaaauauccuuugguagguaauugugggcuaaagaaauguuagcaaaagagaagcuuuuaauaauaagacauuaaaacaaaauaccuaccauuuuccugugugcuggagucuaguugaacacgugcagcauggucccuucaucaagacccagugccuugugccaccuauuugcuucccuuccuugguucccauggcaugccugcuguccccaucaugcaagagcccugugcucuugguggccucacucuuagcuaugaguagcuuucccuuccccuaacaggucauugcuggaaggcaggggcugccuuagaaccucacagcaacuaacaugguaccuucaacccaguuagcacuugagaauuucaaaugauccuggaaaauuaauauuuuaauaagaucaugaauaacuguugcuguuauuuaauaaaaauaauaauuaugaacuuuggaauuuacaaaaugcuuucaguuacaaucuccuuugcccuuuugaagaguacaacagggcaugaugcauuuucauucccauuuuacagaugacgaaauuguuguucgaaagguaaaguaucugcccaaguucagcuaucaaauuaguuguaucuuuuacuggaauuuuaucuuuaaagcccuccuccuccuauuuccucauuagcucaaaaaucuacacuuaaagcaucucauuaaaaaaaaaguuguuuuuaggccccuaaaaugaguuuuguuauauguacauuaaaaaucaaaauguaaaauaaguauuccuagaauuugaagcagcaagcuauuuguccaccauuuagaggucgauugaccucuuugcuuucugccauggugagauuuguauguggugggcuuuucaucauacgaugggcaggacagguguagugucggguuuguugguauugcugcuuugcuaguggaucuggccugagguuucuccauaagcagguugauagagcuggcuuccguugggauuguucucucaaauuucagccauucuugagagcucuuugucuaaacacgaauugucuaaaugggaggggugggagauugucauucuaauucauccaggccuccacccacauuagaggguuggucgguagagucccaaaauugaaugaccacaggguugcccucuguuuuuuugcagaacacaaaaauguugagagcuucaguuuugcugcuuugugcagguggaguaauuuuacuuguaagaaaauaaacuaagagagcaugcauuuuguguuuucuuagaaugaaaagaauggauaauaaucauauucuaaaauuaaucucuuuacugauaagggaacaaaccagaaguugugggaaguaacgaacagaaaucauuuuuuguuguuaaucuguucuugggcauaggcugggaaacauccuggcaaaagucaguaccaugaagcagacucauuuucacccaaaccugagagccaggcuucccgauuucaccauaugagaaggaagcauguuuaaaugcauggggcacgcuagucugugauggcauuagaagcccugagcuuuuuuuuuuuuuuuuuuuagcagaguugagaucacagauaaaugagcacagaagccacgaagagcugguauauguucucuaguguucauucucagggaagaauaggaaucuuaauuuguugcuggaauccugguaaauuucuuuuuuuucccccuuaagaucuuucuaaugcauuuccccucaccgcccccagccuccucacacaauuccacacucccuuacaccccaugcccaguaauuuccgaagaagauggcuuugguggaagaccugucuuuauuuugaagauagcauuuaugagccaguuccuucaucugauaauacuucuaugagaguaggaguuaacguguuuaucuuuggaagcauauuuuuaagcugaagcaaucaucuguugacuucacuugaaaguauaguuuuaaaagguguuauuugcauuuuuaaaugauuauuagguaaagugagugagaugaaagaaaaauucauguuucaaaacuaaguaaguccucaaaauagugcugugcaggcugggcgcggugccuuuucccuguaaucccagcacuuugggaggcugaggcggguggaucaccugaggucagaaguucaagaccagccuggccaacauggcgaagccccaucucuacugaaaauacagaaaauuagccgggcguaguggcggaugccuguaaucccagcuacuugggaggcugaggcaagagaauugcuugaaccuaggagguggagguugcagugagccgagauugcgccacugcacuccagccugggcaacaagaaugaaacuuagucucaaaaaaaaauaaaaaaauugaaaaaauaguacugugcacuauauaugaggcccauuauucacgaauauuaaauggugcuucauugacccugaauuaacauuuucccuuccuguaaggaacaggacgaugcuuggguuuguuuuuaaaccuugcugguaacugcaguucuggccuugauugaugccguucuccgugucuguuaaauuaaaagauugaaugaugaucucucggaucucuuuucuaaguuuuuaugguuccaaaggaguaaguuaaauaccuuuguuacccaaauucaguaguguuguguuuuccguacuuauuuuuucuacuucauucugggguaacauagggugcagguggggccuaaccuagauuccaacauuagaaugagaauauuauuuuacuuggcaucauuggcagugucgauuaaaucuuuacuaugcccuugcagccaugaccuuaagcaacaccugacuguguuaagucugugguuucacucaaguguuucuuuuuaauauucuaagaagaauauauuucuaguagaugcauucuugagacagugugaauaauaaaccugggaaaaguauaguuuucugacucugcaguaccuauguuugugugugcacauuugacucauuuuggcaauucuuaccuuaauauuuacuuacaugauuacacacaguacgugcauuuuacuuaccccuuuuuuuuuuaagacggaguaucacucugucgcccaggcuggagugcaguggcacgaucuuggcucacugcaaccuccgccuccuggguucaagcaauucccugccucagccuacugaguagcugggauuacaggugcccaccaccacgcccggcuaauuuuuguauuuuuaguagagaugggguuucaccaucuuggccaggcuggucuugaacuccugaccucaggugauccacccaccucggccucccaaagugcugggauuacaggcauaagccaucacgcucggccgcccauccuuuuaucuaugauggcagugacccuguuuuugcuucugcuagagaacauuguaaagcuguagaggaggggguggaggagacaaacagagacacuuggcucaguuuagccucuucuaagacaagcaguugggcaccucagaaaaauauuuuaguauccuccuaccccagcccucccucauccccagcccccaguaacuuucuuguugcuguauaaaugccuuucuguuuagacuuaucccugagcuuuggcaaugaggccugauuuucuuuuggaguucuguaccagcgucuagcacucagagcaccuuacacaugugucugaugcaacugaguggcuuccacuguuaucacuuacuggcaacaacuuguugaagcccucauuugcuaaagucucauugugaggauuuaauaacugcucuugagcaucugcaucaaccucauuaagccaaccuguuguacaaacuguaaugguguagauuugaagcuuaucggugucaugacuaagacagucauuacguagucaggccacggcaucuucaaggcacuauuggugcagcugguaagucacuucucuccaugacccuacaaauaguuuuccucaucuuauggaauuauaaaugugccagaauuuccuaauagguuugccaucucccugucagucuccucagugagcugugaagugcccauuauaggaagcacacgugaaagacagcagccccucuugaucugugggcuucaggcaggguguuguguuggucagagaaaaggggcuuuauguuuuguucacauagcaaaggacuuggggcugagggagcgagcugauucaucugauggagaaucauuucuuucuuagaggcccugaucucacagcacccugagcauccuugcagaaagcacucauuugcugcugcaaaaauauauugcaaaaagguugcccagggcuuguuugccaccaaacaaguucuggcucuggcuuucuucccaccaaagaaauaacaggcauuuccauuuuaaacucugauguucucccuaagaucagggacaagacaaggaugucuuuucucaccacuuuucaacaguguaccagagauucuagacagugaacuuagguaagaaaaugaaauaaaagccauucagacuggaaagaaaaaugaaagauauguauauugacaaauauaugaucuuguauuuggaaaaccucaagaaauacacacacacuuaaaaaagaaaccuacuagaacuaauaaauuauguaagauugcaggauacaagaucaauauguaaaaaucaacuguauuuuuauacaacagaaauggacaauuuaaaaugaaauuaagaaagcaauucuauuuacaauagcaucaaaaagaaucaaauacuuaggaauaaauuuaacccaagacuugcacugaaaacugcaaaccuugcuguaggacuuuaaaaacuaccuaaauaaauggaaaaauauccguggaucagaagacuuaauauuauuaagauagcaguacuccccaaacugacauguagauuccauacaaucccuaucaaaauuucaauggugguuuuugcagaaauggaaaagcugauccuaaauuucacauggaauuggagggaaucuugaauaaccaaagccaucuagaaaaggaacaaaauuagagaauuacuaguuuccuauuucaaaaguuccuaaaaagcuagaguaauccaaacagugugguccuggugaaagguuaaacauauagaucaauggaauagaauuaagagucuagaaguaaacucguaagcccauagucagcugauguuuugacaagggugcaaagacaauucagucggaaaagaauagucaauucaacaggugaugcugggacaacuggauacucucaugcaaauggaugaaguuggaccccuaccucacaccauauacacaaauuaacucaaaaugguucuguguccuaaauaugagagcuaaaaugguaaaacucuuagaaaggaaaggacuaagucuccaugaccuugaauuugccaauaaacuuuuagauaugaaaccaaauaugcaagcaacagaagaaaaauggauaaauuaucauucaucaaaauuaaaaucuuuugugcuucaaaagaugcuaucaagcaagugaaaauacaacucacaaaauauuugaaauuauauaucugauuagggccuaguaucuagaauauauaaagaagucuuacacagccaggcacgguggcucaugccuguuaucccaacacguuuggaggcugauacagguggauugcuugaggccagggauuugagaccugccuggacaacauggugaaaccccaccucuaccaaaaauaugaaaauuagccagccuuauaaccuagucucaaaaauaaacaaagaaaugaaaauuuaaaaaauuaaagaagucuuauaacuuagcaacaaaaagacagcccaaauaaaaaaugggugaaagacauagacuuaaacuucuccagagaagauauaaaaauggccaagaagaacaugaaaagauacucagcaucauuauucaccagagaaauucauaucaaaaccagucaccaaaagguagaaacagcuuaaaugcccaucaacugaugaaaagacgaacaaaacaucauguaucaauacaauggaauauuaauuugaaggaauuaaguauuauuaacuaagaaggaauaaaguauuaugugccacaacguggaugaaccuugaaaacauguuaaguaaaagaaaccauacacaaaaugccauauauauaguaagauuccauaugcugaaauauccaggguaggcagauucauggagacagaaaguagacuaguaguugccaguuacuggguauaugagaaaugggaaauaguugcuucauuuugguauaggcuucauuuugagguaaugaaaaugcucccaaauuaaauaguggcuacgguugcacaauucugugaauacacuaaaaacuacugaauuguacacuuuauagggugaauuucauuauauaugaauauauaucuugaagcuguuaccaagagaaggaggcaguuuagacagauuagugaguuaucaacuucauuauaaaauaaaauucauguacauuguuccuuaaauaaguaaaucuauauaccacauuuucugaagcagaacaguccaucuucaucuguuuaaaggccagccaaguuuuucuuuguagauaagcaguuauaaaaaauauucaagguucuccuuuugggcuugagcaucacagugccuuuuucugccaucuguccacuuguucugucacuccugaaaucuugaugcugugcaaaugcucagaacagcuccuguggccucaggaguuuguugcauguuucccauucccuaaagcaugcugcugucaaggacauucagugucuucuucauggcaguucugcuggugagaaguucuagguauuguguuuuguuuuguuuuguuuuuuuuuaagauagauucgcucucuguugccugggcuggaaugcagucuuacaauuacagcucauugcagccuugaugucccaggcucaagcgauccucccaucucaucuucccaaguagccaggaccacaggaguguaccaccacaccuggcuaauuuuuuuauuuuuuguagaggcagcgucuugauaugucacccaggcugguuuugaacuccugggcucaagugauccucccgccuuggcuuccuaaagugcuagaauuauagguaugagccaccaugcccugccacuaggcaauuuugauucuccaggugcagaacccaauuacucuguccuguaauauuucuccuggcuuucauaacauaguuguacucuaagaagucacauuguguacaacacuuguuaaaaucucugcuuuuuucccagacagauguaccaaguuaaccauuuuaacacauaauguaaagcacauaccacauauuuggccccagucaugaaaguaauuuucagcuuuguccugcugucuuauucucagugacuuuucuggaaaugaaguauuggcgccgugcucugcuguguuuuuuguuuuguuuuguuuuguuuuguuuuguuuuuaaagggccguguugauuugauuuauuuuuuaaucaucagaagccagguagcagcuuguaguauguaaaguauguccuugugcccuaagcugaaggagcagagacccacuagcagaaaugagagaaucaggccuuggagcuuugaggucucuucaaaucuggucuucugguaacuaaaaauuucucgucacucagcauuucugaacuucagcaggugggcaauaacuaauacuuaaaaauauguccacaaguacugcaggaucguggcugucuucuccauuguuaaaguuuaaauuauauucauauauaguaugaauguauuccucugcauucacauuuuuuauaauuaauuauccaaguauagaaugaaucauaucuuuuuguuagccagauuacugggauaaacagaucccaaccuuccccucuuuaccaaauaaaagagcuuccuauagaauuuccuagguaaaagacaggcaucuucucuaaaaaacagugaugaauucaucuaacuguguaguguuuaguuuucuuuaaguaaaaaguuaaaugaggaauugagugauuuuucauaugcagauuuuauuucuugaugauugugucuggccucguggagggacggagugacuuuagguggaauaacuggaucuguuugcucuugagaagcaggcgcaaguccacgaaggaaaggcagggagacagauggcuggcuauuguguuacaaccaucaucugcugggcccugagcaaauauuaagugaauaauauauauguaauuggugugaaaguacaguugcaacauuucuaauaugguuuggaggauggcuacuucuugaacauuuguguuuuauagaaugcuauguugaaauguuuuuguuuuuaggguuaaaccauuuuaaacugcuuuaaagugaacauuuucccccauuuugacaccacugugcaauauuuugaauugaaauggccuguaaucgcccuuuuuuauuuuccauaacaacaugagcacuaaauuauagcugugcaauuauguaaacaauggaaaugcuuccagaacgaauccuuccuuuuaaauuuucauuuuguguaauuguuggaagguuuggagccauaauaaacaaaauuauuuuacacauuuaucgcucuaaaggucaauuauaagggaacgaaagaaacaacacuaugcaaaaugaauaaaccaauuucuguugccaucaccauauguuuuucuuaucacuuaugguuuuuccaguuacuguguacauagcauucaauuaaagcgauucauuuaccaggcugaauaugguuuguguuuauagaacugugcuuuggaggagaggaaacaacacgccucuauuugaauuaccugauuuuuugcaagaucagugauaagagacagauguucucaccaguuacuuucucauaaccagaaucuuuugauaagcuacagauucacaauuaucaucuuagugaucuuuucacacucaguguauaguauucacuuggacuuuuaaccagagcaagagaaaaauacuaguuuggugaucuguucacuauauugcaacauuuugcaggaugaauuuuaauuucuuugaacaaaagcuugugaaagaucuuugucuacgugucauauguucaacucucaagaauaaaccucauuuuauuuuagauuccauauaucauugagccuauuguuuaguuugugguuuagucuauuuaacgugugaaaaagaaacuaauucuugcuauaaaacuaacuugaacuucuuuguauuaaguucuagaacuccuuagaaaaaugaauccuagaaaaucuaaaaugauaauuuuccuguuuuucuuucaguauuugccuuguaaaacacuauggcuaauugccguaaagcuuuguuaaggguguugcuugaaagcacuaauuucuagagcuuuugaauuucugggguaaugugcgaucuaagaggcuuguuugugugccaccuuugaaaugucuuaaacuauucuuucuguagaucagcaaaauaauaguucacugaauuauacaaacuacaccuauaaaguaaauuuuacaaaguaaaacucuucagaguccuucucuuuuugaaaaauaauuauuuacuugcuauucuacuuacuucuuuauggcucuuuucauuuuacaaaggcauauguucuuaucuccuaucccauuacauacagcuccguaagggaguaucauuucauuuuacggaagagaagcaugaagcucuggguaugacaugaucugcccacagucacacaaggcuuuggaccuaggccucauggcucaaguucuagaguucuuuucaccacgucagagugcagggccguuucucacuagccaucucaguggaggcagcgcugaauagcauugaaucacacaguagaaaggauggccccuuuccuccucucugcagguccuugugauacuguuagguaggccagcuggaguugagagaaguuauucuuucacaccacccugacauugcauucugugcuuauauucaacaaggagagcugcucucagacccagagucuucaucagaggaugguauuuuuagcaaaaauuuagcagcauugauuacugucauuguauuacuugaguuacuuuuuacuuaugagaaaggauacacauaaauuuuucagaauaauugggccauuauucuaagcgaaguaacucgggaauggaaaaccaaacauuguauguucucacucauaagugggagcuaaguucugaguacgcagaggcauaagaauaauacaguggacuuuggggacuugggggaaaggguggaaggggaugagggauaaaagacuacaaauuggguauagugcuuacugcuugggugaugggugcaucaaaaucucacaaaucaccacuaaagaacuuacucaucugaccaaauagcgccuguuccccaaaaaccuauggaaauaaaaaaauuaaaacaugagucacuuugaaaaaccuguuaggcaaguaauguucacuuuggacagggagauggcaaaaggcaugaggauugcacaugaaugacucaugucugagagcaucauucuuucccauguauauauaaagcccuggaggcugugaggaagguuucagauuuuuauuauauuuuucaaagacuucuguuauagcugugucuuaauguaugguggggauggugaaagaaggauucuacugaguuagaaaugaguggggcauuuuguggaugucccacuauugagaauaugcagcggcucuucuuugaguaccacgugguuauuccuaauuuuaaaauguuaucacaaagauacagucuucgaguuguuccacuucaguguggagaagcaacggaagcaggcauauggccauaauuuggcugacuggucauauaguucccucuuuaacccccccauuuacccucccccagugcugucuuuggcgacuucacacaggcgcugugucuccucagggcgcugucuuacguggguggcaggguaggguaggcuagccaucuguuauuuugcccucucuuuccaaccuucuugcucauaguagcagguuccguugaagugauuggcugagguccagggggugagggagccaugugacuuuaucucagcuacaugccuaucugcugucuuuagcaucaguauagcaacuuagucauauuuuuugaaugccccauuuuacagauuguugccuuuacacauacaaaucuuacaaugcaaaauggauucauuuacaaauugugguauuagcuuguuaaaggauuuaguucauaauucccauaaauuuagccuagaaaagcauuuuuuaauuaaaacucuaaauuccaguggugaaaaggggcuuauuugauucaaguaugugcuaaagauuuuuaaagcccacaagcuucaagguuuaguuccacaucucaacagauggaauuaacacaagcauaacaaaguuaacaucaugguuguuugcauuauuaaucuucaaaugcauggcauucugcuaccuugcuagccagguuugcacgaauccuuucauugcaacauaugucaacagaaaugugcuuccaucugcugccggauagcuugaugccugauauuccgagacaagucccagcacaaugaguaccucugugaguaauuacaggugugugcugaggagccuagggcauuaaucagaggcuuaauuaugaaaaagguggaucuuuuguuccacucuuggauccugaguuuaccacacacuuucuaaacugcagcauccaucugcucggucccuuagaauguuugccuugacugauauggaccuuaaaguguaucaaaggacgugauuaaagcaggcuuaaacauuaaccuggaagaagcaugguucauguuuuuuuuucuuccuuccuuccuuuuucacuuaucuauuuaucuguuuauuucugauguaggaaaaaagucugcugaaaugcuaaaacuuuaaauuaguacuugcuaaacuauuuaccauaugugaacucuacugaauuaagcauuauacaguaauuuuaagaauguaaauaucaagauuuguagaaacuaagacccauguaaagaaaaaaaagucuuaggaaaaaugguuugugaacacauacaaaguuuuuuaggaagauaaguuguuaaaugagguaauuuuuauuaugacagacugaacauguuagaauuuagcauguuacuacugcuuugcucuaaugugauacugauagaauuaaaucaggauuauuuuuaaggauuuuuuagauaaccauacugaaaucuaagaaaagaaacuaggauuuuguguguguguguguguguguguguggagauuuugcuucuuacucuuauauugagacuauaauagguuguauaacuauaagucacguuacuauaguauagucauguaacauuucagucaguggcagaccacauauaugauggugguccuauaagauuauagugcuguguuuuuacugaaccuuuucugugcuagaugugguuugauaugcagacaauuuccauuguguuacaauugccuacacuauucgguauaguaacauguugugcacauuuguauccuggauguguaguaggcaucuaccaucuagguuuguguaagucacucuaugauguucacaagaugaucauagauugccuaacagcacauuucuuagaauguauccucaucauaaagcgacacgacuguacuucaguguguguuuugauuaauguacauggccaacagcugcauaaguuugugguuugugguuuucuuacuaauuccuguuacacacacacacacacaaacacgcuugcacagauggcuucagagauguggccuggccauggauggcaugaaugcuguccagugguggaccccugaucugccacaggcaagaauuagauaucugcuucagaccagagcuggggggugaggggccauccagccaucaaugagaggccauuacacacacaggaacacaagaugucuggggcagaugaugcucuucacacugcacucugugcaaaaggcuacuguugcacuuuguacuugcacugagaucacacauauacucagagccaugcuguuucccugaccuuagcauuucacugauuacaacgucaccuuagcacucugcauauucccauuucugaacacguaaaacuaucugaagagugaaauuuuccaugucuuugccuacuuuaagauauuuuaauguaacugugcuuuaacuguggccaauugaaagcuaaagacaggacauuuguuuuagugauagauauuugaagguuuuaauuacauauuuaccucauuacuccuguagcuuguccaaggagccuaccuuuacacggaagacagaugaaaugucuagucucagagccaugauuuagauuuuggauaauucaucuuacagcuuggggucuccaaucuuaccuuuaaaauggguacaguaauccuuggaguaacucuguuuccaauaucccuuucacugaaaauuuucuguaaucugugcucucuuggauuauuauacaguggucauauguaccacuacaaacacuacuuuggaauuuuguguuugaacauuacgauuguguuuuuucuuaucuucccuuuuaggauaucuuaaauacgaucauaaggcacuguccaccccgcuuuuucucccuggguuuuccuggcuucucaaugcuggugggggacuucaucacggccgcugccaggguccuuagcacagacauuuugacggugaguaugacaaugcucagcaucccagcucccaagaggcuucacaaucgcuaacaagguucagauuucuccacucuuaacagguguugacucauuagugcaaugugaaacugggcucucaggguagauacccuggcagcugaugugugaaauuguaggauaagaugacacacugguuuuggaaaggcguuucaucaaaaggccaaagugugagaaaucauauccucacuaauauuucagcacauuuacacagucagaagcaggacuugucucuuagaauauuauuagcauuuuccaguaaauggugacacagacauaaaugucuaaaauagagaguuuuaaaauguacauuagcaguaaguuuuuuuuuguuuuuaaauuaagucuugguuauuauaagucucauagaaaauauuuucuuaaaauguuagaacaguaaagucuuaacuagaaguaaauauguauucucuuaauaacaugccagaauacuuuggcagaauuuuuguaauaaaaaauuagaaguggacuaaaugaucaguaagggcuacaaaaaaauuauuuuuacucucuacauuuaccucuacuacuaaggcaguaucuuuucuuuucuuuuuuuguuguuguuuuucaagagauagggucccauucauucucugcccaggcugaagcgcacuggugcugucaugccuagcucacuguaaccucaaacuccugagcucaagugauccucccaccucagccuccugaguaguuaggacugcagguacacgccauuaugccuggcugauuuuuaaauuuuuuguagagauuggagucccuccauguugcccagauuggucucaaacuccuagccuuaaaugauccuccugccucagccuccaaaauguuaggauuacaggugugagccacugcacauggccaaagcaauaucuuaaugccuuuuugagagaauacuguuauacauuuaaaguuaaagggccuuuuccauuugugcucuauaagcuguuauauauucagaguuaucuuugccccuucaaaugguauaaauaaaauuagcuuuacuauuugcuaagcauuggugucgaaaucaguguugccauccaacaaccuaaaucuuguuugauaugagauuacuuuuucacuuauuucuucuuugcaggguaaauucaaacuucaagcccuugguuuuaaauuaaauuguuuaaaauacuuccuguagcugguauuucauguuggcgcuuucacacacuaacuuuuucuuauaaagauaaauuagaaaacaaagagaagugaaaagagacaggagcaaaagagaagaaagguaaaagagaagaagaggccaggcaugguggcguauguauagucacagcuauaggagacucaggaagccaaggugggagaaucacuugagaucaggaguuugaguucagccugggcagcauaacaagaccccaucucuuaaaaagaaaaaaaaaaguagaagaagaaaaauguugaauuuguucaacuguggcuuuaucguaaauaauuaugacaacuuuucauacuucauuauuucugaaaaaauuuaggauaaucucaaagaauuuucaaauguauuuuaaccauucacaucaucuuucaaaaaaauuacaagauacaagaagggaaaucauacuucuuuauugaaauacucauuuuuuuaaauuauacuuaaguucugggauacauguguagaacgugcaaguuuguuacauagguauacaugugccauggugguuugcugcacccaucaaccugucaccuacauuagguauuucuccuaaugcuaucccuccccuugccccccacccccugacaggccccaguaugugauauuccccucgcuguguccauauguucucauuguucagcucccacuuaugagugagaauaugcaguguuugguuuucuguuucuguguuagucugcugagaaugaugguuuccagcuucauccauaucccugcaaaggacacgaacuuacucuuuuuuguggcugcacaguauuccaugguauauauaugccacauuuucuuuaucuagucuauuauugaugggcauuuggguugguuccaagucuuugcuaugguaaauagugcugcaauaaacauacaugugcaugugucuuuauagcagcaugauuuauaauccuuuggguauauucccaguaaugaaugggauugcugggucaaaugguauuucuaguucuagauccuugaggaaucgccacccugucuuccacaacgguugaacuaauuuacacucccaccaacaguguaaaagcauuccuauuucuccacauccucuccagcaucuguuguuuccugacuuuuuuuuuuuuuuuugagacagagucuugcucugucacccaguagcugggacuacaggcacccgccaccaugcccagcuauuuuuuuuauguuuuuaguagagauggaguuucaccguguuagccaggauggucucaaucuccugaucucgugauccucuugccugggccucccaaagugcugggauuacaggugugagccaccgugcccggccuauuguuuccugacuuuuuaaugauucuaacuggugugaggugguaucucauugugguuuugauuugcauuucucuaaugaccagugaugaugagcuuuuuuucauauguuuguuggccacauaagucuucuuuugagaaguaucuguuuauaaccuucacccacuuucauaugggguuguuuguuuguuuguuuuuucuuuuuuuuaccauauacaguuuuauuuuuuaauuuauuuuuaauuuuauuuuauuuuuauuauuauacuuuaaguucuaggguacaugugcauaaugugcagguuuguuacauauguauacaugugucauguuggugugcugcacccauuaacucgucauuuacauuagauauaucuccuaaugcuaucccuccccgcuccccccgccccacgacaggccguggugugugauguuccccuuccuguguccaaguguucucauuguucaguucucaccuaugagugagaacaugcaguguuugguuuuuuguccuugcgauaguuugcugagaaugaugguuuccagcuucauccauguuccuacaaaggacaugaacucauccuuuuuuauggcugcauaguauuccaugguguauaugugccacauuuucuuaauccagucugucauugauaggcauuuggguugguuccaagucuuugcuauugugaauagugccgcuauaaacacacgugugcaugugucuuuauagcagcaugauuuauaauccuuuggguauauacccagugguuuuuucuuauaaauuuguuuaaguuccugccgggcuugguagcucacgccuguaaucccgacacuuuaggaggccggggcagacagaucaucaggucaagagaucgagaccauccugguuagcacagugaaaccccgccucuaauaaaaauaaaaaaaaacuagcugggugugguggcacaugccuguagucccagcuacucaggaggcugaggcaggagaaucgcuugaaccugggaggcggagauugcagcaagucaagaucgcaccacugcacucuagccugggugacagagcaugacuccgucuaaaaaaaaaaaaugguuuaaguuccuuguagauucuggauauuagcccuuugaugguuagauugcaaaauuuuucucccuuucuguagguugccuguucacuccaaugauaguuucuuuuggugugcagaaacucuuuaguuuaauuagaucccauuugucaauuuuggcuuuuguugccauugcuuuugguguuuaggucaugaaguuuuugcccaugccuauguccugaaugguguugccuagguuuuuuucuaggguuuuuaugguuuuaggucuuauguuuaaaucuuuaauaugucuugaguuaauuuuuguauaagguguaaagaagggguccaguuucaguuuucugcauauggcuagccaguuuucacaucaccauuuacuaaauagggaauccuuuccccauugcuuguuuuugucagauuugucaaagaucagaugguuguugaugugugauguuauuucugaggccucuguuuuguuccauuggucuaugugucuguuuugguaccaguaccaugcuguuuugguuacuauauccuuguaguagaguuugaagucagguaucgugaugccuccagcuuuguucuuuuugcuuaggauugucuuggcuauaugggcucuuuuuugguuccauaugaaauuuaaaguagucuuuucuaauucugugaggaaagucaaugguagcuugacgggaauagcauugaaucuauaaauuacuuugggcaguauggccauuuucaugauauugauucuuccuauccaugagcauggaauguuuuuccauuuguuuguguccucucuuauuuccuugagcagugguuuguaguuacccuugaagagguccuucacaucccuuguaaguuguaucccuagguauuuuauucucuucguagcaguugugaaugggaguucacucacgauuuggcucccugcuugucuauuauugguguauaggaaugcuugugauuuuugcacauugauuuuguauccugagacuuugcugaagugucuuaccagcuuaaagaguuuuugggcugauaagaucagguuuucuaaauauacaaucaugucaucugcaaacagauaauuugacuuccuauuugaauacccuuuauuucuuuaucuugcccgauugcccuggccagaacuuccaauacuauguucauuauuuaccaagagaguuuccuguaaaaauguuggagcccuuccuagagauaauaucacacaugguggucauuuucugucaguguggcuaggugggcuauuaaaguagccuuacagauauacaguuggcuaauaguacaguagccccacuuuauccucaguuucacuuucugauaucaguuaccacagucaguggugguccaaaaauauuaaauggaagauucuagaaaucagagcuuuacauugcaccccauucugaguagcaugaugaaaccuugagcuguccuggcccauccugcccgggacauggaucauugcuuuguccaguggauccacgugguaucugcuacccagccauuagucacuuaguggccauaucuguuauuagguggacuguugugauaucacagugcuuguguucagguaaucuuuauuuuacauaauagccccaaagcacaagaaugucauauuguuauaauuguucuauuucauuauuagcaguuauugcuaaucucuuacucugccuaauuuauaaauuaaaauuuuuucauagguauguauguauugcaaaaaccauaguguauauaggguuugguacuauccacaguuucagucauccacugagggggucuuggaauguauccccuuuaaauaagagggaacugcuauguaugaaaaaugcucaggaucaccagggaaaugcaaauuaagaucacagugagauaauuaccucacaccuguuaggauggcuuucaccaaaaagacaaaagauacguguaggcaaggauguggaggaaagagaacucuuguauacguaaaaaaaaaaaaaaaaaauucuccugacuuuuauuugaauucauuauauauugccuagauugcgauauauaaugcccauuuauuauuccauucccucugugaucaccaauuaccaaaauagugauucuuccuuauuugaggccucugacagaaaaaacuagaaugagauuugacaucacaaccaacacauccccaaagacauagguuaaaaacauauugauaaggaucaauauguauauuaaaacaguauguauaucaaaacauuauguuguauauacuuuaaauauauaaauuuuuauuaauuauacuuuaguaaagcuggaaaaaaagaaucaacacaauagagacuacucaaaucaaagaugguauaaagguaaauguaaaggucaaauucacaugaaguguugccaagaugggaaaauaaauaaugaaagcauaaccagaaccuggaaaaacacaaacuagaaaauguggagggaaggaaguauugaaauauaaacuucaaaaaauucagaaaggaugaaauacaaaaccagcuugcaauaaagaaaaaaguguuauguucuuugaaacuacaguaaaagagacaugagugccuuaucuuuuaagcuuucugacgguaucgaauuugcuuggucuuuagcacauauaucaauguuauguaauguuauauacauuuaacuaucugccugagguaugauaguaggaauaaauguuacagccaugaaucgauuuuuaauucuguuuucaaauauugcacaugaguguguggguuagugaaugguuggguacugggugugcuagucauaccauuuuuccuacacaucuucauccccguguacuacacuuuuggugggaagguaaauugcugcagccauuauggaaaacaguauggagguuucucaaaaaguuaaaaauagaacuaccauaugacccagcaaucccacuucuggguauauauccaaaggaacugaaaucaguauguugaagaaauaucugcacucccauguucagugcagcagcauucacaauagccaggauaugaaagcaacuuaaaugucuauugacagaugaauggauaaaggaaaugugguacauaucuccaguggaguguuauucagccuuuaaaaaaugaaggaaauucugucauuugcaacaacaugaaugaaccauuuuuccaaaugaaagaagccaagcucagaaagauaaauacuguguggugucacuuauauguggaaucuaaaaaaguccaacuccuagaagcagauuguagaauggugguucccaggggcugugguugggguagggggagaugggaugauguuugucaguggaucaaaaguuucaguuaugccgaaugaaugaguucgggagaugucagcauggucacuauaauuaauaauacuauauuauaaacuugaaauuugcuaagagaguagaucucaaguguucacaacucacgcauaaaggaacuauaugaggugauauauuaauucacuuguuugugguaaucauuuuauaauguauuuguguaucaaaacauguuguauauacuuuaaauauacaaauuuuuauuaauuaugcuuuaguaaaguugaaaaaagaaucaacacaaaauuaauaaaguagccuuccaaaauguuuuuuuaaaaagagagagaauaugaaugagaauguguaagaguuacaugaaggaaucacacucugaaugauaguacuuucuuguuuaaacuugagguuaaaauuguagaggaacuggugaaagguguuugggcuggagcacaccugcucagucagaauuuucaguuagcacaagguaauuaccaguuugaaguaccccugcuagguaggacugccccacugaggcagugggggaggaagaugcacagauggcucgcacaagucaccaagagaugaggagaagcuugugcacagcaacauuauuuguaacagccaaagccuagagccaauccaaaugcccaucagcaguagaacaguuaaauuauaguguguacauaagauggauuauuauauacaaugaaaacacaggaucgguuacauaacauaaugagugaaagaagucagacacaaaagaacauauacucuaauuucauuuauuuaauugaaaaaccagacaaaaccaaucugugguguuacagcagaauacgguuacuuugcaggaggggaggcuaucaugggaggggcacaaagaggacuucuguggguugguaaugauauucuuccuguugucugucucuucguccucagggcuccuaccucugucaucacuucucucucucugcacuccacaaagacgcaugcauucaguuccucugaacacaugugaauuguuaucccagacuuuucucuccuaaccucaggacaagcauuucaaaaagucuucuucagaacaguaaucuccccagauacuuugggggaaagggaaggaagaaagccagguucauagucaaauaauuuugggaaauacacuucuucacuuggaaauucacaguguacaauaacauguuaaaggcuuuuguuuaauugugcuuagccaaaugucucugcaacgucuuuuucccgggagucuuugauuuugcccuuucacagucccuguggcccuaguggaacauacuuugggaacgacugcuucugacccuuucagccucccaucucauggacaccuuccucuucccuacucaacuggcucccucacccaccgccagccugccugauuucuacucuccucuguggcccuuagcaguaguuuguuuuagguuuccuaaacauccugagcagaaccaauccuugccucaucccauggaauagcucugcugugcuuuauauugccuuuuauuuaccuguguacuuaugggaaccaagcuagguaaaaaaaugaaggacugggcucccaugcuauccucaguauguugcucuccuagcaggugcuucacugaauuguguguagcuguuauuugccucuccucaccuaccucacauacugcgccucaucucucugagggagaaaagcucucuuugauuuuauagcccaagugcuuaacuguaggcucagucuggaccuggagcuagauggccucaguucaaauccagggugcaucacuuaggagccauaugacacugaaaagcugcuuaacuucuuuggcgucaguuuucucacuggaaaaugaaaacaguagccucuucuucauuggguuggugaggggacuuuaugaagaaaugcuuguacagcacuuagaagagugccuagcacagagugagaacuccuuaaaugugagcuuucauuguuuuauuacauaauaguagacauauagauggacagauaggugaguagauugaugacagaccuguguaguccccuauucuuggcuaaccauaucugcuaguguuggcugaguugaaaucuagugaaaugccuuuuuuuuuuuuuuuuuuuuugagauggagucucacucuguugccuaggcuggagugcaguggcacuguguuggcuaccugcaaccuccaucuccuggguucaagcaaugcuccugccucagccuccugaguagcugggauuacaggugcccaccaccaugccuggcuaauuuuuauaugcuuaguagaaaagagguuucaccauguuggccaggcuggucucgaacuccugacuucaggugauccacccgccucagccucccaaagugcugggauuacaggugugagccaccgcacccagccaugccuuuuaaaauauauaccuaauccuaacacugggcaaauaaaaguaucucacuagauauagugauauaguaucucauuauauuuuuucguaaagcaguucuuggcaguagaugggaaauuugauaguuugucuucucuuucuacucuccgauaguuaccuccaucucuacuucccuaugaauuuuccuuaauuguucuuaacagcaaaaugguauucaguugauauccuuuacccugcuuuguugagaacauuagcaguaaaacaauguaaacagucaugacagagucauuggccuuucuaauucugaaugaaucugcagaucaguuuccacaacacuuguuuacauccaaguacagugauauuuuccauuacuuagaaauuugcuuuuucauuuaggcaaaccucuuuugcuuaaauaugcacuuggaagagaauaacucggccaaguuugguauuuuuuaucuaggaugaagaguaaaacaugucacuuauuuaacguuucuaacuuacaaaaagagaaaugugugugcuccucuuccuuaugugcaggcgccucguucagaggcugucacuguccucggcucucuggucugcuuuccaaauaccuaccaggagauuccuuuacugcagucagugccagaaguaaaugaggccauuacaggaacugaagaugucaagguacauaacgcauuugacuguaucucaaguuuaguacuuuuuauaauucuagauguaugauuaucucuuccauuaguguauauuaaucugcuuauuccugaaguuuugcuguaucuuuuaaauguuucaguaguuguuucuagaagacuauucaugggcuaugcauguguuaaauucagaguauauugcaguuagaccuuauagcuguagcuauagcagguguuuuuuauuauaccuguuuauuggaccuaaggaucauaaucauguagugaauugcccuuuguaauaauuuuauuagcuuaacuaacugcauuagugcaucaaguuaauuuauaagaaauaauggaaauaagcuaaauauucaauccccuuguuggccugauuaaauacugcuaauacuuugagauucuaaauuauuuauuggagaauaaaaguaagcauuuguucucuccucagcugacuuugagguaaacaaaaaugcuuuuagaaucccagaaucaaucaaacuauaaaacauaauuacaguauauaauucaguguacaacauauaauucaauugaaguaaaagaaaaccgagauuuuccuaucuggaagucugauuugcuuuauaccagaagcgcucuacucccgcgggcugaauggccuaaggaggcccuguggagacccccaucuucuaccacccgcucccccgagcccaguguucuucuuccccccaggcucucacucauagaugagcucucugagcucccuggucgaacuucaguagcuccuggcugccuggaacauggucagaacaugugggaaaccaacuaugacacaaaguuuuuauuuuacuuaauuuuguguuuuuagcauuaccucauaaauauuuuacugaagaaugccacagaagaaccaaaugaauaugcaagguaaauguugaauaagagguaaacuauuuuagaauuuuaagauacacauuuauguguaaguaguuaauguuacaaaagaaaacacuuauucuuucacauagcucuuauacagacugaaaagucuaggaagaaugaugccaggaagaugcuuugcaugauuauuuaaaaagaugucauuauuaaguaaaaauuguaaagugcagaagaguauauaguacacuauuuugugugagaaaaagcaagauuacaaauauaaucauguauccucugauauuuucaagaagaaagaaaaugaaaauauaaaccaaauauuuauagaaaugguguauguguaggguagugacucucaaccagugaugaucuuuuacaccaggagacauuuggcagugucuggaaauauucuggcugcuucugccaggcaucugagguugcuagcaaccuaugaucaagauauaugagguuuucugggccacuuacguauugaaaaguuucugccucuccucccaacgugaagaccaaagcugggaaugcuaauggaggggaacaccugucucugauccucaauuucaaaccccauaagaucaccagaagcccagcucagccucuuacucccuccuaggaacgguucauguucugcucccucuguagccucauuccaagacagcagcccaucauucaucacugccuuaccagcuauuugaugauuuuaaguguuuuuucucuuguauuuugucuaauuucuuugguuaucuucaguagauggguuaguucaaauuuccuagucugcuuuuaccagaagcuaaacugauaauaauuugcaaauauuaagcuaacauugcguuuuuggauaaccucaacuugguuuaugugauaccagacuugguuuggcuaauacuuuguucaggaaaguugcuuuuauauugauggccuauaauuuuccuuccccauccuucccuuaucagguuugauuauaauuuuauaaagucucacaaaauaaguacuauuucauuuucuuuaaucagaaagaguuuuuacaaaauuagaguuaauauucuugaguauuuaguagaccuugaugguaaaacuaccuaggucuaauauuuucuugaugagaagauuaaccacugacucauucucuucagugauuuuaggacuauuaagguuuucuucuucuucuacuuuuuuuuuuuugacaguacugauaaaccaaacuuuucuaggaauuugccuguuucaccuaaauuuuaaaauauacugguauaugagcuaugaguuaucucuauuaucuuuuuuuuuuuuugagauggggucuugcucuaucgcccaggcuggagugcaguggcacaaucucggcucacugcaaacuccaccucccggguucacgccauucuccugccucagccucccgaguagcugggacuacaggcgccugccaccaugcccggcuaauuuuuuuguauuuuuaguagagacgggauuucaccguguuagccaggauggucucaaucuccugacuucgugaucugccugccucagccucccaaagugcugggauuacaggcaugagcuacugcgcccagccaucucuauuaucuuuuaucucuuucacuucuaugguuacauccacuuuuuaaucucugacacguuuuguguauccucugauuuuuuaauuagucuugccaaaaauuugucaauuuuauuagucuuuucaaagacuaggcuuuugucuuuguucaacuucucuauuuuauauuugcuuuuauuugccacugucugcucuuuucuauccuuccuuuuacuuucuuuacaaucuuaccuuuaagguuauauauuuaguauauuaauuucuccugcacagauauaaacauuuaagacuauauuuuuauugcuaguuacuacuuugucugaauucuauagguaucuuuuuuuacugaugucuuacuuaauugcauuguggaucaaaaugucuuacagcagucuuugaaauuguugaaauuugcuuaaugacccacuagguagucaguuuuugucaguaucccauauaaaccugaaaaaaaugaaugcccaguucuuuguugggcauagucuucuaauuguguuuauuaaauuuuuuuacuacugggcuucaaauauucuguauccugucugauuuuuuucaucagcuugaucaccuucuggaagaaaaauguuaaaaucuccugcuauuaugguguguuuauguauuucuccuuauauacugucaaauuuugcuuuauauauuuugaggcuaugugauuaguugcguaaaaguuuagaauuguccuauauagugaaucaaauauuuuacauguuuguagugacucuuuauuucuaaggaggauuuuuuuuuaucuuaaagaccacugguuuaguuaaauaauacuuucuauucuuuuuaauuaaccuuuuuauagucuucuuuuagaugucuaugcaaaaacuguauauauccagauuuuguaauuuuaucccaucccaccuuuauuuuuuaacugaagcuuuagauucauuuucguuuguuauaauuacugaucuguuuggauguacuucucuuaucauauguuauacuuuauuuuuaauaggaaagaaagauccuauuaaaaauaagguauaauauuucuuuuauuucuccuuuaucuugccuucauuuccccaucccauuuuucuuucuuucuuucuucuuuuuuuuuuggauuuuuuuuccauucuauuuauuaucucaguuguuuuuaaaucauaggcucccuuuccuucuuuuagagguucuacuagguauuugaacaugcauacuuaccaagccugcagcuagucucucguuacucuuuuccugaauagugcauguuccucagaacauaauucccuaauuuugcuccugccucacugaacuuucuccuuucugucccuuuugcugaccucuccuccucuaccuaaucucugaugaauguuagagugacgcagggcuuagggcugggccuauucucucuaugacuuccugggcacucuuauucugaucagccuuuaaauaccaucuucuugcucauuuauuuaccugccucuucagugaaccccuuuuauauucagacuuauauauuaaacggccuacuugacaucucaacuugaauguuuuaacacaaccauaacugagcccuugagucuccuucugaccccccgagcugacuguuccucagauuucaucucaccacauggccccaccauucccccagguuuucaguucagaaauuuagagaaaacccuugauuucuucuuuuuccuacaccuacugcaucuaaaccaucaagucuuggcaauucuucuuccucucucuuucuuuaguguagaaagccaaauuucuguguaguuaaaaacagaauagaaauguauauggcauggucggcuuucugugaagaauaucugguccuagcacacuguugagaagaauuaacagugaaauuuauuuugaaaguuguauuuaaauauacuuuaaaauaaaauauagcauuuguuuuauguuugugguauagguauugugcauauuaugguaaagaaaacaauuacaaacacaauuuuugacaguuuucucagauuuauguuucuuauucuuccucaaaaauaucuugaaacagucaaauguaauaaccuauuaguuucaacaaaacuaagugauauauaugggcugugacaauuaauagaaaauaugccauuuguuuaauuaaauauuuaaguacuaaaccauuaucaauauuucuauuuguccugaaaauuggccuauugaggguucuuuaucuuuucuuucaagaaaacauucugcuaauagaucuauaauauuugcuauuuuguauaaauagauuuaaaguguuuuguuauuugaaaauacugagaaaguauauuaaguuucaugagaguuuuccucuguuuucuucuuuuuaaaaagaugcauugcuguuugcucccuuggggucuggauaugugaagagcuugcacaguguacaagccacccucaggugaaagaggccaucaaugugauaggaguaacucugaagguauuaccaguuuguggugcugauuggauauuaagccauaucugaggcauuuaacaguuugaguuugaauuagccccaucuuuuuuaucccccaaaugacagagggauugugauucccauugcaugugcugugaggcucccgggaggggcaccaacggaugcuccccugcuggcagcugcagccuggccacgagugucucgagucuuccuggaccaguggccaaauggguuccucugguggcugggaagcuccugucgcaaagaggucaccugucaccuguuggugggggugacaagagaguggggugucgugcucuggccucuucagcaggccugggagaggccuccacaccuuccaguuaggccucucaguguucaccaucuggcugaaucuugggcacuuuaaggacaucuuuguuucuuuguuuuguuaaugagaagaagaacugccauucacugggcacucacacuaggucagaguaauggcgaacucuaaauaauucuguuaaucuucaagacagcucugcaagauagauguugcaauuucuguuuuauaccagaggaaaucaaggcccagagaaauuaggucacaagcccgaggccacacagguauaagugauggaaccagcaauaaaagcagaucugugugguguuaaagacaugcuugaacuuucacaggugcuguuaggcugccucuaagccagagcucaaauccugcuggauccuuuccuagguccugcuuggaaauggugguaauaaauagcauugccauuaucacacuuagggaaccagugagugccuggucucugccaggcgcugugcugaggguuuuguggaaguucuuaguucagggguaagcguccucaguuuacugguggaggaacugaggugcaggaucauuaaggaacuuguucaaggcucuagaaugaccaccucacugagccaaaguucaaccccugaaccauccaccuaacaccagcauucaggcugcugcaugcccuucugugcccccugccacaugcagcuauaauagcaacggcacuuacagcugacgccugggacugucgccaucaggccagcaacagucucuguaccacccuuugugcauuaucugcuucugcccauaggaugaccagccagugcugucucccauccuugauuuggcgucuggccccugcuugaccaaacucaaugccuccuguuccccaaguacacccucugaccacccccauugccucauccuccccuauuucuccuccacaacaccuaguggagguggggguggugguuguauuaugggagcuggaaaaacacuugcugcugaucccugugaugaggaauggaaaaauuauccaaccaaaauaucacagaagagugucccuccagccacagcagggugcugagcccugaccuuuguaggcaaguuuaauccgcagagcugcccugugaggggaaaugucagugccaccuccacuucacagaugagguagaugaacugacuaggaacugaaggagcuugccaaagccaaacccagaacacucuggccacauguguggaguuuuacacaacugaggugugugggauaccuccugacucccaaagccauggagaaauauuuacauauaauuuauuaaagugaaaacaaguuggcuauaaauuauagaucaauguagauuccaauucauuuuuaaauacccuuuuucaauuccaagaucuguuuuugaauuuuuauuuuuucuuaaaucuagauguauauaguuaauguaaggugguucccccaucucuacuccuuccauggaaaaacuaugaauaacucgguguguuagauugaaggagauagacacacacagacacacagagucacgcaucgcauagugauggggauacauucuaagaagagugucgcuaggugauugcauuguugugugaacaucauaaagaauauuacagaaaccuagaugguuucuggacugugugggauggccuguugcucugagguuauaaaccuauacagcacacuacuguacuaaauacuguaggaacugaauauucaauuggaacacaaugguaaguacuugaguaaacaugucuagacauagaagagguacaguaaaaauauggcacuauaagcuuaugggacuaguguuguauauguggugcuuaccaaauguuuccaaaacauauuuaggagguacaugacuguauauauauuucuauauaguauaggaaagagauggaaauugauaacagaguagagggauagauauucuuucugcaacuuuucuauaauuaugggggaaaauauaagacaccagaaaaacaaugcaguuaccacauauugagcucucacucuguccgcuaucccagcacagcauggagauuguccuguugaauccuccccccucuggauagcagcaaaagagaagaggacugaggaaggucaaagaacugacuccagcuugaauugcuaagaaagcagagggaucaggaugcagccaaguuguucugucuuuaaccauuauuaauaacaggaaacucauugacuuaaguccuggucucugaggacaccucccuccccacugcccuccucuccugccucccucuaguuuccguguugcuguggcaacuggguuguuuuaccuaaggacauagcacauaaaucgaagaaaugaggacugggagggaaagaguugcuacaaggaacgaggagaacaaccaccacuaugagaacaggggacucuaggaggcuuuggggcucugccaggagggagagauggagaaagaggaggcagugggggccuuggccccacccccagcccagccucagccugcuucauggguagcggagagugcaagcucuggcagggcuuccugcuuuacgggcuccacauaaagccagcaccaccccucuuguaagaacccuucagaaaugcccugcaagggugaccuaggugcacccaugaaugugcagagcauuccacucagcaagguguugguuggcugguuuguuuauggugggguagcagauggauggcaggcauggggugguugggggaggugguucuaagccacagccauacucaccaacucuugugaacugcccagcccugcuccuucucccaccucgucuucugagacaugacugacuuuccuccuucuccuuaccccacuguuucuggcuuugaguccugccagcuguacuuccugaaugcccauugaauacccaucguccgucccacccacugcccaaguccaucccucacacacucacccugccaauacucagccuccugaucagagucaccaguccuagacuggcccccacagauuacuguucauaccaccgucagagggaucuguccaugcacaggcugaccugugcagcccacaggcuggagcgcucagcauggcacucuguugguguucuaugacuauaugcuggagaagugagagagcaaaugaauggcuuauuucaucuccaccauuccccaccuccuucauuacaugucaguaacaccacccugccugcagcccccuguauccgaccgaccuuuccuaccuuggugccugggccuugccacccauaccuggaaggagaccccacauccccccugcauucuccaggcacagcuuagcucuccucucccuccacgaugccuucucucugccuguuuucccccaagccucaugucccacuccugucugcccauagcuuuugugucuugucugugggcucucguaauuuucccuugucuguuuccagcuucuugaguucagagcuuugccagccuuaucuuuccaccuggugacucugccacuguggugcaucagcaacacacacagugcccacucauguucucccacucucucagaguuucaucuucaccuuaggcacaccacgcacauccuuaagggggccaugcuaggcauuaaagauacaguggugaacaauauaugcaggaaaauaacaaacaaaaaggucagcgcugauagccuguaaugcugugaaggagaucuaauaggggaauaggaugaagcugaagagcugagggggugggccaccacccagcucuuggggguguggggggagggcggugugguggccucagggaggagaugacauuuugugccacaauuugaaagguauaacaaugcaagccacaugcagaccuggggauuaaguguuccaagcaaaguugggaaggagcaggugcaaaggccauggggcagaagcaagccagaguguuugagagauggaacaaggucaguggaaauugggucaucugggaugugaggucucuguggccagagaaggcugugaagagccccugagugcaacgacuacaacccuggguuuagcuagugccucucagguagggguagucaguaacuguuuauucuguagaauuaaaaaccuuucccuuaucuucuuccuuauucuguacauuugucacuggggcacuaaaaguugaugauggucugcuucauguggcuuagagugaggugucccuagacuagggucagcgacgaaccuuuccugcuauagauaaugagauauggauaaugguguagccccauguucuggccagggagggaagcagagggugcccuugucccuucugugcucucccagcaugaaaaaguaagaccuugaaggugcugcccuuagacaugcugccucgcaaucaauggaagcauccagcccuuguuggugacuugagaugcacgccagccucaggaaacauacucaaaauaauugaguauaccauaauucauuaguuaucuucuccuacacucuaauuuuacacauucuuaguauguuauacauguaggucaaguuuuauuucauaggauagaaagccauuugaucaaucccuguuucuccauguguaaaaugaaaauaacaucuaccuugcagagcugucagugaagauuuaucagugagagaaugaguaaaauccuuguaaaagguucaguguauggggguacauuuuaauuuucucuaguugucaaaaauaugauuuaugugagcugaauaagaaauuugaauuaugguuuuaauuuccaaaugaguaaaugaaagcuccuuguuccuguagaacguuauguaaauuaacacagugaggcuagagaagagacaguuuuaaaauggugaugugacgaugucuaaacucugugguaauaggacauauuuuucaucaauuugaggcaaaacagauaaauguaaucuauaaggaacugagaagaaauaacuauuuuguccuuaagaacgauacaccuguuaaguuaugugucugcuuugggauucgguuuccuuuuauaguuucccaacaaaaucguggcccagguagcuugcgauguccuucaguugcugguuuccuacugggagaagcuucagauguuugaaaccucucugccucggaaaauggcagaaguaagucuuuuuuucuguaauacuaaaacauaagcauuuccuuuuuacuguauuugauauuuaauuaauuauagauauucaaauaauuguuagagaaccaacuauuaaauugccacaagucacucguuuuaagauuaaguuagacugguucuucucagcugugauuucaggcacuauguaaagaagccagcaguauuccagacagaggcuuauacuuggggaguuugaaaggcaggcacgaccacaacaaagagaccuuuuguagauugggcuucauucaucaagagcaauuuggauggugccaacaaggaguaggcagcugguuaugaugcccuccgugagggguggaggggggcagcuguuguguaaaacagaagucucucccagacuaaagcccuggaccacacuuucugcccuagcaugauuaccggcuguaaugagauugcuaccacgauaaccuuuguggggguaacugguaggaaagaggggcggaaggaauaggaagaaucuucuccacagucauauccugaaggccacuugcauccaagugugcuuugccuguacacaagcaggcagcuucacucccguagguguccaugggauaaggcacuucuacugauuuuuguagcugcacuuuaaaaacaugcccuguucuuauacauccagugguaacucuucgaggaaacuucauuuguccccaugagguauuacaaggagagagaagugauauucauuuauuuucucucagcccuagacagauuucacuggaaagaacacuuuguucucucagagacacguuaaaaggcacaagugauuuuugaccuuaagugaccuagagugaaauggaguuuggacaugggaacauaaagugcucugaaauggaaaguaggguuuuggggugaugauguaauuuaucaucuaaaugggacugcuuuugagaauaaaaggggugcuguuuacaccaggauagcagguggagauguaggguaauuuacaauaaaacuaaaaugggagcauuuucauaauuauuuuuagaaguauuuuuuuacuucacuaugaaaacuguggaaaccaauguucagaauuaugugacugcagagagaaauacucuuuucucugccuucccuccuaauuuuucaaccagaaaaguagaguggaaacuggauguggccccauugucuuucccuaauuuucaagaucaccacacagcuggcccucugcuuuuuaucaccuuucuguggugaguuggcaccaagcuggguuuaguugcaaggccaucgugggacuccuaacauaggcuuacaaaggcuuacaaauauggucuguuugauuggggauuuaucuuuuaugcagauccucguggccacaguugcuuuucuuuuaccaagugcagaguacuccucaguggaaacagacaagaagguagguggcacauuaacuaaguuuuuccuauaguuuuuuuauuuuaauguaagguaaaaugauaaauaauguuacaacuagugauauccuuuguaauauccuucucuauuggccuuaacagucuuuuuugugaaaaugcuacuuauuuauuuauuuauuuacuuaccuacuuaucuagcaccugcauguccacugaauacuggguguagggauaauucucuuauuauuacauguagugagguuuaagagacugcagcauaagcuaccgggcauguucuucuuccaguuuauuguguccuugcuacucugccucuuggacuggugcauggcauugcccgugaguguccuucuccaccccguguccacagcaguccuagaggagcagcauucggccagagcccccuugcuggauuauaucuacagggugagucuacaccugggccugggggaauggaguguggguuuauaugacagagaaccaccaaaauaugucuuaugcauguacuuauuugucauugcccuuuugaaaaggauuuaugguggcuuaaacguuuucuuaaaaaguaaauaacuuggcugggcacgguagcucacuccuguaaucccagcacuuugggaggccgaggcgggcagaucacaaggucaggagauugagaccauccuggcuaacauggugaaaccccaucucuacuaaaaguacaaaaaauuagccgggcgugguggcgggugccuguaggcccagcuaccccggaggcugaggcaggagaauggcgugaaccugggaggcagaguuugcagugagccgagaucucgccacugcacuccaaccugggcaacagagcgagacuccauccccccccaaaaaaguaaauaacuuaaggacugaaagcagaacagauguaaagaagcagugguuaguuaccaaguuaaagaugcaugcauuuuacaugacuaucaucuuuaaucuuuaaacaacugcaguuuugucagaauucuucaauuuucauggaacauguucuaugucuacuuaaagaacuguucauauuauagggauaucuacauuaauuuuuucccuagggcaaguagcuucuuuuuaaaagauuaauuuauuuuuguugauacauauuagauguacauauuuucaggguacauuugauaauuuaauacauucacguaaucaaaucaggguaauuggguugucugucuuaaauguuuaucuuuucuuuaugcuagggacacuggaauuauucucuucuagcuauuuugaaaucuacaguugauuaauguuaacuacagccacccuacuaaucuauagaacaccaggucuuauuucuuuuaucuauuuguauacagcauuaguuugacaaaaucuguuuaucaaaggaagaaaaagguuuaauggucuuaauaaucguuuugccucaaaaaaaucuuaagaaauaaauuaaggaacuaugucacaucaaaguaauuagcgucaucauuuuuauaacauuuaaaauauucuuaguuaaccccccaucccuucccucuacacacauacacacugaugacuagguguggcauuugcucuggauugcuuauaauauccuucuguaauuugucuuaacagugucucucaaaccuugguuguuuguuuagcauuugcauguccacugaauaauuacugcuauggagggaaaauucugugguuuauucuuuuaguaagaaaccuuuaauaauaaaaaagaguccaagucacagacugauuacuuuguugccuuauuuuuaaaaguauuacuuuaaaaaaaaaacaccuaauugugguugaaauucuacuaaaaaguauuuguguauucuuaaaugguuucuucaguagucaaagauuuuaauaacuauauuaggauucauuagauacuucuguuguuuuugugguuuauaaaccuguacagagcuugguuugggccaacggcauuagccacaaucacuuuuguaaaucucuuuucugaguucuuucuuuucuuaaagauuucucuuaaaauugcuuuaccacuguaaaagucaccucauaguaaaaauucauaaauuuacuaaauaacuguuuguuuuguauuuuaaaaguaaacuuuuuauugaaguauaauaugcuuccagaaaacugcaucagucuguaagugaaagccuggugaauuuuuaccaagugagcaugcuuguaaaaucagaguccagaucaggaaacagaacauuccuggcauccuggaagccuucucugugccuccccauagccacuggucccauacccauguccagggauagccgcuauccuguguaacagagcagaguaguuuugccuguuuugaacucuauacaagagucauacaguauauccucuuuugucugacaucuuuugcucaacauuauuuuugagugauuuauucaaaccguugugaauauuugcagauuuuucacucuuggugauauauaguauuacauagaauaaaccacaauguauuuauacauuuuaccguucauagacauuuggauaguuuagaguuuuggaccaauaaaaugugaauauucaagguuuuuuuuuuuuuuuuguacauauacguaugcauuucuguuggguguauaccuaggagugaaguugcuggaauacauguauucugccuuauuggugaacaccaaauaauuuuccaaaguaguugugcuaguuuacacauaacgugugguuuuaaugugcauuuccuacauuuauugcauuuuggcuacuagaaauuaauucucucagugauugcagcuuaauuuuuaaauuaauaagagagcugccauaaggauuuuccuauacugcauuuuuugcuaggaagaggacauagucaagugguugcccugacaacuguaauucuugguacuuauuuacaaaggguaccugaccacaaggccucuugccaugucagcaaaccaaagcuagucaucuaaaagugaauuuacuuuacauaaauauauuuaacccaaugguguuuucuuauuuucucaaguauuaccuugauucuuauaaaaaucaguguuuggaguugaugaucuugaauuuaugauuaaaaagggaaaucuguuacaauuauuaccucauuuaugcauuuuggcauauucaagaugauuuguguuugcauggcuuguauguguacaaaggcucaaaugaguagauagaucuucaaucaacugcaauuuguaaacaaccagugaacuuucaggaacuaaucuugugaaaauaagaauaauuuaaaaauuguauuaaguuagcccuuacaauuuauggcgucaugaguuauacuaauuuaaacucauuacugguuaugacgugcacuaauggucucugcuuguugugcucauuccacccuccaccgugauuggccugucccaccacuacccuucauccccagauuaguuccuucuaccugugccgccuuugguggacaggagggggacuuagguaugugcaaucacacagaaugugaauaaguacuuuuuaacuuuuacuuuccuuuugccuugagaacauauuucuuggcauugauaugaaaggagcaaaauaaauuugcuaauagcaagaagauauuuaagaguggucauuccauuuccagcuaggaccaagcaggaguccuagcugccaagugcugcaguaguuugacagauugucaggggacacgcggugaguagcauccguggugcacauggccucuguuuucacagguuuugcacugcuguguguguggcucaagcacguacacccaacagagucacuacauacugacccuggcugacuugucauccacggauuaugaccccuuccugccacuggcaaaugugaagagcucugagccaguccaguaucauucaucagcagaauuggguaaccugcugacuguugaagagggugaguauucuuucagguaugaaaucuugugggaaggaaaaggaaggauuuagccuuuagccaugcuugcucuauuuuuuuuuaaucuaguuguugaaguugaaauccuaguuccuggaguccucugugauggcaaauucugccuuccuuguuucuucuuuuuuucuccucuguuuucccauuuuaguaguucaaaugguuuuuguauuauugaagacagguaugucucaaauccauggaacucacaaaaaaggcucauuuucuauccucaaggagcuuuacaucuaauggaaaacacacagugaaguccagaaggacucacuguggacugguagcaccaugagggcuuuccaugaagaaggacuuaagccagacuuagcagggugggcagguguugaaaggagcucauagauuguuccaaguuaggagagcaucauaaaaagagauggaaauuuacuugcuacaguuuuagauuugcucugcucauagcagagaguccauuucagagcauauagggauugucaggacuuagagccugcuguauuucuuacuuaagcaccccucuccccagaaugauaagagcccagcuuugggccuuggaaugggaguagaauguggguauacugucuauacauaugauaaaauugcauagaaccaaacacacacacacacacaaaugcaugcauguaaaacuggugaacacugaguaauauagauggauuauuaucaaugucaacuuccugacugugauauuguccuauagguaugcaagauguuacccugagaugaaagguauuugaggucucucuguauuacugcuuacaacugcaugugaaucuucaguugucucaacacuaaaaauuagaagaaggccaagcaucauggcucccaccuguaaucccgucacuuugggaggccaaggcgagcagaucacuugagcacaggaccacuugagucugugaggucaaggcugcugugaucagcgccacugcacucuagcuugagcgacagagugagacucuaucuuaaaaaaaaaaaaauuaaagagauguaggugugaaguguuagaucauccaugaaaauuguauggacuucacaaguuaaaaaccuaggcccaagacuagaaccuugugggcagaaacauccuuaaggacagcagagugagggaaugucaccaggaaagcaaagucagggaaguggaaagaggaccaagaaagagucauuucuagcaagucaaggaagaaagcaaauaagaaguugagaaaggucagcagugcuaguugcuucagaaagcuuagggaaggugagaaugaaacaggagcuguuauauuucccaacuagguguuuggugguagguuuugccagagcacuuucaccagagugguggguccagccagauaacaugagcaggugaccugugcagugacagucagaucccugagucagacuccuuuugugaggcccuuaguggaaggaggaaggacacagcaggcaguggcugggugagggaggacaaagguccagggguaugcuugcagcacuacagagucuggagcaagguucaagcugacaugaaggggaaggugagaugaggaugaaaaagacaggacugggggugacagucaugagcaagggcuuaaaaucuagcaguccugauuuuagcugcauuuuguagaugagcaaacugagguuaagggauauucccagggguguguacaagucagaaguaagggagguggaauuugaaccuaagauuuaaugaccaaguuccuaaaaugcauuauuuacucugaaaguuuugacguggaguagacuuaacacucuuguuuugaguuguguuggugguggaugguacaugguucauuuucauguuguuuucuugauuuguucuccauuuauuuaaucauuuaauuguuuauuucuggagcuccacugucaacugcaaugucugcuuuacuuuuucccccacaaugauaaauuauuuuuauuaaguaauugaaacaacucuuaaucuauuucguuguucccuacuguaaguucauaugucuuauaauaaaauuaacuuguuuuuuccuaaagucaucaauuuauacucauccacaugaguauauccccaaaacauggcuaucccuaaaauagguucaccauuuauuaugaguugucacuuaaaaauagcagaagauaaauagguuauugaaaaaggaaaaaccuaaaaauauacauuuaaauucuggcaccauuuuucuuucaguguacaauacucuuugggaaacauucccaagauaguucuaaaguacuaaaaauaauugcuuaaacuucucugacaaaggaguuuuuaaaauucacugacauauuaacuaagcaaauaggcaagaugcuuaaaaacauauuggugugcacguccuugccaagcggauacaucauauagaaagugaaaaggaaaaauaaaggugauagcguggguauuuuagguuaagcaagaaagagcucaaauuugaggguauuuuuuuucacucaguguaaugcuucaucauccauaacaaaacuaucucuggucaggguggccgggcgugguggccgacgccuguaaucccagcacuuugggaggccaaggcagguggaucacgaggucaggagauccagaccauccuggcuaacauggugaaaccuuaucucuacuaaaaauacaaaaaauuagcugggcaugguggcaggugccuguagucccagcuacucaggaggcugaggcaggagaaucacuugaacccgggagacggagguugcaaugagccacgaucgcaccacugcacuccagccuggugacagagcaagacuccaucucggggggaaaaaaauuauuuauguugguuuucaccuuucucugggaucucguugaguagcuuaauaaucaaccuucugaaugcuuuaucugguauuucaaagauuucaucuugguuuggauccauugcuaggaagcuagugugaucuuuucaaccuuguuuuaucauauuaccuguauuuucugguuccuucucauuuguguagacuguuucuucaaauuguucuugaauuuauucuugauuugacuuuuuuuuuuuuuaauuucuuuuuucccccucuucaagauguggcuuuaauguuuauaguuuauuauagccuaauuugauuuugcugcuuuuaggggugaagacucuacaugaguuucuugguuauagagagucuuuguaugcugacuuucucagaugcugauuguaguaguuuuguacucggggugugggcaauuucauugucuccuguggaauuggaauggcaaggaucucuugaagcuuaucucauuuccccguguuaggcacuuuuuuauuuguuuaauuuuuccccaguauuuuauuuacucucuugaugauccaggcuucaggccaguaggggaaguaucccuagauagaaaccaguugcagcuaaagcaggugguuagauacaauacacaauggugggcugaggccccagcuuugauuaauguggcuaggggaucucucaguuagaugcacugaguuuuaucagggugaagauugggaacuaauccaccuccccugucaggccagcaagaaaguuacccaccucccagccucacuccuguccuaauguuucagcuauucacaucagacaggcaccucuuuucaucuguagggaugagggauguugauguuccauauagaaaggaauugugacucugccucuugugcaagccuaaacuuggagagugcuucugugaggaugcagccaccgugaauuguuccaggagggcuaucuguagguacauucaugcugaauucgcaugggagaaguuccaguugugucuauggugguggacaagguggagaacaaggaccccuucuccacgacccuucacaagcaugcaggcugccugccuguugggguagaggugcagacuuucccuguugcacccagcacugcaauugugucugcugcaggagacuuccaaccggcagaaagaugugggacucaagaccugcuguccaaauucuuuugucccaugggguguucccuugauguggugcucucccacuuucccuaggaauaggaguucuugauagccagacuaccgugacugcuauugcucuucugggucuagccacccaguggggcugccacacuccagguugcugcugggaaaugucugcaggugauccggugaugugaccuuucuucaagucucccagcaguggguaccagcaccagcucugauggagguggcaggggagugauguagacucugugagauugcuugguuauagauaugcuuagugugcuggcuuucuugaaugcugguuuuaauuguaguuaacuuuaacuucgacaggcucaggaccucugguggcuagaguauuauaggcaguggugauagcugaggucauucagccauuuucuccuuccugggcaguguuauuccaucuguagaugcuguagugggcugcaucagcuagcuugcagccaugagguggugcuugcaagagagcaccagcugcaguacuagcugugggauuugagcuugcccuaaauugccuaggggaaguaaucugguucugaggcaaugagcagggcuguaaagcucccacaaguuuauguccuuuguguuaagcuaccagggugggugcagggauacauaccaacagguggggauaggguugagcaggucugugcucugacucuccuugaguggggccagccauggcuccuuugagggucagggggugguuuucaggguaauguuccagagauaguauaacugccucugcugcacagaagaguucacaaugggaguggagaguagcaggcagcaguaagccuugcccagcucccaugcaguuggcaaggccggucucacucccucaguguucuacuagcagcaccagguuuagauccaggcagucugcacgcagaacccagaucugccgcaggccauaagcuuucccaccuggcuuucggguagugccccuccugucugcccaugaggcagaugugucugcagugcacuucccugccccccccgccccacucccauugguucuggucaaaggaguuuaucccugcucgagauuauaucacgaaauucaguuaggagcaucuuucacccugcaaccccuuucugagcuaguugacuggcuuccccaagguccccugugagauauauucagguauggcuucccucgguucaugcuggagacugagaaugccugcaaggcauuuccugcugcugcuucuacuuuuauguuucucaucacucccuuaagcaguuccagcucuggguaggguuaaggccuucucccaugaccuggauuuucagauucccucauagggauguguauucugaagguagucucccccgacugacacucugaggauuuauaguuuuuuaccugucucauggaguagacuucagcuuucugcuucuuucaaaggaucuguggauucuugcaguuuuccuguugaguuccuguauugcuccuuggaaaaaaguucacagugugaaucucuacacacuauucuguccuucccagugggagacgcaugcuaacacugccuccaaucugccaucuucuggauuugcuucuauagcccuaugcacuucugucggcagguuuuauauggggcugugcgauuugaccuacaagccaguagaugguguuuauggguaaaagcuggcugugggcaagguggcuagguauauacuugauccuuguuuaccagcagaagcucucuauugccucaggcaauggagugguccauggaaugcacaguggucugagcucacugcuuagcccugggugggcagggggcaaaauggguugagccagacuggacaggcucauuuacagcuccccugguguugggcacaaguagcagugcugagggagaauccagugggcagcgaucaggugcccaguggugugccuagacauggagcugggaaaucuccuuggcuccugguucucugcacaggcagaggggcaccuaaacuccugaucaggagagcggguuugggugcuccagguaccuauaagucugccugggcuuggagugcaaaaggcucugcuauacuacagucucugcacaagaaaggugggguggcucaggcugguaacccagaucagcaggcacugcagcuaccuggagauaugccugggcaugggguggagaggaccccacuucaccauggucucugcacaggaagggcaaguuagcucagucugcugauucagaugagugggugcucugaauucuuggagaucugcuggggcauggaguggaaugggcuccacuguaccauaaucucuacaggaaggguggggcagcucaggccaccaaucugggugaggaagugugccgaauaccuggagauccaucuggauguggaguggagaggguuccccugcaccaggaucucggcagaggagggauggagagacucaggcugcugaacuaggcaagcaggagcucucagugccuggagaccugccuaagcaugaagcagagaggggcucccugcugcaggaucucuacauaaagggugaagcagcucagacuaccaguccgggugagcaggugcuuugaauuccuggagaucugcuugggugcggagcggaaagggcccuguugcaccacaaucuauguccaggaaggguagcauggcucaggcugcucauccaggcaagcagguguucugaaugccuggagaucugccuaagcauggaguggagagggcccuacuauaccaugaugugugcacaggaagguuggggcagcucaggcugccagucuaggaaaggauuuccacuuacugccuggaguccugccugggaauggaacagagagggcccugcugcaccaugaucucaggggagcagccuggugcacucagcaaugacacaugcagacugauucuguguugccaagcuggcccuggcugcaagucucauugcccaggagaaacuuuagcuguagcagcucucuccucccaccccaagccugcaguugagaagagugcaauuccagugccuccugcuggugcgcuuuccacaguucuggcuguggaagucccugccccacuccagagcaagugcuccugucucucagucccagaucuaggaauugccugcagcuuuuucuggugucuuuuccucucagcaccuccaagucucuccccaagauagcucuggggcuugagagaaacaucauucucugccuuggccuggguugcuuggauccccaguggaaggguaaauuacagagagagacuguuucugucucggguacuggggcuucacucacucuuaccagcuggaugccaucacaagggcuguuugccugcauuguccucccugagaucuggaacauccuucacgauuccaguggauucccauuuuccuuccugaauuaaagcucagagaguugaucuuuuugcacuaucuugcuauuuccaaguggcugaggcacacuaaaagccuguaaucuaccauauuggaacugcccccugccccccacccaaaaaaaagguguugaguuuuaaucuucauucaccacugacucuuuauguuucuuuaccgcuguuuacagagaagaagagaagaaguuuggaguugaucccuuugacugcucgaauggugauggcccaccuggugaaccaccuggggcacuacccccucagugggggcccugccauacugcacagccuugucagcgagaaccaugacaaugcccauguggaaggcuccgagcuguccuuugagguguucagaaguccaaaccugcagcuguuuguauuuaaugauagcacccucaucuccuaccuucagacacccacagaaggaccgguagggggaucaccagugggcucucucucugaugugagaguaauugugagggauaucucagggaaguacucuugggaugguaagguuuuauauggaccuuuggaaggcugcuuagcacccaauggaagaaauccuucauuucugauuucgagcuggcaucgugacacauuuggaccucagaaagacucuucucaaguugaggagggggaugauguucuugacaaauuacuugaaaacauuggccauacaaguccugaaugccuuuuaccgucacagcuaaaucuaaaugaaccuucccuaaccccauguggcaugaacuaugaccaagagaaggaaaucauugaggucauuuugcgccaaaaugcucaagaggaugaguauauccagagucauaacuucgauucugcaaugaaagucaccagccaagggcagcccuccccaguggagccccgaggacccuuuuauuucugcagguuauugcuugaugacuugggaaugaauucuugggacagaagguaacaauccaagcuagaccuccaguuauuuuaucauuauuuucauguacuuguucuuuuuaucaguuugugguuggggaagaagaaaagauuggggaagagaggagaagggagauuuuucuuuauuuuaacauuugcagcuuauuuucugcuacuaaauuaaagcuagaaaugaaauuaugcuguacuggugugcagauugaauuccaaacauguuggauauuuuaaaggauaucaaacauuuguguguguguguguguguguguguguguauguguguguguguguaggggggguuguuguuguuguuuguuuuuuguuuuuugagacagagucuugcucuguugcccgggcuggagugcuguggcauggucucggcucacggcaaccuccgccuccuggguucaagcaauucuccugccucauccucccgaguagcugggauuacaggcaccugccaccaugcccggcuuuuuugauguuuuuaguagagacgggguuucaccauguucgccaggcuggucucaaacuacugaccucaugauuuacccuccuuggccucccaaaguguugggauuacaggcgugagcaacugcgccuggcugaguguguguguuuuaauuacugcuuuguccauuauuguuucugcccucaugcaggaagcaaaugaacuacaaaggugaauaagccacagucuaaccuuaggucugaugugggagauagaccuaauacaacucugauaaaggauagaaugacacaggaguucaugaguaaugauuaaauccaaugggaaguacagagcaauggagaagacuuuguggaaaggggaggauuugagcuggacccugauaguggaguggaguuuuuaagaacagagguagggaaaagggauucacagcagagcugacacuggaaacagacacagucacacaggcacaugcauguaagucacauacucaccaaagagccaucugugucacuggguaguaaugggaugcugauggaauuuuuauaccuuugcaugucuuaaggaggauggaguucauucuguagguuucuaucacaaaucuuuugugagugaggugguagaggauggaugauagguauuuuuauuaaauuacugauugaaaagcggcaaaaugguucuguaaucacaugguuuuucuuccauccuuuuuucuuuauaggaagaauuuucaucuauugaagaaaaauucaaaauuauugagagagcugaaaaauuuggacucccgccagugguaugugaaaguauaucaaaccacuuuuuuccuguuugucuuuggguauucuuggauaacagauacaacagcaggaaugaauagacuuacugagacauccaaggguaguucuguaaccuagcaucuggugacauuugcgcaugccauaccguugguguuuuuuacuauaaggaauaaacuuucauguuugauacacuaaaaagaggucaccacucccaccuaaucuguacuuuugauuaucuuucuuuguggcugccaguagaaauuuauucucauuugaucucugcaaccaccuccuuaugaugaagaaaaaguuuaccuagguuuaacagcccgugguugcucauaccauauuaucuaaagccaagugagucugacuucagaauccauguuguguaucaaggcgcuaacauucuguacuuguggcuucauaguguuggaaagguuaaaaccaguguguuguaauuaauaacucucuguuaauaaggcucauucuccaaagcuggccagacucagauccaccccuguucuauacugucucagaagcauuucuaaagaugagcucacaaccaugaaaaguguuugauuuggggaauguguguuuccgaaaucaucuaagucaagaauaaguauaggacuugguacauaacagauguuccaaaguuucgaagagaauaagcugccuccuuaaucuuuaguuuuuuaaaaaacucuaaaaaaaaaaaacaccacuuuuauucccuguaggaauauucuaauauucugucagcucucaaauuaaaaauucagguuguuuuccucaauuuuauuuuucaacucuucacacuauauuuuuucacuacauuuuucuuacuacucauuaacucaaaaauuuucaaaucuguuuugaucuauauguuuuuaaagggugguacaguugcuggcugagaaguaagaaggaagaaaggaaauaacagagcccugcuuuaucuugacaaagucauaucuuagaauuucagaaaauuacuagagcucuuuauuccauucauuaaauccuucauccacugucacguuucucaucuaagucaugagcuucuccugcuugcacuuacagcgaugaguuagagccugcugaaugaacauuuucaccauuguguguguuucaguggcuuugugaugguuuuauuguuuauuuuagaguuuugaucgaaacccaaagugacacaugcuuaaauuuuauuuucaagcaaacucuugguucaugucacuauuauuugcauaucaccuucacaacugugauucuucuuugguguuuugaauucuugaauuggauauaaacccaacuagcaaaguccaguuggaauuuucuuuuaaacacuuggaagauuauauuucagaaagguccuuugguaaugucacuaaggacugaguagauaaaauaauauuaaacuuacucacagcuauguauuguuuccauccuucagaagcauaugguauuaagauggauuuguuuguauugaccauuuugugggaaucagaagggcauaaguuuucuuuucuuuucauuuuuucuuuucuuuucuucacccuucuacuuucccaccugucucccaggucacugagcgccucuuauugcaucauauagcuacauacauguugaagcaugaacuguuuuguguauguuuccaagucuugggaaugugacaggauggcuguuccaaaccugauucccucugcagaaggggacaugagggccuuuuuuccuagguggccuuaaagagugauaaauauuucaguaucaaauaugcagacauuuuuuuaaaaacacaaaauuaaaauauucauuuguaguuuuaccuggauaaaggagccauucucuguccagaagccugcagcuccauugccauuuuaaaugucuuuguuuccugacuuaucaggugagacaguaaaagauuugaauuugaauaauuuuuuaaagucauuagaaaugaaaaaccugaagcugccauuucucaccuugcccuucacuguauucuguuuccugauucuucuugugauuccuuuucucuagaggaacauagaucaacuucucuauggaaauucuguaagggauuuauucugaagaacucagggguucaccacacucucccuccuuccuucaguauuaaauaagcagucauuuggguuccacacucagcuuuuuaagcguaugcugaauuauuccaggcuucuuaguauuaagugaauacuugguuucauguaauugcggucaauuuguugagcguuaaugcacuuuaguugcaugagguacaauugaauuagcucccugggguacuguugcaacgaaauauggcuuugaauagcugaguggcaguccccugccccuugaucaaccuucacuuaaaaccccaacuccuggauuuagugucuucuugacaucaaauggguaucaacuuauuuuauggugaaggguauuuucaagaucuuuuugaagaaacuagaaauaagucugggacucuucagcuaugagaaaucuagacugcccuguauuuuggucagguagcagguaagaaaauaccuugucugucaacuuucauuuagaacauuucuguuuaauucugauaucaauguaucucacugcucuugauguauaguuccuucuuaacauguucuuuggaaaaguugaggcuaucuugcagcuauggucuagauugucagugcuaugaugaauguacauacaaaucacagugggcuucccuguuagauguaaaugccuucuugccacuacauggggagguggauguuaaaaucaugcuuuucuuuggcuuuuucaugugacagcacaaggaaacugagcuauucuggucuauuccuaauaagaaagaacagugcauucuaaugaggaagggaagauuguuaauuucauguauguguguuucugaauuaccugcuccuucaugcauuggugugcuucuuauggaugugaagugcuguugauguugcuaauuaucauuucaaaagcauggcuuuaauaaggccagacacagcuucugcauccuagcaggcucucugugguacuaacauuuuggagaaugugaaauuugaugaauguuuacaacuaaaggucaucuuuccucacacucacauuggucagcccaucauucaggcuuagcucucuugugcucucacauugaguuaaugagggcucaaggacuuaggaacagcugcaauggaaacagcuuagauuuuuaaggagaauaaacugaaacauuguagauaaaccugaggcuguuuuuauguauguaaagucuauaaaacaaagaaaaauuaaaugcugaggaguuuuuacauauguagagagaccuucagauaaaaacugaauaacuauacuucuccacuuuuguugaaagagacagucuuuuaggucauagguuaugguuucuguuauuauccaagugcccaaauuuuuauagcucuuggaauaggcuaguuagauucuacgccauugguguccccugccuguugcucagggcagugaaugguguggcacuuucagggcuuccugcugcaugaggacaaguuuucuaaauuuauuuuaaggacauauuagagauauuggggcugggcauggugcucaacccuauaaagccaacacuuugggaggccaaggcagguggaucaccugagaucaggaguuugagaucagccuggccaacauggcgaaacccugucucuacuaaaaauaauaaaaaaaauuagccaggugugguggugugugguagcaugcaccuguagucccagcuacugggacggcugaggcacgagaaucacuggaacacaggagguggagguugcagugauccaagaucacgccauugcacuccagccugggugacgaagugagacuaucucaaaaaaagauauugugaaaagauuaaaaacauuaaagauuaucuuuaaggauguauuaaagauaacgugaaaaugucuuuuaaaaugaaagcaaccuaaaugaagauuugggccaugacauauuaauauaauggaauguuguuacaaucauuaaaccucuguuguagaagcacaugauauaaaaguguucacacuaaaaaaaugguugaaauggugaauuuuaugauauguauauuuuaccacaauaaaaaaguguucacaaauauuuuaagugaaaaaaucuguuguaaaacagaauguaguagcuucucauaugugcaugcaaaaguguauccuaaaaugguguaacggcuauguucuuugcuuauccguugaaacugcaagugauuuuuauucuucucuuuucuuucuguauuuucuaauucuucuuccaaguauguuuauugcauauaaaccauaggggaagugaauaagcugaguaaaaggagagaacucucuuccuccaguuauuuguaugacuuuuuaauugagaaucaguuaguucugauuauuaaguagagaaauaacucacacagaaggaaaucuuagauaauuuguuaaaauauggaacucaguucuaccaauacaauaucuaaucaaauuacaauguugaaauacuaaacaaauauuaaaaaauuaaauauuaaauuugacagaaaaaauauuucuguauuuaagaacuugacaguuauuccuaugagauuuaucagaauguagugcaaaaaaaggagaaaguuggaaccgcucuggaaguggacaucgaaacuuuaaaaaaaccaaaacucuugggugauugggcuagggaaugaaugauucguaaucaaagcuccguuugaauaagaacaguguuucaucucuaaacuaucaccaaaugcuuggucuaggcccagguauuuugucgcuuuacuccaggguauaauuuguagaaauuuauuauuaaugcauucaaauguaucaccauauaucugcucaguguaacagagacuuaacugaacaccuacuauaugcaaagcaguaugcuagaugugcaaaagagaaaauggcagggcuucuuuuuucaaaguacacaucacuuuugcuugauuugauaccagaguauccaagaucuauguuggaacaagcagaugaaggguuuauauggcuaaaagggguuccacuaaauagcuauccacccugucaggcacccucagaauagucagaguacagaaguugguaaaccccuucaugaagaaaauaccuaaguguguucgcuuggaaggaucuucuuuuucucauaaaaucguggcauauuuuauaguuccaaucacagagccacccaguagccuuaaaguguagaguuaaauauggacagucacauagaucuauucacaauuuauauguauuugaaauacuuuaaaagauauuuuuuuaccaaaaacagagaacuuaccaaauggugugccccagccuucuggucgguguaucuuaugucugaggguauggucucaggaagcagauggccuugcgacaguucccauccccagcuugcuggaugugcuuuuuguuucacuuucugugccuccuuucaaccaccucuacuagggaggugauaauaauacucaucucuuuagcaugguuuugaagaauaaaugagacuaugugucagaccaucucagaacacugacugaccucuagcagguucucaguaaauguaagcucagugguagaagucaugcuggugguauuaauaguagugaaguaaaauuuuacauauaagaauucuaacuccuuuaaauuuaaaaauuuauagccgugagacacacaaaaucgcaguguuuuacauugcugaaggucaagaagacaaguguucaauccucucuaaugaaagaggaagccaagcauaugaagacuuuguugcuggacuuggaugggagguaaugcauuucauucaguagguguuuauugaccagcacuguuuaaagauguguccaaacuagacauuguguaaguuuuuacaugugcuuuugcauucaaauauagcauagauagaguucuggaauugaagaauuuauuggauuugacaucuguuaguugcuugucaguauuuaauacaugaacuuuuguuuuccuuuaacuuuccucuuaauauuuuuucauuugcuuuuuaucagaacugaauagucagaugggcucucccagacauagacaguuuguaguaagagaagacaaaugugggcagagaagcaauggcuuuggccacaguauggagauugaagaagaagucaaugacuugaugggugaaaagaugaagaaagaguuggaugaagucaaaaguugcaaugaaaauauaauauaauagccaugaugguuuagcuaucaaccuauuucccuaagguagauuucaggaugauugauguugaaaaaguuuauuuuuucuuuauuaaaugguacucugacauacagacauauauacauuuauacacacauacacaccuuuccccaaaaaacauaaaccuaaaaaaaaaauuccuagaaucugaaagaauuaggaguaguuaaaauggaaaucaacauaucuaaaauaauuuacuucuuuuuuucuuuuuuuuuugucuuuucuuagacagagucuugcucuuucaccaggcuggagugcagucgcacaaucucggcucacugcaaccuccaccucccggguuccagcaauucuccugccucagccucccaaguagcugggacuacaggcacgcgccgccacacccagcugauuuuuuuuuguauuuuuaguagagaugguguuucaccauguuggccacgauggucuugaucucuuaaccucgugauucaccugccucggccucccaaagugcugggauugcccggccaauuuccuuauuuuuuauuaguuucuugaguaccugugcucugaaaaacucucugggugccuuugagagcucagugcuagcaaggggacuaaggcagggauggaaacaggguaagaguacaucagagucaaaacgacauccuuacuaagaaggcaaguagguuugagucuaacaguuacuguacuuccaguaaaucauuguucucacuaguaaggcuacuucuaauuugucauagaauauaguuguuauuuaauauauuuuuaagccauacauuaucaauuagaguuuugagaguauauguuuacucuauuuggcacagaagagauucuucuauuucuuuuuucauauauguuagaauagguauuuuacugaaagaauacuaguuuaugacaaguuaaaaauuuuggauaaaggcacuaagaagugaacacucaugccguaacuuugaauuaugacucauaaacuuucggcagugguguaaagugguuguucaacccuuuugaaaggcaguuuagcaaggauugcuaaauauuuuuaauauugguaccuuuugacccaacaucuuagaaaaacacuccuuugagugugcuuucuguuuugaaaaagcagaaacccccaaaauccaucaauagggaaccuauguauacacacacauauaugcauauauacacauacauuuauacauacaggugggaaaaaaguuagagauuauauaccaaaaguuugguagugguuuuauucaguugauaugauuguagagcacuuucauuuuuaauguuuuuuauuucuuuaacauuuuaaucuggucuaacuuuguauuacauuuguuuguaaucagaaagaaagauauaaaaacgaaaauaauuuauuuuuuuucugaauucacaguccugcuuagugaaagagcagcucauuuuugauccucacucuuucuucuuugugaccuuugucagguggaucucuccacccacuguggguucauggguggccuucagcgcaauggcagcaccgggcagacggccccuuacuaugcuaccucaacuguggaagugauuuuccauguuuccacucgaaugccgucagacucagaugauucccucaccaaaaagguaaggggucuccucgggcaccauucuuagcugcccugguuuguaggugaggcucuccuaggacagacaaauacaaggguagaacgcacacugagaugguuucucugaacucuacgacccugagauuaagguuuggggaaagaaggcgucuuaaauguuauuacuuuuggaucuucccucccgugaauauuaccugauggaaaaugacauuuuugaucucacagauugucaaagguuacaaaauaugaugacccuguacugguggggcucugggaaagcaggccccucugaggcuugcugcggggcgauuuggcagcaucugucaacauaagugcaggugugcagcugcucagccgccccacuguugccccuuaccuuuuauucuucaacuugccuuguggccaguuuuccuuagaauucaaaggaaaccuuauccaccccugaggaaccucccccagggaacuuggccuuuacuuuccaaccugcaggauguuugccucaggcaacccuguguuaaaagugaggagcgccuuaaaagaagaggcauuuaacucugggaaggaagccucuaaucagaucugcuuccagaugaggagaacgucucagagcaacugugauaugcacucaccuggccugcuagcagguggggaaccuagaauccccaccuuacucucucccuaccacauaaaugcaagggacugagggcagcaccucacgugcugaccaaagcuggccacuggggagucuacuguggugguuauagccaggcuccggugacaggcagaccagggaucagagguauauucaguuauuucaucaaccugugccucaguuuuucaucuauuaagugagauuaaaaacacagccuauguuacaggguuguugagugaaguaaaugagauaauuccuauaaaauugcuuagcacggugccugggaagaugucucugaccaucaucccucauuauugcccauuggucuaauugauucuuuuuuucccccugccccguuagccagaugcuuuauauuggccgauuggccucacuguaccugcuuuauuucuuuauuguacgguuuugcuuuuucaccacugcagccacagaugucuggacuauguacaggcauaccuuguuucauugugcagcacuuuauuacacuucacagguauuacauuuuuuacaaauuggauauuuguggcaacccuuaaucaaacaagucuauuggcaccauuuuucuaacagcagaugcucauuugugucucugucucauuuuguaauuuucacaauauuucuauuauuauuaucauuaucucauauggugaucuguaaucagugaccuuugauguugcuaucguaauuguuuuggggcaccacaaacugcccuuauaagauggcaaacuuaauucauacauguucgguguguucugacugcuccacccaccggccguuccccuauguaucuuccgcuccuugggccuuccuauucccuaagcacaauaguagugaaauuaggccaauuaauaaccccuugauggccucaaaguauucaagugaaaggaaaaguuggaugucucucacuugaaaucaaaagcuaggaaugauuagaaggcauguugaaagcugagauagggcaaaagcuagaccucuuuaaccaaauauuuacccaaguuuugaacauaaaggaaaaguuuuugaaggaaauuaaaagugcuacuccagugaacacaugaaugauaaagaaaacgaaauagccuuauugcugauauggagaaaguuuugguggucugaacagaucaaaccagccacaacauucccuuaagccagagccuaauccagagcaaggcccuacacuguuaaauuuuaugaaggcugagagaggugaggaagcugcagaagaaaaguuugaagcuugccgagguugguucaugaaguuugaggaaagaagcugucuucauaaaaugaaagcacaaggcgaagcauuaagugcucaugcagaagcugcagcuuaucuggaagaucuaacuaagaucacugauggagguggcuacacuaaacaacagauuuucaguguaguaaaaacagccuucuauuggaagaaguuucuaucuaccacuuucauaacuagagaggaaaaguuaauguuugguuucaaagcuucaaaggaacagucugacucucuuguuagggcuaaugcagcuggugacuuuaaguugaagccagugcucauuuaccauuccccaaauucuagggcccuuaaacauuaugcuaaaucuacucuaccugugcucaauaaauggaacaacaaaaccaggaugacagcacgucuguuuagagcauggcuuacugaagauuuaaagccaacuguugagaccugcuacucagaauaaaagauuuauuucagaguauuacugcucauugacaauguaccucaucacucaagagcucugaaggagauguaguguuguuuuucauuccugcuaacacaauauccauauucugcaacccacagaucaaggaguaauuucaacuuucaagucuuacuauuuaagaacuuucauaaggcuauggcugucauagggagugaguucucugauggaucuggcaaagaccauugaaaaccuucuggaauggauucaccauucuagaugccauuaggaacauucgugauucaugggaacagaucaagauaucaagauucacaggaguuuggauagagucccacccucauggaugacuuuaaaagauucaagacuucagugaaggaagucacugcacauuuagcagaaauagcaagagaacuagaauuagaaguggagacugaagauguagcugaauuacugcaaugucaugauaaaauuugacuggaugaaaaguugcuucuuauggauaagcaaagaaaguggguuucuugagaaggaaucuguucucagugaugaugcuaugaacauuguugaaauuacaacaaaagauuuagaauauuccauaaauuuaauugguaaagcagugacaggguuugaaaauauuacuccaauuucaaaagaaguucuacugugggcaaaaugcugucagacaccaucacaugcuacagagaaaucuuucaugaaaggaagagucaaucaauguggcaauuucauuaucuuaccuuaagaaauugccacagccaccccagccuucagcaacugccacccugaucaaucagcaaccaacaacaucaaggcaaaacccuguaccagcaaaaaaagacuacaacucacugaaggcucagauaaucauuagcauuuuuuagcaauaaaauuuuuuuauuaauauacauaugguaagaaauaaugcuauugcacauuuaauagacuauaguaaacauaaguuuuaugcacacugcuuucccagugcacacaaaaguuuauaugauuugcuuuauugcaauaucuguauuugcaauaucuaaaaaaccuauugcggauaugucugaaaccaagccuauaauaucucugaggugugccuguauaugaugggcagcagugcaugugaaacaucagaacucaagucauggcccaauuacagacaacuuccguagugaucaagugucucagauguagaaaguacaauuugcguucaaaaacucagcagccuuucccucuccugccccagcaugcuauaaugaccuccuggggguggcaguacuacagccagaagcgcugaccacgugcugguucccacacgucuuggaggagcugccucaguguuggguuuugauggcugccccuggcuguagagcucucagcaaagggaacucugcccuccaagaauucaccaggaucucagacucuaguguagcuuaccaggauccuaagcugggcucacacaucuuuuuuauuugcaguacauuguaaauuguuucugcuuugcaaaugugucaccauauucuauaauuuucuuaugacugagaauuauuuuguuaaaagauaaaauuuauauauaaaauauuuuuuaaauuauuucuuaaguaaaguaggacuguuuuuucuuuuuugagaaaagacauguuuucuugauaaaaugccaagcuguaaauaauguucuaagacuuggccugguugaaugauucccuacuguaauaaucaaaauucagcugauaccuuuugcagcuguaagguuuagcaucauuagugauaaacucucuuuaucagaugucucacagcuagacuaaaaaucagucacaguaacagcagcccacaguuccuugucuuauucuaacuaaauugucccuaacagcuuaaaaaugagcugcaaaauucuaaagugauucaugcucucuucugcccccaucauggggggacuuuuucaauucugcaauccaguugcaaccccauacugaacucuugauccuucacugcagaaauuuguuagcucuagcuagauuagauuuuucacagcuaaucuaacugcuguagggguuugcagaguggggacagagcugugcuauuggauuuguccaauucauuugacuccaggacuauaauugcacuuaugucuuacaaggcuuuuauagccucaggcuggccagccacauaaaaaacaaauuggcagugauacaguacgagugaaaagggaugaaaggcccacauuaucagucuccaggcagcgcuguucuggcaggaaguuucuugguuaauuuacaaauaaaacuuagauuuuaggaugggcacacugucagcugaacaauggggaugucaggccugacuguuacuuaguaaaaguagcagccgggcccacugaggagcaggaauucuucaaucaaacagacgacuccuucuggagccagcuggcgauguaaugcaauuagucgagaaaggaggucagccuauuagguguguaccaugaccggugucaccaguggcgugcagccuggcagcagcaacagacagaauggcuuaggcaaagggacuuuaaaacucuguuaggaugaaaaguuguggguccgggauugauuucuuaagacuuaaaaucugagcauuuguucugagccugauaaguauccagccauuguggagccuguugugcaguugaaggaguagcuaacauaaacaccggcuccauuccagaaggagacucaucauucuuccccaguuacacaggaaccagaucaacuugacuugugugcacucaccgaacucacugauggguuucuaauuugagggccucuaaucccaguucuucaauacucacaaaaugaugugucaaugauggacucuucuuuaaauugggcaacacuuugagccauccagaguauuccguauguucugacaugguugacaguuugcccagaugaauuuuauuuauuuuaccuaccuguuuucuuauaggcaaaagaaggcauauuuugcccuuugcuccagauuuaucagccgauugcucccauggccuuagcuuuuaguuuugugauuuagcuaauuaaacugugacauauccagaagucugagucacgugccacugaaagcagcuaugagaagaugaauaucauaucauuaccacacaaaaauugcucuuccuuaauuacagaauugccacacugggagaaugggucuguuagugugaaacuaaccucccucgcuguaguucugaguauacagaugcaaguaaaauuaagagauacuuacuuagguuauguaauugaguaacccaauuugaaaugggaaaguaacuacaaaacuucaauaaucacgguauuaccucacagucaauguuuugcaacuaauacuuguggaucaaaaggagcuaucacagauacuagagcaccaacaucgggugguggcagcacguuugagggguguuuaguaggugaguguuuccauucagacauuugugcaagcauuauaccaagggacccagagccacccugaagcuggcugucuuugcagggugagggcugugugaacucuaggacagccccaguucucacaauuacuuucugcaggucucaauuccuccuacaguuccaguuagauacuauucauauuuccccgaaaacauaccuauauuagguucuuggugaugcuggcuaccguguuuucacuucaaaaggacugaauuuuaggaguguauuguaaugucuuugcauguuuuauuaaaaaggaaaaagaaaaaagcuguagcaaauauaggaauggagaaauauaaagagauguucagcacuacuaggaggcccaggguuguauuuuguuuaaaacuauguaagggguuggcuauacauuuugccugcuauucuuuuacuuuuaugugggaaggaggaaggaaaaaaaugauguacuggguaauuuugccauuagaaagucggagaugccauuaaauuguucuggaucaucgugacuugugcucagcacccgcaguugcauuugucccagagcccacauucaaacacaguugaaucgugcacccuucaguauagguacaaugguauaggcacaggucacuuuuuaaauaauuggccuguacagucauucccagaaguaugagagagugaagaauaaacaggcauugcaacagaugagcuuccuuuuguaaccuuauaaacagaaaagaggcuauguuggggucaccucagauuuucuuuuuguggucaaauagucuaaagaaaacuguauuuaugcuaacacguuuuaaauacauaguauuccagaacaccuuuuuaaaaaauacuuuaagacaaaacuaaaaauguuaaauuugacacaucucuauuuuauuaaacugcuucugaauuuagucauuuuuaauguucaucuguuagauaaggaagcaagaaauaauuguucauggugccagagagcauccuucugcaguuccacgugagagaacgagaaucucaaauucccagaagaugucagagggccuuaccagcuuuugugguuucagaacuucaauuuuggccaacauuuuaaucuucauaaucuaguuucuuuuagucacacuuugauucuuugucacuuaaaugauuucgugugcagcuuucuccagcuugagaugguacggucaucgugcaggagauugaucaaggguguucuuacaccugacagagccugggccugaaagaacucucaaggggucuuguuuuggagaucuuucuaguaaggccuccucaaagacgccaggagucugugauuuguuuuuguucuuuacagccucuuuguguauaagaugauaaaacaagugggcuacacuacuaagcaaugacaguaaaguaacuuugggugcaggcuuagguagcuuugaaacaguggaaauggcccugaauuggaagccccagugcaugucccgggcccacucugccacugcuacucaugcauccucggguagguggugccuucaccuuccugagcgcccauuucuuuuuuguacaguaagaugaagaugaugucaucuaccucagagaguuagugggaagauuaaaugagauaguaugugugaacaugucuucuauacaguaagcacuccuuaaaugcuagguaggaguguucuuaucagacuuaagcaguaguuauucauuuccuaagcaaagguaauuuuauacguccuuuucuuaaagguuugucacaaaucuaguuucuuauacauuugguaacaauuguguuguaguggcuuauguucucuuauguucauauucuuauuuucauaauaaccauugaauugagaaucuuauaaagcacaacugcaauguggaauaaaagacacguguuguuaauuguuuagaaacauauucagcaauauaaagcacaggacucugacgcaggaguaaaauuccauuagaaaauaaauucuuacaaaggccucagccccauccagcuguaaugugccugcgaagcuagcaugccuuaucuugguaccaacacauuaagaagacaggcuguguuuuuaugcacuugugcuuuuuaaaauccucacagaagaacaucaauguuguagccuuuuuugguagugaaauuuuuuuggccuuugaguuuuauaauucaauuuguaagccaugaccccucauaaacugcuguuaucacccugauuaauaaacagucaauuugcuguugcagcuucgucacuuggggaaugacgagguccauaucgucuggucugaacacuccagagacuaccgcagggguauuaucccaacugccuuuggagauguuucaaucauuauuuacccaaugaagaaucacauguucuucaucgcgauaacgaagaaaccugagguacguuuucauugcauuguuguacugacucauaaagcauuugccaugugauucauugucauugaaaaucagugauacaaauauguuaaaggggacucucauccaguuguugaaugucuuacauauaucugaauuaugcaugcuuuauaggaauuaaauaugaauugggauuuucaaagaauuuuucaucaugagcacaaaauuguauuauuguauuacuaggccucuuuggaaauuauaaugucaaauuuauuauuuuguaaauguuuuaaguuuucuaaauuuuguacuuuugaaaaauuguaucuugaaauuuugguuauguugauuaauaauaagaguugaaggaaccccauaucacaucuagcauuuuguggagaaccguggguauggaauccagccuugccuggugucgggcacuugccaagccucugacugugcuaauggggucaauccugcagaauugcaggcauguccacgaagaggccgggacucuggagcacggcccacgugaugaguuucaacaauuggagcaccuugcugcagaaucaauucagccaugucaauugguauugaucaugggaagagcuggaacaauccaaugaucugugugcuguguacuaaauuggcugcaguuucgauccuugucauaccuuuagugguauuuuagccaugcuuuauguagcgacuuguuuuuguuuuagaauuacuaauagaagggcguuuuuaaaguucuuaaauuaaacauuagcauauuaagccaucccucaagaggaaugacauuguguuuuucagcuugauaguauguauaaucuucauuuucauuucaaguuguucuccugaaggagcugaaaguuacccuucugaaaacucucuuuuaaagcuuugaaauaauaggcaacagauuuauuguucauauugggauuuaugaccuaaucuaaaggguuaaaguugugaggauuaaaugagcuaauaaauagaaagugcuucaaacagugccugguccagaguaaaagcuacuuaaguguuagcuauuauuauuauuauuguugcuguuguuuuuuguuauuacuacuauggagagagaauacuuaaugaauuccaaguuuaacaugcuuauuauucucagaauagaugcauugugggucaacuccugaauucauaaaagucccauucuggcuguugcaaagccugacauaaagggaacccucuuuucuauugagggaacgcagaugccaaaagucacuucauauuaaauauuugcaucauuuuuuauucugaucuccaugugcgugaaguuuucaguuuuguguaugaaaauggcucuuagugcuaacauuuguauuuguccaugaagagcacuacuuuaaagaauuaaacugaaaauuuuaauauaagagaaccagugaauuuagugucuuauagcuuucaaaaagaggaaauguguuucuuuaauauuuaguauggauuaauuggcuuuauuagcucauuuucaacaugggcuucuaaaaugucauuuaauguccuaaaaaugucaccuuuauuuuuaaguaaaaaacaugcaagccauuuuaauucacuuuauagaaucaaaagugauuuuuuugauuuuuuaaaaagauaguacacuuauaaugcaugaauauaauuauuaacauaccuuguaaacuuucuuauaaaauguuugcacauuuaaugaauuuggcuauaaauucugacaagaugaauugagcaaaucgcuuucuuaauauuuuaauucaaaaagccuaaagggaagaagagaauaauggccaacuggaaauuuaguauuauccuuacauuuaaaguacaaaccauuacaauguaauaaaauuaauccagacauuuccagggcaaguguggcugaccuuuuguucaccaaccacugaccccagggugaaugcaagaggcuugcggagggaaagucuguuuguuuggcuucagucccugguauuuaaauugcauucccuaaucaaaugaaaaggcuguccucucuaucagguuacagaauccauggcaacauuuggccuuuuauauccauaauguuagccuuuuuguuugcaucuaaguagagacaccuggagcaauguuaacauuaaccgauuuagcauuaauagcuucauuauauaagaauuucugaucagauagcuguuacuuuuguuauauugcuucagcuuguauuguugucauuuuuuaucucccugcuuggcaaccaggcaaugauuugcaaauuuuuuuugucuugauuaauuaagcaauauaauuaucaguaaccgugaugcagucuuugcucaacaaagcuucugagagaaaacaaugguaagucuguuaguaugaaugcauuccacgcgucccagaugcaugaggauauuacggacaaugaggggaaaggccgccugugagcgaggacaaagggugccacgcagacucgacacacugcacauaccgccagggacaugcugcgggcucccugggacacagacgccucguuagauuacagcuagucagcagagauuaauucucagccauuugguacaauaauuuacccauuccccagccuuuuaacuagugcuccuuacuguggaagggaaggcuuuguacucaaaagguuuauuuaaccuugccuacuuuuagggaucuccaccaaaauccguauuuuuuucuuagaaauuguaaugacgcagcugcuugaaguuaaggaauauuccuuuugaaggacaggauaugcauguuuccaaaauuguagguagagucaaaggcauucuuuuagcaccuguguauuucaucugaguauaguaugacucuguggucuaaguacauuuauuuuacuguucucugggcagccauacuccucuaagaauaauuuuaauccuuuuuugggagaaaaaaaaaccucaucaguacacaaaagucuugcucauuggguagagucaugcauauucaaauuguacuuucauucacucggccucauuaauagcguauguaauaauguagggcuauuuguaauacaagcuuacaggcagcauugcuuccaaguccuuugaaauuuaacauauuucgcuuuuucauuccauacaccucccuuaaauauacaaauuaugugccuggcagaauccgccuccucuuaauaauacacagcauuugugaaaugguauguugaagaagugugggugugcuugugugaacgcauaaaacccucucaucugagugggccuguucacuucuugagcuuuguauugaacuucuuuuuuucauuuaaaaaaaaaaaaucagugugcuuagcagcaucauuccauuguuaaauuacuuucaaaauaaguccaucuccauaaacauugacacaaucauucuuuggucacagaaaagaaauguguuauuguuagacuuauguuuuuuccagcuuuuauuauuaagucagcagucaaggaaagacuugcauauagagcagaaugugagugauucaagggguuuguuaaaaugccagaguuguucuucagaaaagugauucauagaacuuccacacugcagugaguacccgugcugcuuucccucucuuucaguaucuggaaaguaauauugguguucaaaguguuugccuucagaaauuugcgaagguaaguuuuagugguuugggcauguuuauuuccaggcauaguagugacuggcuggugaccaguugaccagaggguagguguucagaagcagccuugagcaggagcaguugagacaagaggaaguuuuggugaaguguccuccucuucaccucaaccagagugucccuuuuguaaauggaaaauaugcuaauguccucugaacucuacuuacucagcccugguacauacgagcauggagaaaaaaaugauagugauucagugauuugugaaaagcguaggaggggaaguaguaagacaggagaugggacaccagaguuccaguucuaagccuaccacaagaugguaggugucuugggcagaucuuuccguuucuuugaaucuuagcuuccucagcugugaaaugcugguugagaaccaaggcuucucuguaguccuuacagggauucuaaaugccuuuuuuuuuuuggauccucuuguuccuagcugcccguaccuuuccuuaaguuguccugacuauccccagagcgucauggaaguagucgcuggcucucuugaagguucagcagcuauugugagugagugagugugaguguguguguguguguguguguguguguguguguucauguguguucaugcaucccucuucagggugacaucuagcccaggaccuguaccuggagcaggugcccagaaaugcugggaaaaggcuguugugccagaaguuacaagagcauuugcacaugggaggcugagaggagccuaggauuggcacugaguuugaaaggaagucuuuuaagcuuacuaguguggccucacgguauagggagaguguuugacuuugcaacaugguuauguaaauuucuuucuuuucauuuuauaugugcaguuuucuuaaauauuuaucccaaucacagccaacuaaccuguuuaagauuaaaucaugcccuuuaaaaugcucugggaacuucucagggaaaauaaauuguuaaccuuugaauauacaaagaauuauuuauuuagaaaagaucauugaaaauaccaaacaaccagaauguacuaaaauagguuauuaaauggauuacuauguuauguucuguuuggauaauuuauuauuauuguuauuagcauuauuuuuaguaaaggaaugacauugagaacuaugugaaaaggcaucugucauuugcagauguuaaauuaaaaucaaauuucuucucuaauucauugccacuucuaauuagaggaauucccuagauacaggggauuuguauuauuccuuuuguccgguuuuugaaagacugagucacccacgagcaguugcugaagaauacuaaagaacguuuauuuauacaauaagccuugauacagauggaagaaaaucuauagccuacuauuauuagcucuuagcugcuguuuuaucuuucacaacaauuuggcuuuugagaauuucuucucaacugauuuuccucagaaguugacguuguuuccccuuuuuuaaguuggucuuugcauauacaucuucuucuuauuugcuuuaucuucucuccuuuggccagccagagccagccuguguaaaugcauaccaaauggcaaaugguaauguaagaaagcaaggcagcucucauucucugccucugagcuacucaguaggaagggccuuuuggcucaagagacagcacacuccccagaccccuuggcaugcgacugccuagguuccugcacacaggugcacacaaugucagccacucagcccagcaaggaggauggguguccagagcacacagaacuuuucugugaaaaggaaagagcgcucauugccccaaaucagauaauuuaucuuuacaguaguauuuucuaugcuauacuugaaauguauuaguuuguuguuguuggguuuuuugcucuuuuuuuuuuuuucaugaauacuuucauuacaacuccaccucacugauuacuggacugcuuuuaguauaagccauaagaggaaguacacuuauuuuuuuauauagaauauuuuuuaaauaaacucuuugaagugugguguuacuaaagauagaaggaagaaaggguuauucuuucuuauuuucuuauuucuuauuugaaccuggcaacacgaaugaucuuagacuaugaguagauucuuaauuuuccuguuuggaacugaaacgccuguguuuucuaccaguacugucguagagggaaagcucauuauuagucaucacuaguagaacuaacagucuccuccuucuuugcucccauuugaauucucauagguccgacugcuuccucugugcuguagacgcugauaucaaaauagcuuugcccaaucuuugcaguuuuuaaaucuuuauguuuuaauuguggaacauuuucuucaaacccaccaaacaaaacuauggcaguggaagaaggcuacucaggaucccaaggccacucccgucacccuuccccuggccuuucaugcaucuccaugaagcaaaagacagauggucacaagagaucuuauucuagaaaugucgaaaggagcaacagauuugguuaaugcccagcaauuagucccuugggaacaggagugcuucauucagucaagcaggaaacaucuaucaguugaggcugcuucaugccagguacugugucaagggcugggggucccacucuccuggaaucuaaauuuuaguaagggagaaggccaguaaauaaguaaauaaaugguugagcugagacucuuauagcaauggguauuucaaagaaaguaaagcagagugauagaaugggcaggaaggaggcugcuuuaauucagauagggagacaucugguuuccagucaguauguagggagcuugauagucaucacugccauccucacagcaagaaaaagaacgagcugauaaucagcaguuaacugauaaucaaacaguucuuagauucaucagagaauugaaaugaccaggcaaaccccugucccuaaaguuagagagauagacaggcagauacagagaagcacaccuuaucagaacagaagcccaggagcagaaaccucugggaaaccaauaccacaguaggaauacuuaaauuguaauucaccaauugcaggaggcuuagugugggcaaaucugagaguuaaauagagucaaguggggcuggcugacaauccuccacacuuuugugaguucuaccucuaggauaccuaccagguucucacaguaaaaacuggaggaaaauccccucuuuggcagaaaaagggagaaagcagucauuuggaaauacaguugaccuuucagcaacauggguuugaacuguguggguccaccuacacauggauuuuuuucaaccaaacacagauggaaaauauacaguauuugugggagacgaaacccauguaaauggagggcugacuuuugguauuugugggccaauugugggaauuaaguaugcuuggauuuuggcaugcacagggguggggcauugguuuuggaaccagucccccucauauaccuagguaugacuauauacccaaaguauuuuguucuuaacaaagucugcccucaagaaaaacuuuuuuuuuuuuuuuuucgagaccgagucuggcucugucacccaggcuagagugcaguggcacgaucucagcucacugcaaccucugccuccagggcucaagcaauccucgcaccucagccuccugaguagcugggacuaaaggcguaugccaccacgccuggcuaaguuuuguauuuuuuuuuggagaaaugggauuucacuguguggcccaggcuggucucaaacuccugaacucaagugauccacucaccucagccucccaaagugcugauauuacagguaugagcuacugugcccagccaagagaaacuauuuucacacagccugucuggccugggggaacggaaacacuuaauaccaacgccuucuagucuccuaccucaucuaaguuggaauuggaaggagacaagaaaacaaaacugaaaagcacuuuugaaggucacaguccaggggcacaggcucacugaaagacugagacuaaauccuaggacuauagaaugcuuccucuucuccauaucuaacuacgauaucaggagggcuuuuguauaguaacagggaguacagcugaaagaacugcacaucccagaucuuauuuaagaaaaguuauguaaaaaagccuacaaauaacaugggugauaacagcaaggucauucaaagaaauuuuaaccucugacaucuacagcuauagaaaacaagaagcacggccuguuagccaguuaaacauaaaaccccacauuugaggccugauuacuucaguucauuuuacccaauacaucauauccagcuuucaacaaaaaguacaaggcccacuaaaaggcaaaauaaacaauucuaagagacagagcaggcaucaaaaccggacucaaauauggcagagauuuuagaauaaucagauugacaauuuaaaauuacugauuaauaugcuaaggauacuaauggaaaaaguggacaacauauaagaagagauggcuaauguaaguagagagauaggcacuccaagaaauaauuaaaaugaaaugcuagaaaccaaaaacccuaugacagaaacaaagaaugccggaugggcucaugaguaaacugggcauggccaaggagaggaauugugagccuguggaugugucaguagaaaccgugaaacuggaaugcagaggggagaaaagguugaaaaacaucugaacagaacuuccaagaccugugugacaaucacaaaagauguaacaacauguaaugagaauacaaggaagagaaaggagaagaaauauuggaaauugucauggcugagaauuuuucaaaauuaaugacagauccaggaagcaccaggaacaccaagcagaauaaauaucaaaaugucuauaccuagacacauacaaagcacaggaaaccaaaaaagaagagaaaaucuugaaaggagccagagggcuccuaugcuggcaccaguagcugcagaagagcaaggguaauaaauagggcuucucuucagaaacugagcgaucaagaagagaguggcauaauauauuuauuguguugaaaggaaaaaacaaaaacaaaaaacuaccaaccuagaauucuguauccagagaaauuauccuucaaaagugaaggagaaagaccuucucagacaaaaguugagggaaugugugauuaguagaccugccuugccuuuccuucaucauaaaaaaaaaaaaaaauuauagaagucauaaagauggacccacuuaaagaagggaaaagcuuuagagaaggaagaaauauaaguaaaaugaaaucuguuuuuuuuauucuuuuuuugaaacagacugucagucuguuguccaggcuggaauauaguggcaugaucauggcucacugcaaccuggaucuccccaggcucaggugauccuccuaccucggcuuccuggauagcugggacuacaggcacacaccaccaugccuggcuaauuuuguguuuuuucuagagacaggguuuugccaugaugcccaggcuggucuugaacuccugggcucaagugaucugcucacccuggccucccaaagugcugggauuacaggcaugagccaccacacccagcccuuuucuuauucuuaauugaucuaacagauaacaauauguuccagauaguaauagcaacaaguauuucaugcuuauagcauauggaugaauaauaaaugauagcaauguuauaaggauaggagggaggaauugggaauacucucuuauaaggaacuuccacuaucugugaagcaguauaguguuauuugaaaguggauuuggguuaguuauaaauguauuuucauacucagggcaaccaccaauaaaauguuuuuaaaagaauuauaauaugccgagagaggaaaaaaauggacucauauaaaauucucacuuaaaacuagagaaggcagcaaaugaguggaagaccaaaaaagaaaacaauaaggacaaugaauaaaauacaugucagucgucuuaaauauaucaguuaaaagagacugucagagugggugccaaagaagccaagacccaacuauuuauguugucuacaggagacccacuuuaaaugugaagacacagauuaaaaguaaagggguggagaaagauauaccaugcucacacuaaucagagaaagcuggaauaacuauauuaauaucagauggagcuaacaucagagcagggaaaauuaucagggguacaggggacauuacauagcagaaccugcaaggccacagugaggaguuggcccaaaucaugaacuagagcaggguuguccaaucuuuugcaucccaagggccacauuggaaaaagaauuaucuugggccacacauaaaauacacuaacacuaauaauagcuaaugaccuuaaaaaaaauugcaaaaaaaaaaaaaaaucucauaauguuuuaagaaaguuccgaauuuguguugggccacauucaaagucauccagggccgcauguggcccacaggccauggguugcacaagcuuaagcuacagcaaaucgguuagccccucuagccuucaucucuuccuccaugaaguagggauaaagugcuggccucaugggguuguugugagaauuacauacuguacauugagcacugagaucagaaccagguucaguaauuagggaucacagucauugggcucaucaucaaaaaugaaauguuccugggcuuuuaaaccccuugucuaugauucuuuuguuauuuuaucuuaaucuuauaaucaaaaaauaucuauuauguauauuauuuucaucucuaaucacuaagaaucauugacuccaaaggcaucaaaggagaaucacuuacaggcccaauuaagugaugaaccaucuuuaaaauauauucauggagaugcccuauuguucccuaagaggacuuucuuacuauuuggaaaucccuuuccgugucuggcucaggcucugcaaaauagaauauaaaucagucuuuucccaccuucaagaaacuaguccaagcccaaugaaccauuuccugagcagccucuccucagagagugcugcuugcuggugcuccauggaguuccauggaguuauguguuccuggaggguggugcauggccuuccccuucccacaucccacccugaaccauagaacacacaagaagacauuuaggauugaacacauuuuacuuuucauaaaauguuuauaaaauguucagugcauggacuccuugguguuucugguaaauaaugugacuacuauuguuuuucccaacgggaaaauuacugucuuuugguacaauaucuuagcagauuuaucuguugcccacuuugacaucucaagcauaaaugcacaaguacaaacacacccucuuaauucauaaucccuguggaacugugaauuucccagagggggaaacugugucagauccuugaauccuagaucucagaggugaaggaagcauuuuagguugucuguucugaccuuuaugcaggacaccccugauagcgucccuacccuuguguuugugcaccagcaucacuagaguacaagaucagcucaagguccguauagcucucucugaauauccagaaaccacuuuuuuuccccuuuuagccucucauuuuuauccuucauuauuuccugucuggcacuugauucucucauuauucguuagaacuucuugauugucugagauuuacuuaagggaucugguuagaaaugugggaaaaacauguugcuuguaguucuaaugaaaugcccucaagaaguucuguuuccuaagucuguacacaggauuuaggggguugcacaugguuucccugaugcaugaggucagugcuuuguuauuggcagaucaccaagagaagaccugcccugcaguaugagguuccacaggugucguacagauugagccuugauggaugguccugaugccuuagugaugaggaaauuuuaccuguggagcagcuggggccaagcuucucagggcgacuguccuuggccaggcacuuacauggaaagcagcucuggucugcucaacccacuggcaacccuccacuugcccauucucucauguguguagaaacuuuaacaguuucuuuucuuauuggcuucuuaaccuaaaauuauuuuguaauucacuguugcaauauucccuaccaguuacauugaucuguuuuagagauugugaucaugauugcaauuacuauugacuucacaggcccuuucuuuccaucauucuuugaugggcagugguauuucucuccacguauaaaaacauguacucuuuccuaccugacuuuaccauuuugguuucuggccaccuaacuugugaggaacacccaacagaucugcagccuuuccaauucucaccacccaccagaucuuaucuccuacugacacacacagugaauguaccuucagcucagccuuuccauuaaguaaaagaugggaaacuuaccuggugcucuguguugcuuucauuuggaugaccaggacaugauguggguagaugagcaggaguaggcaaguacagcagugcagagucuugagagcaagcugguaauuucugcagggcauuucaucaagucccauaucaucuggcuucccauaccuguucuucagccuuuucucuuaucuguaugcauuuccguacauaccuauuccagagcuuuccauccuucucaaauccagucuaggcuucuaugccugccucacuuccuuuuguggcccuaccucugacuucacuuugcucucaggaaucccucaggagcucugugcaguccuuugccauguucuguccacagucuuucuguuuauuuaucuguaauacuuuaaucauuaacuguaggcacagcauucauacaaaccagcuagcacucagcuaaauuaguaucucuuaaagugcacuuuggggaacccugcgcuagaaaagagagccagacccaccucaucuuuucauuccuauuuuuaccauuugucuggagugcuccgcucuucccaccgugaaucucugccaacacccacugucaugaccacuuccuacaugaagacuuccauggcuucucucagcuagaaaagaacucucuguagcuucagaauauuuuaucugcguccacccuaaagcuuuuuuucccuuuugccuucuugaauacauuguuuuaccucuucugcaaacuaccuacaguucagagccucgacuuguucauaucuguauucccccacagcccuuaacagaacuuugaucaaaugaugcaaauaaacagaugguacaugaaaucucugccccuuuugacacagaaagauucacuguagucuuuagaauuuucagacaaaguuuuagagucuucugaguauucauuuuucccaaaagcuaucuucugguauuuuagagaauguauuuauauuauacagagauaggaauguaggaaaauaaaaauucuguuucucagaaauauaccuuacauuucucuuaagguuuuuacauauaucucaaaauuguuugguuuuuuuuuaccuugccucucauuaggacaguacuauuugcaacacgcuuucgggguugguagggcauuugaaccuuuuagucacucugugaggcccacagggcagacaacacugcccuugugcuccaaauauguauguaguugauaagagcauaaagaauuuauccaagaguacuugauucuggcaccaaguccagcauccuaaaucccaguagacugaaucucuuuaagaguagagagguaucaguuuucacaccuguaugcagaugcuuuuuauauucuguguacacauccuguguucacauuauagguauaugugugaagucaaggagaaauuugaauucuagaccuuuguauuaaguuacccacuucuugcaugauaaaggcagugccaaaaaucuggacacagaaaucacagccauaucauuguuaugaacacaauacuugcaguuuuuuagcagaaugaauaacugaccaaacuggguaaguuaagccacgcacauucuucauuugucauuuucaauguggccugccucucgguaggcccauccauggcaauauuccaauccuggaggcuggagguuaucugugaggaauuggaacagaguucaguuguucauugcccugcuuuggaccaucaagaugucugcauugcauccuugaaagauuaauccccauccccacaaaucaaauggguauuucagaucauuuucuguguccuaaggauucuuuuuugucuuugcuccaacaacugggcacuuccuugugcuggcaugcuggcuaguguugccacguggacuucagcguuaucacuuugcugcaaaaggcucucuuugcuuucacaguaucuugccaagaagagucccuggauaugaagugucuucaucuggacccaaaccugagaaagaaauuaauuugggcugcaccuucuaggugugugccuccccugagcacuguacuucuuuagucaaggaacacaugauaggggcuccacaagcagcuccuaaucugcaggugguaaggaaauccaguuugucagcagucauggaaaaucuuauuaauccccaggcuuuggucaucauguuaggagagggcacuuaugagucacucagaaacuuuaggugguugugaaauauacaugcucagcaggaugaaauacugcuauaagguucugauuaggacugauacuugauguugucuuccauuaaauuuaccauugagcaugggaucaggagugagugcuccaugagaacccuuccgcauccgcuuuguacagcagcagcacuguuuucccuggcaggaccacucacccugucuauccuggagccuccuuuacugccucaguguccaguggucuguggagccuaaaauaccugaccaucaguuuccucuucccacugagaacacuguaucuucuucuaggaaguacuuaaguacuaaaguacuccuuaaguacuaaaacuaaagucagagacuaucaucauagggauaggaaaaaaggacauaccauaccuuaugggucagcauccccaacucaugggguaauauaucccacuuagcuuggugaaugauuuucagcagucaucaaacaggcaggaggcuguguggguaggcccuccuguaacuccacuggucccgugugccuuacucauacuguauuucuuaccacagguugggauauaucuugcuguaaggcaagucccuacccaguucuucuuuggcuuuuuuuagccaauuucauuucuacaaaugucuuagaaucagcuagucaagauacauacaugccaugcauuaaauccauaggucagucuaggaaggaaagucacaacaauauugagucuucuaguccaagaacacaucuaucauuucauuuauuuaaacuaacaucucugaauaaaguuuuguaacuuucuuuauacuuuccuuguuagaucuauuuuauauuuuuaugcuguuguaaauaauauuuccuuuucuaaccauuuguugcugguggagaggaaugcauuuggauuuuuggugaauguauucuguauccauugacuuugauaaacacucuuacuaauucugaccauuugccauagauuauguuggagauucugugaguacaguuauaccaucuaaaaaaaugacaguuuuucuuccuuucuaauucauaguccucuauuugugucuugcauuacuguauuggcaaggaucuccagugcaaauguugguagaugugauguagggggacauuucuuuucuccuucacagucucccacaucaaguucucaauguuucaccauuuagugguugcucuggaauucuguagguauucuagaacagauuaaggaagaucccuucuauuccaggauugcuaagaauuuuuuccuuaacuggauuuuggauuuuauuaaacacuuguuuaaaugucuuuugaggugauuaccugacuuuucucauucaaucuauuaaugugguuguauacagacugauuuuuacugaaaauuguauucuugggauauacccgacuuggucaugauauuguuauuuuugcacauuauggaauuggcuugcugauauuuuguuaggguuuuuguaugcauguucauaagugagauuggccccucauuuugguauuaagauuguacuagccuaauaaaaugaguauauuuucuguuuuccuauacuauggaaguuucuccaaaauaauaguuauuuguucuuucgaagauuuuauuugaauuuuauuauuuugaauaugguuauucgaagauuuuauagaauuugccagugaaggcuucugagcuggcuuuuccuuguuagaauguuuuuuucuacuaugauucaucuacuuuaaagcucauagaauuauagcuuuuauauaucaucuugugucuguguuugcuaaauuguauuuuuuuucucauuuggccauuucaucuaaacuuucaaauuuauaggcauaaagcuacguauauuuucuaaguaucuauaguuggauuccuuuuuguuucuaauauuauuuaguugugcuuuuuuuuucuugauucaccuugccaaagaccugucaauuguauuagacuuuuuucaaagaacgaacuuuuuuuuuucaacuuuuauuuuagauuccaggaguacaugugcagguuuguuaccuggguauauugcaugaugcugagguuugggguaugaaugguccugucacccagguacugagcuuaguacuaacuacccaauaguuaauuuuucgacccuugcuccccucccucccccuucugguaguucccaguuucuguuguugccaucuuuuuauacaauuuuuguuguuaucuuuauguccaugaguacucaauguuuagcucccacuuauaagugagaacaugcgguauuugguuuucuguuccuauguuaauuugcuuaggauaauggccuccagcugcauccauguugcugcaaaggacaugauuuuuuuuuuuucuuuaugguuccuuaaagaacuaacugucgaucuugguucuccuuuuuauuguauguuuguuuucuauuuuuaaaugaugacuuuuaucuuuauuaguucuuuccuucuacuuucuuugaauuuguuugauucuuuugguuuuucaguacuucuugagaugggugccuaucucauuauguugcagucuuuauuucuuucuaauaugagcauuucauucuacacggucccuguaaguacugcuauaagguauaaguuauaauaucuacuagucuuauuuuaucaguuagcuuaacauauugcuaaauuuccauuucaauauuuuguugacccaugaguuauuuagaaguguauuucuuaauuucuaaacauagagguuugugccaauuauccuuuuguuguuguuuguugucaauagcuuuuuaggcacagaauauggauuguaaaauuuccaccccuagaaauuuauugagauuugcuuuauaaccuagaagagaggccagcaaacauuuuuuguaaagggccagauaguaaauauuuuaggccuugggucugucacaacuaaauaacugugucauuauugugcaaaaguagccauagaaaauguguaagugggccgggcacaguggcucaugccuauuaucccagcacugugggaggcugaggugcauggaucacuugaggccaggaagucgagaccagccaggccaacauggugaaaccccgucucuacuaaaaguacaaaaaaauuagcugggcuugguggcacaggccuauagucugagcuacuugggaggcugaggcacuagaauugcuugaaccggggaggcggagguugcugugagccaagauugagccacugcacucuagccuaagcaacagagugagacucugucuccaaaaaaagaaaauguguaaguggauaaguguggcuguguuccauuaaaauuuauuuaugaacugaaauuuagaucucauaauuuucacauaguaaaauacucuuuuaauuuuuuuccaacuguuuacaaaguaaaaagcauucuuagcuugcaggccauacacaaguaggugccagguuggaauuaggcccugcaggcuguauuuguggauccuuggcugaggauauggucacuuuuuaaaaaguauucuguacaugcuugaaaugaauguguuuucugcaguuguuggguagaguauuuuauguuuccauuaugaugaguuuguuaguugucuuguucaaauccucuguauucuugcuguuuucuggaaaacguuuccuuggaaauauauuuaauauugaaaaggacacaaauuguaaguauacaacaugauggauguuuucaaagugaacacacuuguguaauaccaccccagaucaaaauagaggauguugccagccuccuaauucuugcucgugccccaucucaaucacuaauacaaugaagaaguggccacuauucugacuuuugggccuauugauucauuuuacuugguuuugaacuuuuaggaaugaaauuauguaguaugaacuuuuuagugucuguuucuuucacuugucauuauauuuggauuauuuucaugauguuacauguaguugugguuuguucauuuucguuacuguggaauauucuguugggugaauauaacacaaacuuuuaauuuguucuccucuggauggaccuuguggcuauguucuguuuggugacuauauauaacuugccuuuucauuuuugugaugggcagaguuuuagaaauuucuauauaguccaauguauuuucuuuuauuuauuuauuuauuuauuuauuuauuuauuuauuuauuuauuuuaugauuuaugccuuuuguacccuaaaaaauccuugccuauccuaaggucguggcaauuuugucauauuuuuuuucuggaggcuuuaugguuuuagcuuuaauauuucagucuauaacccucucaauuuuugugugugauaugagaugaaggucaagguucacuuuuccauauggcucuccaguuguuccagugucuuuauugaaacaggcuuuuuucuuccaccaaacugauaugcugccuuuauugcaaaucaauuaccauguagguauggcucuauucuuggacucuguauuguguuuuauugaaauauuuguuuauccugguaccacuauaaugauuucuuaauuauuauauuuuuauagugugccaugaaauuagguaauauaagucuucuuauuaucaucuugacuaauuuaugucuuuucauuuccuuaugaacuuagaaguauucgguacauguauauuuuuuaaaggcuugccagaauuuugauuggguuuuguugaaucuauagcuuaauguuagcagaauugacaucuuaacaauauugaaacuuccaguccaugaacauuguacaucuuuccauuuauuuagcuugucuuuaauuuaucucaucacuguuugguaguuuucaauauagaugucuugcacauucuuuuaucaaauucauucuguuuugaugcaguuauaaacaacauuuuuacaugucuuuucccaauuguugguugcuaacauucagaaauauaacugauuugaggaguauauuguuuucugaggcuuaucaaaauucacucacuaauucuaguuaaauucuuuggacuuuucauauacauaaucaugauaucugugaauaaaaacaguuuuacuucuuucuaaccuuuauguuccccucuucuccccuacccuucuucuuucuuucucuuaauuuucuuuauuguagugacuaggaucuucaaaaauguugaguagaagaggugaacauagacauccuugccuuuucagaucucuuuuagaaaauacuuaaucuuucaucauuaauuaugacaccuuuuucccccuuuaagcucucauuaaauugaggcauuucccuucuauuccugguuugcugagaguuuuuguucuguuuuguuuuucuaauuaugagugagaguuaaauuuuauuuaaugcuuguucugugucuguuaaagucauaugguuuuuauucuguauuuugucaauguggauuuuugcacauugcaaaaauaaauugcacugauggauuuaugaauguuaaaugaaccuugaguuccaauggaaaauucugcuugauaagauauauuguccuuuuuuaucuugcuggguuuaauuuacaaaaaaauuauaaaggauuuuugcaucauugcugagagauauuaguccauaguuuucuuaccaugucagcucuuuaugggcagagacagucucuccuucauuauuguaucccaagcaccuucaccaaugccaaccacagaaaaggggcuuuacaaauaaauaguuuuugagaaaaguuuaaagaccuaggauggagacccacauucauuaauuuaaauuauuuaaaauauuaaugaauguaacucauuuagcagguauuugccuuccaauugugugucagguacagugcuacucagaagggguuuucuugcuccaucuccagccacucuuucuuuucuaauuguuucucaugucucuaagcucuaaacauuggaaggccagaggauauagucauugagucucuuuucuugaucuuuuguugauguuaugugaucucauggcuagaaacaucaucucuaagugaacagcuucaaccuaggccuuuccccugacucuagcaugguauagcuacuccugcccaauacaucaucacuggauacccaguaggcaucucuaacuuagcaugucugaaguugagcuauugacccucccucucagucuucuccauuucaggaaaacguagcuccagccuuccaauggccaggccagaaacuguggcaucauccuugacaccucucugucucucccaccucauuaaccauccucaacaaauccugacaacucuaccuucaaaauauaucugucaccuuucuccacuucugcugccauucugauccaagccauuaccaccaucucuugcuuuauucaguagucaccagcuagucuccauaauuccccuuugcaguuuugucaacacaggugccaaaacaauaccuuuaaaauguauuuuagaucauauccccugcuucccuaaauccucaggaggauuugaucuuacucagaacagaaauccagaacccuuaaaacuuccuauaaagcaccccuugugaccugcuugacuuuagcucuuaauucuuccuuuuucucgcuuggccccagccaugguugcuuaaacauacuaauucuacucccaccacaaggccugugcuguuacucugccuggaauguucuuccguuagauguucucauagcuugugguucauucaucacuuucuuuaggccuuuacugaaaugucauccucuucuuaaagcccacccuggccauuagagccaacuggagaccccucccaaaaauaaaguuauauugcucuucccugcuuuauuuuuaccuuagcacuuuuccugccugucauauauuuuauauguuuauacuguuuauucucuaaaaucuccaauaaauuccaagcucaauaaauucagggauuuuuguacuauucacuguuguuucugcagugaguagaacaguguccaacacauaauaaauauuuucugaauacaugaauaggggaguaauaagugaaugaauauaagaguuacaugaucucauggagcucauguaagaauugugaucucauggaacuuacaaucugcauguuacugaauaaaauuaaagaaauucuaaugggggaaaaaggagagagaagaaauaaauccaaaaaaggcaagcacagaaacuugugaguuuuccacauaacagaaauggguucagcuaagaaaagccagucucuauuaaaaacagaagcugggugugguggugcaacuguaaucccagcuacucaggagacugaggugggaggaugcuugagcccagaaguuccaggcugcaaugggcuaugauugugccacuacacuccaguuugggugagagaaggagacccugucucaaaaaaaaguagaaggaaaugaagguaaugcaguaucuuggaagcagagggggaaaaggucgagaagaaugaggacuguguaggacuuuguaguuguugacagggaucaucaucaucuccuuuaagaguuaauauacaucaggacccauggcaggaacauuaccaguuccauaacugguuucagacagaugcaaggauagugugcagugaagcaugucuguguaucaugcauaauucacaugauguaggcacuuaagagcaacaccauuucuguaaaugacaacagaagagaaaaaacgaagaaccugguaaaauuuugucauugaaaguuuugcugaagaaucccuaguaaaggagcauuguggggcaguccugcuucacucaauuugaaagcccuagaccuguguccuguuaaggucagcgucugcucugugggugacagcuuaagugcucauugcaggucugacaucagucagcuacucucauaucuuugauuugacuuuuaucaguuuuuaaaauuuguuuuuccauuucaaaucaacagguuccauuuuuugggccucuguuugauggagccauagugagugggaagcugcugccaagccuuguaugugccacgugcaucaacgccagcagggcugugaagugccucaucccacucuaccagagcuuguaucuuuuugcuuuaaauguguaacuuacuaaccaucccagaaucaagauuccuggcaguuuuucauaagagguaaguauucaaaacugaauugaagagggaagagaauuuuuuucaaccucuguuaaaaauaacauagugguuuuucauagcauuuguuaauuuauauuaaauauaauaauuuuaugcugcauuaaacuuagaguuuacuuucauaauuuacucacauacguuugugucugagaagcugugaccauuaugagaugcucauaucuucuuagguauuuugccccacguucagucucauccuguaucccucuuauuuguggcaguccauuguauauaaggugggaugcugagcaaaacguaucgcucauucagagugccuaccagaaaccaaagcaaaugaaaugacccuaauaaaucaaagaauguggcagguaccaccugagaagugcaaguagguuucuggaagaucagaggagauagaaauugcauuugguugaggguagagggaaagauguccugaauuaaguugcauuuggacuuaucaauaggaauagcuagaaauucuuuuguaauuuucccaaaucauugauauuuucucuaguuccugauuuuguuuccaaaaacagaauaaauuucacuccuaaaauuuuuuccucaaacauuaauuggccugcuguaguccuuaaauucaagcaugaucucaaguuauaagaaaaagagauuaagaugggugaccuuauaaaauugaugcaaaaaaagugaccuccuaauaaaacuuagaaucucuuuguuucuaauugguauugauaauaauuugaaacauauuguguuugaccucuauauauacuucucccaaccugauaguaagugauguguugcuauagcaagugagaguuggggguagaugaaaacuaucccaugugaauagauacgguucaugaaaaaauaccuuucauuaaaauccuggucacuucauugacugauauucugccuuuagauuaaaaaaaaauacauaugccauguggcaacuuaaaauuaucauagaaaugaguaguagaaaagagcuauuaggucccaucuggucccuccccugggggccagggcaggauuauucccuucaguguacucucucgugcuuuguccaggcugguggugaguguuuuggagauggcauucuuugcagugauuuccacaacacuguagacguaaucuuguggcuggugucaauuuggccuucagcauggaguuuuuauuucacauacuauuaaaaagagccucuuggcagaaaugagaaagaacuauucagcgauuaguuugucaguuugcaugucaacuaggacgagcugggcacgcaucagucaaguauguuggaccaaggcagcaaaaaaaaaaaaaaaaaaaaaaucuuauuuuacaaaugagaaaauuccauuuuauauuaauuccauugugacuuuugucaugucaccuucucuacuuacugaacuucucauuauaaaauacuugcuuuguuauuuuguuuaacacugcuuucucaaauaagaauuaaugugauacaauuggaaugaucagguuuagggaaaaugguauuuuuaaaaguucaaaggauacuauucagaaucacuuugaaaacuuuucaagcagugacacaucaggacuaauguggauaccagcuagggcuacugaugcuauuguguguuaguaaauguacucuaacucacaaaauagcuaacuugacaucucaaacaacaauguaguacagaaauuaggaaaaauauuuuaaaaacuauuauguugaucauuaucaauauuuuaaacuuuuuuuugucuuguaccuggagaaaauuuaauugguauuauucaaauaaauuguuuaaaacaagaaaucaacuguuauaccuaauuuuuuauagagauggaguuaguggggaaaacuuugcaaucauuuaacuacucuauucuuuuaauuucugucugcagaagggcuaauauucaggacagaaauaaggaauauaauaagagaaaacaaauaaaauggaaaacaguaauguuagaauaacauuaaauagcaaauaaaaaauaccaugacaaguugagagauugcagacaaauaggaaaaccuuuauauuuuaggaccuuuaaaggcauuuuuuccuauuuuuugaaaaaggagcccuauauuuucauuuugcacugggacccucagguuauauagccagccccgguucuaggugugcccaagguacugcugaucuccucagcccuuggggagauuacacaugcugggcaugaugggcccuacacucccuccccacuuauugcaccugacaucaggcagcugugggaguuuacucuggaugcugugcuaagaugacaacuaaagaaacgagccaguggaauuacuuuggaguaguuuuucuuaucucucuguccucuccccagcuaaugacugauacuuacugccuuaaaaucgugucaguugggcuuuaguuuuuauaauauuuaacuagaaguggaaaugugggcaguuacauauuaauuuuguucgcuauguuuaagaaaaugaaacauuucuaauuaagcuaaggaugggggcauugcuggagcaaauuuucccuuugggggucuuuuugagaaguaaaugcaguuagaaucaauaucaaagcaguucuuauuugggagcccuuggcugaguuaacaguuggaacucugcagcaaaggcacauagaagacugaaaaauaccauugucuuauaugauuaaaaaaaaauguaagcacaguagggguaucuuuggaaagcacccucaggaacgguucaucgcagccccuuugucccuccuggguucuccugugauguccucugcaggcuaaaucaaauuugucaaguggagccuucaucuuguggccacugcuuuucugagugaugagggccaacucaccugccaucugcuuuuucuaucccucaugggcaaucaaagagccuauuccugugccuagaggguuguaaaugggaagcuugccacauguuauguuuaccauucccaagccgacuaaagauuccaaaaucaaaccguggucaacugauagacguuuccacaaccauuugagccaagguuuucauucuucucaucaaauaacuuguuucagggaaaagguugccacacaauaugcagugugcccguuaggaggaguucacccugaaucaaacagaugguggcuuuuuaaaauaaacguccacuucaauagaacaauagucucaauggcauucaccaucucuacucgcuguaacuaucagcauuugauggagagaacugggcugccuaagaaaaaauaauuuuguaucucauucuuucacaagugaaauguacuuucauuuucaguuaacauauguguuugauaguaccagaguguccccucuuagacccaugacuuuggaaucucauugcuaaauucugcuacgaauuuucacaucuucaaaaaugacuccucucccuaaagcuauaacaaccuuguuucuuucuuguucagugggaucuuugguucuuuuuccuggacagaucuuuauuuuuuccauucaucuccauacauuucagaaaauaagucaaaugguaccauguguucuauuuugccgggcagcaccaguuagcauucgucaacauuuacagugccccugccaugugccaggcacagucguugccgcuaggaauagaaaugugaagauacuccaaaugaggggccaauguuuguucauggaccaggcuuugaaagagcacaucauauuaucacauuugagaaugacagaugcuuccauauggcagaguauagaauacacacacacacacacacacacacacaaacacacacacacacacacacaggauggaggugauggaaacauuuaaggggccauggacgggguucugagagagagcaggggucucgucgaaggcaguggcagggaugauggauuggauaucuagguaaaggagguggacuaagucagugugggaccugcuagauuuguggggguguggagagaaugagaagaauagaacgguggucucuuggugguaugagaacagaaucgcagacagaacucucugggccauuugaagaaauggcuugaaaggagggggcagagauaaagaaagacgggaauaggagagaaugguuucacagaaaagcaggaaagagagaaaugaaggguuaguuucagcagacuggccaagaaagagacauccuacugggugguuuuauucaugacugguucuagcagacucaagucuucaccuggaggauuggguauaagaggaccuagaacugaauuacugcaagguaagauguuaaaacauaucagauaguagcagcaccacaaagaaacacuccugagugaggucaacacgugccugugaaugaaaaaugcauggggagaggggcugcauugaagagcggcagccagaauggaguuauacccccagaugggagggauggccaugcuuuucuaauccaaauuucuaaacaggcccaaagcaaaauauagcuguaguggggauuucuacuacuugauaucagcucugacauacauucaaccaaaggugacauguguuugauaaauuccuggcuggcagacaaucucaucucucuucugagagaugcaaacaagaggcacuacuauuuuuguuuuggauccauuucuuaguaauuugaaggaauggauuuuugacguuggacguugcaaaaaguaaugagcuuucaguagaguuuguauaagaaugggagggaaaaaagaagaagaagaaugggaaaaaaauguugguagaccuguacccuagacacuugggaagcaccuuacaaaaagaagaguucagaggaagaaauagcauauuccccugggugggcugagacuguaaaagggaaugaggaauuagagauuuuuaauaaggggauuuuuauuaaaaacuuaaaauuauuccucugagaaagaaaaaggggaggccuggaggagcaaccaauauagcugcacaagguugcguucucugaugcguucauaguuaaaauacucacaucaagauucaaagaggagcucuugacucuguaaauuagcaggugggcacuguuagccaguaucugaaugacuuccgucuucucuaucacaucuccuucaaaugggaagggacagagaagugccuaaguggauaaauuaaaacucaagucgcuaagaauacaaucaaucaaucaaucaaucaaucaaucaauggcucuugcaccuaagcuccagacugcagggccacguguaucuggcuguagaacaaauaaucucagaaccacaagaaauauuuuuuuagaaaucauguagaauaaaggauguacccaaaauuggaaacaggaaaauauuuuguuuucaaaaaggauuaaaggaugaauuuuggaauguugcauggauccuuuguaaaauuauuagacuagguuacuaaauagccugugagccuucagaaaugaauauguugacaaaguauccggaacacacuuacuguguguuuuauaagauuacuauuuucggagauuagaggaagcauauacaucuugauuuugguaaaauauaaaauaaaauacuaucaucuggcagguauaagagagaaauaugggccccugagaguugggugauuucacugugaccaaaucuaaaauacauuaauucaugggcaccagucagcaagaagcuuugugugucuuguaugguuucgaugccacagcuuugcuguuaacccgucuuccagucagcaguuuuuucaguaacuuucauaaaggucuaaaacauguuuaucaagccaccauuugucagaaagcugagaggguuaacuaauuugacacgaugcaaagucacacauuaggauuaucucaacagaugagagacuuccaggcccaagccagcaagaugagguuuaagagggcaaaauguaacguuauguacugggcuuuggauaaucagcugccugaguacagggugagagugaugugguuucauagcagucauugugaacaaugucugaggauuucgguuggccacagauuggagaugagagaugagagugaugcaacagccagccacaccagcauucucuugagaccucugcauaggaaacaugagguccagucacaggaacuacggccugugcuccugcagccucagggagcauccaaagguggugugcagcccuggggccacauuuuaaaagggaccucgaccaacccagagccaauccagagaaauuguaaccaaauggagagccauuaaaaccaagaaguaauuguuucaggagucugagagguauuaaaagaggauggcagucugcagaacugugaccagugaauagaagcaaccaggaagcagcuuuaucucagugucaagucaaacauucaaaaaccagagugggcagaccagcugccagcacaccaaauccagcccacagaugggcuuuguuuuaacugcaguuguccuccucacauuaccaaaaaacuaaacuaaaaauugaguuugucagccaugcugaaaaauugggagaguuugcauuuuuaaaaaaucuagacuuuugacuucuccugaagaaucagaauaucugacccuauggggccuuccuucuacugacagcagucucuccacagaauaugugcugucacggucaccacagucccuccuggugucuccccagugcugaggccuggugccaggcaccaccaccauggcacccaccauuuggucucucugaguuggugagagggcuaaugggccaagcagguaaaacagugccuguuccuuggugaaagcccagcaaacguuaccugcaauuguuguauauuaucagccuggcccuugcagauacuggaguuucaaaccucuguuguaaaaauggaaccaccuaacuguggaguuaggccucaggaaauauuuacuuuuuuaccauuguggguauuaaaauaaaggcugguagaaugcuguucauucagugccuugcagaagguccucuucugugugaaaggcugguucccugggguaggagcugcccuccacucuuggugcauggaaaugaggcccgugagaagugcgaaggugcaggagaaaucucgagagaaggugguacacucugcuauuuuugcuauagagugacaucucacuguuagaaaaaagaccaucccuucagaaguuauucucaaccucacagccuguggagaaaccaggcugaugcucccccuaggggaauaucaggaacagccucauucuuccuucuuucucucuuuccccccucucucagcuccauccccagugggucacugcaucucacuaccaaccaucauagggagcgugcugcuucccacugggaugaccccuaaccugggagucuccucucagccacucugcuauaccccacccuucacacugcccuugaggcccuccugugccaaggaccccucacccucccauagucgucucugcucugacucacuccuugccagccugaaccuccucuauccucugucucagauguggcacucuugccacagugcuggcuuucccagugggggccuuguguccauucugcugcuguccccuaguaugagagagugugugugugugugugugugugugugugugugugugugugugugugugaaggccugcggggggagggaagaagcuggagaguaauuugguaagaaacauuuuggaaaacagaagccaaaaguaaaucauauuuuauaaaaugauacuuuuucaaaauugaaggccuuaauugccuaaggugaaauauagccuuaggaauagaauauguaugcauauguauguauauaaauauacauuaacucucucuuuuccauuuuugaauguuuaguuuacagcuggauccugaacacuuaaaauagcaccugacacauaguaggaacucaaaaauagauaggauucaagaggaagcaaauaauuuuuaccgaaaaauugguuuuuguguuuuuuucuucuuacuggguguuuugugcauauuuuuauugugcucuaaauaaucauucuaacauuaucaccccuaaguuguugaagcacauuuauauggaaaucuuggcaauuagaaugguaacuucauauuugauuuuaaauuaacagaaucuuauugagaucacuauaaaggaagugaucccauuuucuuagagccauuaguuuauuuaguugguuuuugaaagagagauugaauucaaacauuguuaaagucagaaaccuugcagacaagaaggaagugggagggaaauguaccaucaaagccuuggccuccugagaaaggagugacucucuagaccugggucagaaagaagugucugaaaaggccuaauuucauugucagaguccauuuauaaauccuagggaccuaguugugguuuuuuguuuuuaacucuuaauuguauguaaauuguauacacauaaauaaaacaggcuuguaaugccuaaaggaagcucuccauggcucugagacugggagcgggcgggccuuggcugagcaugcaaauacugacagcugaagucacuuguuggaaaguccgcaaacucugguuacagcugcauuugucaguagcuuuaagggaaguguaaucagccagagagauuaauuugcaucucaauuagaaaagagucuggaggaagcacuagggucuguugcgggaagguuguggaagaaaucucaccaagcacaaaagccuccuggcgcuucguccuccagcugaguggaggacaauaucugagguuucguuuccauagggaccagaagccugcugggccccagaagaaucucggguuugcaccguaaucauuuggucaugaugacacaaauuccacuguuguucccaaauacauuuuugcuauuagaaagcuguuagaaaaguggaaauggucaucauaucaaaagcaugcaagaggguauuugcugacccaacuuaccuuuuucauagugcugcuaggauugcuaagcauuuaacauuuauuaaugucugaguauucaaagagcaaaaggucauuccauaaaugacaauauuucuuuagcauucagaugguuacuuugggaaugacagagcuucaaagggagccauuauuccugauucuuccacacuuuucagcaguaggcaaacaagauuauaaauuuuaaaacacaggcaaggaagagacauggaaucuucuggccaugaagcauagaaaaaagucuggccauuacaagacuuuuuauaauccuaaugaauccuaauaaaaaucauaauuuaaaaaagcacaaaguagucuaaauuuauuaauuuucccuuuaaauauuaucuagucauuuucauaggcuuugauacuuauaucacacggcuccuuuguuuucagaggaguucuuaauauuaucaaaagcggguacaaagccuggugagaucuaaagcugucugaaccguuuauccaugccaaaucacuuacucaaccaggaaggcccacccuuggcauuuuuggaagaagacuuuuauuucagguuuauuuuguucucucuuaaauaguuaauucauuggccccagcuucaaagugagaaaacaaacaaaaaacagugagacagaaaaaaaaaaaacugaauccuacauuauaaacuguugacuacaaacugaauucuuuaacaaaaaaaaaaaaagucaggguuuuaagcccauccuccuauucuggaaagggaagggaacaaguuuccuaaagacaaucucuucuggugcccacagacugaaauaacacauugcagugagacaucagaaccucuuaauccaacauuaaucaaauuucaguuuacuaauuaucagucccauguugaaaggaacagaaugccauaaacagcauccacagaacguuuaguggacucugggauuauaagcaauauuuugaaagugagacuuucuguuauucaaaucucuaaaaaggauaauacauaccuuauuagaauaagagacgcugcaaagccaaagaaggacaaagcaggcaaguccaaaugguggucccuucugugcagagucugcccuggcguauacagugagcucccagcagguuuccgugcuggaguaauuugcaacacacucaaguaaauuuuuuaaugaaagcagaauacuuuuuugguaaucuaggggugaguacgacccaaaugccaucauguuagccuugaaaggguguccuuucuguuuuacuacugaggaauuuuaccacacucuaaaagggguacuuugaauuuugugcuucagauacauuucugaggcccugugcuuugaaagccuuagauagagaccauuggggccaggguggaggaaggaaggauacugcaggguucugugcuggugcccacucccuuuucuccuccgugaugaucaggugucccgugugccagcccuagggaguccagaugcacuuuaauguuuacauuguguuuugcacauggcuuuaacacauucaacuugagaagugcacagcugcuuucguuucuaguaggauagcauguccccaaaaugccacaauauuuuaaauagccaacucuugggugauuucucauuauuccuuagaaaaccuacaccugauauucuguauguucagauggucuuuuuguaacucuuuucaucagaaucacaaaaaugaaaugcuacaauguuuaguggcuuaugauuuuuaucuuuccuuagcuuauuuuuucuaaugcuuuauuucggucuucaaucuuccucuuugguccuaggauauaaaagagcacagaauauguugucccucugccuuguccacuuguuuaaacucuccagcacaaagcuuugguccuuaauccaacaccaaugaaggggcugccuccugaaaccucagggucugcuugucauggaacaagccagcccuuaagaugccaagucccuuugguucucccuucauuugccuaugaagugggaugugaguauaucagugcaucccggcuuugaggcagauguaugccuggaagugcaaagucucauaccuccacaaaggguagggcaggcuugcuggcugaugggauucugaauuuauaagcagaguuccagaauucccccagggccuacuuuucaaaggcaaauuaguauguuugcaacuugaucccugggcaacuuuugacaguuguucuaagaauaauaaaacagauggacagaauagauuuuggggucuccauccaaacugccauccucaguggaauuuaaagaaggcguagagcugauggagagagcugcugcugcuuacuaucaugcucugccuuuaacauccaagagccauagcuuucucccagaagauggcaacugucaucacauuacauuugccugcugagaguucggcuuagcugugauguguguuuucuucccacuuuugaaauuaaaaaaauugaacucaguuaaauugaauuuauacuccaaagaaaccaauuuuaauaagaauaucaguaaaaauguaaguuaguuuuaaauuuaaggaguauuuucauauaauuuuuaaccccuauaaaaagaagagccucuuuagaaugucucagaaauaccguuuacucauugauuuagaaaaauagaauguaugccucuuuaacaggauaaacauucuuugcuuauaaugacauaugcacaucagaagacuacaucagaaaacaacaucuaaauuauuugaauaaaaagaaacagauugguuuuguacuuaugcucuauaauuuugucaaaugcauauaauuuuugcagaaaauuugacuaaggaaagcacuucacauaaaccaccccauuuuuuguagaauuuuagccuaaguguggguuucagcucagauugggaugagaugcgcuuuccuuuuaacuuauauuggcuuucucugacauaaauuuccagacucugauuccacacuccuucucucuggauuaauuugcccagugaucacuuuuuuaggucaucaagauucaauaagguagcaggucagucaugcuuuggaguuccagagcugcugugugcugucagagcugguaugcccauaugugugcacgagcugaaccgccaguuuccucaguggguuuguuauguagaccaauuguuuaacuaaaaugccccugacaauaacucaguaggauaguaaacauguuuuguuuguuuuuuaauuuaggggaaacauaaagcaauguaaaaccuuuuucuacgucucauguugggccguguaacugacaccauaacacuggacccuuauggucaagucuugguucucagugagaagaguucuugcacagaagaguuuggggauauucucuuuccuucauggcagcaauuuuacuacaagugccagauaaauuuuaaaguguaucuuguuuauugucaugcccagcuuagcagguaacaugucauagcugaccucagaccuuggguuuugauguuaguuuaaauuaaauaauaacuuaguuuuuggcuuugaauacuuuaccucugucaguuuccuuacucuaaaaugaggaaaauaaucccuccaagacagauuauuguaaggauguauggaaugaaguauauauaaauaugagacugaagaaugaaugaacgguugagcugauggaugcagcaguguagaggagggccuggccccucgcucguucucccagccccaacuagaagaacaucucagggcccagacccugccacaugugccaugguaaaucaggguggccaugcuucuguguucuuccugcaaccaacaucgguauagccguggcaagcacuguagagggcaggcagaggugaguggccucagggggcuucacagccaggauggguuauaacugugacauaggguaggaugcagccuaugcucugggagaggcauguggucagugcccagugaguauuuguugagucacugcaacacaagauacaagagagagaaucagugggucaugggagcucgaagggaaaagauuauuucuagcugcugcuucaaauaauucacguuuuuguguaccucucauuaguuaucucuucacgugugugucaucuauaacuugauaggugggaaaugucauaacuuuguuaauuuguuuguuuuacaaaaagauauucauacgcugauuauaauuuauuauauugguguccauggcccauuccagggugcuaaggcauuuuuucagggcgcaagggucuuggugaacagcaugcucuugaggcuguauggucgccacuccccauuccauuccagaggagggcacagaggccggacugucgcaguccucacuuuagugggugaggacaccugccuccaacccacuaccuaccucagaagccugcaggcuuuuucuuauuacauaccccacccaaagaccuaaaaaaaaaaaaaaagcaaaaaaaccucuuaagcaugccauucaguagugcauauacugauuuauuuuaaaguauguacaaguucugcuuuacuaguacauuaugacauaaaguauagucaauacugagaauuuuuaaaggaugcaauaaagaggaaauaguaaucugaaguauuuuauauucaauaguguaaaauuguuuugcuuuuauuaggauaucaguagugcuuuagugagugcaguggaauuaaaaugugcugcuuuauuuuuauaaucuuaguuuaauaguucugugauucagugauuccaagggguccaucuaagcucaguguauuuugauaacuugguuucauagccggaaacaaaacuuugcaaagaggacauagaccagcuggagcagauuguugucuugaccuccuaaaucacagguucgugcucaguuuacauucuuagccaccaguucuaugaagguuccuguugacauuuggaaggaaauuuccaucuuccuugaugugagaucaguuguuguauugguauauauauauuuuauuuauuuguguguguguauauauauauauauauauaggucuauauauauauaggucuauauauauauauaggucuauauauauauaggucuauauauauauaggucuauauauauauaggucuauauauauauagguguguauguauauauauauagguguguguauauauauauauagguguguguguguauauauauauaggucuauauauauauauauugaaugagggcucuacugccagccccuugcucccucuccuucucuuucuuaguacagcuuaguacagcucauauauuucuuauuguauugguauauauauuauauauauaauauauauaaaauacauauauauuauauauaauauauauaaaauacauauauauuauauauaauauauauaaaauacauauauauuauauauuauauaaaauacauauguauuauauguaauauaaaaaauacauauauauuauauauaacauauauuauauguauaaaaaauguauuuuuuuuggacaaacagauucaaaauguacucagcucuuauuuggaaguuuagaaacaaauaaaauucuguuuaugaguguuuugauaguagagauaugagugcuuucugaaaacagaaaccaucuucgacaauaaauucccaugcugaaggcaacauuuuccaacaucucaauugaaggcuuucucuuuacagcauguuucuuucaaauagcaguuacucucucacucagugucagcgcucuccuuuucuuuugugggagcaguaucuuucuuccuaaaggaauggcuaagggcgcauugcugaccguggccuccuccccagucuccucggagcaucagccagggccagcgacuaaagugugagucagccacgucacugccagcucacccucaccaggggcccugccucccucagcauccaggccuucaggggaggccugugcccuccaugcccccugccucuacugcuccccagaugcccacguggcauguucccuuggccccucuucacugucucccuaugcgagagccccgcacacaugugcacccacaccucccagcacugccugggcugcccaugcuguguguucccacagccuuuaucacccucucaguuacuauguaauucacugauuuuacucacaccgugcccccugcgugagggcagagauuucugucugcuuuguucacuggugccuccaagggugagaguggaaauauuuaacaguggguacauaaggacaccaguuuggcacugaccaggacgccagccaugcggguguuuuccaggugaauaccaacccuggauguagccucagcaccugcugcagaguaaauauuuuuucagugaguacacgccgaaugaacgaauucagcuccuugucaucacagaaaaggucaccaaauuuaggacauuugucuuuccauaaaaaagaaaaaugagcaacucaucuuuauauucaaauuucagcuuuuauaagaucuuuccugugagauaaauggcaaacucgugugugcgacaaaagauuuccauguucaugcucugccucagaacagugaauuguaaagauaauacgauuuauaggauaauaaaguucaacacuucaguuuggaggcucauguaaaccaugguaccucucccugugcugaaaguaaaugagggcucuacugccagccccucgcucccucuccuucucuuucuuaguacagcucauacauugaaccugaccuaggacagucugauagaugaccuagcaagaagggugcaagugucaggcacguguuaaauuucaguaaagcuuaauugaguucaucauuggagauaaaaagauaaauauuaauagaaguccuaacauugucuucucacaugagagucugcaaacuugcaaaauuaagcaucaugauuuuugcaagagcuggacaugguguugcaaguuccagcuccucaggaggugggaggaucacuugaguccaggaguuuaggcuguagugcaauaugauugugccggugaauagccugcagacacugucacuuaaaaaaaaaaaggaacuuuauaaagauuuuugcagaaauguuuaaaggcaaaaugguggagggaggcucuucuaugguucuguggguugacugggcucagcuggaugguucuuacccagggucucuuacaucuggcaccugcauuggcauagcuggaacagcuuggggcuggccaggcauaccuggcucagcagccccuccacuuggcuaguuugggucuucucgcagcagucaggcuucugacauggcugcuacaggcuccagagauccagguggaggugccagcuucuucacaauagcacuuuggaagucucagaacuauuuggccacagcaggucacaaggccagccuagauucaagggaggagagugagccuguugugagauaagcagcagccugccuguccaaggagggccacaggccaacggacauuucucucugucuuccauagcugguguagcacugaccacacugggugaggggcucacuaugaggcaucugccccuccacuggucagcaagcuccuuaaagguaaagcuauguguuauucaucuuucagucuccggcaucuaacaucauaagaagucaguagauguuaguuggauuaaaaucagaaaugcaaacauuuuaaggaauuucuaauuaggggaaaguagacucuagugccauuuauguaauuacaccacaggaugucuuuacaaugugcaugggaggaaaugacuuaauauggauacugaaaagauaacugauuuaaauaaugacuucuaaauccagagaguuaagucaugaaagcaauagaguucacucugcuccuguguccacagaagcaaguguugaaagcgugcauuuuguuccuguuacacuugauuuccuugagcuccuuauuuucacuuuaacuuggucucaugaauccuaauuuuauauugcuuucaaaaaucaugaguuuugauguaccucauaauuguauuugacuuuuuagaugaguuuaugucuuugugccuuggaaguugucucccccaaaaucuuuugaaaaccauauaaauuguaucauugagauuucuuuaaggagaauguccguuuggaccaauuuuuuuaauguuuugcuuuaaguaggggaaggcaucagcuuuuaguggggaaaaggauugugucuuuuuauaguaagagccggccugauggcucuggugaaccucucagccgcuggaggaacauucuuaaagauguauccacauucucugaccacuucuuaacaugacccuuggcaguccucuguggcagugguuuguccguucugccuuggaagaccauaggaaugcccguccuaggcuuuuguugccuguguuuuuuaaacagccagagauuucacauggcaucuuuggaucucgugaccagcugacaggcgaggagguggugaugacauuccagccuuuggcccgaucccccagcucuuuaguguuuccgugcacguuauaguaacucaugggugaugugaaggagugccacucugcaucuggaaccacggccuucugccagagcagaucgauacuugagcugucugucucuagcgcucaccuuccuuucgcacagcgagacccuucugcaggcagcgaucgauagcucuaauccguggcagccugcagcaagucaugcgaggcagagcacuuagguggcauuacacgggacuguggaggcagcagcuccggggcuuagauucguaacacccuuccuagggacacauucuguuuguaauguguacuuuuuauaaucuccgucauggaucaccauuccucugaaacuugauucagggaaauggacauguguuuguguuuguguaugcaugugugaauuacagacagauauucauucccuucucagacuuuguaccagcccucccuggugcugcuccagaccaucacugcgucacuacagaccugggcuuugugcuguaauuauuucuagucuggguauuuuuaaaacauuaaaacuuuaaaaauauauauauauuugaaaugccaguaacugaagagcauucuuacucuagcauguacuuucccacaaaacaucauuagaagacaaugaacauuggaugucacuaccgucuuugaauggcugugaccaagugagaggcuggagagugaagaucugucuuucccuggaccacugaggccaaaggagcuuccccuagggauuagcuuuggaacuaccccuguggcauccuuggaaggcagaguggggagucaggaaaagccucuucaguucuuuaccuggcuuccaauccucauuccauucccauaucuaguuaucuugauuuuaucuguggauuucaggauacaacguaaaguuaagggcugaucugaagaaagcaaauaugugggagacaaguuugaaccaggguuucuggccacuguugugugcugguccuauaaggagcaggcagcaguggccaauagagccacgagugucaugccugcugugugcgagagccucagcagcugccugccggucagagaggacugguuuccaaauucagacaugcucaaauucauuagugaaugacacacuguauuuuacacaaaggucucuccugggauguaaucuuuguuucgagcucuguggccuuuuaaacucuaugcugaucaucucaccuuuaaggccacuuucacuaaucugcaccucacaggccacugcauccuuuccauuuuucacagaguacagauaacaccuucggagaaccccuuaaguugagcuuagcucacaggaaaacuucugagaaacaaguuuuucuccaagaaccagguaguucucucucauauuuacacacauccugcccuacgauauagaggugcaaggugcauuucuugcuggagaugaucauucaguaaaaugucuuuuacuuagggcuuaaaaaaaucuugacaaaaaauaaucaacugauucugauaaucugauaaucucauucauauuccuagacaccaauucugaaaaguccaaaagcauuuuuuucguuaguguacucauucauucaacaaaauacccaucggccauuuccuguaugccaggcacugugcuguugcugugggugcacaaauggaaggcccggugcccacccuggaggggcucuuuguugaauacagagcacauuagggaagagagcagugcacaguuuccucauggcugugaugcagagugcagcccagagccucaaggcgucccacagagggccugugaccuggcaauuggagggugaauaggcgucacagggacuugauggaagaaaggagcauucagaaaaaguaaacgacuuucagcggaaaagagccuuugguaaaccuggaaccaucaagaaacuuggugaucuuggagcuucagaugcugcuaggagcccaaacccaccccccgcaguaaucagauugggguccacagcacccagaugugcacacaucacucccuccccuucuuaucgcugucucaucucacugugucugccagacaccuucccccaucucaugccauagaccccucacucauaaggagaugugcuacugucuugucuugugugagaagaacaagaccaggaggugaagcugcuuggagcuguccucuugggucaccuggagagacaucuguuuacuuagcugcaccauucuuugcucugucccaggcacuaagaaccucacauauuuuauucaguuauuaagcaauccuaucaggaaggcacaauuaugauccuauuuuaauguauuaugcaaacgcaaugcaaugucuuaacacaaucuauuaugucacaaacuuuuuuauguuuaaaaaauauaguugagggaacagaagcccagaaaaguuaaauaacuugccugaggccacacaguuuugugaaugguaaccaggaccugaaccagcagcagcugcuccaccugugccaucaacucacggcuccccaccaccccagugccuggucaacaccucuccaucaggacccaaagaugccuguggaauuuuacuugcauuucagugcaacauuuuaaaucauguuggaucuguuggucggauuuauaacuugugauuuacagcugauuuugauaagccacaaauaccaguaucaugcuuuaaugagacugaaggcaugaacgagcagauucuacucuugaggcuguugugggaacaugccggccgacauugcacuuaccccucugaaggccggcauugucgccaggcucauuagcauccacgcuccucgcugggccguugccgcuugcuagcuuaccagcuguuccugcugcuccguacaaugucggauguguucagcucacuggguuccuguccucgccgccgggaggagacagcccuuccgcuggggauacccacguggcugccugucagcgguggcaccgaauaaaguaauaggccuucgcauggcauauggugucuggauucguacaagaugcaaaacucuucugcagcuaaugcacgaugacucauagcauugcuaauuuuucaaacaaaagcugacuuccacacccacacuuuuaaccccuccagcuaaaacgucuugaguugcaaagcucuacaauggugacuuuugggucacuauauaaaauuuguuauacuuacugaaaguguaugaaacgauuugcuuuacuuuggauugaaguuauuuuaaauuucuauuuuaaguuuauuuccucucuauauggggaauuuuuaagcuuuaacuuucaauuucuuuuuuacauuggaagagucaaaacaguuugguagauuuauuuuaaaagcuguuauuagaaaaucggucagaagacacuguauuaguugaacacuuguaauuguuuaguagaaguuaacuuucucuuuuaaaagcuucauagaaacuacugccuaaugcucuuaucaauucagguguggagcauuucaagcucacauuauaguauuuuaaagcuauaagagaauguugauucuuuuguggaauaugauuuugcauagucucuucuaguauacuaaauaaggcccacuuaaccaaauucuggcaacagaaauuuagauuauaaauuuauauuaaaauguccauuuuucaaacuagaaaauaaauacaugggaucuucuaaaagaaugucccuccuaaacuuuggaucaguugugcuaauagauagcuacauucaaucugagaccuuaaguacuaaaauaaggcaguuauuugcauuuacacaaucaggccucccuuugaaguagugaucaaaauauugguucuuuuauaaauaaccuuuuacugaacauuuuauuuaaacauuucagagucaggaauugcaaccaugaaaugauuaggcaguuucuaauuauggaucaguaaguguuuuguagccagucuggcacaugagcacuuuugcaaucagaauuuggcaaaugaaugaauuuauaaaggaacuucaaccuaagaggguaauauagauuuuuuuaaaaauagauuacuuuuuggaagcccaaaagaugucuuuuggggagcaggcuagacacucagaauugauguuucauuuugguuucauguuuaagucugaaguuuuugcuuucugaucuacagauaggaauucaaaugcacaucuaacuuauaaagggcauucuauucucugaaaaugaaacaaaaauauauaaaauuucuaagugggccucacuuucuauauuccaguuuugaugccauuuuucaagcaugcucucuaauuuugcucuuugccauuggaaauaagcugguguguauuuggugugccuaaaaauuuauuaggcacuuaaaauucuccacguuuggcauaugugaggauuucuaguuuugcuuucacugccuugaguuugagagcuauguuuguuguugcuccuacuaguacuuuuauuuuauccuauuaccacucauuuuuaugaaaugagggcaaaauucacuggaguauucaaauaauuaccuaaggacagaaguggagacacugcugagccugaacucuuggucaguaguuagugucugcauguaacugauaaaaugcuuucucaucagccaauggaccagagaguaaacucagcuccaaaaggcaguuuggaacaucagugcacgaugugcaaaagcgcaggcugaucacaggcacccagaaggacuguuggaccauuauucucacucuuggcgacaacccugcagaaugggacuguguuaacccacagauggggagagugaagcucgaggaagcugggucuuggccuggggcccacagccagggcagggcugggaugagagcccagaccaaccugacucuauggccgccugcuguuucucauuugugcacacuuuugaccuaagaauaggagaccaucaaaaugauauagcuuucagaaagugaagcaauuccaauuaguuuuagcuuguucucucauuauuguuaccaagugaauccuagccuuuuaaaccuugauuguauggaauaaauaugaaaacaaaauuaucguuaaguuaggauggaaaguauucccguuuugauaccauguguacaucucuuacaccuaaauacauguagcuuccaaauuaaaaagcagugaaaauauuaaguuuaaauauucuuacuggcauaucccacuuagaguccaucccaaaauaagcaucuaauugauguuaguuagugugcuuuugccuugagaaauaguugaggacgcaguuccaucacagugauuuuucugucuuuuugcuagcaagauauuuauuuguauauguggaauccauuuauauucuaccucucucuaaaauagauuugaaagagcuuacauaaaggccauguauaaugagaaagagaaaaucaaagcccaggaagcgaggaugaaaauaagaguaucaucugaaggcauacagagaauccacagucauggcucuggcagcagagcagggcauccccauugacuacugcugaccucuaaugcuugcuguaagguguagcuaccacaugucuucgggccauucuuguucuaaaguugucaauuacuguuaaugaaauuauauuuuguauaaguuggaagacauaauaggucauucuaaccuaauaaguuccagacaacagcauauauuuauaggaaauuuuuaauaucaaaaugauuucuauucuaccccaugaguucaaaagauaucuuuggagcagacaugcaaguucaugugcaucacaagcuaauuagguccgggggaaaaaaaaaaguuaagggcuuaacaauagcugaaaaagugaagaauuaauuagugacaggggaaaguaugauugaaaaauaaucuuaaugcccacauuagcuggcuagcugcuuuugcuaagccuuuuaguuuaaaaagcccaaguaccugacauuuugcaucuguuuuucugugaagauaaaaggaaacuugagugucuuauucucaauaauggauuuuaugugacaaaaagguuucugcucccuucauuuccauggccaggcauuuuuauauuauugccccaccgacugucauuucauguuuaacucuuuguagacucacacagcuuuccucaacccuggggauggucugggauugaaugaugucaaagccucucuguguacuaggugcuuccaugcauguuggucuucuuguuaccauguugcaggacuuguugcccuauaauccagcucuucucucagguuuguuuacuugugaucacuauguaaucauucauuuuauggagcuucauuaaggacugcaaaccucugucccaauuuagcgucauucaagcguagguagcauccaucugcuccacccgcacuguuuaauuaaugaacuucauaauguguuuuugccugugaaaagcucucugucuccucagguuguuaaauaagaugugcauuccagguuuucuguguuaagauucuagaaaacccgccaugggaggugcuaauuauggacucaccgaacuccuguuaagucguaacuugaaggcagauuuaccuuuuuuuuuuuuuuucaauauacauucauaaacccaaagucaggucgcuuuuugaguaaguaaaucacuggucaguuuucauagucauucucuucacugagaguaaagauuaacauuuuuuuaaagcuauauuuucuuucaguacccuaaaaauauauuuguuacuuugagguuuuuccuucugaaauuaaaguuguagaaaugcuugaaugucaaaaaugcuauuucuguuuuccaauaucuuuucguagaauugccugggaaacuuuguaggauagauucuauuaaaaauaauggaguaacaacuguguuucuuggaaaauaguaacacucaaguaauauauuuuuuaaauuucauuaucuguuuaauuauuaguguguucuaaaauucugucuggauuuagagguguuuuguuggcaccucuucaaagaccugauaaauuugauauuauauggcagauagcauaaaacuagccacauucauuuacuuaacacaucuauuaacuaagaccaggagcuuaauccugauuuuuaacaaccggacaaccuauggauuaucugccuuuucuuaaagacuauuuaacauugagauuaaacuacacucuacucggucaaguacucucaaguccuagaaaaaauucuuucugucuugaaauaugauagaguucuacauucauguuguauucagcucuuuucaucacaauauuaacucuuauuucuauaauggugaaaaauacaucugaauauucauuuuucaaaaacaauuuuuacuuacccccauccaaacuggggagggacuauauuuguguucucaucuagccauuauaaaguuaauacauuggaaaaaaugaacguuaaaguuguuucacauuaaguaccccauguuccaugaggauaaaagcaaaagggauuaagaguuggaagaauaauuggagcacaaggaaggcagaaugaugcccccuuguuucucucccuucucuaacauuuguagaauugcaugcaucagggaccuggcacauugcuggcuacacugaggaugcggggcagagauccucagauacugucgauguggcucaguccaguaggcaagagacuguccuaccucauccucucuacaggugcccagaaaaagagcuucaugaugacaaaaaaaugagagacauugugagaugaguuccacuccuuauuuuauguuggguugaagugcaugaaguuguugauauuugacuguuugaccuaguuaaaaaaaaaaaaaaggcaauuugauauaauucaaccuaauuuuuugcauuacaaagcauagagaauaugugaauagcaacuuuguuuacuaaccagaggaaucugugcacaggugcugugaugaggguuuagcugccuugacaggacaucugccagggcucaggauuguguuugugaagcuucucuggagccccuugcuguugagcucucugcaucuugaaccauuuuggccucucuucgggaccaucuuuuuccuuuaguguuguguuuguguagcugguuucucugggcauugugcccagugaauguuauuuuuguuuauuguaugcagugucuccaauccuguuuucaugauaaagucuuuaaaaaucaauuaacaaaugaaaugcaucuuugccugggaaacuuucgaauugcuugccauguuagcaaauucucaauacugccaccaagucagacagcugaccuccuucuggugcuggacaauggauagcccccuuccuuuaucaacccauugaaaaagagacucaaaccacuuuuaucuuaaugaaaugaaaagcacaaauggaaaaaaguuaucuuugcuuuauaugcaauuguauuaaaauguugaaaucuacaagcaagauaauuaaaaugcuaucccugccaaucagcugagaaaucaguuuaacugggguuugacuucaugacaaaugggccaucaaacuaaaacuuagcagaacuauggcagccugagaguuccagaguggaauuuggccuuagaacauuuccuaagugcgaguuugggcacagccagccaaagaggcucggugacuugucacuccagagaaugccugcaguguccucacccugucacagccucagacacauuuugaaucugcaggaacuaguucaacccaggaagucacucacuuuaucauuuauguagaaccaccaggcccaguggaauauuugcccucugcauuauaccuguagccacgcaggucagcuuuguauaacccagggcagugcugagcagugcagugucauucaucucuuuaugcguaguaaugcauuugcuuuccacagcaauccugcaaagccaagguacugucauuucuuuugcuucugguggcugcuguucuccucuuaaucaucauucuccucuccuccuuguugauuucaaaaccuauuuagauuggugcaaaaguaauugcgguuuuugccuuuaaaaguaauggcagcagaauaguuugaaaauuuaccucuuucacuguaagaugauguggugguuuucaaaacaaaagauugauaaucugccagcauauguguuuaaccaauuuauaauauauucagaauguuuuuucauuucucuaaauguuuuucacuuguuuuuaugugaaacccucaaaauggggaaguugagagggggauaucucaaauuuuuguguuuuaugugaguuuuaacaguucacacuuacuaacuagaaacauauacauucauucagcaauccaaagaggucacaguuuggguuucuaugaagaacauaugcucaaguaagaauauaagauuuuacuaaccacagcuccuguuaaagaggauuuugaaagaaaaagaaaaaaaaaaagugccccagcaagagagaugauacuuuagcucuaagaagaaaauggacuauguuuguaaauucagucauuaaaaaaaaaaauguuuuuuccaaagcaaaugugcauuguuuagugcuagcagaaugcauuagcuuuggcucugaguccagcuuuucagaaaaugcuuuugaguucaaaucuuacagcuucuuucaaagcaguugcuggauuuugccaguuuuucuuuuuaagauuauacuucuuuacauacuaguucuaaaaauauuaaacacauugggcaauuaaauuuauuuauaaugaaaauuacauggaaguguaauuccuaagaaccuguuugaccauuaaucagaaguuuuuuggcauugagaggaaaguacuguuuggaggcuaugcuauagaucccuuuacccauccccagccauggagaaaauagccuaauuggguggguggguugauuggccuuuuuuuguuaugguuuauuucaaaaacaagaauuugaagaagcacccauuucugagugauguggacuagucagggccacaguuggagccaaaggccagauuagauuccgugggggaucuccccagcuuccaguuccaagaacagaguaaaugucauucaguggcccccauacucagaaccaacaucugaccaauauauuuacuccaucaucugccuuucugccaugcaaaauucagcacuuuggguguaauaggcuuccaucuucaugaaucuccuugcaaaacucaggcacuuauggaauagucagacauuacauucgagcaucucaaguuacaguagcuuccccuuaucuacaggggauacauuccaagaugcccaguggaugccugaaaccucagauaguaccaaaaccuuuauauucuacguuuuuccuacacauacauaccuauuaugaaguuuccuucuaaauuagacaaagagauuaauaauaacuaauaauaaaauguaacaauuaugacaauaugccagcgucacuacuuuugcacuuuggggacauuauugaguaaaauaagaguuacucgaacacaggcacaugcaacacagaacacaggugauccuguggcuguugaucugauaagugacuaauaggcagcgcaugcggcguggacccgcuggacaaaaggacagacagugugcaguuuaaaacacgaauuacuucuggaaucuuccauuuaauauuuucagaccuugcuugacugcagguaacaaacuuauggaaaaggaagucacggagaaggggggacuggcuacuguauuaaaauuaaugugaaaaauaccaaguguuggugagacuauagaacaacuagaacucugaaaugcugcuggugggaauguaaauuggcucaaucaaccacuuggggaaacugacaguauuugcuaggcuaaucugcaguguaucaggagaggaguuauccuuccaguaagggggagagugucuggaaagcagcaggaaggugcuggugauuuuuuauuggggugcugauaacaugaguguguuuaauuugugaaaauucauugagcuuuauacuucuguguacugugugugugugucugugcguguguguauuugucaauaaaaaguuuuaaaauuucuugaaauaaguaagaucuccucaaauugggaaacgaggugaugugcuaggguguaggagagucccaggagacacacagcgugccuuugcagaucaucagcaguacuugauaguuaaucauauacaacauuuuuguauuaaaauaaaugcaagccgugaauuugcauuccuuuuuaacacguaucugacacauuucuugcuuacaggccccuggagguccuucugucccauucuguggcccuguacagaggggaggauuccagaggaaguguguguguguuguguugccauaaaccaugguucccaacccuggcugcacauauaaucacauggggguuccaauauugacugaugcccagcacccaccccacagauucuggguaacuugguuuggaaugggggccaggcaucagugccgauuaaccacuaggugauucucaugcgcagccaggaaugggagcugcugcccuaaggcauuaagcagccccuuagcagggauucacagaugcccaaggacuaggaagaaaggauugcugcugcugugagagauggacucgagauucccccaugguuucuuccagaucugagaggggagaauaguggcuaacagcuauccaggacuuagcuuuuguugugcacuguacuaagcacuucaugugggcaccacuguguucaucauuuagccaugcggaaacaggcccagaggagucacaugacuuccucaagcacuuuauaaugguuauggugggccuggcgcacaggcauucugaccacaaagcuggacuccaccuuaugaggaugucaugugguacgccuugcacagcagccugacaggcagaaagaaguuagggaugcuggaagauugagguggcugcaacuauaaaagacaaauagcaccagcuucacauuuaggggcaccugguaugggacagccaaggcucaagagggauccagagauacaaggggaaaaaggugaagaucaagaggcaccuggagacaucguuucauaguucucccaugcccccagaaaaugaugcaaugucagaagagucacuaucuggacuaucucaguuugaagccauucauucacuggaggacugcuucccgcauucucacccaaaaagaugcuuuuuaugcauccuuccucauccaggaaaugaaugcaguccccuucaaauuacauccccacgccacgguaguuuuacagauccuucugguauuacaaucuuaccuuuuuagaccuuuguuaauugaucaaaggguuaaaaguauaaaaacuaugcagcuuuaaggaaaacguggauauuaaugccuuucuuuaaucuauaauaaugacugguuuuagucagaaugcuuuaaaugcagcuauuguaaaaucucugcccuuguaucagugguuaaguaucaugguccauugauagagcuuuaaaaaguucaaaggcuaugcuagcguaucuuuugucucuucaucuuuuaacuguaaagaaaaagauguccuuguaucaagccuuagcauuuaugugaaaaaugaaauuggguucaguucgugcauagauuucuagagagauuaaagugggcaucacacaauuuuucucuguaaaaggcuuccuuugaugugccuucugucuguucguacagaagugucagccauuguuuuucagcaguagaagagugucugcuugucaucagcacauucuaauaccuuugugcuggagccuuguucaagguggaucuuauaauucagagauaauguuacuggaaccguacauuguaauaccagucugcuuuaggaagauaaaugccaaggcaaagccaaaguguuuaucagaaaugaucagggagcaaaacuaaaacauuuauauuuggaugucugauuacaauccaugcuuuagauauuucauuagcaauauaacacaguuauucuuuggugcuugcuuugaguuuuaauuuguuugugcuauuccacugcaaaggaaacgaaugagaugguuacauuaagggacucagaguagcugaguguauggccauaacuugaauuaggcuaagacgacagagagcggagugaagaugccucauggcaucugaaaguguagaacauucccaccaaguaucucuuggccaaucuauaagucauaauuuagugagcucuuacaauguguacgaugugauaaauauuuuauguguacuuuaccaucacuagaaaguaggguuguugucccauuuugcaagaaagaagcgaaagcacagagagaagcugaaugacuugcccaagaucucucagccaucaagugagaagugaauucacaccccggcuuggugcucacucucuuagccacugcugucugucuuccaacugcauugucacuaauugcuaaaaauauuuucacagacuacuuugaaugugcaaaccaacuaauauuuaugccuuuuucucuaaauuuauucagauacucuuuuucauuucugaaaaacaguaaauuuuuuuucuuaaaugaaagugaaauccaauagaauuucuuucuuggcuugucuuauguuauuugugauaaauaauguauacuucaggauaauuucacuuucuguugaugcugccucuaaauuaaaaaaagaaaaauccuguuuuaaaaugaucuccaaaacagcucagacuacaucccuaggacagcaguauuuaaaugacucuaggauaccucuguaacuuuguuuuucuuacauuucuuccacuuaaagcuuucccagcacaugucaacucuacagcucuguaucugaggcugauggccagugcuccaaccaugggcaaccuagagcauuagccaggaggagagagggagugcuccuccagcaacccccgcuggucuugagggagagaagcagaggaugacugacgacugaagggagggagcuugcuucugcugcuguccugccuugaccugccucugcugucauuguggucacugcugcagaggcccagggagggcaaggugacauucuagcuguuuguuuguuucaacaaggcuagccacagguccacccacacucaccucaucccggucaccuuccaccuaaacauuggcagcaguucccuaacuuacagauuaacggcugucccacuucccacuuguuuccuucucuuucauuuucuguuaugaaaaagguccucaugugaaacagcucccaaaaagcaucuuauguaaauucaugccaaaauaugugagaguccucuugcaaaagaaaauuggaaugugaauucugaauuaaaaugagauuucccuuucugaccacuccauuaaauucggcuuuuguuuguuuuuuauuugcaaguguuggugcauguuaagaugaaggcagagcuacacugcuccauuccgaagaagcauuuggccacuaacugauaaaagagccaggauccauguauaaauuauucagaaauuugguaaauaaacaugcaaacuucuagcuggggcuauugcuauugcauuauucagcccaauaaagagaauuuaauuuaauggauuuucagcaacauuguucaaugaucaacaaaaggcauacugucuuuuaugaauaacugauuuucccggggcauucugaagaaaguggguccucguuaacccuagaauggcuagcuaauguaauugaagcgcgaccaccuggcagugagguugcccgucagcugccaaggaaggcccgggccggggaguaccaggugcucugcucucgcugucugauuguuacaguggaauaaacagcgugauugcacaguauggccgggggcgagaauccaagacugcugccaaccagagcgcgggcuuucuucccuagucuuugacaaggggggccaaaagugcuucuauucagagcagguaaagcugacaaagcuccgaugcugucugcgcaauuaggaugaaagaaaauaagacuggcccaagaacgaaccagcagugagccucaaguaccuguuucuguauuguacaaagccuaggccuauuuaauacaggcugggaaguuuaagcauaaaaauuuaaaauaaauucaagaaaaagaacuuaaauacucagugaccacuguuucuuagagcaggucagcauuauuaugcuuccuguuuugaagcaaaauuccaagucgucaccauacaaaaaacuuuauuuuggcccgaauuccauaguaacccaaauacccuguuucuuugauuauacuucauguauucugggccaggucauuuugcuuucucuaucuuccuuuauaaagcccuacaagcaucuauauuuaacucacugaaauaguccucacucugugguguuguuuauucucaguaauuuuuuuuaagugcugcugcccguguggagauauaaaagaaaauuagcauuauuugacuuguaaaaacuuaauuaagaaauagacauuaugaccuaagggguuuugaaugugaaaugguucauuaaguuuuuguuaauaggaaaguaaagagcacuuuccccaaacagcaagaacaaaaucgcuuucucuuaacacauugauuuauuucauuugcuaagcacaggaaccaugaaaugcuucaucccauuagcacauuaaauaugugcagaaguaaaauuacagcugaacagcaccuuguacuuuguacucaugguguguacauuucaguaggcuaggaggaaaaaacgaacuguagaaagauaauuuuauggaauuaaauuaccuguuuuguauugcucugaagcugugcauguagcuguggauucagagggacuugaacuguugccugcggcuuuucacuggauaaucccaucacccuccccagcccacucccccaggaucgguaucuaucaugggaaaauagaaaugagaaaaauguuuccuguuggguauuuagucucucuagugauaccuaacuguaaaaagugaccaggggcuggguguggucgcucacaccuauaaucccaucacuuggggaggcugaggccaguggaucgcuuaagcucuggaguucgagaccagccugggcaacaugaugaaaccccaucucuacaagaaauacagaaguuagcugggcaugguggugugcgccuguagucccagcuacuugggaggcugaggugggaggaucgcuugagccuaggaggucacggcugcagugaguugagaucacaccacugcaccccagccugggugaaaaagugagacccugucucaaaaaaaaaaaaacuaaaaccaggacugcuuagaaggaugaauauuaggucuguggcaucucuguguauuaucagauggcagucagggcacuuaguaauaaauugggagagugacuugagccaagccaggucacgucuccuagucuccguuuccaugccugggaaaagagaugguaaauaaauccuacacgaaaaguaauuaguacagggccugcuagagacaguggccuaaugaaugugcuuuucuuccccuuuugcacauugggccuuucccaaugaaaggugacccaaaguuugcucaggagaaacaagaagucagaagaacaacacaauuuuacgccuuuuuuucuaaaggauuuauuucucagccuccauuuugcauaaauaaguacucuguaaggaugaaguaaauauauaugaauuuaguuguuuggggggaaauacauauauauaaauaauuaguccgucuuuuagucugauagcuugaaacuccauuuuguuuucagucaaaugugagagucuuccuggcaaccccagcuugacccugucuuuggaucuggagcuagaaacccagauuggacaguuggcgugcgugcagucccgagcgcacugccuggcagccccgggcccaugcugccuguggucccugguggcugagucacccugaucacugccucugagggcuguaccgugaacauacccuggaacuuagcagggacacuaaaagggauaaagggagucagucccaaaggcaaucucucaaccuucuuugugccauggaugucuugcacuucucagaauguuuguaaaugcagaacauaaagcauauaggauuccagaguacaucaguuauagugaaaugcuuucuaaagcaaaugcauauauaguaauauaggaaugccuuuauucaugcauuaaauaccaagcucuaguaguagguccaauaaucauuauaauuuugaagcaguaaugagcagaaucaauauuuugagacacugguaacaauauaaugcgucaugaaaauaucugauuucuacuggugacacagucacagguaguaucacugugguauguuccuauuuauaacggaaagaaauguuucauuucagcuagaggauaggauagugagaaugaagaugugcuuuuuuaccauccaaguucagggaccccuggaauuuugaucaucacccagaagauccccaugggguccauugacccauauuaagaaccacucuuugcgggauucauaagaaccacggagucaggauccacuggaaccacugcaguguuguuccuucagccagcuagccugcgagagugguuucugagacucuguagguauggggccuguucucugggugcuagauauaccacaguuccugcccgcauggaacuuccauuccaguggaagaggcugacagcaagcaagcuagaucaugaaaauccagggaaguuagagcauggugaguacugaggagaaaaaugaagccaagaaaaggagaaugaagggucuggaucacagugccuccugagaaaagcuggcauuugagcaaagaccugaaggaggugagggaggcagccagacaggggucuuggaagagcaucccaggcagagggcacagcacacacacaucgugugugugaagugugggaagggcuccacaccacagaggugacagcaggggcaggcacccaguggggcagggccuugccagccacaguaaggacuuccgcuuuuccugugaggugggagccaucugaaggcugaacggaggacggcaccaucccugaaagccuccugcugcuggguacagaggccagaagagguaggaggccacagccauaauccaggaacgaaaugacaauggcguggccuggaugguggcgugugguggugacaaguggucagguucuggauugauggggauuuguggccagaugagacguggcaugucagagggugcagagucaugugugccucagugaccaggcggucuucaggacguucagagugguuugugguugccagucuccuuaauuuccccauuuacaggaggugaacuucuguuugaauuaauaaugccaacauuuauugagcuaacauuuaugaaauuauacauauuauguauucccaugugaacagaugguuuguguucagaugccauugugcagaggaggccacaggacccagggaggauggggaccuugccaaggucccaccggcagcauucagagcucggagccucccgucaguuaguuagccccggagcuuggucuccccggugcggcugccaugauggccaaugcacaggcucggaugagguggcgcccuggccgcccgcccguggcagggauuagaucaggcauggcacaugagugugucuggcaggacguagugggcagucaaaauggcaguuuccugccucccucccuuccaggagccuggggcuugacgcauugccucucccagaacgcuacucacccgacuaggccaggguuuuauucuuuuuucuauuuagauuacucuucggccuccaaccuuauggcagcagagacgacagugucaacacauugaagccuucgugagccauccaguguuugucuccccaggggaagugagauggcuucccugggcugguguucuaugccuuuguguccuggccagggcccaggaccggcugauggcagggacacuuugccgucuuacucauguauugccgugacgcuuaaauacacuuuaucaaccacuaccaguuuuuucuucauauuagggauggcauuggaagaaggaauagauaaguaacguguuugagcaaagaaagaucuacccuauuaaauuguuuuaucugguagggaugguauuuaaauagacugaaaucuuuuuagaaaacucaugcaaagcacauguguagagaacuugaucugauuuacuuggaacauggaaguacuaaggauuucaguagcucugguuucuucgugggguuuuauuugaaggguccuggaagcacuguaugcuggaggcugcuguauuuccugaggagcaaaguggccugagagagagggagcaauguccacaggcaggucugugauuuaggcagacagacggggaaaugucuggggcccagcgggcuuuuccaaguaaucuguuacugucugguauuaggguuagaccauaugaaaugcugcuuuugcagguuaaaaaucagcaauuuuguaugauucaacuugauacauaacucaccccauuucaagacuugagcagcuacaguauuuaugggauuguucauuuaaacagaacuuagaacaauaaauuucuaagaauuuuuacuaauccugcucacagacuaaucuugauucuuguccaugugagcucaauccagagcagucccugaaaggccauagaucuagugcaguuccugccuguggcaguguccacagacacaucccagugucggggucccucguucccuucgugaagagaacagagccaccucuuuucaccacacugggacuccggggcagcaucagccugccuccuucuuugcuaaaaaucacacugugccacaucuuuauccugcccccaaguggagagacgcacaugcuccucccacuuugcuauggcacagcauugucagcucugcagcagccaacauucuaguaagggugugaccccuguucccuacucuucuccuucagauauaauaugauuccguacacuuuauucaagaguucauucuuuacuguccuuccuuuuuugcucuguauuagcugcauuuauguaaauuuuucucccccaaaugacagugcccuuaacuguagaugcuguuaugcauccuuuuccucagcugcucccagcaucuagcagaguacgcgcugucugcccaggguggugaacacccuccaucucugaaguguugcuucugccucugcgucauggacuuuaguuccauauuguugcagcauucgccugucccucccaugccucccaugaccauuuucuucauccagggcugaguuuagagccaggggaucuggcaucaacacccagguggcugugcagggccuccuugaggaaaagggucugcaguauccaccacuuuuagauaccuugcaccucaagcauuggcaaacauggcauucaagaaucguaggugaagaacagaguccacauuggagccaucucucugugaugucccgucagcuucugggcaugggguaggacacaggagaauaacuuguagauuuguuuuucauaaguucacuuugaaugccuuucucuaaaagaaaacuuuuuugagacauggucucacuguguugcccacgcuagagugcaguggugcaaucacaguucacugcagccuugaccucccaggcucaagcgauccuccagccucauccucccaaguaaccaagacuacagacaugcaccaucacacccaucuaguuuuuaauguguuaguagagacggggucucaucacguuguccagacuggccucaaacuccuggguucaaaauauacuccugcaucagcuuccuaaagugcugggauuacaugcaugagccacugcucccagccucuaagaggaauuuuaauauaguccucuacccaaacagaugaaaggcaauggcagacugcuuuaaaacaaacacaucccaugcagaacguggucaucuccuccuggucuucacuucugagcauuuggccaugcugguggccuccgucuguuuuuaguguuaggauaucagaggcucaccugcauccauuucugguuguggcugaaacaguccccugcacagcucacaggggacugagaguguuucugcuugcuuuuaaggugcuuuuuacaaccuuuuccaucucaucaggcuuugaacuuauuaauuuuaaaauccaaggccucguugcugacuguggauuuuagcucugcacuuuucccgggacccccacagaggaacuacuggcauuucccaugaguucccaugagaggccaguguguguggcuaugagcaacuuuuguuugggagagacuaaccauguguauuaaaauuuguuuuauuuuugucuucauuuugcuuuuauacacuuuauuccucacugcuggaccuugcuaaauuacuagagcuuugauuuuucaggggcuuuuucaggcccccagaugaacaagucauggacuucccaguacaucaccaccccuucucccucuuccucccuacuacagagagcuuacaacugcaugccaugucugaguacaaagaacauggccaaaaccuucaucuacauggcuguuaaguauacuuuacuauauaaaauacauaucaugcaguauuuuguuauuugaucuacuuucuguucugauaaauuucggaauuucacugauguauacuggauuuugaaguauuuuagcacuugucuguuguguggugaagcagagaugcuaauccugguccuucgugagcaucgucuucaucucacaaaaacauccagacuaucucauuuaucagcugaccuugucucugugguccuuuggucaaaggucuuugugguccuuuuuaaguaagggcuuauuuuaaaugagcugaguagguuuguuuggggaguacuuauacuuguuggaccucaucugagaaacauuucagccucaugagauaagucaaacuguuggugcagcuugcacagaaaaguacugcguuuuuagguugcauuuguauugauaccuuacaucaaagagcuuauuccuguuuucucacaggcuagcagccucuggagauauccugugccuggcugcagcuucuccaaauccccucagccccuugcaggguuugagugcuccuccuaguuucuuucucucaccucuuuuaagauauuguaugagaagccccucccugcccaaccaccuuuuugggcucugguuaaauuacuagguggaaccauaugaaauugcuaauauugguuugccuaucaccuaaucuugaacucggagccuuaauuucuucagcuauaaagugagaguaacaauacuuucuucauaggauuuugugagaauuauucaagauaauuugggcacacaauugacuggcacauaguaggacugauaauuaugucugaauggagagacaaauggauagaaguguuacuagauguuuguuggcaucacaugaaaugacccaauggcuugccacuaaauuugcauagucauucuuaaaaugcaggcucuuuagaauggggagaauucacuuaggagauucuuggugcucacgagugagccagaugugcaccuccagacagcuggagcggaggcucugcccaugcaccaagugcugcugggcagucagaucaaccagucacuuucacauggacagcuugaggguggacaauugcagaguuggaguauuuaaugauaaugaugauucucccugguaaaaagaggaagcgggcuaguuuuaaaaaauauucagaaaugaggcuauuuggagagauuagaauucauuuuuuuuuucaaaaucauucuaaauaaauaaauaguuuuuuguuuucccauguauguauagcaugguggaauguauuuuccaguguuuccgaauauugaaauagucugcuauuuagucucucucaaagaaucauuaacuuuacaucaagauguucuaaggaaaugcuguggcucuuguuuuuaauuuucuuccacucagggggauuagguggcauuaccaagugauuuaaaaauccagguaggugccuuuaauuugugcugaaaaaauccaaaagcucauuaagugacuugcugaaaugaauauauacggcgcucaccuuugaaaagguuagcaccgucacgagcucagggagccacugcuuggucacucuccacccugcccuuaguuguuuaacccaugguaaucaccugguuugugacacaaggcagcuccuuauaaccagcaaaggagagcccuggcagcccuccacuacaggcacaaugagacagucacagucuuggauccgucucuguagaaaauguaccuacguguuuuauuccauaguggucgggucaucaagggaaaauaaacauagcuuccucucaugaauucugacagugaagacgaucaccagccuuggaacaacggugguuccuauuucacaguccuuacuguuucucgcaccaacugcuucuuuaaaaaauuacaugacuuuaaugaccaaaauauaauuuauuauuaguuacaaguuaacugauguauaacccauuuaucucucccauuaagucugugcaaguaauauuaguggauguuucucauugaagauagccccuacuucaacuuugcauagaggaaaaacccgggacacaggccucuuguagacauuauggcugcauagagaggugcacacaugcuauagaagugacauuuggaaccaucagauaauaauugcauauauuuaugggguacagugugauguugugauacauguauacauugcagguugauuagaucaggcuaaucaacuauuacuucacauacuuacauuuauuuguggugagaacacuuaaaaucugcucccuuugcaauuuugaaaucuauaauacauuauuaccuacagucaccaugcuuaauuuuuuugcauauggccauccucccaucucaaggauaauuuuagaguaauuuauugccaguuugcaaauugugucauacauuuuaaaauuauauaaagccuggugcauguuuaaguuuugguuuucucuugcaucauccauuaaaccugucuggucuuugaaauguccucuaccugccugggauccucucccucugcccagagccacuuuccaaggcuguguccagggcuuucuguacagaucucugugcuguggcacccuuccuucuccccccuccagccucauaccuggcugccagacucaccaccaugcauugucagccugcugucuacccucaggagccuccucgcuucccuaacagcagugucagucuagacuccggccucucuccaguccuacuucuuaaggagcccuguguuccccaguucucugggcauggcuucuugggaaaugccccaugauguuuuccuccugccucccccaucacuccuguucuggccuguguagauuccacucagucucagagcuacgcuucagggggacucgcuccacaaagcccccaaccacaccaaaaggguauagccauuuccuucucaugaugccuugcacauuuguucacaccaccaagaagcccugggaagagugucccaaagucauuccugucauaucaguaguaugcugggagacgauagggaccaugaguuaacgucuuuauguccuccaugaacucacaaaauaauuacuucugauugaaaauauauagaggcauuuaaaaaguucucucgcucauguacuguccuuaaccuuuggggucuacguagaguauauacugagaccaggugaucccagugauguacauacgugauguuucaugaaaacagugagaucuugugucugcuaucaacauacagacacagggaacuccgaaagguaaaggcaguagagaaauacaaaggaaauuucucaagugacauuuuuaauauucacuggagaugagugaaaacaguugaaacaucagucuacaaaguaaaucaccaguauacuugaucaggaucagaaccugcuauagguagaggcaaguuuccaucauguacaaugacuacucuccuuaucacuggucccuguguuucuguuuuuaauugagaaaaacacuucucaugaaauauucccccaccuguuggaggaagcauucaggccaugggacaaggaggugauguggcccuuucccauaaagggaaagaucuugcugcccuaggccuccacagggcccacaacuuugagccagaugccuggccacgguagucagugauugaguggcacugagauccaggccugcccuugugucccuacucuggaaugccagggcucuacuccacguugcuguuuugccagcugcucccuguuagguuccacugaccgggugccacuagguccagcagcugcugcugugaucuugaacaggcacaccuguggcaucauuccccucacugcagcaugguccugcagaucagcccugaaccccucuuucacagaugaggggaugcagguucugcagggcaaacuaguugccugaggucacagggccaggacucagaggagucugcaucugaacucagggcuuugacuucaacccugcuaucugugaugacacaugaaauaucaggccugaauuucuaccuucuuuuuuguucagagucauugcacaggugcuucuacccucuucaggguuuuugaaugacaccaaguggcacauaauuaaaaauaaggauuuaucagaaaugguucacccccuuggaagauagcaaugaaagaaugacaguucauuccuguuccucucaguguuuugauuauggugcaaaaggccuuuaccgugagacgcucugcucuccaguguugaagcaugucacgacuucagaagccacaucuggcaccaaauucauucucucuuugaaaauguccauucaaaauaauuaagaaaacuuuagaauuuuguacugauugucuucaaaauaucacuggaaauaauugcagaaagauaauuuuuuguguaaaugaggucauguaaauuuuucaaaucuugcugcaugaaggaaagaaucaaauuaauguaguuuauuccucuaaauuguagcuucuuaugacaauuguacagauaaugauuuagcuagaaagucaccauuuauuccagauuagcuauaaaaauggccaguuuugugcuacucuugguucuggggggagaaagaagaaucuaauuuaucuauccuuauucuuccuguuagcaccaaacaacaauguuuguggauuaauuuagcacugaacauugcaagcaucuuaaauaaguuugaaagauuaaacugagacagcauaagggaguaggaagaggccagcauguguaacagaucgcccuggguuugaguuucagcccugcucauugcuagcuggguggucucagagcaucacuuuuguugccugucucugcuuuaucauaugugguuugaguuuugcaggaggacccaaugggcucuuggcuacaaagagcuucaugaguggcagccaacugcaccaacauuggguagcuuguuuuuauuucauagagauugucucuuuuauucuaagugagauguugccccaacagaacucaggcuaauuauaguguaaucucacuaugauggguuuuagaauccuccaauauacuauaauacucaguacaacauuugaauauuauaggaucaaagauuuagaggagggcugagaugcaaggaaguacuuuccuuacaucugaggagagaauaauggauauguaggaggcacuuaguaaauaucagauggaaggguuggugaguagaugggugaauggguggguggguggguggauggauggauggauggaugggugggugggugaauagauggguggcaggcacaauaaugggaagaaaugagggauugagagaagaugaaccugggcucucugauguggaugggccaccacauuugggaucauguccagccuccuggccuugagaccagugauacaauucugccucacauaugaauugugaggaucaucuccauggcucuucaaauaaaauacaaaauggcuccaaaggacauuuuccucaucugggucaugucucaugccauuaauauaaaacugcugauuuaauggagcugcuuuugaucuaucaagaaaagacguaccgaauucaauuuggcuauuuuuuuuucuaagaguaagugucuuaauuugcaagagaaugauuugauuauaauuuuaaguaauacugcaguuauauuuuuagucacgaagaugauaucaagugacucuaugaggcuuaaauguggaaagucccagagaauuguguggguugggaauuuuaucuuuaacagcacugggggcuguuucuguuauuuguauauuuuaugaguuuaggcagaauagaugggaucuguuacaaggaauuuugcauauaaaauauaaaagcagacaguuuucauugaagaguaaaguagaauuaucccagaauauaaagacauaaaaaguuaagauaaacacccaucauuuuuuucugaaauuuuauuuuuaaagcauguguuauuaugagagaauuucuaauucugaucucucuucugacugcagcagacuuuuuaaccugaauuccuucugccuuacucuuaaaaguugaaaagauuuagguacucagagguaccugcugaaauggaguagaaauguugaaucuguuguucaaaugucagauucaggaaggaccaaguaucugcucugcacuugaugauauauguuguccagcuacaaaagaaaacaccccuuacaaaaaaaaaaaaucuuuuuucccuugcacaauccauccugggccagauauagucauagcucaauagaaaauugcuuuccuguuacuggcaaccugugcggucacugguaugacagugccucacgucaaauugcaagccgaggggccacugcagcaggugcaugguaacggugcccaggagcacuggaggacaugaaggacacacaaggcacccagugcuguacaccaccacuugaaacggggcaccaggaccaggggcaggaagacagcagccccugggcuagccggucggagggaguucuaaugaagggaugagugacaggggaagagacaucugcaugaauaagugcaggacgcagggcugaugugcugugcugcagacgcucccaccccgcaagcagaauggcacacagaugggauuuagugaaacugucacucccgccucugcucuaacccacagggauuucucucacuggcuuguaagagccaaaaauacuugaaaugcaaguauugaaguuuaauuugcaggagaaaacacaguaaguuuucuuucaccugaaguuguuggauaauagagucccaacuggagagaguggaagaagggcuacaauuuacuccuucagcuuucuaugaaaacagcagugaguagauggaacugggucuucugcuaguuuuggccucacuagucuuuucucuuguugggagaauucugaucauaagaggcagggccgugacugagagccaggcucucaagucaggcugcugguagcaucugagagagguggaacagaacacuuuuccucacugcucuucaauuuccuccucuacaaaaaaauuaggauaguacaaaccacagaaggaaguugugaggauuaaaugagauagagccuauaaaacuucaacccauuaaaagcacuugaucauuuucauuggcaucuuuauuuaaauguaaucuuugguugaugcagcaucagcagaggugccuggccgggggcucacuuaugcucaggauguagucugauucaccugcugcagacgccacaccugaagggcugucagaacagggacuuuuuccuuugaggugcauucguaaaagggcaucccguaugcuguguguugcugaugaucucugagauuaugucagugacgaugccugaacuucacacuugagcccuguugcuucuuaagccuuccucuaagaucauuacaguguuucccuuccucaccccuaagcagaagcaucacagggcuguaugaccaccuugugggguucucagcccagugcccuucagccagagacucguuagcaaacagguggcuucacuaccccacucaaacacguagaccuucaucaagacucauuauuuucaacagagcuauauguguauauuuuuuucuuuacacagccuagaaccagauuagcagaagguguagaacaguacaauugagccuguuaugaaaccagaguaagucauuccagcagccccugggaauuuucaugaccaaucuugacagcaaacauaaaaauuucaaaccacacuauguaagucacuuauauauacuuccugaucaucuuuauuuuuuuuaaccuaacagugaaccaaauguuagaacagauguaaaaggaguaaaagaguugcuuuugcccuguggcugcucaaaacuacuuuccauaacauuaaugagacccauauucuccacgcucaucuggucauucugguuugcacaggaccagugucuguugaggggcccagccaugccuacagauggagcagcucuucagagugcugcagauaaagacaugcuccagggccguuuguugugauggcucaacccuuguguccacuuaguguagcuucuuccuaagugagccaguugcaucacaugcuguuauuaauagccagaaaucaguugcuuuuaauauuaacuggccaacauacuuuugcuacuucugaucaugagggagcuuuguguuauuagaauucccccaaauuuccagugagguuucaauaauuguggcauuauuuuuuuugcucugauaggucugugggguguauugaguuucaagugugggucagcaguaauauuuaucacucaggugugcuuugcaacccagcguaccacucaagcagucugaaucggccaggaaggccgcuuggcaaccuucacaucagcuucuuuccucauuuuguaagucacuuucauuugguaaaccccuaacuuuucuuggaguuucuucuugacaucugauaacuugguaucagaugaauaucuuccuggaaaacugagaugccuuuaagcuauuaaaauuauuucauagaagcauagaaauacuauuuucugcuuccagagguagugauauuuauuauuuuaaaacgcacagaagaaaaaacaaauaaagcuaaacuuuuguaaauaccaugaaaaggaauuauuuccccaaaauugcuuucagaaaugaaaaacgaagaaaaucuguacacaacuuggugcaaauacuuuggaccacaaaauucaguugugucgugccugagccuagucugauuucacgugggccuaagagauuguuuauagguaacaauuaagaaugucucaaaggaauggauaaccagaguaucugcuauagauguuuucuuauacuugucaguuucauuuacuuguuaucuaucguauaucauauaucaugauccuauuuaauuucuagaaucaaccuagauaugaacuauucuguaggccaaaugaaagucgcuuuugccuucaaaauagaauggucgaagaguaaacauuggauaauucaauucaaauuauguugcacuaaauaguaccuguaacguauuuuauuuaauaauauuuuuuucucuuagagucagugaugauagaaacagaguuuacaauucauguguguugcucuuuaauugucuacucuuuuuauacuuugccacaaacaggauuuaagacauuuagaggcaguucugcauuucuucuuuuuuuuuuuuaauuauacuuuaaguuuuaggguacaugugcacaacgugcagauuaguuacauauguauauaugugccauguuggugugcugcacccauuaacucaucauuuaacauuaggucaguucugcauuucuaauuauuuuccguuuuguugucacuucauggauauuaaaugccccaaaaaugucagcagugguccuuucuauauuaagguugggaguacauuuuuuagcuucuaacauaugaugucuuuaggacgagugaaaaucugugaaagagaaacacgguucaagugacauugacucccuuccucccagaaaucaaguuauuggcgucagcauggcagaacucagggcuucuauuguucauauugauucgucacuuuuucugucguuuucaucauugaaguagccuguugaaucuuuucucacucaauuugacagcacuuucucuagacuugaaauaggcugaaugacgaauuuucuugucacuuacauuuuuacugaugugagacuuugagcgacggugucacggggcauuuucucacuuggugauuugcagaaggugaggugcacugggagaauuggagaagauggaaauggaaaaugcuauaauuaaggaugugcuccuucacaaaucaauccccugggaagaacugauuugaacauuucuaauaacagcauaguccaaauccguugcauguguggagcgccucggauucuaggagggagaccuucagcucccuaugccggaaggacauaggaauaugagaacagaccaucuccaaaagucuguaauuuaauagccugaagaaaaucuuuuucucauuuccauuugcucuuaucauuuccucagaauuauucuuaaacuugguuauaugguauuuucuucuuuuugagcaguaguggacuguuucucuccaggaguguaucauuaggguuugaaacuuaaucuaauaucuuauaccuccauguguuuaauuuccuuuuccaaaacauccauuuuauuugguuacauuguugaguaaagucauccucuuuaccuguuaccaggcugugacauuuacuuucaaugauucauuuauuuguggccuuaaacaguccuagaauuuaaauuuacauuauauugaaagagagauaaaaucuugugaaaaugauguauggcuuuaggauguaacuggcaucuguuccugucuugcucauuauggaauuuuauccauuuguuuaguuauuaaaugcgaccugagcccaccuguggagcaugugccuuugaggcagguaccagggaagugcaugggagcugaggcucugcaggaacccugcugcuccuccuuccagaugcuucucccuaggaucugggaaauggcugucucccgcucccuccauaucccuugacuguucuuucacuucugcccacccucuggugggggugggggugguucccuaacauugcauucuccccuuuucuccuucaagcucaucuccaaacccaugacucagcucuucagcucuggccaggccucucugcugagucccagucagcacuucccugaaguugucccccaggaaucccuugggcucuucagacuccuccacucaacccugcccuccuccucaggucccuuuuugucccacccuccuggucacuuacaccuugaucccaggguuauguccagaauccaucuccaucucuuaccauuggugagcaccccaaguccagcugggucugcccugcauugugccgcuuccuccccugcauugucucccugccccauuaucucucaggcauagaucagguccugcuguucaucuguuuuaaaaccuucggagauuccaaguugccacaggcugguguugcuucuucccuucuguaaccagcccauugcagucugacgaagacccacuccucauucccaugaaucgcuccacccaccagcuuccuagagcucguuguccacuugucuuuccauauaagcugugaaugcugugaaggacaagacuaugucuuuuucauccuccagcugcuagaacagucgcggcacauggucuucugcucuuccugugucuuccaugcuuaaaugauucagccacuaucugccuggagggcuuuugcugugccaggccauccugccauuuguucucucauguguucagugaagaucuuuuuauuagcaggccuuccucacaguacauagugugcacugcguaccacuaggcauuuuggggggcauuuuuuuuuugagacagggucucauucugucgcccagacuggagugcaaugccaugaucagaacucacugcagccucaacuucccaggcucaagcgauccucucaccucagccuccugaccagcuggaaccacaggcacgugccauuagagacagggucucacuauguugcccaggcuagucucaaacuccuggccccaagcgauuuucccaccuuagucuccaaagugcuggggauuacaggggugagccauugcacccagccugggggcauuuauuuuauugagauauaauucacagaccauagcguucacccuuuuaaaauguauaauacaaugguuuuuuguauauucacugaguuaugcaaccauugccacuuccaauuccacaacauuuuuaucaccccaaaaagaaacugaaugcccauuaacugucaugccacauucuccccugccucuggccccaagcagccacugauuuccuuucugucuguauuaauuugcuuauucuggacauuuauauuaaugaagucccacgauauaugggcuuuggcaucugacuucuuucacuuagcauaguguuugcaaaguccauccgugucacagcagguaucaauacuucauuccuuuuuauggcugaauaauauuuuauuauauguuauauuacauuuuguuuauccauucaucaguuugcaggcaaggggguuguuucugguuuuuggcuguaaauaauaaugcuccuaugaacauuuguuggcaaguuuuuaugugaacauauauuuucaguucucuuggguauugaacuucuaggaguagaauugcuggauaauauguuaacuuuuugaggaacugccaaacuguuuuccacaguggcugcacuuuguuuguuuguuuguuuguuuguuuauuuuugagacagaguuucgcucuuguugcccaggcuggaaugcaauggugugaucuuggcucacugcaaccuccgccucccggguucaagcaauucuccugccucagccucccgaguagcugggguuacaggcauggaccaucacacccagcuaauuuuguauuuuuaguagagacaggguuucuccacguuggucaggcuggucucgaacuccugaccucaggugauccgcccaccucagccuuccaaagugcugggauuacaggcgugagccacugcgccuggccuguggccacacuuuauauuccuaccagcaagguaugaggauuccaauuucuccacaucuucucaucguccucacugguuauuacugucgcuuguccuuuugauuauagucauccuaguagacgugaggucguaucuuauuauaguuuucauuuccauuucccuaaugacuugugguguugagcaucuuuucauguguuuacuggccauuuacauaucuucuuuggauaaaugucuaugcacauccaucccuugcccauuuuuaaacuugguugucuuuauuguugaucugugagaguucuuuauauauuugagauacaagauccuuaucacuuaaaugguuugcagauguuuucuccuauucuguguguugccucuucacuuucuuucaucacuacucaaaacauugcucaaaaaugaaaacguguuauuuucuugugcauccucuauaccaaaagcggccaguaguggggagcagcagaagaaaucagcuaauuaauuuccuaguuuuguaaaauauucuuagccauuccuucucugagcucagacucugccacaguagggucuuuuuuuuacuagguuuaaaacgcauccguggguguauuucacacauucgaaacaggguacuauuccucaauccacagcugcuguuaacucaucucauuuuuauaaguaucugugagcccaguaucuguccugugggagggucgugccugccuccuuguguguagugccucauucucugccucaccggagagccugcuucugcuccauuuccucuucccuccacgccagggugugugugucacccagcauggcccucucucugccaugccauaguccuuccugguuaugcuuaaggucauucucagaaguucuggucauuucaagccugcaaguagcauucuuaccucuuccacaugcccaaaaguuguaugucauccacuucugaaaaaugcaaagaauaaguaagguauugaaauauuuggacaagcccauugauugaacguauagaugccagucagccuugaccucuuccaaacuagaggacacucaggacccuccuuaguggugcaguuccucuaagggcaauauagcaacuuaagugacaucauguugcuuccuugccucaagccauucgggccuccugugcccaggcccagcuugucuuucagcugcaccuccugccacccucuuacuaccccaugacuccagucuccuuucuccuccugaaguaucccaacuuccuucccgcucauggcauucucugugcccgaacugcucuuacacuccuuaccccacuucaucccugcuugguuagcugcuucccucccaucagagacuucuuugagcuuaucucccucuuuccuuccugguacugacauaaugacaguuugccuuauucccuggacuuguccuuuaacuaguguucggucugccucccugcuagaaugcaggauugcugguggcaggagcgacaucuaucuuguuccuugauuacaugcccauuaccuagcacaggggggcacucaauacauaucucuugaauggaugagcgcuugaaugaagguggauuugcuuuuugaaaauagcacagccacuugagauccaguucucugagcagacuaggauaauguauagaaaucuaugcuuaagccuaugaauauauguaguauucugaccauucucagauucagcugguuuugucauucuuaaugcauaguaauucuaacaacaguaauuuuguagaaauacauuuuuauuuuuuggagcauuaucccccuccccuacagguggcauucguauccauguuugauuugagcuuuuugaaucccuucugucagaguuccccacaacuuucugaaaauuuugagcucugacauucuggucuauuucugaaaugaaaucccuaaaaauaguacugucucuuuucugcuuucucugugucugagucaaauggacuucuuugugaucaucgucaacucuaacacccaaacauagaccuuuuauaucaaccuucgacuugaagcucauucuguccuucugaugggugagaaaagauucauuugauuagugcuguuucauucuggccaaauugcccauuuuuauuaugaaauauuuauauagacuagaagacaugucauuuacauacguucuaaggaacacuaaaacacgucccgguacugacacccacuugcaccagccaauauauuucagaaccucccagguacaaccccuccacaccccagagguaaucccagguuauuauuuccuugcucuuuaucauuuccuacauauguguguagcccuaagcaauauguuucacuuaaccuguuuuuaaaauauauauaggccagguaagguggcuuaggccuguaaucccagcacucugggaggcugagguggaaggaucacuugaggccaggaguucaagaccagccuaggcaacauagcgagaccucauugcuagaaaauauuuuaaaaauuagccaggcauggugacgcaugucuguagucccagcuacuugggaggcugaggugggaggauugcuugaguccaggacuucaagguggcaguaagcuaugauggcuccacugcacuccauacuaggugacacagugagacccugucuauaaauaaauaaauaaauaauguauagcaauagaauugcacucaauguguccuucggugacuggcuuuuuugguugagcaugguuuucaguuuuauccuuauuaauacacaugccuauaguucauuuauuuucacugcuauauaauaucccauugugugacugcauuuauccaugaauguuaaaaauaguuuccuuuuccuuuuuugcuguugccuguaacauguuauaaucauucugaaccaagcacauauguaccagagcucauauacugaggagcggaauugccagccugcaagcacgcacgucuguucuucccuggauaaggucagauugcucucccaagaagccaggccaguuccucccagcagcagguucuuggggcuccugugacccauguccugucugacauuuggcauuauuacauauucuguguuuggccacucugggauauauaagaugguauuuuguuguaauucucauaaucccugaucauuaaugguacugagcaacuuaauugccagucaugguuuaucucuugguugcccaucuuucuaguagguuauuugacuuucucuuauggauuugcucggcguucuucuuauauucuggcaccuaccccuugccagcucugagucgcagaugcuuccucccacguugugccuaguaguucuaccuucuuuacaguauugugguaaacaggagcucuuacuuugaauguggucagauguaccagucucuucucccugugguucauguuuugguuucuuaagagauuuuccauaccccaaggucauaaagaguuugcccccauacauuccucuaaaaguuuuuaucacgcaguuuucuaaaucuguguauaauuuuacuucaaauugaacucucuaaccucuccuuacaaguugcuauugccuagaauauaucuagcugucucauagcuuaaagcaauggacacgaauuucaggccuucauuuauucauucaguaaauauuauguggggugcuuuuaagcuagauuguaugagugacguaagagaauaaauuucucuugacauaaauuugaugaaccugacucauaugguguccucaaggaguuuauugaaguaaaccauggucccaaaaaaccauaugucugugucccaguuccuggaaccugugaauguuaacuauuugacucaaggcugugugcugauauaaguuaaggaucuugaaaugaggagaucauucuggguuauccaggagagcaguaaauccagugaggaguguccuuuaugagagacacauagaauaggaagaggccauguagccauggaagcaaagaggagagucaugcagccccgugaaugcagacagccaccuggaacuggaagaagcaugaacaaaaucucuccugcagccucugcugucgucuugauuuuggaccuguggccucccaaaacuagugagagaauaaauuucuguuguuuuaagccacccaguugguggucauuuccagcagccacagaaaacuaacauaaggaggcuuaagauggucauacgugguagcuauuuagccagagguuuucaaccuuuuacacacccuaauguacucaagggauggaacaguggcagcagaacucgggggcgccagaacuuuugagagggaugcguggauggcugaagcgucccaggugguucugaaacaugacauucccuccucugcagaucacugccaugggaguuagagucaugagaauggcuagcucugggcuugcuugugccagugauuagaggcugcaugaguucagaaagaaaacugagguggguacgcaaacuguuacagcacacacacacugaugucaggaggcugccuguguccggggccacuuugccagucugagcgucauguccacucuugggaaauuuagagaagguucaggcaagaaggguuucaaggguugaaaaaauacagucugcaacauagccucuuacagacaguucucuuuauuucuuugauaaaagaagcuugauagugcuaaacaacagucaacaaacacauagcccgaaugaguaaaaagaaauuaaaauggaauaauuguuguuuuguuguauuuuauaaagucagcaugaucuggguauagaugcagcuuacacauacgcacucagguuuacguugcggguugguuauuauagcucacguauauuuaagucaguugauuugucucauuuggaguuuaguucccauccucacacaugaucuugaacuuaacaccauuuauucuagaauucaagauauuagaugaaagcaguaaagguuagaggaccugggcuguagccuuaauuccauuacugugugacugugauucaagaaaauuucuugaacucucugagcucucauuaccugaucaguaaaauggagaccacaggacuucccugcucaugaggguguagccuaaaggggguuugcuugccauggagccugacacagaacucuccuccagcuuaccuacuacauucuuucugcaacaaaacccuaggcccacaugguagaggcagggaggagucaauccagauuuaucaugcuuuucuuuuugugcuggaacccagguagaugcuucauauauaggauucuauuuaaucuucccagccguccugagaacaggcguuguuguccccauuuuacauuuaguaggacaacugaggcuggagucggaaccacuugccucagcugucucacauguaaaauggggacaucaacaccuagcagggaaaagggcagcugagauucaaacccugccuuccuuccaccaaaauacaagcuccuuccugacugucaugcugcuacugucauuucuaaaaccuaaaacaaacaauaaugagaguaaaguugggggacagguucagauucucagauucuuacagcucugcagauucagcagggugugucuugagagucucgagaaguucucuuggaaauuuuugauaaaauguaaccaguaaaggcguauaaccucuuuaguaaaguagaggaauauuauccauuuuuuuauuuuuuauucuagagacagaaucuugcuauguugcccaggcuggacucaaacucuugggcucaagugauccucccaccucagccuccugagucacugggacuacaggccugucucuuaaucaaaauucuugauaaaaauucauaugugaaaaugugaacagaaugaguggcuaaagaaacugagaaauguccagaagccaagauggguuucuggucaguaauuugaauguucccugaauugaguaauccaggggaaaacugcucuuuaaaaaaguacuuuguuguguguggcuuuucaugagauaauaauucagaacagaauuaaaaguuacacauuuguuaguaaacuuuuuaagggaacaaaagggccauggcuaguauugaaacagggaucggauuggugaccuggugccucuuucagugaaaggucuuugaccguccagggaucagcauuauuucagcauucacuuaacauuuuaacaugucuuacaugugaaaagcuuacaagcauuuugaugucuagauuauaaaugcccuuuguuauagaaagcaaccagcauugaagcccuaaggauauuagauaagaaaaugucagaugauacugcuccaaauugcccuugcaauuaauucaguuaagaucccagcgcuguguuuuuuauggcuacuaaaagaaaugauuuuuggcacccacaagcuccuuggcuguuucuaaacgcugccagagcuaaggggauauuuguuuucucuuugucaggguguuuacaugcccuggcuugggccaugagcgaaaauguauuugaugaucuccuggucucaccccaaucccuaauggauguuugucuaaaugacagcacccaguuuagcacuguuaacacuccaguuagugggcgggagagugugggcugugugugacagucgggggcaugcauggcagggucaggaaccuucuaugaaggaaacacuugcuccuccaggauccaguucuggaagcaccuuuauguuuucugucuccuacugccuuaauuuaggagucagaccauaaauauucauugaaucagagaaucucacaacuucauuauuacuccucuaaauauagugcuggacuuccucuaaggugcccagaucucucagccuugacaaggacaagcuuaugacaagaacaagcuuaugauagugccauccaggauugggacggugggcugccgucuggggucaguucaucugguauuaugcaaaacgucccuuuguagguuugaucaugagcuugauuaacauagccagccacuuuccagauacguggcuuccgcagaguaguuagcaaaaugcgcacgcauuuccuuuuuguucaccauugucccaagcacuguauguggauguguuggacgcaguggggccuuugaggaaacagcaggacgaugcuaggcagagcaugacaggucuuuagagggacgugcuugcucuaacccaggcccacaagcagacgauggacugaaagggggagccaugaauugagcguugacagcgggccacggcgguccaaaggcucaggugguugucagccauaaguuuagcucagcucuuugaguaauuugucacgccucgcucagccccugcugggccagcacgugccagcuuagugucagagugccuguucgccagacggccacucaggccuaacguccugcuguuccccggaccagcggcuugcuggggccaugcacggagggccgagccguggcgacagccaagugcugugcagaauaaguguguucauaaugagacgugaauggcauuagugggucccucuagaauugggccugagcaggcgccucucgcugaggaaguuuggcagccuguucauuaaggcgagucaccaggaguucagcccacagucaagaagccaguucaggcucaugcugcccaggccuugggcgguugugcccaucuauauaaaagaucauaaaucauuagaggggccacuuuggaaaucuucaaacacauuuuccuugcuugagguuguauagaacaaacuuacggagaaauucuggcagcacgcuguccaguagugcuuuccacggugacaggcacauccuguaucugugcgauccaguauagaaccccuagccacgugcggcuauugagugcuuaaaauauagcaagguggggggaggggcaaagcaacugaauuuuagcucuuuacuuuaauuaauucagauuuaaaaugagauauccacguguggcuuguggcuacuguaugggauagcacagcccuagaaugccucuggucuccucacgguaugaaaauuauccucugaauauaacugaaggaguagggagaggaagagccugcauuuagagaucggugugcacacuuugccauaagaaagcagaaaaguauuugaccauuuaaaaacacgugcugucuugaaggcugauugaaaggacauaauugucaccaacuuguauuuuuaaagaggccauuuugaaaagauaguuugaaaauguagugagaaaugcuagaguuacuuuuccucuucuggagcugccaauaauaaacugauggugauccgcauucccuguguucccggagaauuagcaugauuuucaaaacgacugaaacaugucuuuuaacuuuugcauugauaaugaggaaggggaaaaugagacgucaugcggacuuccccaaguguuaauucauaacgucguaugugcagugccuccauccauugugggauuguucugacguuauccuguuauuggaagugcaugauucaccuucuaaggaaacagaagccacacacaaaaggggaagauuugcuuucugcccugugaaagccugccacacgcagggguccuauuaagacagcuggaaaguugcuucaguguguuacgcuuguaaguuuuauuggugacugguuuuugauuacacauuugaaugcuguguguuccagacugcaguuuuaauuaaaaggcaguagucuuuuuuuuuuaaauugcacugugcacucuugguagauucucucacauaguaguucuuauuuuccaauguucacagcuugucuugguuagaggcucugaugcccccucagaaucuaucuuccuagccuucucucuucccaguaacuugcaucuucuuauuuuuaagaagcgucugcacugucguaucaccaaguugcuugaaguaucaacucauaugucaguaggcuaagaauguuuuauccacugaaauaggauguaaaagaucuaccacugucaguggaaagagaugcuauugcaaucaguaucuccuguuuuuguuuaaaucgacccuaaugaucuuaugauguuauucuguaacuguugcuuuacauguuuuuuaguguuauuaguauuuaaugcaauuaaagucuaagagaaacuuaggucucaaaaccagaauuuggguaugaauuaugacuaauacuuaauuuucugcaagaugguaaagaaccugcaggauacuuuuuuacacagaaaaaauugcacaacgguauuaaaagugaauucugucacugcucugcaugccacuuugcacgugcacuuguuuccuuaaccgauuaccgcagcuaugaagagcgagcucuguaucucgaagcaauaauucagaaccaccgcgaaguaaugacauucgaggauuucgcagcccaagucuuuucucccucucccagcuacucccucagcggaacgggugagugucuacauuauucuucucucacgcgcuuaagacgcauucgagcagcagauguacaccuguuuuucacagauaaaugcuuugcaaauuuaagaagagcauucucccucugaaucaacuaaugaauaucaaaaggaaugaugacauucauuuuaauuuguuuuguauucgagcuguucacucaguuccuuucuucagcuauccuguuaaccuucaaaucuagcaagguuaaugaacuuuuucucaguaaugugcuccgguucauucaggaguguggguuucuugcugagcugggaauaugcuguuuaaaagcgaugcccgaaucagugcuuacuuaucaaaaaagaguuccucacaguggaagccguugcuacuaaugcuaaauggggauuaugcugccgagauucgaaggucagggauuaaugcaggagacauggaaggacagugucccgggguccaucauuacagcagugcagugugcgugucucucuggagugguuugugucauguggacaagccgccgaccggagcagcaccugguguggaacccguuuagaaacuagcuuacaauaauuuucauuuauuagggccaguggaaaauugugaaaguuuccauagauuuccuuguuuuuagguuuuuauucuuuuuauauuuccaguuuggggggaaaaauacauguauugccacuuaaacagauuaugugauuacuguguguuucuuucaaauaauagaauuauuacuuguaaauuucugcauauaauuacagauuaauugccuuucagagaauaaaugggauauuuagccaaugcauguugagauucucagugaggagcuuccuucuucuuccacugcuuuaaaugaaacuguuagagugcuuaauagauuucuaaccugugucaauugucucugaacacugccuuacuucuccuauucugacuuguuaacaaauaucuuauacacaaagugaaaaaaaauuaaauccagugaaauaaaucacuuacaaauaaaaucagccaugcaucauuguuuaacaucgcuggccucaauccuugccucucagagcuuuguugggagauaagagggagaggcacgcacuugcgcagggagccaggagcagcaggcagaaggcuugggagauaagcaggcuggcagaggugcaggagcagcgugauuugcauaaucacgccucugcuuccuggugaggcgucaaggaacacugggauggccucuauugaucuuuguugaacuggaauacuaagcaacaugagaaaagcuuauaacuuaaagcuuugauuaauguuucuuacauuaaaaaaguggaacagcugugaauugaauucuuuuauacacucugccaacauucuaucuaagacaaaaacaaauucguuucaagggaaaugaagauuucauacucggucuggcuagagauuuuaaaucguuucuaauuuuucagugaaagaacaugagggaucuguagcaaagcuaauuuuaaaaagaucucauucagcuuuuucccacccucaugagauuauuccccucuucgugaggacuugauuuuucagugcagguuguuuuuuguuuuuuguuuguuuguuuaacucuugagaaagcuuuuuacuucuuaaaauuaaacacguaaauaauaacuagauguuuucauuccuuaacuguuacauucuuaagauuauuaagauauuaucaaaaugaauaaugauggacuuuguuuucuauguauauuuuagccucuguauaaacuaauuugaucuuuuccaaacauccauaauuauuuaaaccaauagaaaugagugagauucuaggagcaauuugaguuuuuaagaacucuacuuggagaggauugucaauaggcuucuucaagaacgucauauuuuugaaaauugcuuagcagaaugaagauucugacagcaugugagggugggcauuggaacucuucuaaaaggaacgugaaaccaaacauggaauaucaagacaaaugcuacucccuccgcuuuucaaauuauuaacaucaguauuacauuucauaguguucaugguuuaaggaauucaguguugagugggaaacauuuuuauacgucuaucaugccuauccuuaagugugauuuuuaagucuaggcauaauguucuguuuuaauucuuugcauaucuucucauaacgcugaguaggaaugaacuagauauaaucuugauuugaacugaaauguggggcaguacaaugaggacagagcauuucagcaccauagacaagcacguuuucggaagcaucuucuagcuuacauacuggcuucgcuuuugaggaaucccuguccacuaucuguuacuacuucuacagaugaaaacauuugucauuuguuuacacuguuauguucuugggacaagggcgaucaaacccagaugagccagccagcuuaaacuaagaaauugaggugaagucuguucuuccaagcaacaagccaacuggaaaaauugacccugagcggcuuaagcucccacagugcacuuaggacccaaucagaccaucucuggcccucagugucaucaaagcagggccuugggcuugggcucacaugcguaugcacaaucugaggaauuaggggcuccuagguuuucuuuguauccucaccaccaggacuuuauuauuaaugaagagggagcaucaccugaacacugcauucauucugcacuguauugguagcagcaagccagaaagcagcaugcagcccccacuucuagagggaaagccccaaaaucagccuuuaagucugaaguaaaagugggagaugcacucggugggaauggccugugccugaagcuuccacuguuggaaaaugcccucugcuucugacucuccccauccaggugcuguuacccauccgcccaacaagcccugcggggguggguuggccaggugaacaggcuugcguucaggaugcgccgucaaccacacauggugguguagcugcuaauauaugagcgcucggcauuuuucaaagagcuuucaaaacaaaaucuauuuuccuaaugagaaaauauuuuuaaagaccaucguaucuaccuuguaucuauuccauccauuacuuguauugauaacaccugacauguaaagauauuucaacuacuuuuuuaccuagcacuauaguuuaccuuccuuuuuugaccagcauuaaauaaucuaaaauguagccaguauuaaaauauugguugcaauuaacauauauauguuuuauguauaaauacauuuauauacacauauacauuucucucucacacacacacacauauuggggugggggacuaaauuugugcuuucaaucauaucaccaagaaagagggaccggcagagaggccuugaaaggguuaacuggaaugggcacccucgacugcugggagggacugauguaaucacugcagcucacagccaagugcaucuguucaccaugaggucauucuucugcaugcuaaugauuuggaaaaucaagucuaguguuugacauuaucagaaaagauauaaauaguguaaaucuuugcuuuuuagaaguugcucuuauaaaagagaaaaaaaggaacuuuacauuggaccugagauuuuuuucagaacugccuuaaagauugugucuggaucuaaaaauuuuggaggaauccacuugugucuguugaucaaucaauccccagaucacuauuacggucacagcuagcaaucugguagccaagggcuacagguaugucucauuuaauaucuaauuuuaagaauuuccaagugccuuugucagaaguugauagauuuuucucaaagaauguucaaaaccaaguuaaaugagugguucuucucggaauacccaaacugacuuguguuugcugaagaugccaauacuacguaugguuccuuucugcuucaauauugcuauagagagccagcagagggagcacaggucuuuguuuauuuguuagcccugcauaaacacagcauuugauuucuccaagauauggucagaaauacuuccuccuuuaugauaggcuggauugucaaggcuccaggauuuagaacaagugggagaaaauuccucacuaugcuucaucagagucugccacuuuuaauguaggucguauuuggagcuuaaaccagauuagucugagucggucuuaggaugccacugccauuccugcuacugcacaaaacugcaaacuuucaucuuucacacaauugcuuggaugcccucguggaaaggguuauuauugccacuuaccuaaugaaaaagacuucuguagcuuuucuucuacaacacagucguuauguuaaguuugcagaaccuuugccagaagacucugccuggugucacugagucauuuugguggccaauaaaaucuucuccuaaaacugcagauggaggcacuuauguuacacauucgccccaaagcaaaucugagauguagacacuacacaaacuccucuuagaacucaccagccuuugcccagagggauauggcuacacccagcuuuugcuugcuaaggccuccgcgccauaugcagcucgucauuccgcaugcaguccugacaggcagucuuccuuggccguuucacugggcaguuaauaaucaaguuaauucccagaaacagcacaaguaaauccuaacccaaaccaccaaaaagaguuuccccgcucauugaaaggauagucaugugacagacucaucacauucauauucauucccucccuguuaaaguggucuuaauacgguuuuaauuaauagugcuucuuuugaauuguauguguucagcuuccccauaacuuugcugaagccagcaaagaacaucauagaauguugaacuagaagggacuucaggaaagaucaugucuaacccugucacauuaauuuggagcaagcugaagaccaacccaggaagggaccaccgaaggucaugggcaaguuggaaucagugccaacucaaucuucaccuccccauuucacauggaaaugccagcccugugcccacccuauagugauaaucccauaaucagagccguagcuaccagcucuuuauucauacuaaaggccagagucaaauuuuacucuauucagauaauacagaaguuuucccuuuuggucucacucugucgcccaggccuggauugcauuggugugagcacagcccacugcauccuucccgucccaggcucgagcaauccucuagccucagccuccugaguagcuggaacuacaggcauaagccaccacaugcagcuaauuucuguauuucuuauagagacagggguucaccauguuacccaggcuggucuugaacuccuggguucaagcgaucugcccaccucagccucccaaaguacuaggauuacaggugugugccacugcaccugacccaaaaguuuuccuuaaauacaaacuaucuuauaugaccaucuauucaauaacucagccaucccacucagcacccucagcacacuuggcuguagcuggccaaaguguugccacauguccuacagacaacugccuuggacagauguuucuucuacccccauaaucccuucuggacacagcccaagucuuccuucccucauaaccggcuugauucugaccacuuuugcuuugauuuuuuuccaauuuaagauguauucuucuuggaaagaugguacaacauugauagaaaguuuuuuuuaccagcuaucauuccaucaccaagacccagugggauucaauucuggcuucacauuggaauccccugugaagcuguaaagauaccgaugcuugagucccuccacuagauucggauuuauuggucuggggugugaccugagcauggaauuuuaaaaaagaaaaaaaagaaaaaacugaggguauuuuaacgugcaggcaggacugagaaccacugcccuaaauccucucugaaauauuuaggccuuaauuuuagugccauccgacuugugguuacauauaucuugauuuuccuuagcauauguaagccuuuauccugcgugugugucuccucuccauaauggacuguaaauucuuuagagacugguacaugggauuucuuuccuacaugcaacaggagugaauagaaaggaggacagaaaggaaucaggcuguugcuuuaagcagcacaggugugucucuagaccacagaugugugggccugaugcaagaugcagagcaaacacucguaauuauguuucaucuguccccuccuucccagucucuuagugaaagugggccaccgacaagaaaucugauaagaagccgguguggagaaaggcaggggaagucaggagccagcgaauccacagaccgaguaacugaaacuugauucgaggugcuuucguagauggucucgaggguuuuaaagggaauuaucgaucaccuuguuuagcaccacuuuaggcuucgugcuucuucaucccuuuguucuuuuaaaacuuuuuuacucuccucagugucagcucuggaagagaugagacaagcauucuuuucauuugcuuggcuaggaaagugccacugcuaccugucagauguuaccaucucugacgugguccuuguugccccuggaggcugccacugagcaggacugugcagggcacuucaggcaacacaaacuaaggcucugggaaucucaugcaggccugugucucuccuucccuugugaagcuugaagucuuauuggagaaaagcagacacucgugagccacacacaaaaaaaauggcuauuuauuaauaagcucagauaaguuuccuccaaacuauaaccacaugucaaaaagauagccagccagugguuuaggccaguuggguugagauuucccugagauggaccaugccauuugccuugucaacuugaggagaaugaaaacuugccucguuuguauuagauauucuacuaagcauccugccaguugguuuggaacuuccccacauugccuaaugucugagaacuggaaggcccauggacaaaaauaaaaagauagaggauaguaaaugugagaagagcagagagaaagaaaccacauguuucagagccacugcggggacagugacacuccugacaacccuggggcuggugcugggaguauucauagguucccagaauaagaagcggccugagaucauucauuuugaagugugaccuugcacugaaucuguucccuuggcagaacucugaaggugcgguuuuucugugaaaugcugcguuagguucuggguucccaguccuuacagaguuuuaagugcagguggcaucuuccuccugccugacugcuaauuacagcucaggggacgcuuuagcaguugccaagagauggcuggcagguaccaggaauuuuucucagagacaauuuuuggaaauaacucuuaauuaaagcuuauuugaaauaaccuugagaauguauuucagaagaaccugaagcucccgacaccccggguucacauuccuugugaaucgugacuggcccucaaguccuccuggcucagcagguggugcaugcacaaccucagcugcugaggggccuccuagaagacucagugguuuugcucaaauuccuguuuaggaacagccaaaccaaagcagaggccaaauggaaccucucuuauucgcaguuaagucuucugacagaaagaagaaagaauauuuuguacuacccuuuuccaggaagauauaggaugauaacaggaacuaaaccugccgguuccuuuuugcccauuagccuuuaaagucccucaaacagcagaaggaauaaaaucccuuaaaaaugggaaacaugcccauccauuugaaauaaguaacuuuacauauuuacagcauugauguggccaaauucacuucucaguacacaagaaaccuaguagcaucacaguagacaaugccgagaaagaauagggaaaacccuauucuauuuuguggccacuucaagaauaugagacaauaaaauccagaugcauagaggacacguuccaccuaccugugcccccacgcagaggcuccucuugccuuucccgcagcacucagcugugaccuguggugggaaccaguggccuccaccaucccagcaucugucuucuccugugugggauugugugaucugugagauugccugaggauauggaaaaggaaucauggguauggcuugggaagguuccacucccccauaccccuaaucucaggcaaaacaggaagugugcacaccuugccuugccagugcugcugaauguguauggguagacucugcagucagcgugcaucccagagcccacgugcagucauuagggaagcccugcucccuagcuacaucccuagggugcagagaagcagcuggagaaacagcgcaacuccaguuagcaccacagccuccagguaacaucugggcaugcagcuucgugaggcugggcgcuccggaccagggugacagucgcugacccaacagcaucacaugugagagucccagaggaaauagaucaccacggagaaggaaggaggaggccagaaguggaaaucuguagcccgcuaggcugacucugcucuuucucccacuuacccaaagcuagcaacuugccagaggccaaauugagauauuaaaacucagguccacuuaagacccggggacacagagggaugcaccuuugcuacaauuuaaguagaugcgaacugcagcuucacuccucagagcaucucauaaagcccacgaaaguggguuuucagacauucaucccauaaauguuuaccaaacacugaauaugccaguugcagagaugggcaagacagacagcagcccuuccuucacuggaggcucaccuuccagacgggaaaggagacggcagugucugcucucaggagcugaagaguacugaggagaaaagacaacagggaaagagccuugggagugccacugagaaaauccaacacaccuggggugggggcgcacuuuaaaauagggggucagagaaggccucccugaaaaggcggcgugugagaaaugacaaggaaggaggggcaggaaagagcagguggaagggccugaggcagggacuuuccuggcacaaucaaggaacaaggagcccagccuccuuagagcugagugagccagggugggcaggaagaacaggaaggucagaguggccuuacgggcagagggcaagaccuuggcucuugcucuggugagaugggcagcacacaaagaugugaagcagcagagugcugugauaugacucuuccacgaaggucagucaggcuucaguggggagggugcacuguggggaugggggacaacuuccaugacaguuuacucgccauguauucccaucucugggcacgcaacagguaugucauaugugucuggugaaugaacagauguuaugcuuauacaauagguguucugccugaacauucccuggggggcacuagaggggcccucagcggugcccccucacuccagcaccacagaacauagccccuguccuggauugcccagacaggcagaacguggagcucagccacgugucccgcccugcccucaagacccugcagaucccuguaaguuccaguggucaugagcacgcgugugcgugaagaaucgcgcagauggccauccccacuacacagaaagugauucaagagacuuuaaacaacucagugacacagaagggcaaggaugggaggcaaggcucccuagcuuuuuuuacucuuacaaaaauggucuccaggacucucugugaacugucaccauucuuuauguacauguagagauuugcaguuuacugcacacuuuccccagaguccccccucccauggggcaagauuucucugacaguugaggaauggaggcaggcugguuuuuccaucaccagguggcuggucauguccagaccagagcucgagcacuuaggccucuccauucucagacaggacucauugcuccacccuacagccccgcugccucuccgugccugcugugggggacccacccacaggaaugaacaacccagugggggagaggagcccuucuucaguggcaauggcaaaaugucccucccugaaggcagaaaggacuguuuucuagaauguauggccuguacaauuuauacaguggcaaagaccaugccacuuuggcacggauaacugagaaauuuagcuaaaggguugccuacuuugcaauucaaaaggagcaccacagaaauaauucacauauaggaaguaucuuaauuaugggccaaaauuccuuucuggggacaagacaguuuuuaucgguaaaacuaccagacauuuccauugcuucugcaauguuuccucagacaccucacacaaauaccuagaacucacuguccucccacagucaucauggaucuaacugcuacauuuucuugagcuguugauuauuagggaaacuuuuaaaaaauaguccugaguggcacacacacucccaguguaucuugggacaaaucacacaguaaucccaccucacugccccggucacuccugaguuguuuuaagacagaucaauucaaguuagaauaagcuugggagacacccuggaagggaaaacaagucacugaaaagcagugugccagcaguggguuggcccuauuugcuuugaggguggugugagguuugggggguggcacagcaggagaggugcugguggcaucuacagaaccucacagcugcccucauuccccugcuugccugggugccccaggggauuuuucuucuaaaaucuuggagccacuucuguugugucacuuuuggaaucaugggaauaguagugccacccagaccaccuucuauuccauuuugccauuuuaaaaaccagcuuauugagaucuaauucacauacugugcaguucaaccacaugaaguauacaagucgauguuuuuggucuauucauuagguuaugcaaccauuaccacaaucaaauucuauaacauuucauccccccuuuuaaacagccugcugauaggcaaucccacuucuccccgcccacuccucaacucuaaauaaccacaaauccacuuuuugugucuauggaccugcccauucuggacauuucauauaaauaaaaucaucccauauguggucuuugguggcugacuucuuucuuuuagcauauucucaaggugccuccauguguagcccauaucgguauuccauuucuuuuuauugccaaauauucugcuguacggauagaccacauuuuauugguccauucaccaguugauggacauucgggcuguuuccacuuuuggucacugugaauauugcugcugugaauguucggguccucuguggccacucacucaugugaauucagucugguaaaguacacagacuucccauggcuaagaugcagcggaaaucuugguguuuauguuccaugagagugagagagucuggaaacauuucuuuaugauggccuaacaagaaaguugacaccaagauauuaauuuuaaauuuauaauuuaguuuaauuuagucauagagccacacacaaguacauuauagucaugggagagaaagaaaaaaaugccaggaaaauuuuuuuuaccaaugauccaccugcucacuuagccccugcacgggagcagcacguauacaggcacacgcuccaugcacuuucccuuccucccucccuuccuguccagcugucccagcuuucggcuucugaaccaagggugaugggcaagaccaacaaccagaaagaggaagccaaacccagagucagagccagggccaggacacagccacugcugcuggauuggaaauacuggaagccauccuugggccauuuggagauguuaauuaggcuggcuaauucccacuggccuuggguugccaguguugagugugugggcuuaccccauccacugccugcaccuguucccuuccucagagccauuccaaggggucugaauagcccagacagcucucugaucucccacucuguccgccuuccugcugguaggauauuuagcacuugccuaaagcuggagcccuaguccacuguuucucucccucauccaugccagcucucaaaaucauucucuuuccuaauuaucuugaaccaguuaaucauuuuccacacugacuguucaguaaccaggauccaaggacaggcagcagcguuucuuguccugacccugcccagccucaucccagguggcgguucuggauggcagccuuucuucagaggcaagaagcuugguucaaagccuugcucucuugcuaucccagugaguacagcuggagaaagcaugccauagaaaggcccaccaauuccuggaacgccucugcuaggcggagccgcacauaacacaacacaucuccagccagccucuuguuuccugugcugcuuuaaaucccuguugauauccagaguaucggagaagucacacaagguggaagaagcaagacaucuuucuucaaaagugacuucuggauucccccggcucaacucugugucugagccgccaguuggccacaguuuggccuuuuggugucugaguuaaacugcuaagggcuguccccgaggagucucacucaacuacucuuagauaugaguagggcuggcuucgauucccagcaccacaaauagguaaaaaugacuucaaauuuaagacacuguaacccuauaaccuagugucacaacuuuuuuuuuuuuuuuuuuugagacggaguuucgcucuauugcccaggauguagugcaauggcaugaucccagcucacugaaaccaccuccccaguucaagcgauucuccugccucagccucccaaguagcugggauuacaggugcccaccaccacacccagcugauuuuuugguauuuuuaguagagacaggauuucaucauguuagccaggcuggucucaaacuccugaccuuaggugauccacccgccuuggccucccaaagugcugggauuacaggcgugagccaccgugcccggcugucacaaccuuuuauccauuaucaccccaccguggagccuucugagacauuuugguuuccuaauuuguccccuccccugaaacaccacagaaacacuguguaucuguuuacuuacaguacuuagaccugugcuguaugcauauaaagaguaggcuauuuugccaccccaaggggugauauccccucauuagacugcaugcuguaacuuuucucccagauccccuggaggcagcgguuucaucugcuuuggucaccacuguaacccagagccuaaaacaguaccuggcacauaucugcugcucauuugacaaagggauaggacaguuaggcuuugugucucuccccuaucgcccccagacgucaggucccuccuggccucuucccaccccccaucuccgagcacauugcccuccaggugcccuccacacugcccagguuggucagugcccugugcguaccccagagauguaucaggaagcugacagcuuacuccucugcuccacgacuggaaccccacccuuugggagcaccgccgugugucaagggcaagugacauuugagccccauggaauaaucaaggcagcccccaacugucucugucuuugcaucuccuuaacucaaccauggauuggcaguuacugagacauucuuugugguccagcacaccacaccaggcugcgucuggggaugcacaggagaggggcaacccaguccucaucagcaauuacaaacaaguccuccauuguuagcugcgccaucugcuuucuugguuucuaccaaucgggugccuguacgcacagcauaaccagggcugaggggcugcagaggagugagaucaaggagcgccuucauaaagagacccuuugcucacacuggagggugucaguggcauggugcucuaaaagccgaacuuccucaacucaaggaagacccacgcagauaugcucuauguuugcccucuuccaugagaggaaaugggggcccuucagcacagcacauuggggggaaaucagaaaucuaaaugauuaaucaucccgaggauccauggaaaacauucuagcccaugaccaacagucagcagcagcccagaaccucuugugcccaaagagcacaaccagguguggagaaggaacgguguuaacggugguuggaaaucaaaccaaggaucauacacgacccacgaucaguuacugauccagaaucuccuaaccccaaauaauuuucuugggagaaagggacaauuuucaucaauagauuggaaaagaugucuccauagcagugcacguuucuuucauggagccuuggcuaaaagaauguuaguggucaccuccugauggcugcuggagccaccaucuuagaaguuugccccugucacugugccaaccuuggcaaccuuggcagagggggucagcagaaaauccacguuuacaacugugacugugcagacaaugguccacgucacugauaaauguccuuuguccagaucugauggucgucuacugacacagaauucaggagaguugugggggcugagaguucaggagaagcuacugccugacgcagaaagaggaugcauuugccaaggaaaccccgccguaggaaauaggauggcguggaagggguggaagaaccugucacaaggcauagaaaagcuaaaaucccccucaguucugugugacuacugagacccugcugcucugugggugagagugaccuuaugguccaauuucaccacuccagggaacccucccaagcuuuccucugcacaggaugcuguguguucccucccuggggacugucauauugcaggugacaccaguauuaacacacuguguauaacucagaaaccuguaaaaugaaacuuggagacauguaaacuugcccaccuaggggguuucaauuauuuuuucaggucauccauugaauuucaaaugcuugucuugaaaacacuuuuaucuuuguauuuuaaacaaaaucagucaggaaaaguuggagagcagggaaaggauauagcugucagugcuguucagcaucuguagggcuccugacaaggucugcaugcauagauccugacaaggucugcaugcguagauccugggaguucuaaugucucucucauuucacauuuguaaacacgacaucggcuuguauuuuguccuaucaaguagaauuuucaagugaauguucaguuuuuacugauugacaaggcugcagaaaugcuugggcagcucagggauaaauguauuauuagcacuguguuaguuaucaaguuggagcuguggggguguuguguuuguauucauuccauuuuguguucuuucccuucagauuaaaacacguaaaggucucauuucaauauuugagcaagguaagacagacacuucaguggauuuguccagccacccugcuuuggggagggggugggacuuuucuaaucggcugcccucgguagcggacccugcaucagugcuccucgcccuccugggccuuccccuccccgggggcccugcccacacuccugccccugcaugucugcgcugcccggggaagcccagccuugccuuucuucugcccgugcacucggggaggaauccgacaccaacaccugccaucccggaaaaugucuuugucgccugcccuuuuguguguggggcugcagggagccagcgggcgcuggggccgcccccuuuuuuguugcccaggccugaaggagcagggucuugagaugggccgauaagacacggcacgugcugggccggccuuugaccgccagccuuaauggaggccucugagaccuccaugcggggagggcagguuguggcgggggcugcugaauggaacagcuggggaaggaaaagcggacaaaagcugcgggagcgcagaggguggagaccuaggaaugggcugcggucuaggacccagaggauaggcuggccauggcaggugugaccuccccagccugccuuucuguccugggucugggguccaggcccugcccagagcgcucugauggauggcagccgccuuggcaaggcugucugaaaacccugucccguguggccugggcugcaccaccucccaggcucacaggcggaaggcgagcaguugguaaugacaaggaucacggcaaugccauucacaggagaaagcaagugagcgagcugccguuccugagccugucgcccacaguggaaugcaaggcacagacaccagucacuuugucucaguaaauauggaagugggauguuaggguccagauuuguugguuuauccaaaccuucacccuccucugcuaggcagggcuguuggaccugcaggccagaggagcagccagcaucacagccagccgacccuccagccagcugcccuuucucuuccccucacccaaggcuuaagcccaguccugauauugucccaaacugggcucacucgugucagccccaacaggugacacgagccucagagcccaggugcucaugucaagauggggcagagaaggguuguacaguccccucccagcagggcaccuugcugcaaaacuucgcauuugccgagacccccgucuccaugcauguccuccugcuccugccgccaaaguggggaggugagguucgaguguccugugaauaaauccuuggcuuccaucaccgggaggaggcagugcgaguggagcaaagcugcgaguggacgugucauaucaggaaggcggccguaccuugugucccgccuaccuguccugcagcugccaccuccccaccacggggugcuguggcacgagggcccagugcagaugagaaugucccagcagaaagcuggggaccagaggccuguguagggcacuguggcacuggcugcagcccagcugcagggguggcuuugcccuuugccccuggccaugggaucccugcuuucaggugcacaggcccccuucucugcagagcuuccugcuguucuccaggcucacucagcgggacaaagcuggcauuccucuguccaucugcaggaacucgaggugcaccccucuuucccucuuuauccucccugggugaguggguggggcagaggaacuaaaauguuuuccuucgaauccagaauuagcaaagguucgcucuuucucuuuggaucucacuuuauaucuuucauuuacuugccuuuuuuuuuuuuuuuuuuuuugcuuauuuauuagaaucaaucugauuaccauagugggcugggcuguuggaauauugucugggauuaaaucaagucuguucucccaugcugccccacacccuggauuaaaugccagugcccaccaccagcugcgaggggauggagagaugccuuguaacaaucuagcuucucuuguggaugauggucuagcugugcugccuuugucagaagcagccuguuuuuguguucugagguuuuucaugugugguguuuuuuuuuugagacugggucucacuuugucaccuaagcuggagugcagugaagccaucacugcagccuugaccucccaggcucaaaauccucucaccucagccucccaaguagcugggacuacaggugcgcaccaccaugccuggauaaguuuugcaauguuuuuguagagacgggguuucacuguguuucccaggcuggucuggaacuccugggcugaagcgauccgcccaccgcgcccggcugcagccuguuuuaaagaugagaauagugagccuucucuguaugcccgaccugacugagccuagaagaagggaggcaaccaugaagccccuggacucugaaaguacugaauuucaggacacccugagccaggcugccuccauagguccaagcacguuugcaaguauugauuuuggaaacuccuccuagaaacaauaagggaaggucagagaaugaaaaaagaugcgucugugaauaaaauaacugacuuaaauuaauuucaaaugccaauaauaauaauaauuucaaaggccaaagcccugcaagugaaucacgcagggaggaagauguggaaacucugcuucugagguugguucccagcagaggucaugcaggaaacuuggggcauaauacaacaggguuuaaaaauacacuacgaggggaagggugaugaaaugauccucucgcucgcagaacggugcuaggggagacccagcuccacccgcaacaguggcuugguguugcagcaggcauucuuguauuccucugagcacaccgacagcagcccuggggaagcggggggugcagaugugcagguuuuaauuuuauuccuuuucccuccagugaugaacagcuguaugcucaucuggacucauucagacaagcaauuuaggacugaccucuagucuuagacccuuuggggaauaaucgaguuguaacucauuguguagaauaucgauauguaaacacguggagauuccaggaacaccgccagggaucugcagagcggccucugaaguuucacgggcuuuuccauugacuccagccacugcuucuucaguggcucuuccucccuuucacugugaccagaugccuuuucucuucauucuuuacuuaugaauuggacaguaagucugaauuaauuucacaagauucauagcuucuuuuaugcugcagaaaagcccagggcaaagaauaagaagaaagacauucauguguuuauucauucaacaaacaucuuugccggcauagcgugggaggaggucaccagacccuucuccugggaguuucccucccuucugagugccacagauccucccugaaauguguggccguagagccgccguugccuccaugacuuagcaguucucugcuuccuuugcaggggcccuggccuccagucugagugcugaccucgaagagccccugagugaggaggagacagaacacccucuccugccucugccccgagccacuaaacccagaaucuccaggaaauuucguugcuguacuagugcccucagcaggucuucccauuaguggacuucugaagcccauggugaaucccacuaccgugucucagaugggacucaaacuaggcuguaucaucuuguccugaaaccucacaaaccuuggacuuccaaagaagaaaagaaaaagucaccaaaaaccagagaugaacccacugacacgugggcacugguguggcugcucugggcagaugacagcaggaaaagauucugcgcuuucagggagggggcagagggcagcuugcuucugcaccccaaguuguuucuucucauuuaugaacccaagcaugauucacaaaggggcuggcaaaacaauugucuaauugaggaaucugaucugcauugauuuugcuaguuccuuuuauguuaggauuuaugguuuacucaaaaauuucaucaucauggaaauuggcuuuccccggggucuuuugcccaggagaaguuuuaccucaguuguccaguguuuucccacaugguaccugacgcccgcuaacuaagcagaggcucuccucaccacgcagaggcgcuucaggucaugacagugaugccccuaucuuagaacacucagaagauuccagaaauacaggguccuguccuugcauaaguuccugcaggacaggaagugucccaaggcucaaaacaacacagaccacauccacacaaaaggcgcaugccggcuucaggcgcuaggcugagacggguaccccccgaauggccuugugccuccaaaagccucacgcugcaacuuugcugcuccugucuguugcccagagaggccucacacaggccucagaaauguuucuugucacacaaagcuuuugguagccgauuccaagcgagggauuuaauccuuacauuuuugcccauuuggcuccaaggaaggcuuauuagaccuguuuuuuuguuguuguuguuuuuuuuucuuaaaaacaaaaugaaugaaugaaugaaaagagaagcaauggugagcccucuccugcuggggcgcccugggugggccuugcccguccugcagcagagaaaucagucagcagcgaagagcugcuggcgcaggccccaggcuguguccuggacccuugaccugccucagagcuagagguuugcuccaccccgcacuucacuugggaaguaaauccaagaagcuuaccagaguccaucgccacugcgcaggcuuuguucucacagcggccagguacagagcaacgcccugcagugggaagggacagcagcacgagagacgcagccccuaacucagggcuuaugaugggugggcugguccugggaaaggcgggcccugugcgggaggccuccccaccuuccugugcccucugcccucugcccuugcacacacuuguuaccuucaggcugcuuggccacccaggccugaagaagccuucugaggcucucaccccaucagaacggccauuuucacugaggagccaguuuuuuccauuugccauggagcugguuuggcuggaaccuggccuuuguagggaaaacggggagacucaggagccagacucacucuugggacaaaugagaaagagcugagccagucguuccugucggaagggcgggccugcucauccuggcgagaauuugcuuuucugcuuuauaggggauugcaggccaggcccacugacaggagcaccuugagaaccaccugaacagaagagaaugagggugccccaaaguggaaggaagcuucuggccccugggccguuuugggaagggcccaggauacucacgggggcugaagggcaaugugaagagugacugcaaguccuggcauuuucuguggugucagcaaaugccccuuuauuuuaaaugauuccagacaucugggcagcauagcuuggccaccaucacucaggcuugauccugcuguugagcugcuccugucuccuguuuaccucacuccuguugggaaggccaucgcaugcuccuaggcuccagaguccccuguaggucucuaccagcaggucgccucugggagaacguuucaucuucaggcucuagaaacuccuguugcggaauugcuggcuuuaguagaaaagauaugucaggauuuagaaaucguauugaacucuccuggacuucugcuccaugauuucauuuugcuuucacgaaccagcgaucccuaccuuggggugggaaauucaauuguaggcagcaaauaacucaacccuccuguaaccccugaggauuauaacgaccccaugacccccgaugacagccagcaguuuggugacuagaguuuuuugagccugccauucucaguagcagcuuuggucuggagauggaacguggagcagggaaucugacagccacguuucucgugaucacguggacuggaguuguuuuuguuaucugggguggaaaauugcaaugaucaaguuucuuuuuuauuuuuuuuuuacuuagaaaagcaaauauuguguuuuuguaauaaaucccuuucagcaaaauugcggaggaucauucauccacuagggccccaccugaggcacagcgcugacucaucacggugguaccaguaggucagccaucuggaaacagaaguggcccuaauugggccaaaaugugguaagacucgcuggccucaggcagggccaggccaguucccucacuucucugcacaccuauucccagauuccauccagagcaaagcugauguuuaucgucucauuguacuuaggcuuucguacuuuaaaaaauuaugacuuuuuaaaaauaagccuucagcagacagaagugaagaaauuuagccuggguugccucagcaacaaagucugcgguuccuaagagccacauguuggggaaguggggugacccaaacuuggugacauagguugauugaucagacccucagccuuacaagcaagagcucaugcagauccacagagccaugcacauccugucuuccugaccuuccucagguggcaccaccugcgccccauggaccugcuguaucggugucauguggaggucugaugaauccuuuaaaaccuaacugugaugucguaaauguaacugugcuaccuuuauaucuacugaagggcagcgucugcauccgagggaaauucaacaugaaacaaccaucguuuuaguugcacucagucuguccauaugacauacacaugaagugaauguuuccuuauguuuucaggucuacaauguuuaguacauguaaauaaggaaaaaauuugauaaauaugguaaauuaaguuauagcgugucauuugauucuuauuuugcugucucuuguuauuuaauuuuccuaaugcuccacaucuagguuccuuccuagguggugggaacaccuugcagacgugugugcaccaggacacaccgcggcccaggcagccacaccgagaaagcacacaucuccacugauggcagccacccgacucuccaguuaaccucuuuuacucuuuaauucugauuuacugugaugauuuaauaaaguggaaacacagcacuucagugcuauauguuucucucauucucauuauaguuuauaagaaaauaaaguucacccuggcaucuaauaaaaag
